United States Patent 7,868,149 (PLANT GENOME SEQUENCE AND USES THEREOF) - sequence listing, part 95

SEQ ID NO: 49813 - DNA, 49857 bp, Oryza sativa
  unsure (1)..(49857): unsure at all n locations
ttacttatttgaatatatgatattcactcgattaaaaaatagactattgtataatatcagaaaatataatcatcaccaccactggtgtcttttataatagtatagataccaactaatcatgcatcaattctcatcataattttaattgtctaagtataattgaaatagcattgcaacaaatccgtgcatgtcctaaaacttacttgaccatctagatttcaggtgattaaaagtttaagaaattttagtcgcttttgattgtttctttttccttatatataacaagttgaacaacatatttaaacatataaaaggtacaaaattatatgaaataaatttacaattaaaaaactcatacctgaataaaaataaagtaaagcaatgctactatatataacaacaaaattacaattaaagagaaataaaactacacatggcatactactgcaattttgtacaatctagtttttgtctattttttataattaaatatacatattaaggtttaaccttgtttttttttaaaaaaaatgagacgcctttctttatgtaaagtacgttggcaacaaaccaacttggttaaaaaaaactttgcttcacatcctcatttgcggtttgctttgtaatcataattttgtcagtccttttacataccgaccttgacaaatgtgtaggtatttgaacacacatcttgggaaaaaggattgcaattgtaggatagaagcacgggcaaaccattacgcaactgaatgcccgatgaaaattatgaatgtgctagaagccacttaaattttactcagttagcgcttttaggcttggatttcccgtttaaattttacacctcttggttagttggcttcaccactcatgcgtgcgtacttcttcacaaatggggctacagtcggtgccaatgatacaacatgctcacagatccttcagtttgtgtaggcgtacacttcacagatttggcaccggggctccacattgcctcttttggcccaacgacaaggcctcccccctctcccccacctccatcttcgccattggctagcgaatagcagtgcaaccctagctcgcgcctcgcggctcgcgcgggtggactcatgaactcggcctacgctttacactgggctagaaaacaaacgatacggcaggggatgcccccgccgcggcctaccagctaagcaggcgagccccctcacacacgtagaatccacatatggtgacatgggatccacgtggcggccccccacgtgccctatcgctgggcccactcctcgcagctataagtaccccgtcctctcccactccgcctccacccacctctcaaactctcggagaagcgagcacacacactcactccctgtctcctcctcctcctcctcccttgaggctgttcgtctcgacgagtgcttggctttgtgtttgtggtgtgtgatcatgacgaaccaggacgtggtggtttctgagatgggcatcgcggcaggcgcggcgctgccgggaggaccggccggcccggcgggcggcctcttcgcgtgccgcagcgcggccgcgtcgatgaggcagacgtacctcgacctcgccgcggcggcggtggcggcgcgctccgcgagctgcaccagctgggccgacgccatgcgcgcctcctcccccacccgctcgtcccgctccgcctccgacgtcgacgagttcaccgcctgggtggtgagtgttgtagctagctagctagctctccccttagcttgcttgtcctctccttctcgcggcgtttctcgcgctcggtgcccagcccccggctattgcctttctggagtggtgtctcaacctttctctgtgtttcttggtggttcgaacagaggaagcacccgtcggcgcttagcaagttcgaggagatcgccgccaagtccagggggaagaagatcgtaatgttcatggactacgacggcacgctctctcccatcgtcgccgaccccgacacggcctacatgagcgacgcggtgagccaccaatccatgcatcgtgccgcgatctgttccggccacctctcccatctcttctcttttgctgatgacgctctctttccatggcggtgcgcgcgcgtgcgcagatgagggcggcggtgcgcgaagtcgccaagaccttcccgacggcgatcgtcagcgggcggtgccgcgacaaggtacattgccggagccactcctctcgccgtcccagacaccgtgacactctcgcgcgtgtattctgattcctctttgcccttcaggttcgcaacttcgtcggcctctccgacctctactacgccggcagccatggcatggacatcaagggaccaagctccaacgtatgctcgctgcacctcttcatccaatcatctcctcattcccagctcactctcgctaattaatcttcttcttctcccatgacaatctgcagccggagtctgccctttgccagccagcaagcgagttcctccccatgatcgacgaggtactaacctgcctcgctaatgaggattaattagtagctggacacttgtcgatttgtgattaacccgcactgattactcgagacccatagatattaatggtgatgaaatattcacattttgtcaggtgtacaagacgctggtggaaaagacgaaatctacacctggagccaaggtggagaacaacaagttctgcctgtccgtccacttcagatgtgtagatgaaaaggtaggcaggactcactctatcttgggataccaacacaacagcttcacttaattacactgctttataataacgggcagctgcatcatgtgcggccataatttatccacacccatcgtctcaagtctgaaccattactgctctcttgcagagatggaatgctttgggggagcaggtcaaggccgtgatcaaggaatacccaaagttgaagcttacccaaggaaggaaggtaggcatgcataatcttgttaatctctaatgaacttaccaagtaattacccagaaaatcaaatcagttagagatacctagtgaggatctattttaacgaagattgcaactttgtttttgtcttttttttaggttttggagatcaggccgagcattgagtgggacaagggcaaggctctggagttcttgcttgaatcgctgggtatgtacgaacatctggacattttgtcttttctccaccttctatgagactatgactcttgctatctttttaattaacctgttcgtgtcagcgtcgtcacagtcgctttcgtttcggttttatttcacttgcgttccacaccactgtcgtaaaaaaaatcggctgatgacactttgcccctattcgctgttcctccccaggattcgccaactgcggcgacgtcatgccggtgtacatcggtgacgaccgcaccgacgaggacgccttcaaggtaaacatcacatcagtttaacaagaacacaacataaatgcatgcatctaatcatcactttaccgattaattcatgcttgcctcggtgattccgactggtgtttgttttacacacatgcaattaacttggtcaaaaccttttgcctcgctatgttgaaaccaggtgttgagaaagagaggtcagggcctgggaatcctagtctccaagtgccccaaggacaccaacgcctcctactctctccaggacccaacagaggtaaacccagctcagacaagaacatgtccaaatattttacctttttgtacgtatacacacgagcacagcacgtacagaatatataaaacgtttttgacccgtttctgcaggtgatggagttcttgctcaggctggtggagtggaagcggaagtcgtcgtcgtcgtcgttgatgattcgtccgagagtgtagcggcgacacggtgtagaggccgtaagaaactgaaactaagatggtcaatcatgcgaacatgcgaacataccccaccaacaccacgtactacccccatttttttccgatgatttctgtggttggcctctgcgacggactcgtggtggttacacgctagctgttcgattccgtcccctgtgccgccgaggaaaaggagaccaccaaaaaagaagaaaaaaaaactctcgcttaattagctctcgatcagattccggcatgtttgggcgcgcagcggccggcgccaaagcaagcatggctccaggcatgttggtcactggtggtgttgcagctgcagtctagaacagtaaccatgtctactacccggcaatgtgctactactattactagtagtctactgctgctactgctactacgactacgactactacccttgttattattatttttttggtcccatggacttggaaggcatatgcaaagaaacctgccatcctagacccttaacaaaaagagaaggttctatctccatcgatctgttcatcaccccatgtaaaatgtactactactagctagctagagcaagacttaattcatccgtttgtcgacagttcgtcctcgatctccctctgtaaaatgtaatggagttaattaattaatagcaatggattatttcgcatgtcgtagtacctctccatcgatctgggatgctaactttctttgctctttcgatgatctcatgacgacgaagatatactgtgatgtgagcatgcatgagcaccgggaaacaaaaggaggccaggtggctagctaacaccgtacacatacaacacctcgcgggaagcatgtgaacggcttgctgcaggatctccctgcatgatcacctgcagggttcttgcgtgcagtgacaaactagctagctagctccaacaagatcgcagggcattgtttacaggattaaccaggtcgctctgattcctgtcgagcagccgtgattaacgggtacatctcgcgtgtacgaacgtgtgatatatattaaacgggggagggttctgaattgcttttcagcctgtgctgtactatggaaacagcttattaagacggagacgtgtgtatcagagatctacacatgtacacctatattactaacccaatagctcgatcatgttgatgattccttgatcagagacacacgataggctggctcttccaaccatgcatgctgtggtcctgcctcgctgctcgtcaatgtgtgcaatatgcaatgtattctatatgtgctgcatctttgaatattggtgtaagttcttgatatgatcagatttgccggtaaaaagtagagcggaattaagcacaacctaattaacaatctctgtgccttgtggccttaattaggccgcaactccctcttaagacgactcattaatataagtatagccaattgttaatcatcggtagatgtatagtaccactactatatatacatgcattaagtgagtgaagcctctcccccctgccagatgattcctcacaatgattcgatgcatattctcatgtgattgcatggccatagtacagttctagagcactagctcatgttcttctgctggaaaagccagtgctacttaaaatgttcatctttatcagaaatcattcatatgtggaagcaagcctctgccaagattgagctagctagctgactgtttgggaccaccaaagttgcaattatctttgatgtgtccttccagtgaccaattgatcatcctaccacttttttcccagacgcaaagcaggtttcctaagacatgaaaatgagtaactgctgctggaaatgaaagcattgccgatccaatcacgcacacaataatgcgcccttgtgtgtgctggatttagtaggtccttgcccctgtttgtcctgcatgcccagtatataccaatgtgcactgtactgcagacaccatagcacaggaactcgcaagctagctaggccattggtggttacatattctgatgcaatttatgattgggattcagtggtacatctgatactagaaaacatccgccaaccgaaacaactttaatttgaatactgctaacctagcttatcaatcgccatcaagctgcgagccccgcatttcactgctccaaccaaccagaagcacccatgcacacacatcctcctcacagctgcagcgatccatcgtcctctgatctgcagtcgtctctcagatggccacgcaaggtagggttttgttggaccccttggtcctatgaaaggtggcatgtatgcgatgcgttttacgggctcagagtggcctcatcattcgtactttatgcctttttggcaccagcaaccaaacccctcttcttggggctcaactcatcatccaagtgttatttgctgcaatcaagagccgataaaatgcatgcgtatctctgcagcaaacgacggcgcgtgagttgatgaagctgttgcgttgcaacatccgtcgatgtggatatatatatacccaggtggtgattttgtgccataccatagggtctttatcattgttactgctgcagtgtcaccatcttaactgctcctatatattatctctctctcggctggtagcgatcgaaactttcagtacgtgttatatgtcttctgtcccttgctgtagaagcaaaagattgcagttttgctagctggcagtctatactaggagtcctaaaaatgtagtaattaacagaagaaaattaacaagcagctggtctcggaatcctttcttgcgtggatagatatatgatatgatccaaacaggcatactacactcgatcactagctaattatccctgcattgtttcctataagttttagctacactaacccaagccaacatggaattattaattaaagccggcgcggctttgagcgcgcgcgcgcgcgcacaagcgtacagtcactgatcgtggtactgattatagaattggcccctaatctggcattgagatccccaaattaaccaagccagcgattaaagaagaggttaaaaaggatcagggcaataaaataggcgatgcaaccattatagggtgcagcgaaataatgcttgtttatacagatccaagctgctttgcgtggatattttacgccaaaggcctcgtagaaagctggctgcccttgaatcaagtgacaatggcgagccagacccccacaagccccacatggctcccaggtggagagatctatccggtatccactattcacctaaacaatctagaactcttcacaagatgcatatataatttttacatgcctcaatgtggcacactcctgttacatgtactagtgctactattattgagtttgttactggtagaagattatattagcatggagtgcttcacatttccagaggtttatcactagttctgttagcgaataaaaaggtcagaaggatcagacacacagcaggtgaagtgagtgagagagaaaggggcattttttgtttgagagatactgctgctgctaatgctttttttaggtagatcaaaaggaaaggggtgactggtgatcgaggcacaaattatgtgtaaaggaatctgatggttgagaagggagttggaatccactaaagccatggtgctttttattctgcagcaccacctgcagtgcagtgcaggggtattgaggtattggtacacaggcaagtgtccagaaaaggctttgacatttgacaagtgcccccctttcctatgtggaaaggtgttgagtccactgtgttttagctcatgattggtgcctaagccaccgtataaaataactaaccctagatgaccctcattattggtgcctggtggtggttgggttgggtaagtaattgggttttgatcagttgagcttgggtctctgtctccgatcgagtcacatcctgagagaggagccactcctgctagtgccgccttcaacacgagcccatgcaaagtgcgaccaaacaatgcagggcagccagccagcacaactcccgagaatctaatgcctgcccaatcatggacctaatctagctagccaggtgttaggagaggaacaactgtcaaaatgcccttcatgcctgcatctgcatgccaattccagatcttttatctgcccatacccatgcgcatgggccttctgcatgcatatgccctctgagtttactactactactagcttgctccaaaagcattgccccaggactaaagatggtcgatcgatcgatcacacaaactcatccctactgtatcttattcctgcctgatccgtaggcagcctgtagcagctagcgtcgcatagatcaaatcttccatgtacaaattatatatgtactctatctagctagctatactaccctgcaggacggtggaaagtggaattatagttaccaattcgtgcagctagcgattgggatttgacgtgttgacgagaactgttcggctttggcgtgccggccagctttagcgaccagtagacccggggggcctcgtcccgccggcgtcagatgtgtcgcgcgctcgtcgctcgatctcctcctgtggctgcgggctcgcccacggggcgccctaggcgggggctttttccgcggaaaagaggcgcgtatgcttccatccgtgatccgtccatcaggtcacactaggctatccccatcgcgaccgcgaccccggccgcgcggcatgggggccatatacgcgtgtcgccgcctcggccgtgccggctgcgggtggacacgcgcgcgcggagacgacggacgacgagctaggcattacggcttgcgcgcgagggccgcggtcttgcagggaggggcgcgcgccgcacgaggccgcggtttcggtgtaggagttggcggtgtttgttttgtttactgacccggggcggtcactacaggtggcggcggcatgcgcgcgcgcgtgcacgcacggccgatcaatctgcctcgcaggcacgcatcgtaccgggccagcgcgcgtgagatcgatgggcgtgtgtgaccgtacccgtgcgggggtttgtttatgcgtgggcggataagtttagcgtagcatctcaggggggatcgatcgatcaacgtgcatgcgcgtgcgtgtacgtgttggttttcaatacgtggagtgctatgtgcttccaaaagtttagccatctgtatattaacttatacagtaccgtacttgattctaagggtgacttaaagaggcatgtactacatactccctcctttcttaaatgttggacgtcgttgacttttttaaacatatttgaccattcgtcttattaaaaaaatttaaaaaaatgtgtaaaactatatgtatacataaaagtatatttaacaataaatcaaatgatagaaaaagaattaataattacttaaatttttcaaataagatgaacggtcaaacatttttaaaaaagtcaacggtgtcaaacattttgggatggagggagtatgtaatagtaatatgcgttttactacctcaaaatgcatgcaaggatatgcttggatgggtaatgttatctattataagatccaagcgcgcgaatgagtcgtgtactacgctatatgtttacacccgagtcctaattaaactagctatcgtatcgtgccatccctagttgttggcgtcctatttgtcaggaaatatgaatcggatctcgtgtacagtcgtgtccaccttttcccattaatgaagatcatgtgtggtggttcaagtagtattgtttttgcacgcacgtagttacacgtagcgattgtctgaccatgccgaatgtatggtaacattgtaacatgttcgttaattatcatattaaggcctggccttcattggttgactagccagcaataggaacaaatggatgtactaaagtgctataatgtaacgcagttgtactagtcctcaagcatacaactgcagatcaaggaaatgacaacactagtaattaactagcttaacactgacgtttcttttatttcttaaaacttgtgataagacatgaagagcatgaagtacttgatgtcaaactcaaatttattctctctatataattaattattaaactgccaaaatgtccaatcgagtagcaaccaattaggatttcatcgatctggagtatccagctgactgcacacgctgcgaaataaatatgcataagtctcatcttcttatgtttcttttttcataaaaaaaatgctacttctagttaagttctgattggcactcacgaccagctagctcaaactaaactaatgaagcttaatttgattgattaaacaaagatcgatcgaacattgcctccttccggagttgttaaaccgtcgcttcagttgagagtcccactttcagtctttcagagtgacggttgttgcatcttcacttcacatacattattccttcgcatgtccttttaatttctggtcctggagcatcgacgatgaatgtgacagaagaaaacagaatatatatcataagatactgtacttatatgtatagtactatactgcacacataaagaaactgagaagtgaaaaaatgcagtgtaatgggccaatgactgcgatatgatcgataatgacgccactaaagaataagatcgccgagaacatcatcgtgttgctgactgtacttgacatcaactcttgtccttctcggcgcctcggcggcgagtcaactgtccgacctggcgccgcctgtgaaatatctccgtcgtccaaccatcagtgacccggtcgtgaaagttttttgcaggcccactgcccaaccgaatcactatagagaaaagtgtgtagtactactaataattaccagttgttttatcaaaaaaaaaaaccagttgctggtatgtggaattttattagtacggcttaactagtgtaatagtcaccgtcaagattgtcaggttggcgtgcagccacacgcacatgcatcaattgtggcacgtgtgggttttacaggcaagcagtaaggtgaagaacgtggttggacatggaatgacttaatcatttttttaggagcgttttttctttaaaaaaaggttagagcatattaatattgtagctgttggataaggcatgtttggttgagtattatggatgtacagtcttttagagaaaaatgactgttttggtttgatgccaaaacttaccctaccaaataattggcaatttaaatagtactttgtagatgtttggattgattccaatatttgcaatagctaatacaactcatatagtccaactctaccaaaatattggtagtgccaaaatatacctaagatttggtactgtcaatggtttggtagtggtagggcatcaaactaaatgagtccaaaaaatattttgggatggattagcagcccagccaattgcaaagaatttggcccatatgtgatattcagctttgggtctaaattgtagtagcagtatttggcccatatgtggttttgcagctttgggagtttgggcccaaattgttgctcaggtccactaggccactagcaaaacccaacgaacgaacggcatgcggctcgagacgaacacggagatgagtttgtcgcttctgcaaggctactcctccgccgaggaagacgacccagccgccgccggcgccggcgctggcgagctgagcgactccggcgactcctccgctgaggacgccggatcagacggcgaggaggcttccgctgctccgaggccagccgcgaagccccgcccccgcccaaaccctagccgcggggatgctggcggcggcggcggggacggctcattgctgccctcagcactggatgccttcgcggagatatcgggcccgccggagttcctgaacaatagagtcgccgagcccgaggaggccgtggaggcgctcggagtgctcgaccgccgcggcaagggcgggaggggaagtgacagcaagcagccgcctcctggtgagccttctcagctaattgaagcgagtattgatgttctctcagaagtttattaatgagtagtgttttttagactcgatttgacatctgcagtactagaatgagccctctatttcgtcccttttggcaaagcaattatcaacgtaggttcaaatctgacattctcggaaatcagaatagtagattacactttgtggattgaatgatactatcacctatacttggtgtggtgatcttcctttgatgtatagatattttgattacagtgtgtctgtgttggataaaagttctactagagtcaatcgcttcaattctagaaagaattgcaatgtgctggttgagattttggtccaaaaatgggtaatatgcagtggtgttggagggccttggcccttgggttgttcatactgctcagtgctttgattgatgtgtgcctagtctttcgtgttagatgtctatacagatactagggaatgcgctcgcatggaatcaagatcttggcacaattgggatgcctgccaagttccaattgagggggtgcagcgcaaaagaagggaacattttttagccaggctttctttgacatggtagctccaattggcacccctgatacatgtaggacagttagaaattggatcttacattcgcatagcaaaataaggggataaattcattcatgttatgcgttcaatggttgattttttttccaaaagtaccgtacttcacgttttgcatgaaagtactgtcaaagtgcagcatgtccaaaaaaaaagttcccatcactgatgactgtttatagaatgggctctgttcttacaactgctttgaatcggattggcagtttatattttgcaaattattgatatgcttgggcacaaggtacatggtaaatcggatctgatcactgtatgcgcttctatgtgcttagtattagcgtgtcaagtttctgcgatagcacttatactgtttccagttcatgttacatctaagagtgatctgactgaaagccttctccaggtgccgttgtggtcgcaaaacctcaattggttgcaattcgtgaacgagttagcagtggaacaaatggtgccaaccctccagtttctactgaaggaaagagaataataggtgcggcaaatcctggtccagaagatgctgctgatcttctaaggttggtcatttttatcaatactacaacaagataacttgaaaacttagctgaattcgttatattcctggttaattatttactgctcttaaaactgtgtttcttttcaatctgtagaatgtgcctccaatgtggtataccaaagacctattcacacgcacgaggtatggtgtgtcctgtttgcaacgatagaccagagcaggcaagagagccagaaaagaagaaaggatcgaccgtcaaagacaaggagaagatcaaaaggatgagggggcaatcatcacacgcttcgtggaagagtgaaactgagatggccctgcggcaacaatttgactgattactaactagtgccacctcctatacttggtgtcatgtgttatgtacactgcgaatacttatgtaatcctatcttcatcaaaatcccgtagaactgcctccaagagtcatagtcggttcccgattgtgtttgctgtattttcagttttccaccatgaatatggatttgctcgataagctgagaaatggttccttgcaaaattccgtcgaagccaaagtttgagccaattgtatgatcatttactccctctatcccaatatgtagcaagttttaagcttgtgcacaagtattaagtaaagtagaaaaaagaccatactaccctcaatgattattcctgtactaaaactcagtggtggcggtttgtttgctgccatcaaactcacacgtgcatttcaaacgcattggcgccagaaagctggtaaaacacagtaaaaatccactcacacgcaaatcaaattttaaactggtagacggcaaaagcacatacggcaatataaactagtactccattattttcttctctttcactgataactatgctgaggggtagaattggtagatttattttcttctctttcactgataactatgctgaggggtagaattggtagatttgtggtaagagttgtactaggttgtaacatttgggacaaattttgaatgccaaaacttattatatattgggacagagggtgtatttttcctcttgcaaattgttcctcagacaagactggaagtggcaatcctaatgttgggtcaggactcatgagtgcctgatgctgtaggactgatgcggcatcagaattcttcgacgcaaggaatgaaatgggttggttgggacttgggacttgtatttcgtctccaaggctcgtccatcgtactgtacggacagttttaaattttactatctataagcagggatagtcatgtggtgtaacatggccaacgtgcaatcggtccaaggagatagacgcgaccgtaccaagcagtaagcagatccctccgtctaccattattattcgtcctctactttctcggatccctccgtttcgtgcctggttgccagtaacgttatccggctcatccaacctgtttttcactgccatcctggagcctctactggttcattttgcagttttgctgtgaaaccaaaaacagcgttaatagtgaaacttctgggagaaagacaaacagttgccgccagatgtatgaagcaggtggagtagccatggcatatggcccatggggcctatccagcatgattttctcgttagaataatgcgcgttcatgtccgatcgagacgaatgcggccgaagaaattttccgcaccatcaacactgtgacagcgaggcccccaccgccacgagcccacgactcatcaactgcttccatttttatactgatccacatccactccccccgatctccgcagctcacacaccgaaacaacacacatcgccactagctccctcgatccgattcggatcggatccatggctaacctcgccgcctccctcctcttcctcctcgccgtcgcgtcgtccgccaccgtgccagcgcatgggcgccgcgacctcctcccgactcgcatcaaggtacgtcggccttggatctctggcacctcgtcatcgatcgtttaatttctccttgcggcttcgcagctggtgaggggagccgacgccggcgccggcgccgtggccggcggggacaagatggagtgcgtgtacacggtgtacatccggacggggtcgatctggaaggccgggacggacgcgaacatcacgctggagcttgccggcgcggacggcaacggggtggggatcacggacctgccgtcgtggggcggcctgatgggggagggccactcctacttcgagcgcggcaacctcgacatcttcagcggccgcggcccgtgcatggccgcgccgccgtgctggatgcgggtggcgtccgacggcaccggcccgcaccacggatggtactgcaactacgtcgaggtcaccgtcacgggcgcgcacaaggggtgcgcgcagcagctgttcaccgtcgagcagtggctggccaccgacgccgcgccctacaagctcgaggccatccgcgacaaatgctccgccgcaggagcgggcgccgccgcggcgtgagcgagtgacgcggccacgccgtgggaaataagctcgtacgttatctgtggtgagtggcatctgtagactgtgggggggtgttcatgttttgatttgtaaagatggtaatccgcgtgcgttatcatgtacggtggatgctacagactatccgactaataactttgcgagtcgccggtgatgaaccggcgttgtgtttcctcggttacgcatcgtcgtgccgcctcgtcatacagaacaaaatggaggaaaaatcgcctaagacagcaacgtaaagtgaaataaatccagctcaatgacaacaatggaaaactaaataattaatcggtattgctaaaaatatgtcgccacaaattatgatggatttcagtcggttgtttcaaccatcagatgcggatgcagaaatcaccgcatgtgtacgcatatccctccgattctgttttaacgttatttgctaatcaggattactaattaatcttaaaaactaaatatctgtgtcattgcaaatttatagttttgtgacttacatcaacttacatatgtaattttaggacttacatatgtaattttaggacttacatatgtaattttggaatttacattgtaaatacactaaaattacatacgcaatttagggacttacaatgtaaatacatgccgaccatttttttgatgaaaaatatggtgccataaatatagctactccctaattaattaatgcgccataatactatgagatagctttcggattttgcgcctaaagtcataagaaatctgggatatcattagcgatggatcgacgacttgctgggtatcatcagcaggctggcccatcagctcatggcatgggccagtaatgagcctcccctgaggccctgtggcaggcaagcgcgcgcccaattagcctcgtttgtgaggtccaatttttcggcccatcgttgcgtttgggccagaattttagttcaacgctcgagtgggccccagcctatcaacaagacacagagaagtattaaacttccagatgctcagataactagtaccctcgaataaaaaaaaaggataactactaccctgggagagtttgtttttgagaattcatttttagttcaaaatcctaggtctaaattctattggttcatttgatccatatcattaccaatataccgaattagaaaaataccattaccataccatcgccatcagattttccttccatcttcattctttcctcttcttctcccatggcgatggttcaagagtgaggcatcaagacgatgaagacaggaccatgggtgaccggtcaacgacggggtcccaaatttgctcctggagcaataaagggaactgaggaggaaggaggccaagctacgcatcggtactagagtgttagccctgccgctctaccaccctgaccgcccttgcaacctctccacgctgaccgtgcgtcgccactagaggctatggtattgagcccatctgctggagccaaactcttatcatctcgcccactagagtttgccactctttgtcacgttgcggacctcctcaagccaccgacacaaagttcttctcgtcgagctcctcgcagccagcaccctcatcgagctcctgcactactaacggcctccttgaggcaccgcgctgaagtcttcttctgcctcttcatcactaccgccataaggtggtgccatctcgttctccctagcatgacgattctgctgctactagttaagcttcaacataggaatcggtgaagccgaggaggttgaagaagcgtaggccatacatggaggaaggagaggaatctaacatggataacaaaaaaactagacgataatggaattgttatcgatttgacaaaatttcagtggcacccaatagatatcgcgaatagtaatgatattttttttcgacaaatttgcaaatgatatttatggatcaaattaacccaaattttatcgtactcagatagaaactgacgggaatatgaattctgccgagagacggcctcccttagcgtgccgagcaaagcaacttcgcaataaatcgatggctttgccactgccgccggccggtggagcatgggcctagcgccctagccacccattgccgtcccccataccttgcatccctctcaagtgcatctcccctttcatgattgcaccaaatgttcttaaatttgagctaactcccttttacaatctttacacatcaccgggttcactcatgcacaccaacctctcccagcttatcattggcacacagataaacaatcacggcgacctcattagtattgatcgaaagtgctaatggtacaagagaaccatcattaggtgaattttattatctcaacagaaataattaactaacctagtaacctatatactaccggtgcccatcggattgaaaaataagtccactaatatatgcagtagcgtttagtttgctttgaagtttcatgggcagttcttgtgatgctgcaatgatcaatctctcttctaaataaattctgcgtcgccgcttgacaattattaggtttggcgccaccgcggcagccacacctcttctcgctcgtagagaccgtgacagtcacgaggcactggacctctcatcaagttatggagctgtacacaattcattgcaccacggcacgagttgtagtagtggaaatgcagatatgttcaccatactgcatatcctgtagcattgccattcgccgcagctgtagatgcgagctgacgaacgaactgtgcatgcacgcgcactgcacttaaaacacacaagtattcgatcggcagaaaataaagttcagagcaagaaggtccaggtgccatacctgtatcttgtagtggtacgacaaaagtagtactccctccgttttcatataaaaacgttattaactttcacaaggttatttttaaagtacctttaatgataaaataagttgtgacagagtaaatattatttgcacatttctttaacaagatgataatgatgaaaacatcatataaaaataaaaaaaatcattatatttaaaaacggaggtagtgtcaattcagaattcagattcggtcatgcttgttccagattatccatcaccacggcagatgcagattatgcacgggcgcgttatattttgttcccaaattaaatctagcgaagatcacttctcagttcagtctacagtattcctccgttgtattcctccgttttttaatagatgacacaattaacttttaattaaatacacgattaaccgtttgttttatttttctcgcaaaggcataagatataaattatgcttaaagtatttttagcacaacaaaataaatgatagttacgtaaatttttgagttattttcataaaactacatgcattttaacacgttgtatcactaaactacaaattgaacgctaaagtcatcataaaactacaaatttaaagctaagtatatcaaaactacctatttaatatttaaataataaagaaattgcataatttagagtttaaattcctatcactactattatattggagttataaacgttatagttttgtggttaaattggtgctaaatttatatcaaagtatctatagttaaaattttcttaaatttttttaataagacaaattcaaacctgtatccgaaaattaacggcgtcatctattaaaaagcggatgtattgttgttgacgaaaaaaattgaacaccggcctgggagatctgcttagctcctatgcaggttcaaagattgatgagatgtgggcgtgccagtcagtttgatcctgcaactgacaagatatgcaaatagtagatctaaacagccgatcggctgacaagccgatggagtagttccagccgatagccgataatagccgataccgataccagccgatagcgatagggtttaagcaatcggctatatgtccaatgtggataatgatataaaggcaatcggctgatgataatataatatagcaatataatccagtagaaaccaatcggctaacaatatgaaatagtagaacaaatattgatccgaaggttaaagcacacatcggctggaggtccgatgtcataagatccacaagattagattaaacagtgaaacctttgttgccatcggctaaatccaacttatatgtatatacaatccctacaagccgatgcaacgtccagataacttatcggctagcaccccgataaaacattagcatgaacctatcggcttaacaagacttatattatcaacaacaatctagtagatcgaacctaaccgatgcagcacgagattgtatatgataatctaatactcgatgagccgatagatctatctaatgtgatggatataacaaatctatttagaacagcattatgattgtagagatatatcggctaagacaggagatcagacctaaccgagacagtcccaactaaaccgatgcgtctctaaacacaatgcaattagagatagaattgagatatcaggtaggcaaatatatcaaccaaaccagagcgatccaagagatcgaatcgatgcagccttgaacaacaccaacgtagccgatagattcaccaggacccgacagaacgtaggacttaccccttcgctggagatcgaaagccgatgcagccttgcgtcaggtgcccaagttccgccgaaagataagtaaaaacctcagggaagagggtggcgatgcgccgagagtattatcgatcgatagattgatagattacaatgaccccgggtgtacatatttatacccatagggagatactagtccttatcggacaagaaagaaactaaaaaggaaaagataaagtccttatcggacactaaacacactttcctaaagataaaaggaaactaacaaactatgcctaattaatagataactgtcatgtcgcatccttcttgaactcgaactcttctagataagcttcctttgattgatccgactccaccaagaacacgacatcgtggcgacttctcccatcggctgattctagaactttgaagccgatactgactctaaaccgatggtaattttgggattaccaaatttcactgttaacaattgtcaaatagtttctttggttttagttcagattatacattttttccctacattaagtgaaattagcggctcgccggttcgtttaaaaaaataccgtataatctgtatcaccgtatatagtccagcatagcattaataagttaatccgcgtacttcgggagtatggcagtacttgcttgcatgctacgacgccgggttcttcagttcagaggaagattagtagcggcagtggtacaaaaactgggctcctcttgcagtagacagtggacggacagaaataaatttggtgccgtgcaacgtacacgacatacacacatacccttgtcctcctgctcctgattggatcggtagaaaggtggcggatgctggattataataaaaaccctgtagattacacccataataaaatggtcaaggaccacgacaccacataaagacacccatccccgtgatcaactacctcaattagcctcccaagatccccctataatttaccataatttattcaaacagctggtacctctcctccgggttaataatacttatcgttttagacaaggacacgatataaaaaaaactttaaccattatttttcattataatatatatagaagtgttaacaaatatatgattttattaaattactttttaaaactaatctatacaggtagtcaccatatttaatagacaaatattttaaaatcaattcataatcaaagattctcaagtttgacatcacctttatctaaaataacaactattaccagcaccgaaggataatactaatttgaacatattcaccctactacaaatcttaataaaatctgaacaatggcctattggagttatagtactataatatatcattttccttagtagggccgagtttggttctaaatttttttttcgaactttcaatttttctatcacattaaaacttttcaacacacacaaacttccaacattttcatcatatcgttttaatttcaaccaaactttcaattttaatgtgaactaaacacaccctaggttactgtattttggcactgaggcggcacacatctacaagggaacgcacgaatctcaaagcagatgctcaggccgaacgcctccatctctaccgttcactgcgccacgttggtgtcctttttgcatgatggatcgctcgctacgagtttttttcttttttaagcggcagcggcaactggaaggtggaaggctctcctctgcttttaagaccagcgctgagacagatcgagcgatcagtcgaacgaacgagatgaagggaggaagggggagcaatggcgccgccaccgacctgctcgtctgcttcccgtcgcgggcgcacctggcgctgatgccgcccaaggcgatctgcagcccgtcgcggccgtcggcgtcggagccggtcaagcgccggcacagcacgagcaggtccgggccgccgccgccgtcggccgcgctcttcaaggcggcggccagtggtaggaacccgagccgccgcgccgcggacgtccccgtcgacaacgagccgtcgtcgccgaaggtgacgtgcgccggccagatcaaggcacggcggccggcggccaagcccaagatcagcggcgccggcggcggtgccgggggagcgaaggcggccaagaaggcgacgtggctgcaggcgctcggcatcaagaaggacgcgctgccgttcttgaacgccgtgcacggcgccttccgcctcaacgtcgccggctgcttcggtagctttcccggcgccgtggtggagtacacctccggggaggatgacgacgacgaggagctcgcggcggggaaggacacagagcacggggctgcattggccaagtggttcatggtgctcgaggaaggcaagaaggtatcaagcaggaagcgggagcaagagccgcagaagcagcaggaggaggaggagcaggacaagaaggaagcggacgtggcgccgccggcgaacgccctgatgctgatgcgtgccggtcggcgccggctaaggggttgccgaggaggttaggaggagatgcagaggaggaggtgatcaagaactccaagaaggaggaggaagaagaggatgagaaggaggagaggcttgtgctcatgagctacgcccctgacttcttcaaggtatccgtcgacatcgccaaggagacgtggatcgtcggcggcgacgacgccgtcttgcgctgccggagctggaagagatgatcaccacaaggatcgttctgtgagcaacgtatgtgtgttttgttctacttttttgctacatgcttgccttttcttttccttttttttcttccctcggagaattatatattcttctttatataaagctcatgtaaagggttcgatgagcacgcagcagattcttcatttgttctgccaaggccaccacaatggtctctctgcagaaggatttctgctctgtaaatagtgctgtaataaccttttactagatgctagtacacggtgaatagtacttttgtttgtgaaatgtaacgagtaatatatatatgatgagctgtatagctcactttaatttcctactttcctagtggagttaagatacaaccattagcgctttagccttgtatgatagattggaatctctatgatgaacttttcagaatatcttgttttctttttgcaaactgataatcatttgctggagtggttggtttacctctgctcagctcatattagctgtgataaaaaggcatgatcttaatgttgtatttggccacattttttaatggatcagtcacagttcgttagagaaggccatgttgttgaaagaattgtccttgtatgcccagaggcaattgttgccactgttgttatccgacagatgtacaggggaagtagtaggtggattaaaagctggttctagtgtcaactcggatttcttttagcccattttttgtcattccttttgaatcactacttattattaccacatccatttcaaaatataaacatttctatattctttaggaaaactacgttaagagaattcagtggtcaaattttgaattttgagttactcctttccaagcatctcattggttgaaaacgtaaagatttctatgtaatggaatcagtgcctaaaaatgtttattgcggtacaaaatttaaatcctagaaatgtttatattttgaaacatatggagtagttattagtctccgacctctgtataatgtgcaaaattttcggaaagtgctaagagaagttgatttttctaagtttcagagcataactgaaccagctcacctgttacgatctacaaactaaatcttatggagtactttacaattattgagaccaaacttagtgacaaattttccgattgtgttttctgaaaaatcaacggaaggttgaatagcgaacagatgcaagcattttttaattttgaggatttacataaaaaagatcatttagagaaacattgaacttgtaatagaattataattcttcagtagccctgtttactaaagagtttctctagtttttatgaactaaatctgctcgcgggaagtgtacatctagagctcacatttctcatccccggaactagcattagcctgccttaactgctggacattaccaattatgtgttcagctttaacagattctggacaagccgaaaaatgcaaaccattctcaatgccacataacaggttcagaatgaagaaactacaagcaaccatatgttcagacatccagaccattgtgccaaccaaactgataaatgaaagccatgcactacggtgtgcagtactgaagttcagttacatatacgcaccatcaatagtacagtcagtcacacggcacagcatttagcaatgcatgtcctgcaaaattttgtacaggcatccggattccagatatagtttcagcaagagggagccatgctcaaatggatactcactcattttctgtttgggatggatattagttttgtagtacaaagtacaacccagtatgttttttgtgtgaggcaaacttaaatcttcagaaactttcatggttgctatcactgccaacccacattcaaattaactagctatacttctcggtgcagcaagtattatgtacagtttcattactctcaattctcttgtaatttggcgtatagtgcacaaaaaaagaatcatactgacttgacactaacaaaccgcgcaatggtgcgtgctgcattgttttgtccaaagtcttgtcctcttcagatcttgcagttgatttcgggtagccgacagattaaagaagcctacaaggaagaataaacttatatagagatcaacatgccaatgctttgttctaaagaagaagcacaggcgagaatctccctaattttcaaacagcctttttatttctttatctgcgcgtggtaatcaactgctgtccttgacctaaccagttaaaattaaggtagataaagagtactgaaattctttttagagccgacacagtagtgcccaagtactatagggactacgnnatgcagttttggatttgtttctttccagtatgcaagcaatctacacaatgtctcccagaaaagtaccgatgagggcttttttgaaataaaattaaggaattcaagggcatgaaaatatgtcttcactgtccattttacttgatttttgtttgatgaaaaggacctggttttctctacgactgatttatcattttctagaacatatattagcaaatagtacatacttatatttctctttggtgtagtactatggtgaaacctagtaggaaaattattttgacggtatattcgatgaatgtaaacatgaattggtaaggctagctgtggttacatggcgtcactgttgtgatctgcttgcaatgcccccattcctctggctccggagcttggcttcgacctcggacagcgccttcttcatgtcctcgttctccgggagttcttggatcagcacctggtaatctcgcaacgacgcttcccatctctccagctgatcacaaaaacacagacaaaaagttcgttgacaaaaatgagatcgcgcattcatgtcaggtatggcgatgaaaatttccggcacggcggaggcagcgaaccttgacgttgcagtcggccctcctgaggcgcgccttgctgtacgccggccgcatggcgagcgcgccgttgcagtcctcgacggccttctcgtaccgcgcgagcctcgcgtggcacgcggcgcggttgcagagcagcacggcgttgccggtctccctgtcgaggccctcgcagtaggcggcgcacgcctcggcgaacctggacgccttgaagaggtcgttcccgcgcagcctcgccgacgccaccaccttggcccgccggtgcacgttcgcgatctcccggttgctcgggtcgagctggcacgccgtctgcgccgtcgccaccgcgtcctcaaaccttcacacatccagcatgaacacgacggcatcagaatacagccatctcatctctgctgatctccatttgatcgaggaagaggaaaaaaaataaaaaacaacgttgagaacgaacctcccagcagccatgtcgacctgagcacggatcatgaggacgtaggcatgggcgacggtgccgaagaacttggtcgattcgtcgacgccgaaccgcggcgcgccgcccagcacagcgtcggcctcgtcgtgccggctcagcttcaccagggcctcggcttgcaacgccatgaccttccagaaaaaaattccatcgtgacagagacgtatgatcagatcgctgcatttgatcggatgctggtcgtgtcgcgtaaacgttttctttccttttctttttctttttctttcacgtggcgcgagggacgctcacctgtggggcgcagtcggcgccgtcggcgacggcggcctgcgattcctgcagcaccgtgatccagttcctcagcttgcgcgcgtcgccgcacttggcgacgcggctcttgaccgactgtgcgcgcgacacgtccgcgcccgtcgagtcgttcgccgattgcttgaagtggtggattgccttgtcaggttctcctaatctgagcaataacagcaatggctgtgtttagttcacaccaaaattagaagtttggttgaaattggaacgatatgacagaaaaattgaaagtttatgtgtgtaggaaagttttgatgtgatgaaaaagttagaagtttgaagaattattttggaactaaaaacggtgtaagtttactatcgataaaaatcatcgtggtgttgtgtaaacaaaacaatgtcagtactcagtacagagtaggcagtagaaaaatgaagtgtgtgtggacttgttctctgacagatcgcaaaattcaacaagctagtactaagctagtgctgcaatcattctcttcaaaaagaagtgtgagaatgcttgtcgaggaagtgattagctattggaattaccaatcatcaatgtgatcgcaaatggctagagtaatttacggcagaaggtcttgcttgacctgctaaaccaatgatcaaatgatcaaatgttccaaaggagcacatgtatcaaattgtactattgcctaatcacaaacaatgggtaattccatttcttaagggaaaagtttgagatttccaagaaagaatagcagtacccctactcaaccatgaattcatttctttcaaaaaaaaatgaataagtcatcattgacaaagagccaatgctgatgcaaattagccattccattaactaattccccaacatctaaatttggtgcacctattttcggccaaaataattgcctacgaaatattagtgggtaaagttgaacaatcagttgtcgtcttgtcaaaagccatgatcaaatcccttttccaatagaattagatcatgctactataactatggtgctagtcaaatctgatttccaaatcaagtcacgatatgaactgacctaattccagtttttttttactaaagacctaattccagttgatcagtgtccttaagaattcctgtgcaaatactagttaatttcatttcttttgccggattcctaaagatttcaattgcactaatgacattggtgatgaacaatctgaacgcccaaatgcggaatgcgcgtacctgagatacagcccgccgaggcggtggtgcgcgcggccgtacgacgggcgatccggacagcctccctgcagtcgccgacggcctcgatgaggcggccgagcgcggcgagcgcggcggccttgttgctccagtacgccggccgcgttggatccaccatgatggcctggtcgtagagcgccaccgcctccgcgtaatgcccctcccggtactcctcgttgcccatctccttgagcttctcggggtccgtccggtgcgacagcgcgcggcacagctcggacgacgccggcggcgccctcggctccttgacgatgttcccgaggccggagaacgcgtacccgttggtggccttccgctcgttcgccggcttgttggcggggttgcgttccagcgagctccgcgccgacgcgccggggacgccggcattgaggttgccgaggttgcggtggagcatcatgttgccggaggttgcgcgcaccagctgcgtggtgcccttgaccctctggtgatcgaggatcatcttgtcgagctccgctgccatcccggtgtactccgcggccggtgccgccgacgccgcattcctcgccccgccgttcgccgccttcgtcgcgtgtacggccctgtcgcttgccggtgcatgggcacgctgcgcgccgttgttcgtccctgggagcggcttggccgggcggtgcgcgagggacgagtcgtcgtggacgccgccgcccttccggtgcgcctggttcgccggcgcggaggccgccttggcctcggcctcgtgctcgtgctcggcggtggcgggtgggaccccgttgatgcgggcgatggaggacatggagtttgaccggcgtcgccggaacatgccgctgtagatgccgaacatcgcgcagccggacggcggggggagngaattcgttatggtgactggngacgtccgcgnccgcgcgcccgctccggccgttgtgtcgtgccgcgtcgtggcgagcgcgcgcaccgggaggcggggaagggggtcacgacgaggacgagggagcgcgggcgttggctcctggctggcaacgaacggcggggttgcgaggttggggtgggaatatttttggaggagggggatttaaattggggaatatttacatgcacccgcttgtacctgttcagttcatcctgtgggccattttgggcaagttctattatccttcctcttttttgttttgttttgttttgtttttcttcttggagagttggagtagatatggatttcttggaccatggtttggttggggaggcattcatggtgggaactgcttggttgggtcgaatgtcttggagtttattaatgttctactgtgttgatgaagtttgaaccataatttgaatttcttttgttgaaatttgaggcacatgggcaccaacgaaattagtttcttcgggagaatatgctaagacaaaatggggccacttactgtttaccatcataagacaacagaggttgatggaatggcagggtcaagacgattagtagtacgcctctgttttcctctttcgagaatagtacgtctctgtttttaaatatttgataatgttgacttacatgtttagaatggatagaataaaacttaagtgacgaaaacaacaatagagaagaagatcggtgtagtgtaaaaagagtagagaagcatgaggaaggtagaaggcagcggacatgtcgggaggaaaactggtgtgtgacctgaggtttgctgaagtgtggctaagaagaatggtttataattctttcttaaaaaaaaggagaatggtttatagctatagtcgttgcactaatctcaaagcaatcccaggctcaaaaaaaatgtttggtagtaccaagcatgaacatatgtgcaacctcgtgaaattattttactccagtgcctctcaagaaacgcttataagggacgtgggtcaaaaggttggtacaacatggctcgcttcctccgtgcatgtgtagcatgagtttacttgattgttttaactttggttaagagatgcttgctgtccgtcgctctgaaaattgggtgttaggcgtgagaagagaagagaggaatagagaaaattgagaaaatatgtaaaacgagataagctactagcgcgtaattaatttaatattaattattttaaacttaaaatatagattaatatttttttaaagcatttttttataaatagtttttttcaaaaaatatcatttagcagcttgggaagcgtgcgtgtgaaatacgatgttctttttttctcccttttcaactctcaaacagcatcagcttgtcaactatcaggcaaattctgatcagaagacagataacacaacagctatgcctgatccttttatttttcactactactactaaaaaacaaaaacttggggcggttgactcctgaccaccactaacctgttggatcgctggaaaatgttggaccagatcaaaccacgcaggcacgacttagctagcaatctggacttgggtttgtgttggccatttttgtgctccactattatgtgcacgtacgcaccgtcaccgacgacgtgaatcgtgatcgatcgatctgctccaaaacgtgttcgacgtgctaaacatggatagcacatcactaataatagcgtattgcgcgttagttggcaaagcagctagcaggtctcccatcgttctgggaatttggggtcactgtattttagaccaaaaagttaagcagcacaggcacgaacaaatctttctgtggtcagcgtcgtttctcgcatcattgcatggtgtgacggcagattgttatgatatcataaaagtataaaaccgttgccgcgtagcatcatcggatttcagtatttcagactgatatatgaatagtggttcgttagagctaacaaccctggtgtttgtggctgatgccgattaccgacaatacaatactggccgttgacaaccggttgatcattattataaacctattcatggtttgctgctactgtcaattgcaatttgcaaccgagcgttgaagagcatgtgaacgttggatcagtatgtgccatgaaattaagtatagttaagcaatcactaaggccacattcctgatctcccctgtcagtttcctgaaactaactctgcagcaggagttaagcgcgatcgaaaagcgtttccatgtaagaaatgccaaaacactcctgtctcggaagaattggtcgtctctctgtcgtacggagtaatgcctaggagacgtccaaatcaaaagccgatggcatgtctaaatcgcactacgagatcgaaaccgccctattctcaactcaagcgcaactaccgtttcaatacagtgatgagcagcatgggacagcgatgcgcatgggcttaccggaccatccaatagttactgtcctttatactcacagaataagtctattttactcccctcaactcatttccttgaatcacatcccttgattgcaaaatcgggtataacccatcctctaactccaaaaaccattgcaatcgactcccagggtggtttcggaggcagtttcatccgatgtggcaattgacttgttgcgtcatcaaatcggacccacttatcagtggcctccaactcatcctcacattccccctgacccctccatctttcatctattcctcttctctcaccttatcagggttattgataccacatatctaatagtaattgattaagctcggtgaggcccatcatataccaagtcttatacgaaatcatagctcgtatatagaatgagttccagataaggaaggacgagtagagttctatatgaaaactataatgactattcgaattgtatccatattggtctctctagttctacttggacaaagggacatctatgggtataaatacaataccccctaggaggaggggagacagaccaacaagacacaacagattgacacactaagccaggacaaaccaatacgccaccagacatcgacatcagagataagcctagacagacctcatccagtgcctgtggaggccgacaaagaggaatctagtgctatctctgatctcgacgagttcatattcgaggaggaagactaccctgtcatcgactacgtgttggtgttcgtgccaccatgtcgacgatagttatataggttatcccaaatattgtacttgtgtaattcagatgaataaagagcaacaccggctttggccaacatgagtatggctattacctgtcagataaggggccctaacatgtataaaaacccttgtctctatctcttttaactcaatctcggtaccaacgatccccataccatgcaaatacagtagtcgtgacctcaaacgtcgacacaccttccatcaatagaggtagcgcagcggtgacggcgcactagggaggagctcgccagctggccaacagcgctgcacgagttggaggagcttgccgatcgtcacgctagttggaccggcaaccttcttcagttggattggtcggcttgctcatcccacttctcggcatccaacttcatccacgcgctgcttgagtactctaggacccatgttgcacgcgctactctccgagacccacgttggcagcaagaccggggaggggggaggggaggctcgtgctctgtcccgtcgccgcctcctccatccacagttgcttgccgccatccatttgagagagagaggggggtaaagaggaaggagaaagggtaactgataggtgggcctgatatttatttttattgttttaccactgacatgtggatcctatttagatttgttttcattttagtgccacataagcgccacgttgatgtcacatggggtgaaggtcaagttaacccgctacgtaagtgtcatgtaggatgaaactgctattaaaaccaccgagggactctacttgtaccggtttttgaaattgagggagacgttatacccggttctgtggttgagggatgcaattcacctaagggcaagatatgagggaggtcaatagacttattccctttacttactcattccctgcctcactgggccttaccttttggaccttccaggccatatatggttgggccgaaaagggattacgtgaggcccgtatttggattcccccacatatggttgggccaaaactggattgtcatgtcatgtgcgtttacgtagtggaagttgggccagaataggactgtgacgtatgtgcggcccatattagtcgagaaacgaggttacggttgcgtacggctcaaaattatgtgatggagcaggatcccgttctactacgtaccaatatacttgtcttcagaaaaaataataaaatcatactagcatatactaatggattgtgccttgtgggtctctctgctttgattgcaaccagctcgccatgccgactcacttcatcatggctaatccttatccattgtttgatataaagcggatttttttttcgagacagagatagagcggtttgatttcataataaatcaatgagttttctttgtttattagcgagcacttagctcagtgataaagccatgcccgctccagcctgcagctggccgacacatcggtgcctcctttttatcagaagatactgtcgcattcgcacgtgcatgacttctctgtgttaactgctaatacgtggagtacgtcagtaaaataccgcctccaaaattgtaccagcaggtagtagctttttaaggcctgttcattttgatgtcattttcaaccttaccaaattttggtaaagttattaaaaaaagtggctacatttagtttgctgtcaaattttgataactatataagaaattctgtaaaaaattttggtaagtatgctaatttttggtaaggttttttttgacattaaagtgaacatgtcctaagtgtgtgcaggtatgcggtaattgattaattatccccatgcttaatcaacaggccgagagttcaactacgttgacgccacgatagcaagtcacgaacgcactgaatgacgcgtgtcgtactagttagcacatatattcctggtctatctcactgtatgacatcgtatacatggttacgttacacattgacggtatgtacacaccatctcccttggcagctaattagaagtcgtcagtcaagctagctaagctaagctagcgcgtgcgtctggatgataatattgcccacacgattcttccatgcgtcgacgttatgggaactgtatgcttgctagatcgatactgctgtactctcgtctgaactgagtttcagctacgtgatacatcgaccatcgtgaccgagaaattattggcgtacgtgagcttgaccacgggatttcagttgggaatccactagcagcgtggtcacacgagagggcagcatccgcaaaccgcaaatcatatgaactacctgtcatcgagttcatatctagaaagaaatggccaatggaactatatcaagtgcaacaaaaaggtttgctttactcgtgaacagaagttaatctaccgcgaaaagcaagatgtgttgcatgcagaggcagagcagagaagagagagtccgtcctacttgacctgccggaaaaagcttagcgatcgcaatgccatttcacaacgctcctcaactgtttgatctgccccccactggcttgtagaacaccctccttgttttaactgacgatcacttcacgagcacgagcacaggaagaactaagataaggatcaactcgccatgtactaatgtacagattaattactaatcgaagtcaaaacaacccaactcgattgttcgatacactaccgtctgattaaacatttaggttccgttctattctacaacgatagttggatgaaaataaaaattttcgtgacatgcttttcaaactgctaaacggtgtgtttcgtgggaaaactttctatatgaaagttgctctaaaatatcatattaatctattttttaagtttataataattaaaactcaattaattatacgttaataccatcttattttgcgtaaaaaattaatctttatctttatctttatatttatctttaggagaaaaaacatcactttatgtgtctgcttggcccaaaagatcgtctgcctggagaatatactaccgggataatcaccgaagaggtaaaagaatttagacccaggcggtaaattccagctaagtatatataagtagccatcaaacgcagctattccactggcaaacctacacacactattgagcctctgtcacgagaagccaatgtactcgtgcgaccacgaatgcacggcgccaacgcacaccgcgttcggcgccaagtaccagccgtgcatcggtgtctcggggcgccctgaccatcacgccgtcgggaggctgcagcagccggctggcaaggccgccgccgccgccgtcgtttccgcggccgcgcagcctcagcgcgccgccaagaagaggcatgcggcggcgccgccgccgcgcccgtcggcgtcgacgtcgcgccgctcgtcgaccaccgtggtggcgaccgacgtgtccagcttccgctccatggtgcaggagctcaccggcttcccggcggccgccatcttccggccgctgcctcgtaggatccccgtccacgcggtcaacccgtcgcccgcggtgcgtgggtacggtggtggcgcgcttcaggggcacggttcggacacggcgactgctgccggcagcagcagcagcagcaacccgggcgtctcgaccgtgcagctgatgcagtgctcgccgcccggcgtgttcgatgggctgccggaccttgggtcgccggagttcgactcgtggctcgatttgtccgacgagtaacctctccttgtcggactggtcaatggaagccaatacaatactgtagtaaaggtttggtaattggcagtacagtactttctttctgcgcatgcatctcttaaggttagtgtgttataacatccttgaaaaaaatgatggcgtttgtactcaagctttcccaaatttgcagaaatatgcgttaatacactcatgtaatctcaattcttggttggcttttttggacttcgttacttacaagattggttgaaattagtctagcaattctgtcggatgttcttctttcagagagaaaaaaaaagctgtcagatgttcaactacttcttggaattgacctgtctgttaatattgtctgtcttaatcggttgttgacatgagccggcctaatggcatacaagcaccagtatacaccgtcacgagtgacaacattgcgcggacatacgaaaaacggaaggtaaaagatcgccgctgacatgctcaaagaaattaattcatgtactgtaaacaggaagagtacaagagcctgataagttcgtggaagaggtttcagcgtacaagtaacaactgtcatgtactcactactgcaggttgccaccttctgataatctcctgaagtcaagtcctgatacacacgaaccatgtaagagccatgcgtagcaagttactacactgtgacaagtcttggtcactcgtgaaaattgacagccgatccaatctacgccgcaaaagtgccatagtattgagttgaatataccatgagattctcatgggagtatccgacaaaacatgtttagccttaagaacaattaagtttccacgattctatggtctcctatgtctgtaaccatcctctgctaactcatggcaccctattcccgaacgatgtaactgggctttttttttaaaaaccctattcccgaacgatgtaactggggttttttttttttgaaaactacctgaattccccacgcaacaataacgcttgataatgaaccaatactccaatagtatctgaagcagctcagatgacaaaccagtatgcaggacagattttattatatgagcactgctatgcagactagctcacttgtatcattcagaaacaacaaaatagaacacagttctatgcagatcttattttccgatcaaacaaggaggatcagacagacgagatggagcagatatacacctcactctgctccaaggagggcaaggagtatatcctcgtagtctctggttgtatctttagcaacagctcgctccaatgggacactgtttctcttctggtaggcctcctttatcagcttcaggtctacctcggcacgagttgttatgatccttgtaagagagttctcgtctgtgcccattcctcctagagccaatcgaatgactttctcaaagtatctgtcagggcaagtgaagcatcttatgatcgcccttagtgtaccaaggaactcgtccttaggatcagctttaagatcctgtcagtgtgccagaatgtgttagaagagtttcagacaaggacaggtcggcaaacgacattatggaccactagcaatgtgtaataatttcagttcctaaaataccatgttcagtgcaaacaatggcatgttactgaatgaaacatttcaatacaatgcatgttatcattcagcttagtgattggacaaggaatggtaagtaaaatgtttttcaacgggaaaaaaaacggttatcaatgctattattaccttagtgattggatggccgaactgatcattgtaactattgaatgttgctagtaactgtgctttgctccttgtggtgagaatcctgatgatttcatcgtcactgtaagccttgtcatggatcttctcatggagtattttggcttcagaatgtgccaacgatgtgttcacctctggcccatcatagcgatatacagtcacaagtggcaccaaaagctgcaagaaagaaataaaaataattcattttggtaacaagggtgttctttttttagcattgacgtatgcaatttagtagtatgtcacaaattttaaagcacaataataaaatggtccagtcaacgtaaactgaggagatggtcacattctagtatacagaccagggtaactgaagtgatatcatctcacacagctagtaactgcattatcttctcagatatgatcatctaagaactacgttaccatttatcaatgcccacacaaaatacaaataaaaaaagtggaattgcagtatactagagttaaattgaagagatgatttagatccttagcaaaacaattcatcttcaatattgagttatccactatacactacatactaatcatgagaacaaggagatcaagaagtaaacatctcgcataagtctattgtcatgataaacatctcgtatatccctgagaagcatagcagcaagtgtaaaattcatggtttctgtgattatgacagagatatcgatctatcaaaatttcaagaactccgtggtagatgatagattcaggatcatcaccttacggtagtcgccggtgatgtgcgccgcgacgtcctcctcgagcgacctcttgaagcgctcgtggtacgcctgcttcgcagcgaagagctgcgatggagtgcgcgtgcacgcgatctcgacgagcgcgcggccccccgggtgccacttcctcgcctcctcgttcgccagcaccgcgtcccgctccgccgggtccagcgtccactggatcaccgccctctgacaaaatcccaacccccacacgaatcaaatcagacagatagcgacggagctaaaggggggagccgattaatccgcacaagctagatcggggacctcgaatttgccgtggatctcgtcgttgagggcgcggagcagctcctcgccgtacgcctcggcgtaggcgcggcggatcgcccggcgctgcgccgcgtcgcggtgggcgaggatggagatgatgagcttctcgttcgtgccccaccctgcgggaccaccagtaaagcagatcgcgtcagcacccggtccggcctcgcgccggccggcggaggattaaggcgaggacggcggagcgcgcgcctgacctttgaacgccttgcgcagctgctcgcagtcctcggcgacgggcggcacggcggcgggcacggtgagcgtcgccattgatcgtcgctccggtgatcgatccaatcacggtctctcactttatgcctcagtgagatcgtgcgacgccgcggggcgcggcggggaggcgaaggggatttatgcggcggggaggagttcgaggaaagtttggacacggagtgtgcgtgcgtgcgcgcgcggtcggtgacggtggcgacagcgtcgcgtcgcgtcgcgcagggtatggaaagacacgatcacgggggagaggttggcaaggtgggacccgagacttcagtacgtgtccgtgcctgagacgccacatgttgggcaactggacgcggtgatggcatcaataggaaggtcttgatgacgaataatttagctaccttaagtggattaggtggtggttaagaccgtccaaggcgttaatgcgtgtgactgtcatcatttgcaagtttgtaaccggtaatacgtgtgacagtgtgactttgtcgggatgtgcaagtttgtggatgtttctcgttatggtattattaattgttgatctttacaaatataacatgctatattagaaaaaaacaagaagttatatttcttcgttgatttgtgaaggtcagtttaaggggcttttatgttccgattaatattcgttaccgtattcgtttcgattcgtattcgctctgtatttgataatattcgattccgttttcgtatccgggtttccgattccgatttcgattccgagaaaaaaaatatgataatgaatatgataaagttagtttccaaccgtatccgatccgttttcatccctattccaagaacaaccatgtgtgcgcttttcatagtgcatttggtggtggcgatagaatacttggattgggggtggcagcacggagattaaattaaatcatgctgtattagggctggttgtaacaatgtgattgggacactagcttgtttaggccgatggttatacttatacgccgttgcttagcgctcctaacttactattgacggatcatacagggttacacgcgtaaccgttcttactaggaattaaagcaatgtgcacgcaaggacgcaacaatcctaacatccttagcagcttcacatcttcaccaaaactattgcctgccctgcccggccgtcaatggatggccaccacagaaagtcggaaaacgttttgctgtttaggctgtctgatgtttgaactttctagcccatcgttcccttcctagggtgtgcttagttcacacaaaaattagaaagtttggttgaaattggaacgatgtgatagaaaaattagaagtttgtgtgtataggaaaattttaatgtgatgaaaaagttagaaatttaaagaaataatttgaaactaaactcggccttaatttagaacaactctaactaatggataccatacacaattctgactagtgcaacagtgactgcacagttaggcacttattgggcacagccacgtagccaattgacctccaaagtttctctcgagatatggctatatttaggtacagtggtgtaaagttttggcgtgtcacatcggatatacggacacacattaaaagtattaaacatagtttaataataatacaattacaaaatccgcatgtaaaccgcgagacgaatttattaagtctaattaattcgtcattagcaaatatttactgtagcaccacattgtcaaatcatgacgtaattatgcttgaaagattcgtctcgcaatttacacgcaatctgtgtaattagttgttttttttatttatatttaatactttatatatgtgaccaaatatttcaaagtaacagggctaaattttagcggggggataaacaggcgcagtagtgccggtagggcgatgaatgcatggccatcgagagaaacattaaatgcgtgcagagaccgttgttttcctgtagttgttttttttggacccctttgaatcacggaaatagaaaaacggaggaataagtgtaaaacagagcattgcaaaacacaggaaaaatataggaatgaccgtttgattggaccacaataaaaacacatgaatttgaggagagataaagactcaaaggatttcttccatgaggttctacctcttgttaaaattcctccaaaacttgtatgggaagaggcattccatagtaatttcatagaattccatagcgttcattcctttgattcaaagggctttgtagaaaaaattcctataaaaataaaatcctctaaaatttctatgaatttcctccgaatcaaagcgggccttatttttttctggacggccagctttcagagttcagaacgaacataaagacgcgatgatgatttggaacgtacgtcaccgttcctgcgtcatcgctttgcctaaggtttcgatgaggattgaactggaatgagatgaacacagaacaattccccaccccaatcttttttcacttatacttatgttatgtttattagttaaaatttaaattttcaatcttagatttaaaattaattttaagttttcttcatcaaaatttatttttagcatttgcttttagatagttataagaatacatatataaaatttttattcataaattattttcgtttgcaaatatgtacccgaagtactccgaacccgaagtcaaataaatttgacagaggagtattgagtctgtataaaacccggacaacaaaagcttgaagaattcctacctgtggtaaaacagcatcgtccacggtacggtgcgcacacagacacacaaatcgaacactcttgcactaataaattcagggggtgtttatttcttttggtgtaaagtttttaaagtatacgaaaacatttaaagtattaaatgtagactaataatgaaacaaattacagactccgtctgtaaactggacaaatttattaagcctaactaatctatcactactaagtgttttactgtagtatcacattgtcaaatcatgacgtaattatgctaaaaaaattcatctcgcaatttacatgcaaactgtacaattgaatttttcttttcatacttaatgtccacgcatgtgttcaaatatttaatgtgatttttttaaaaaaaatttttgggatctggcctcagcagagatcttctccgacgtccctgacgagttacagtaacaagctactccagctttccatgtgtcaaatccaggctagtgtgatagtgtcacgcccgctatcctgtaccgttgcacatcgatcgtgatttgtcacgtgaaatttcattaccacgccagaaaaaaaaaaaaaagcccgcccgggccgagccgaatcgctcgattatccgtccgtccgagcgcgtctatctcccaccgccactttgccattgtcacgaaaggcgcgagagcggagaaccagttccgcttatgggcaggcgcggtcgcggaacctttgaaacgtgacgaccgagacgtgacgtatccgagccgcgcgcggaggcgagcgcgacgtcgctgtcgcgcggcccgtttctggcgccctccgcggcgtcacgtcgcggcgcgggtcggccaccgctgctcttccggcgcgaagagtcttgttggttgggtgactcgatccccatccccaacccaaagcatatccctcctccgggacaagcgttctggcgcgcacttggcccagcgcctaactccctttcacccaacacacggttcggcgccgatgctagctgctgctgcctcgtctcgtcgcgtcgtagcctaagcaccgcaacgctagaagccgagactggtctatggctaggctaaagcttgcccgatctggaggttaggcgcgcgccgcagcggggggcgacgatgatataaatggccactagcgctagctacccctcctgctccttgccgaattgccgtgcacagtgcttttttttcttcttcttcttcgtcttctcccttgccatctctgcgctccgatccttggttgagctgctgtcttgtttgtttggctggatcaataatgcatgcgtccgtggggaggagatgggggtttgatccttgcgacgaggtaagtgttcttcagctttctcgttgcatgatgcatatatactgctttgtttctccagcttgtttgatcagtagaatcgatgtagtatcttgtatttttgttgtgatcttgctcaaaattaatatgggtattggccctccaagaaagaacttatggttattgtttggttgttaacttgttatgcttgaagttctttttttttttttgagaacaattatgcttgaagttcatgtacggaaacggagtcgtatgtactctgtatagttcagtacagtagttggtatggactggagttgatgctgctgactttcattttgatctactacatctgatctgcgaactagatgagagtcatcaggaaaaattgaagaaataataactaaccgtttaacagtacagagaaaaaatatcatactactagtacagaaagattggtactgctataaatttcttactgttgaactgtaatgttctagtagcttttctggactactaaagatgaagcgatttttttctcaggtcacccacgttgttatgaatgactttgctctgatgaatgaccacaccgtgctgcttcaaggccatgacaagtcaaggatcagcccagctggttatttgacaaggtcaggacctacacagggcggtggcatcagaaacaatattggatattgtgacgggagatccatcaatgaatcctgcggtaaaagaagcacttatccaccaacttacaagaaagatgtcactgttccaaaaagtacgcaatcttgcttgtatctttcctttttgataatggagcttttatgatggatagttctagtctaagaccatgtctatgaaatgcattcattcaggtacaaaaccaagcatttttgatgctgatgaatatgtcagtgttagcaatgtttcagacgttccttcgtcagaaggcaatactatgcaggatgagcacaggaacaaagggaaagatttgttatactgtgattggtctgaactgctcaacttggatgacctcgaagcagatctgaggtaatctcttgctgcctccagcatctatctttatccatcagaagctgagtcctttatgtgaatcttgaacatttttctttcatttttttctgaagaagtttcgagtccacgtttgagataggaagtaatcactttgaagatccactgtggtcttcagtttgcttaccagatgcccagctagtaccaagcagctgtctcttggacaataccaatttgtcaactgtttcgaatgagagcacaacaaagtctatattatcatcagtttcagtttccgatactactagtgctgaaccattgttccttgatcaggtacttccaaacttttgatctttctaattgatttccccctaattttataggttagatgatgccgagggtttcttccccagggtagcttctcttgtcattccgagagtcaagatctctggcctcttcaatatgcaacaaatctccagatcatatgtttcctcaaaataatcttggttccatataggaacattttaacatttctcttcaatttatctctgcagaataatatggcaaatcctatcaacatacaacaaccacccagcaaaggaagaagttcggcaactttgaatcatgaagcacttgcctgttcttccggggaaatcgagcgattttcacaacattcagatgttgatgttttctacccatttgacaatgtaacaagctcggaacgcataagtggctgtgagggactagaggctatcttttgcacaaatcaggaaatgctagccccaacaacatcaagcatcatgtgtgatgatgaaattgtatcttcatcgactttctcagcaccggatctcgttgcaacctacgttccgcgttcgatgaagagatctcatgatccactgaatggaactccagacatgatcctcgacgaaatggctggaaatccactagagatgtatttccctccatcattgactgcatatgaacacccagaacatctgaataacgttactttgacacaaacacaccagtttcctgaaggatttgcaggtgacgatgttctgaaaagtgcagacttacagttcctctcgaagggaaagacttcagcagacttatgtgtgaacccttgctcaccactgattctagaagctgtgccagttaaggatcttggcttccataagcttcaggaaggcatgaatcaggtatactaatagtatcagtaacttagaacaccctcttgcaacccttctagctatgttgcattcttcaggaatttgtgaatgcaattagctattattcaggttgataatatttcagattgtccatgataagtattcagctcttgtatccttccaatgtactttgcagttggacgtggcatccaaagctcgcataagagatgccttgtatcgattggccaattgtgttgagcataggcatcgcattgctagtacaacagagaccgttaaccaacttggagttatggaatcatcagcttcaaagaggtacaacggtttaatgtgatcttcaattatgtttaggacacttgaagtgatcgacagctgagtttttgtgaagtgtaattttctgacatgttcaaatcaaacaggtggagagaaattcagatgatgaaccctatggatcgctcagtggcacagctgcttctccagaaaccgctccaccataaatctccacctgattcggcgctcggcattggtccctgaattgtactgcaccgtgaaaaacacgtaggagtggctgctgatgcgatgtggttttttttactgcacatgtctgatcgattgagcattctaggtccggcaattttttttccctctcggttccggtacgcatgtatatacagtaatcactaaagagtacagacttactagatgaaatgtaatgtgatagcaacgctttgctgttcagagatgtgattctaaatagaaactacagtgttttttttttgttgtcttcagcatttacctgtgacttgtcagatgccccattgtaccgtccaaaaatttcctctattgacggttaccccttggtcgcagatttacacggtttctcttattgacggttaccatggtaattaggcttatcacgtgtgcggaaacgataagtgccggataattctaccaagttcaaagaaacttaaatgtaaactctctccagttttttcacggttcatcacgataaccgcaatggttaccgcggtcgttggagataaaccctgtcgccgaaccgaggccgcctgtgcactaaccgccaattagaggaaaggaaacaaatcttgcaagtgtgcaagtgaccgggctagataatccaatcttgacttggcagttgtgttcgccaccgaacggcaggagaagcgaagcgtggggaggaaaaggcccaaatcctcgcctcctcctgcctgcaaccaccgcctccgtcgtctcgtctcccccggcagaggaatccccaacccggaagctttcgggagtcggacgagctcgccttgactcgcgtccccctccctcgcgcgcgcgcgcgctcgtcgcctcctaaacttagcggccgcgcgggacgcggaggggcgctcccctccagaaataggcggggtgggtggcgaggaggatggggtacctgccgtcgtcgctgggcagcaaggcggcgcacttcgtgtccgacctcaccaccgtcatcctcaacccaatctccgagcgcgagccttcctccccactccccgtgagacccgagatctctctctctctctccatctctcctctctaccgttcctcgtagtgcgggcagtttatatctggttttgaattgtgatcggtttgcggctcgcgtcctagatttgcgcgatcgggctgagtcggatgctgccggtagagatatcagcgtggtttggactttttggagtgatttcgccgcagggatcatcccgttgctagggtttttgtgtaggttgctgaattctctgcctgtctttgtttagttttctgtgggggtttgccgcgatctggatgagtggcaacggaattggagaatgctgatagatagtggacttcgtcgggtggggatatttgtgttctttttgacatgattgaggacttgagaagttgaggtagctgcaatagtaaagttagctcacctgtatgtttctacttgctacctgaaagttgttcttcgtattgtcagcttctgctagtctcgagaggggaaatagttctgttccatctcagtgcgcttttgaaagcctaccccagctgtttatctgttgtctttgttgatgtatccctttgcattctgttatagtttaaagatggtttgcattgttgattgtttgaaataaattgttactgcatgtgtttgatctttgatgccagtttgtagctatgaattgccgctaatcactgacccgtgtttcactcaccatcttgttttccagtaagctcacatctcaagttctttgatcgttgtaggaggtggacaaagacgaagaaaaatcagaggatgacaaagattctgagcaaaattctgacacccccgatggccctgacacatcttcctttagagcattcttgatctcattcctgtcatcatctggttctagtaatggttccatggagataattcctgatcagaatggggaattgggatacccaactttcacaccaatggggaagtcaaaaaagggaaagtctgggctcctaagtagaggaaaacattccattggaaaaatcattagcaaagcggctagaattggtggtttcaaacaaaatgtggagcctaagattgatagagaggtggtagatcatgttgaatcagtttcacctgtattggagcttgaagaatcaaaggaagttgcttccttcattaatttgccagctatgtcagaaccatctgttcttttgtcagaagtgatgaggttcaatatttatgcatcttttcctgttcttgccaaaggaatgaactgggtcttgctatacaggtttaaaacatgtctgttatttaatatggtatgactatatgcattagctaaagtctaatgtttgcgttcacaattgtgcagcacatggaggcatggaatatctttgtctactctatacagaaggagcatgctttgccctggttactctctcttggtattcttcttctgtagcttgaagctgtttgatttttatagtttaactggtactccaaggccagcagccagtgtgccaatatacatattgaagttccaaatattcttacgtgggtgatactgtgatagcactttattccaataaaattctatggtttaaatatcggtctccataattttagctcatgttagttcagtttttacaaaacttctttttttttttgtttagtaataataataatattttccctaacaggtagttggggataaagaaggtgcagtttttggcggtttagttgaggctccattgcagccaaccagtgcaaagaaatatcaggttccacctacacattctgaatttctgataccctttttttctggtttaattaccttatgcagattatgatggaatcttaatattgcaggggagcaatagctgctttgttttcactaatttacacagcaatcctagtatatatcgaccgactggtaatatttcacctcctgttttcatgttctttgcataagaacatcaaaagctgcgaaataattttgttccatttgaccctaccttccagactactagatgtatttctctgtgtagcagtgacttatgattgtttttgtcccctgattcctgttcaatatatataacactagcatactcctacaaaaattctgggggatcaagttgctgaatatattactgttaacactagcaaagacttaactcaggagagcccctgagcattcatttctggtattgcaggtgctaataactatttcacagtgtgctccaccgactatttggcattaggaggtggaggtcatttcgcactttatctagatgccgacctgtaatctcccacctcttaagcatgtctttcacgccgtcaaatctgctggttttattgccttttgtcattgatagctctcatcttttcttctgggttaccctttttcaggttgagtggttcaagttccaattcagagacttttaacaacatgtgtttatctcattccccagacttcgcggtaaaagatgtcgaggtatctaattgtgggcttctggctgaatgctatcatgttcatctgggatgcagatatgtaactgctgttttctttgcaatgcagctgtggggtttcgtctatccttccaagtacgatgagacgctcgccctctgccgtactgagaaaccaggaatttgccggtggtgatttggtggtccttgaaggcttgaattgtgctgaatctgcgaatgatgcatctgtacagtttttcgtagacttgagagaattttagtgcacaggatcgtgtaggattgtaggagtgatggaaacttgcgtttctcatgcgagcttgctcagagctgtacatatttgtaattttcttgctactgttagcgaaacatggacgcgctggttatttgtttcagtgttgtcagcttgtcattatatgagaacaatattactggcgaatcaggagataaatgacctgcaatctccccatgcctctacaagaaattgcatgcaaaacatcactagaactcgcaaatcgtgtgaccgttctaggcttctagcgaatcattttaaagcagctgaggcgcagcgataactgttagtgctagctaccattaaccactgtttatagataaaccaactgaagacgattacattacatacggaaaacgtaaatgacatatttatccccttttatcagagttattcgaatcacatgacgcgtgcaaaaggataactgacgcgtgcaaaagtataactgtggctgcgttttataatacgatcactcgatcagacatacgagagggcaccatcgtatttcgcttctcaagtcaagctcaggttttgaaggaacagatggaatttaaagagcttgaatatgttattgaaatattcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49814 - DNA, 1147 bp, Oryza sativa
tattaagcctaattaatccgtcattagtaaatggttactgtagcatcatattgtcaaatcatattgtcaaattatgacgtctcttctaggcttttacaattatttctgataattccaattaaataacaatttatatttttgggatttttagggtgtaacaatattttcagccaaatagtgtccaaaagacagcacgcgctttcaacggtcgtcggaaatgtgcatccaccaactcctccaccagcaccatagccattctccacgacatcatctttctcacgccaagcatgcgggattgagcactgatggaaccacaaggatatgggtaaggaaaaccgcgtcactgcggtggaatggttggagaacacaatagtgtaaacattaatttctaccgtgagaaattaaaagatacagggaaagagttgaaataattctgcaactaataaacgacttgtagattggaaaagcatcacaaagctacaagagattaagaggcacgagttgttttcatgggagcacagaaaaagtcaaaaaccgatggtcgtctggttaaccatctccgtcaaagtatttatatcacattatgactggagaattttaagagaagtttcactaccatagaattgttaatcacatacgcgtgttaatgtcgaacatatatagtcacaaaaaatgggacggaaacgtcgtccccgtcttcagaacgtggggacagttttgtccgtgccatgtaaaaacatctcacaagtgccataccacgttcattgaccacatcgaatcaggattttatgactataatgtgtgtaccttatttattgaacgaggaactttatgactattgtcgatccggtcgccccgcttggccagggtgaccggcgacgggctcggtcaatgccggcgccactccacggacctggcaggggggtggctggcggcggcgatggtgacggatgtggcggcgaaaaagttggcgacgacggcagcggactgcggcgcgtgccgtgacgccttcctctatgacgccggcgacccgcactgcgcgctgcacctccaggtccgcgccaccctggccggatctggacggctggcggctggcgacggtggcggctgacggtggcgactggacgtggtgactgacggtggcggc

SEQ ID NO: 49815 - DNA, 2823 bp, Oryza sativa
  unsure (1)..(2823): unsure at all n locations
ttgagtaaaggccgggatattatattctattatctgaagaaaagacgcagatgtcagtaggtctacgtctatgatgtggatttatcgtaaatgtgaaatgtaagacactaatagaaaaacgatttttcacaaagacgattacaatttttataggctgatgttatttttagctgtgaatatgcatgcgaagttatgtagagaaggatctaattttttcccgcttgcaaaaatagatatttttttactaacggacaacttaaaaggagccacctatgataatatttttatttttgcaggcagatctcttccacggcggaacaacccaaaaaaataaattttcaatttgttcttgtccccacatctccccaaccactccctatctatccttatcttctcctctacccctctctctctactagactatcagacttctctcattctcctctcaccgtcctctccctagagcgcacaatccctagagcgtacaaggaggagggctggtggcgggtcggcggcatctcggcgaggaggaggaggagatccggcagcggcggcggttcggcatggcgaggagggcagggtcaacgaggtggtctggcaacggcggctcggcaaggaggaggagggccaatggcagggtcggcgtggctcggtgcggagaatgtcctgcaacggtggcggctcggctcggtgagaccatgaggaccggcagcagatccagagttcctccgttgttcttctttctctagatctagatctgtaatttctttttttttctctttatttctgaggactatgtgaatcttgtttctcatttgtacagtgacatttgatatgtgaatcttattcttctcatttgtgtggtgatatttgatttgatttgtactgtgcttaatctgtgcaaatggtagctggatggggatatttttaaatatatttttttgcccaaaattatcttcgtaggcggtttgctttagatgtccatctacaaaaatctcatttttgtaggtggaccgcttaacgaagctgcctgtgaaaatgatcttctttagagaatgctaggacaacatcaaggcggacgtgttcttagtcttcaactccattttcaatctcagatgtgccaacctgagccttctaaattcaacaaacatcatcttgattccaaatattttaggccaatataattagcctgattcacaacattgccagaaatcctctctaagctgttttcgatgagactgaggcccctcatgaaatcccttatctctgtcaatcaaagtgccttcataaaggggagaagcatgcacggcaactttctcttcgtgagaaacattgcccagagatatcaccgcacgaaagggccagtgctagttttcaaacttgacataatgaaggcatttgactctgtctgatgggactacctcatggctttgctgcagcaacgtgccttccctccaagatggagaaactggttgggggcccttctctccacctctacctctcaagttgtccttattggtatcctagtgcacaggatccaacattgcagaggactccggctaggaaatccgctctctacgcttctcttcatcctggcttttgacccgctgcaaaggatcctcggtaaggctactgagctaggcgtgctcacaaagcttcgaggtagaatggctcgccttcgaacctctatgtatgtggatgacgctatcatcttcgtcaacccaccgcgagaggatgtcatagctcttaaggaaatcctatgacgctttggctcggccaccgaactcatcaccaatctccaaaatcccaggtggcggccatcgatatgagagcattgatctagagggagtccttcagggcgtcccagatgtgagagcgcacttcctgcttaagtatctgggactccctcttatcctcgatagaatgaagaaggctgacaaatagattgttgggcgtgtggcgaactagaggggaaaaaacatgggcctggctgggaggaccacacttgtcagagcggtgctaatggcatagccaatatatttattgacggacctaaaaatgtcaaaggacgccttggagcacctgcacaagtagcggcagcgcttcctgcgggctggcacttggaacatcatcagagagaaatgcaaggtcaactggacaaatacgtgcatgctgaccaggcagggaggcctcggggtactcaacctagaaaatttcaaatgggctttgtgccctcgttggctatggcatgagtggaaagacccgagcaagccgtaggtggggctggagacgccttgcgatcaaatagataatagcccttcgctacttcaacaaggataaccgttggtgaaggaaacatgacgtgcttctgggactccgcatggataaatgagcagaggccgagagatctcatgccactagtttacgcaatctctacaaaaagagggaagtccctacgccaaggaaaggaaaatgatgcttcggtcggggacttggccttgcagtcaaacccacaaatcacggttgccttctctgaccagcttgtggccttatggaccgcagtccgcggcgtgcatctagatgaggaagagtctgatcaaatttcttggaagttcacagctcacgaacagtattcaacatcttcggcctacaaaactcagtgccacgctacacctgacaccttttgacacgctgatatggagagcatgggcaccggggaaatacaaactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49816 - DNA, 2431 bp, Oryza sativa
taggggacggcctggaactaataactagtagctagtactactttcgattttgtttcgtcacagtctgacgcctcacgagttgtatttactatacctttggttatgtcgtgcactcgtgtggtagtactgtatatatagccgtttatcctggagctaggagatcgactgactaggagacccgcgcggtcaactacacccgatcgatcgactggtcaactactaggagaccttcggctgtgttgggttgggaacctctcctccgcacgcaaaacagagcgataaattaatgcatgattaattaagttttagagataaaaaaaacttaaaaaatggattaatatgattttttaaaagcaactttcctatagaaattttttgcaaaacacagcgcgtggaaaacgagagatgagttgggaacttagtgaaaagaacacagccgaagtgttgtttgtggtccctcaattgagttcaattttttattttattttttgatcaagggaaaccagcacgagagtgtcattttcattaaatatagcgggaagctatacaatatacaagaggcggtataagctcactcatgcgctttgcagccgccagaacccacacacatgcttcttcttttattttggcgatcaggaaggacgtagcggccttcttatgctcaaagatccaccgattgtgctcctgccaaacttcccagacgatgaagaggataagggtatgcaaccccttcataggaatgcccacaattgttgctatcattttgcaccactcttggaccgtatgagtgtccccccagtgttgaggctcgagttattggtactccgcccaagaagctactaggctccagatccttttggtatatctgcattcagcgatgaggtgcatggctatttcatcctctcttcggtagagggggcactatccgttattttgccatcccctgatcgcaaggcggtcagaggtccataccctattcttaataataagccaagcatatagtttgcatttccccggtgcccatgctctccatatcaacgtgtcaaaaggtatgtcaggtgtagcgtggcagtgagctttgtaggccgaagatgctgaatattgtctgtgagttgtgaacttccaagaaatttgatcacactggaacgggatcgcttatctgtgacgggctgaaagcatcatcactatcgggtaaggcccccgtcactgggcaaaggtcactgatgtgaggaaaaatctcaatcgggctaaagcccgtcacggatggatgttatctcactcgggccgaaaacaaagcgcgtggaaaacaaagcccgaaaataaatatctatttttgcaggcgggaaaaaaaatagatccttctgtacataacttcgcatgcatattcacagctaaaaataacagcgcccgtaaaatttgtaattggctttgtgaaaaatcatttttctagtagcatcttacatttcacatttacgataaatccacatcatagacgtagacctattgacgtcttacgtctattgacgtctgcgacttgattgagaatagtcataaagttcctctttcaataaataagtacacacattatagtcagaaaatcctgattcgatgtggtcaatgaacgtggtatggcacttgtgagatgtttttacatggcacggacaaaaatgtccctacgttctgaagacggggacgacgtttccgtccattttttgtgactatatgttcgacatcaacacacacgtaagtgattaattaacaattctatggtagtgaaacttctcttagaaatctccagtcataatgtgatataaatactttgagatggttgaccagacgaccatcgttttatgacttttctgtgctcccatgaaaacaactcgtgcctcttaattaatctcttgtagctttgtgatgcttttccctgtatcttttgatttctcacggtagaaatcaatgtttacattgttgtgttctccaaacattccaccgcagtgacgcggttttccctatccatccttgtggttgttccatcaatcctcgatcatcccacatgcttggcgtgagagaaagagagagagatgatgtcaaggagaatgactatggtgctggtggtggagggatgtggtggatgcacatgcccgacgaccattgaaagcacgtgctgtcttttggaggtcccgttcttaataagtgttggatgaagattaatattttcatggcacgtttttcaaactaataaacggtgtacaaatatgtttcgtgcgaaaactttctatatgaatattgctctagaatatcgtattaacctatttttcaaatttgtactaattaaaactcaatcaatcatacattaataccagctcgttttgcgtaaaaaacttaatcttcatcttaatctttatctttaggataaaagaacactgcctat

SEQ ID NO: 49817 - DNA, 1209 bp, Oryza sativa
cttgctgttgttcccccttttcagaagtgtagtgcttctgagctgaagacaaagttagaagaccaaggctcagaccccagttgagttttgcctgtggagtggagctgaagccccgctaggatcgcctttttccgctgctgtcgttctctttcggtgtgaggactaagtgcctcttctgtaagtatttacgctttatttacgtttggaactgtttattacttatcgtttatgtaccatggctggtcctggacagggatttaatacacaaaatagtctggaaatttgggctaaatttctaggcgttacaaagtggtattagagccaactcgactgtaggttgagccaaatggtcaaatcctaaggacaagttttctgaaaaccctagttgtgaaatgtctcctctcttcctccggcatttctttgtgaaacggtttctcaaaattctcctccctgcctctccaattcttttagttgaaaaaccaagaggacaaaccgccagcttcatgtatgttcagaagtcaagtcaagtcaagcctcaagcttcgtgctggagcaagaagatcggtcagcccagagtcttcgttctgcgaaggtcaagtgaagtttctcccggagctgacctaaaatccaatctttcccggaatagtagtttcgttagcttttagatcgtgtgttgtttgcttgtgtgtaggggtatggtttgcatcattggtggggatgcaaccatactaggttgtttgcttaagcaacttgaacaatataagtctactcacaacagatcagtaggcaagtggtttagtaccttatctttagcaacccccctcttctatctctcttccatcctggcagctgatggtctctttagcaacccccctcttctatctctcttccatcctggtagctgatggtcagtgtcagagagaagatcaacatcaacaacggtgcattaaattcatagatcaatgggtcagttgaaagcaacaaggtaccccaaagccagaagaacccctgctcgtgatcaacatttggtatccaagatcagatgatgggtgtattgatgtaggagatgcaaagctcgacgcaaggtaaaatataagcggaagtaaccccagcattgtgttgaggtcagagctactggatcagttcaagacaacaagcaactagctgagtcagagcacctcgctctggtcagattctggttagccaagg

SEQ ID NO: 49818 - DNA, 853 bp, Oryza sativa
cagtttaatacatttttactgctttccaaccactgttgagtaaccacgtccttcgacgtatgcagttgtcatttcgacaatagctggcgccgacgttggggacctccgagcgaaaccactgagagtaaatggcaccgaagagggtcgtgaaggagaaggttgcaaagcgaatggggagtgaagcaggagaggagatggccgccgaagagggagccgagccttcggcgccatcgttgaaactgggggagcaccgtcggcttcggcacctgcgccgcaaccgccaccttcagctcttgccacttcgtcagggctggtgccaaacacggtcgacgcggcgaaggcagctacggcagcaagggcgctccagatcagggcagagatcctttcgacgagccagctgctggtgccccaagccgcttcgtcacagctggcaacagcttcgaccgcgcttgccgctacgcaagtcaaccccagcctcgaagcacaagccgaagccgacatggaggccatgcgccaaaacatgacccgactccaagacatgcttcgccagatgcaagaacaacatcaagcgtacgagacagcacggcaagccaaggtcacttcggccccaatcctccggtattcggcaggctacattccaccccaagcctaaccgcaagcatcaactcaggcccttccgccacaagccatacaagcgccagtgtacttcgctgggcagccttcggccgcaacggtacacccgacccctcatgtacaaccgcagttcggccggtcgttgccaaagtacaccctggccaaatgtcacaagcaatggcggaaggggcctcggctttgcaggcacagcttcaagctt

SEQ ID NO: 49819 - DNA, 754 bp, Oryza sativa
caagtccatgatggccaggtctgataatgacacgttagtcatggaaaatcaatattaccatgggcagacataccagtttaccgctgcagttacatacaaagggaatgacaggacaatttccaagatcttgagaagccttgtgataatcgatgtctccggtaacgcattccatggtgccatcccagataccattggtgaacttgttctgcttcgtgggcttaacctgtcacacaatgcccttacagggccaattccatcacagttttgcaggttagatcaacttgagtcattggacctctctttcaatgagctttctggagagatccccaaggaactagcatcactgaattttctttcgacgttgaacttgtcgaacaacacgttggttggaagaataccagactcatatcagttttccacattttccaatagctcttttttgggaaacacaggtttgtgtggactaccgttatctagacaatgtgacaaccctgaagagccaagcgctataccatacacttcagagaaatccatagatgctgtacttctcctcttcactgcattgggatttggcatttcttttgcaatgactatcttgattgtatggggaagccacatgagaaaacgacactgagagtactttgtgtatgtatacaactctagcagtattgagtgaggccaatattcttaactgaagctatgaacgttctgatttgagcaataatcctgggactgttgtaacatgaatccctat

SEQ ID NO: 49820 - DNA, 3122 bp, Oryza sativa
acagcatggcaccgacgtaaacagtaacttgaccaaactctgaaggctctcctgggcaaaacgtcgaacagggtgcctgcacggtaaggcttgtcaaaattgggtaggcggatgctacaacccggcgtcctgagcacaaatcgatcggccgcaccacaccactcacatacctctagcctttaggcggaagatgattgctgagttcaggtgatatcagatcgccgcccgcaaatctcattcgcttcctgtggcaagcagcaaatgcaggagctaatctcccatctgtcacgcgggagagacctcccactcgttctcccctcacctgccgcgccttcgtggagacgacgagtccctctcggcgcccttctcccgcgtccgtggtccgccgccgctcggagggttcgggctcggtacgaaagttgttttctactccattcgtgtagctcgcgtggggagtggagtgtgttctttttttttttaacggaaaacagcgctagtgtgctttttcattgaatagagcttgagaaaatacaacccctaatgataaaaaaaaaagtcacggtaagctacacacgaacgcggaataaactgcaagggcctagagactagcctcctctttgatcttcgttaaaaggaaactcattgccatctctttgtggtcgaaaatctgtcggtttctctccttccagatctcccagacaactagcaggatcagagatcgaagtcctttttctgggacagcggacgtgtttgctaggttctcccaccactattgcacttactgggccttcccattgacctggttccatctattggtagcccacccagctagacacaaggtgccagattctcttggtgtatctacacgtggtgataaggtgcaaggccgtctcaccttctcgccagctagcatagggggcattggccgttgttttgccaacccctggtctggattttgttctagaatgctgagttcggcacccagacctagagttgggaacttctcacgagcacgctttttaaactgctaaacggtattttttttaaaaaaattatatacgaaagttgttttaaaaaatcatattgatccattttctaaaaagaaattagctaatactttcacgcgctaatatatcgctccgttttttttcgagagtgattcttctttagaaaccatgtgttaacttaagaaattcggctacagcgcaagtgtgaatcgaaatgacaaaatagcacagaaggcaacatttgtgtcttccgttagacttgagttgggcccacatattggtaaatgataccgtgaaatcaacagatttgttttgtttccttgtggttaaaaagggtctatttctacagacctatagtgtttcctatatgcgtactatagatatcttctgtgcttttaaaactctcactgataaatactgagaactagtagaacctctggtttctttcaataaataaacagtccgcaatgggaggaggtggatcaataatgtgttcagattttgattagttccagaagtactatgctgaattgatctgttgatttttcacatgttgattactgatcagttggtaaactctgaatttatgtgccaaacatgcatgccatttaacttgcacaacaatagagaccacaaacaaagaacaaagtgatataatataatgtagaccacgaacttctctgaatattctcaacctagcattacatgtaggacagttgtcttccattaaccatgatatgtaattcttgctgaacggagctgctatgctgctcttggagaagcatcgccggctcctgctcccagcttcactgccttgagcatccgcccagtttagtgttatcaaagcaacaaatatatgtggcttgaggaatacatcccaactgaagctcaatacataaagaacatagtaaaaatggtgtaaaccatatatatacattatttctgcacacggtccatcacttattctgcttttcctaatgcctgttcagttttaagcaattaaaaactgatatggcaaaccagaacatgtcgttcttcagttgaacaggggcagatagcggagttggtgctgccctcgacctccttcagatttattgacgcctctcggaaccgggttggtgacgcgtggggatgaacatcgcctgaaagcggtctccgaagtggccaccgccgtcataatcgggcacacaccggaggaatggatcagagggcgctagcggagctcttgcccgcgcgcgcacggcggcgaaacggggtgacaaatgatggacaagaagttggggaaagaaccgcctatgagagcggccgccggaggccggagcagattgctgcgtgcgctaggatgcaccgtcgagtaggagagcgatacaacctgatgattaatggatactcttctttactctttttcatttacgaagtagtactgataaaatcatactccctccattccaaattgatctacatatttcataggtataccaagaccaagaaaaactaataactctctcatactatatttactctagcaacaaactcgatgcatgcactatccctaatatttcctagccaatagcaaatcaagatattgcatgtgggttataaatacttgtgtgcatagatgtatgcatcaatgtccatttactctaatgcataaataacgagacttaatggattaacacaaatatgtagatcatttaggaataacctcaaaaaaactatatgtagatcaatttggaatggagggagtaaataccagcattaccatgatgattattattaaagtacttatatgtccttacgaaccaatggtctaaattgattctactgatagtataatactactagtagagagcttcctttattcatgggcttccgatggattatgctggctgggccgctggggaattttcgaaattttaatggaaactataggacaaatacggttaccgacaaaacggtcggaaaaacctccatcccatttccgctaccatttccgaaaaatattaccgtttccatttccgacaccgacaattactgacaacgactgaaatggtcggtgcaaatcggaaatggcagccaaagatcttggaaatttctataccattttcaccccta

SEQ ID NO: 49821 - DNA, 1584 bp, Oryza sativa
ccaaatctcaagcagtcaagacaaagaggatcaaatatctatggctcgatttcaaaggtggcaaaaacatttctcgaggtgctaattttcaaaggatttccccagaaagctcatttgacgagaggtctaacaattcaagttgtttcaagttagcaaactgaactgggattggacccgtaagagcattatgagacatgttgagagcacgaagcaacacaagttccccaatgcttctagggattctaccatggaaagcgttatttgagacatcaatgagtacaagtgttcttaaggtcttggaaatcgtcaggccactacctttgtatgagattccagcagtgaactggtatgactgcatcttgccacggtaatacagatgttggtctctcattaacatatcattatcacacgtgtccattatcattgatttgagcatcttgaaccactcttctggcaatgtgccactgaggttgttcgatgacatatcagcaaactgcagtttcgtaaattgacagttgtttccacctccagtataagaaggatccaatatctgcccaatgaacttgttagacttgaggaccaggacttgaagttgaggaagtttactcatccaacatgggaaagagtcactaattttattgtttccaatgtcaaggatctccagattcctgcaagcgaccaaagatcttggtagttgtccttgaatcgaattgccgctgaaatctaatgcgcttaatgcacaaccttccttgatattatcaggtaactcgccggtaagatgattatcctttagacttagcacctgcagtgcatctgcatcctccatcagacacgatggtattaagccagtcaaattgttgttagagagatcaatgagttgtaaactcttaatcctatcacagatggatggtggaatgtttccagatatgctattattggaggccttgaaaaggacagtatttgataggtaagtagagaaattgagaggcagagatgagaaccggttgttggagtaatcaagggtgacacttccttcttttggtataggtattaccccttcaatattgttgaaactgagatcgaagaattcaatgtaaacaggaagcaaagggtgatcagatccaatactcgtaaacttattatgtgataggttgaacaaggcaaagcctaggttcaaggtcttccatgcccacagaggtattgctccttggatttgattatacgaaagatcaagaaaagtaatctcatggagatgctgcaagatgttagggaagctagatatactgcaagatgctagtcgtaacaagacaatactagggtaggacactactgaagaactattttcaccatccatcacaactagtctattatttgagagattcagggcagagagattttgcattttggagtacgatgatagctccactgtgccaactaaattgtttgaatggagcaggaggtattgcaaatgagtcaaatttaagatctgtggagctatcactcctgaaaagtggcaattgtacagtgccaattttgtcagtttttttaagttccctatggaagctggtattcactactacagat

SEQ ID NO: 49822 - DNA, 1199 bp, Oryza sativa
ttgtcatcagtgacgggtcgtaagttacaacccgtcagagatgagtcctcagtgacggtcaggtagttacgacacgtcactgatgactcatctgtgacgggtgacaagttttaacccgtcagagatgacttatataccggtcagagatgggttatctgtgacgggtgtttcatccatcacagatgattttgtcatcagtgaccactaatcactgaccaagaccaaacccgtcacaggtgagggtttgggcccgtcaaagatgacctggtccggcgtaatgattggtccggacaagccacatctgaagaacttgataacagtaagagaagtcaggtttgagatccatgatggtatggatcctactagctctaacccatacacctctatataaagacaaggatttcagctgaccaatggaggagggcagcactccagagaaaccactagctccaagagccaactccttgagagatctaatgttgctgatagaacctggaattgtccctgaaaagttggtgttgctgacagataaactctgtgagctactgtcacctgagaaactactaggcaaatttccggagattcctagatgtttggtgaggttaatagttgtaagtttctcatgctggaagatgatgggagggaacaccccttcaaacatgttatttgaaagctgaagaacactaaggctggggagtgcagccaagaactcaggaactggaccagacaaatgattgtagtgcagctctatcactgaaagtgatcgcaaggccgagagcgagtggcaaatgggaccggagagtgagcagtacggcatgctaatgaccctcaactttggcgatgacctggccatggcgtcgcaccaccgtgcagtgccgtagttgctcgacatgttcaccatcaccatgcccaggcgaagctcctccaggttggtgaggtttgcgagcaaggtctccaagctcggctccgagagctgtgccattgtgtccgagtagtagtacgtgatgctgtactcgtcgtccaactcctctacaaaaaatgtcgtcgacaggtcaagatagttcaggctggtgaggcggccgatgccggcaggtaccagaccagcgaagtttgtgttggagaggtcaagatgggtgagtccggtgagcatctcgaaccctgtggctgggagcttggacttgctgaagtcgttggaagag

SEQ ID NO: 49823 - DNA, 3514 bp, Oryza sativa
ggatttttgagagggaatagttctgcaccacaatagagtgcattaaatcaccctccaaatccctctctattctctcgtgggagggattaaacgaagaagattagctttaatcttttcttgcctaacaagctccaccgaataaaaaacatgatgagccctgacctgaaaggcacataactgaggatgggtagcatggctaaggctttgttttaagattaattaagtattagcctaaaaaacttgaaaaatagtttgatatgtttttttaaagcaacttttatatagaaagtttttataaaaaaatatatcatttagcagtttgaaaagcgtgaacgcagaaaacaagtaaaatgagttaggaaagaggggaaaagaacatagtctatgactagcagaggcatgagatggtaagcaactctcattatggaggacaatatgttggaagatgactgggtttattttgttctcaactctatggtacacatgaataaatacatctacttatctactcgatctatctagttattcccaacatccgttttagtcaaacctttgaaacctcatgatttttttaaagacttgaaacgcgtttgaaaatgatgtgtatatatttgtgttgaaaaatatatattttctacgatatcataattctattggatttataaatataatctatctatctatttatctatctttatacctctatactattgagcacattttttttactctcacgttaaccagaaaaatctgatgactactgattagattactcttattatgatgaccctagattaaatatctcacctaacgggtcaactttgaaggcccaatcaattcatataccaactcaacctctatgaataagggtcagtcctgagatttcggtggtctagggtcggtcctgagaagtgatatccatataaaaaaaatcaaacatattggccatttgtaggtgtgaaatcattgatgataagtatcactatcatctgtatttcttgaagtatctattttactccttaaattttaatttatccattgctcaattagcccaattactcgttctttttttaatgtatactttctcgaccacattatatccatacgggcaaattagtgaaagggaacattttaaagttgaactcatagcttaaggctatagaagtactgtattaattcagaaaaatataaccaacaattatattaaactcacaaatcgacatagtctgtactatttaattaatttgtatccctaatttatcaattgaccccttgtaattatgtaaaaaaaagataatctcgagctagatgacagattgagattgacagaaagctttgcgtacttaccaccgccaccgtcgaccttgtccctgccgccggctgttccctcggtcgcaagggatggggttctaattaatcgacgttccgatggtcaccctcgatcttgatggccagccaatggcgcagcttccgctttaggtcgccgagaacaccgcgctacgtatatacacgccttcctcgccagctactccaggactctgcctccagtactgctcctgctaccctcgcctcctacgcctgccgttgccaccatagactagcgtcgaagcgtagcaagaggattgcggccaagcttgcgctcgccggcccgagtgacatgaccttatgtgcgcagcacaatttgatgcgcaagcttgggttggtgcctgagaagggtcatgtgttggccgaggctgttacggcttacaacgccctcttctcccagcccctccctctggatcacgccatagccctatcttcactcttccccagctccctgcctccgacgcaggctggagtgtagtgggatccccaaccccaccatgcattgggataggagatttttcttttttagtagcttatcttctttgtatttgttttttttttcttttttcactactagaggacccctcttctatcccagttcgcaacctcctttacttccgggtaacgaaccaggagaaagaatccaggactaaagaagccagtctttagtccttgttcaaatacctgggagtaaagattcatctttagtcccggttggtgtggcaaagccacatcctggttggtcccttttttccattgtttctttactatttgctagggttaatccctgtatttcctccaaaatcaagtgggttgcatatcccaaatcaaaccctaaatccccaaatcaaattaacatcccaaatcattcacatcacaaatcccaaatcccaaatccaaattattcacaccacaaagcctaagttacttatacaaacaaattaaatacatcataaatccttaaaaaaattacacacaaatcaaatacaccacagattatacatctcagatccatgcaattaatcacaaattatatataaaaaaagaaactatacatcacaaattatcaaaaaaggaaaaaaaagggacgccgcttggccgcctagcatgcgtgctggccaccgctcgccatggccccgccggccgccgccgcctgccactggccgcctgccagcgcacggccgcgccggccgctggccgccggatgggaggagaggagggggaggagaggggagaggaggaggaggaagggtaaggaggagaggggagtggaggaagaggggatcggatctgagaggaggagaggagatgatccgatcttatctaaatactttgtctgggacttaaccgatcagatatgggagtaaatacggttgaagttaccaactgagactaaacataaatctaaatacctacattagtcccggttggtactaccaaccgggagtaaagatcctcagtcccttgacatgcctctgacatgggatgaaccgggactaaaaatgatctttagtcccggttggaaacatcgactgagactaaagatcagaatttttttaatcgggactaaatttagccccgattctttttggaaccgggattattgtagaaatcgcccgaccctcaaaagataacttctccagtagtgtttccttgacccctggcaacagccttattaccatgtgcgttgtgtaatcaaattttactctcatcttctaatatattgacgtacaatcctttttgccgggatcccagcaggcagcagtgccatgattggtgtttatatcagtggcgagatcgattcaagcattcagcccagcacagcggccagcaattgatgcggcaccggcgacaccaaacgtgctcatccagcacgtcgatcgtcgatataagtaagcatgcgggcatgcggctgatgtgctgcgcgcatggcgtcaccaaccagcacggcagtcgtcagatgagatcgatactcgcacgattgcaaaatcatggagcttaattaggaatgccccctcacgtgtctagcggcagaagatcgctaagtagtcacacacctaggaatcgggggccagagcggtcgccccgctcaggccaggcctatgataaggtcccatctcgattttccaggattgttgctacgagggga

SEQ ID NO: 49824 - DNA, 3568 bp, Oryza sativa
aattaaatagattaaactgactataagataaaattttcattggtaataacgaaggttttttgattttggaaagtatgggcttgtttggtacggctccaactcctaaatttagcttcatgagttgggtttggagtgaagttgtggagatgcctaaatccagctctataactctagtccattttatgatagagctccacccagctccacttctattttcggtggagctgaaactgtttgtctgagcttcagtagaggtggaggtggatttgtgccaaacaggtcatatatatatactagaaaatcggtgcgccggttggcgcacttgttttatagcccgtgtatattgtttatatattattaagatgcattactttcattctattaaacaggataacatcatgcaatgtgtacagttaaatatcaatatcttaaattattaaaatttgaaaatcatattagtagattttttatgaaaactctttttatatagttgtatttttattatctttgatatatgtatagtttgtgaaagttatgataaactttatgtattggagagtgtgtctaaattgacattattttgtttcccaaaaaaaagggcattcattttaagaatgtaggatacattttactgaattttataagaattagttcgattttcttgaaattcatgcaaaagctgaacaattaaataaacatttcattattttttttcaagtgcagtttaacttagcatatcacagtactatatggcaattttttaatttttctcttttcccatccatactatttagggttatttatttatgaaatgttataattgagttatctattagattataaaattggtgatgaattttttaagatgtttcatattttttttagagctgcgatgctcatcatttcttcctaacacgtactaacaattttccaaattttttttcccaaaaacatcacatcaaatctttgtacacatgcgtggagcattaaatattgatttaaaaaaaaaactaattgcacagttaggggataaatcgcgagattaatcttttgagcataattagtccatgattagctataagtgctacagtaaaccacatgtactaatgatggattaattaggatcaaaagattcgtctcgcggtttctaggcgagttatgaaattagtttttttattcttgtccgaaaaccccttccgacattcggtcaaacatccgatatgacacccaaatatttttttttcgcgaaagccctagtactccactgaagcctatacatctagcttaactatcctactgagtaactacggtaggtcagttgctatttttatagggaactatgtttattttattaagtgtcgaaacatgaattcggcaataataaaagggggtagcgcacgagacctaaaagtggatggatgtggagacaaaggattagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatacatataagttatcccctataactagtcggataaccatgccgtgtgggtatggggtacccataatctccacagtagcccctgagaccttcacagtcgaaaagataatcttctctcgaaccagattactccaaagccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggcttcgataattatagttaatcaagcgacttgatattaatatgtagcatatgcggtgtaaatccctgaataacatgatccgagtgatataccgactgctttgtaaaatatgatgagtgtaacctaaagttggctacattattgaaaattcacatagcaaaacagctataaaaaagctagtatgttgtgaataaagaaatttccaaagtattgggcatacgccatgcgcacactgctttaacagatgtgcttaagtccctagaagacacatggttccaccacacctggaaatatatgacatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttataggatgacgcatgtaacatgctcccgagtaataaatcttccgggtaatatagaccaagtgtagctcatatgaatagcttctgatctgagtgattatcccttatgggataccccaaaatagatataaaaattgaatcccgactggcgcaagtattcggttgataacccttacggagaataataaatagtccagtctttgagcatagaaaatagacccatgatcatgaattcatgttgcatgtaaccggaacaagtccaaattgaaggtatgatacttgtgtttgaactagtaagcctctgagcatatagcttgtccttctttgtagtcacaattgtccatcgatggtagctgacgcagttggcatagagacaagacgaccaatatagagataatattgcccaccagaggtggcaaaaatattggtggtagtgaagatagtgataccaatcaaaagtactgaagtcgcatagccatggaggcgaagaaaccagtcggcggcaaacagatcaactaacaatgaagatgaaggcgcccagcgataaagttgtgtagccatggcagcgaaataatcagtcggtgacagacgaggcagatcaaatgcgatgacgaaatccaccaatcatgaagatgaagaaaatagttgacgatgacaaacgcaaccgacatgatgaagatgacgatgtcgatgatccagtcaatagcagtgtagcaaccaatgctaatgacaaagacgctcatcagcatttgcatagtaggtcaaccgtgaaggtgaaataataagtcggtgaa

SEQ ID NO: 49825 - DNA, 716 bp, Oryza sativa
aattcctgcagccccccgactctttgtttagttgggaaacaactgaacatagagtcgagaattatagcttcttatcgtcgagtagtcattgcttgattgaagatatgtgttgaagatgtccaagtagaaatcatgaatgttggagagccacttgttgtagtaaaataacacggcatcgcatgccgagatgtcgagattcacaacaacgtcatggttggtgatgtagcaaaacttgtgaagtagcagcaatagagtttgctggtaccgaagataataaagatgaagtcgctccaccatgatgacaaagttgtgttgccgtgatgaagtgaacacgagtcggcggcaacagaagcaaaccggtagtgaagacgcgcagttgtgaagataaaagcactagtcggcggcggcataacacgagtcggcggcggaagacgatgatgtccatcagtagtggtagctgtataaaccaaatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccatgcaggcggtgacacca

SEQ ID NO: 49826 - DNA, 1343 bp, Oryza sativa
ttctgactgatccattcctgcagcgtaagagataagcgtaaagccatgaatcccttttatgcatatctggatctggatcctgcagaacaaacatataggatgagtagtatctgatataaatataatactcgagaaaaattcaagcagtttataaatacgtatttcttctcttgttaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtaatattccctcggtgacagcagaagtagccgatgtgggaataaagcagtccatcaatggtgacaaaaacaccagtcggcgccagtggaaccaagccagtggtgtagatgatgaagcccattaacagcggcggagtccgccaaccgtataggcaaaaacaccagtcagtggcggcagaggcaagccggtcggtgaagtcgtagacgcccaacagcggcggcataataggccagccgtgtaggcggaggcaccagtcggcggcgacggaggcaggccggcggtgaagtcgtagacgcccaacaacggcggcataataggccagccgtgcaggcggaagcaccactcggcggtgacggaggcaggccggtcggtgaagtcgtagacgcccaacaacggtggcataataggccagccgtgtaggcggaggcaccactcggcggtgacggaggcaggccggtcggtgaagtcgtatacgcccaacagcggcggcataaaggccaaccgtgcaggcggaaacaccactcggcagcggcgaaggcaagccggtcggtgaagatgtagacgcccaacaacggcggcataataggccaaccgtgcaggcggaaacaccagtcggc

SEQ ID NO: 49827 - DNA, 1680 bp, Oryza sativa
acctataaaggtgagttttcaatcttattaatccaacctttaacattattgataagctttcttatagaaaaggtatatcttctcaagtatgcggaggaattgttttcattgaaccatttatggtgtggtaaataaggagtgcaataatatactctctccattccaaaatataaggcataaccactcataacacaaaaccaagaaaacatttaatcaccttcttagtttggatcatgttgatacatacaaacaatgtgattgggaggtttgataatataagatttaaaacaaatcaattttataggaccaagatatgctagttaatgtatctatgcatgcatggcttatattagtatgagatatgagaaaaaagtggttaatccttatattttgggatgtagggagtaataaataacggctgtgtgctatacggtgcaggggctagtaatttttaaagaaagtgcaaaatcatataataactaacacagacaccatgtatatacgcgaatgaatgagatttttattttcaaatgtgagagcagaattacatcatagccagcactgtgtcaaattaatataacccttttttctcatctcatctcagtggtaattaaggcggcggacatggtacatatgttgggcttccgcacgcgggggaattgggcatccctctggtgatggccgtgggacgcacaccttgttgacattggcgcctctcccggcggcagaggccatgaccatcaacagcgtcaggacgaggaggaggaggacgggcaccaccagctgcctgccgccgccggtgctcgccgtcgacgtccagccgccggccatagctaggggacggcctggaactaactagccactctttttattttctttcgtcacagcctgaagcctcacgacttgtagttactatacctttggttatgtcgaatggtagtactgtatatatagccgtttatcctggaactgttgcgtgatcaaggccgagtttagttccaaactttttctttaaacttttaacttttccaatacatcaaaactttcatacacatataaactttcaatttttccgtcacatcgtttcaatttcaaccaaacttccaattttaacttgaactaaatacaccctaagttaaataaaatggaaaaaaacaagggagatcgactagctgcctaggagacccgtgcggtcaactacacccgatcgatcgactggtcgaagtgttgtttgtggtctctcaatcgagctcaattttgatcttccctcttccaaacagcacaggtaatactatttttttgatgatgcaagcttttattaaaatcggtctattacatcaagataatataatataactgcgcactgagaaggcttccgacttctacataactagaatacacgtaaccaaaacaaataccagtaaaagaagtatatgaagaattaagaaccatacactagtacggagagctctgacttcggtatcctgttgcatagttaatttcacaagactgaactgaccaactttgcattggaactgatgcaacttgaggagctggggtgctgcaaacaaagctattgatgtgatgacgatggcgccttaccgttgatcaaccttctgagaagtgacatgtcgtttatcttctatgaatgtttggatactttgcgagaactgcccttga

SEQ ID NO: 49828 - DNA, 1575 bp, Oryza sativa
gattaaactgactaattgctcgatgaaccaaacctgcataagcttgctgttctgttgcttcccatacactgaacggaccgactttgattagcctgaccttgaccagaactgctggtgctcatagaacttcttttctttggattgagttgctaatgctggaaatttcggtaacctgaaaattcaccatgctgaaaattcacaaacgcactcctcggtttcactattgatttcttcccttgcgaaggcgaaatcgaaaccttcacaaactttccgtggcacactacaaccttgggtgctcaccggcgacgccttgtcgtctaggagacttttgtccccaagagtaacaaacacaatcgaagatttgcttgctatgaactcgagtgctcaaagaatggagtgaagctcactaactctcaacttctcaatcactcaatccaactctctccccttctcaaatctttctcacaaagagacaccacaaggtagggagatggggatggctatttggctttggatatatctaatactccccaagaacagcagccactcaaaggaggggtggaggggtttatatacccgagcctctcaaaaactagccgttggggcaaagacaggaattttcggaacttccaaaaatttacagaagctaaactcagaagctaaactcagtttcgcagccattttcggaacttccggtaatttttcggaacttccgaaaagcacatagtgaaacgaccataactttttattcgggagtccgtttttgacgatcttggactctatggaaagctcacttagaggactacacaaatcaaccaagaacaaggtctaaaaccacttaaaggataggttaaagcttgggtttctctcaaggtagcactatgataggtcactttgatcaccgagacatacacaaacacatcgacgttgtatccctcttaatagtacagcattcctatactcaaatataaataggaagagaattataccagtaggaatgccttcttttccatttgctttctttgtcttaagggacgccaatgccaaaaccgtttcaccgtatattcttcaaatgattgatgcggttacttgtagcttcaaatggtctcgcacggtccatcatgacaaagccatcactcgcccttcaccaccggatttggttcttcggcgccaagccccttgcttgcccttcaccgttgcatggtccatcgcgaacgagcatcgcttgcccttcaccatcttgccatagtagccacttcgtatcccacatcttcaatatcttcgctttgttattcttagtgttttaggtgtaatcatatcacttgagcgtcaacaccttttcaatccttggaacctatttttctcattcaacttagtgaaattattagtctcaatgatccggttgtcaacctccacatgttgactaaccgatcgcatgtataaaaggatatgaataaatgatgagtattaatcaacaccacaagtgtcatatactcaaatatatgctcaaatgtaaagatcccaattaaatgaaagtgaataacttggatcaaatacatgcataactaaggcata

SEQ ID NO: 49829 - DNA, 981 bp, Oryza sativa
actcttttcccgcctatcctaagaaataaacccgaacatcaaaatgcacgccctttgatcaataggattttttatattccaatatgtcctgtctcgctacaggttttgatgctttatatagtttgtaacttgtacatatgagattacacttatgccctcattgggcctatgtaaagttacaattgtgcccttaacatgttagcaattccaagggcaatttagtacatctcgaaggtttttatagtcttttggtgccagctggatggagtggttgagtggtccccggaaatcttctcgtggcatctttattgctcgaactgtcttctccatgagaacgagcctttttcatggtagagagtcttctccttggcaagtagtcttttccatctcgaccattcgaccaccttttcctgttcacctagtgactgatagtttacctgtcattggcttagacaatactcaaaacagatctggcttagtaataagaaattgcttgaatagtgtttccaactcgcatagcattttaccatttttctgttctaatggcacttttccacccgtacacttacaatagaaactcactcttccttctaaatgtttctggcggataaggagggatggtggtgacccccaactactgcaatatatgcgtgcataaagccattaaaccatcgtccactacaaaactaagggggagagatggagcgaggaggaaaaatggagggaggcactaccgtgcggcggggcgcacagaccaaaggccgacgagccgggaataatctccccggcctctggcctgggaagaagaatgagagggcgcgccctgagtccccttccgcgttcttgctcatgccggctcctacgacacgcgcaacgacgaacggcgacaacgaacagagcacgggggcggcggcaatggcgcggaggcgaatgggagaggaagggaaaggggaggctggggtttataggatggcaatgtcg

SEQ ID NO: 49830 - DNA, 3712 bp, Oryza sativa
ggcgatgaaaacaccaaggcaaaggtaatccatctcgctttagatggcatcacccgttcttggtatttcaatttaccagctaatagcatttactcatgggagcaattgcgcgacatctttgtccctaactttcgaggcacttatgaggagccgaagatgcagcagcatctactcggcattcgccagaggccgggggaatcaataagagaatacatgcgtcgtttctcgcaagcccgatgccaagttcaagatataaccgaagcgtctgtcatcaacgccgcttcggccgggctgctcggaggtgaactcacaaggaaaatcaccaacaaggagccgcagacactcgagcacctgcttcgcatcatcgacgggtacgcaagaggcgaagaggattccaagcgacggcaagcaatctaagccgagtacgataaagcctccatcaccacagcccaagcccaagtacaagcacaggtcgccgaaccggctcctctcaccgttcgccaacctcagctggcaaaccaaggacagccgccaaggccaagtcaagctcccatgacttggaggaaattcagaaatgaccgcacgggcaaggctgtgatggctatcgaagaggtccaagccctccgcaaggagttcgacgctcagcaagcagtcagcaatcagcagcctgttcgcaagaaggtcaggaaggacctctattgcgcattccacgggcgatcctcgcacactaccgagtaatgctgaaacatccggcagcgtggcaacgctcaagacccaaggctgcagcaaggggcagctgtcgaagcacctcgcgaagccgcccaagaacaagcacccccagtcgaacagcgccaggacatccagctcggagtaattcaagtgattacaagggccgatccaccagttcaacagtcgaagcggcagaagaagatgcagctgcgaacggtgcacaacatcaccgcggcaggccaaggggctctgaggtacttgaactagcatatctcttttgggccagaagacgccgaaggggtgctattcccacatcaagaccccttggtgatctcggtcgaagtagctggcttcgaagttcggcgaattttggttgacgggggaagctcgaccgatgtcatctttgctgaagcatatgccaaaatggggttgccaaccctagccctcacctaggcaccagcctcgcttcgtggttttggcggtagagaagttcaagttttgggccaagtacaactggtggtagctttcggcacaagtgaaaacaggcgcgtagagcaaatactgttcgatgtcgtcgacatcccatacaactacaatgccatcttcggccgcgcaatcttgaacaagttcgaagccatctcccaccacaactacctcaagctcaagatgccgggcccaactggcgtgatcgtcgtcaaggggcttcaaccttcgaccgcatcaaagggcgatttggccgcaataaataggtagtgcacaatgtcgaggccgaaccacatgaccatgctaaacgaatgccgaagtccgcccctcatggcaaggtgatcaagatgcaagtcgatgacgccgatcccacgaatttttccagctagggggtgatctagcgaagaggaagccaagaatatcctggaggtgctcaagaagaacattgacatcttcacctggagccccgacgaagtgggaggtgtttcgacgaacttcatcatgcatcatctggcggtcaagccggatgccaagccaagggaacagaagctgcacaaaatgtccaccgatcaccaagaggcagcaaagcccgaagtgtagaagctgctcaaggctggggtgatctaagagatcgaccacccagagtggttggcgaacccatttttggtgaggaagtcaaatggcaagtggcgcatgtgcattgacttcacagacctcaacaaggtgtgcccgaaagatgatttccccctgccgcggatcgaccagcttgtcgactcgacagctgactgcgaactcatgagctttttggatgcgtactccggctatcaccggatccacatgaatccggccgacatcccaagacagccttcatcacgctgttcgacacgttctgccacctcagaatgcctttcagcctgaggaacgctggagcaacattcgccaggttggtgtataaggtcgtttacaaacagttggggcgaaatgtggaggcctatgttgacgatatcatcgtaacaagccgcaaggctttcgaccatgcgtctgacttgtaggagaccttcgacaacttgcgtgcggctggtatgaaacaaaaccctgagaagtgtgttttcggtgttcgcgcgggcaagctgttgggctttcttgtttctgaaaggggtatcgaggcgaaccccgagaaaatcgatgccattcagcaaatgaagcctctgtcgagcgtacgcgaagtacaaaagctcacaggctgaattgcggcgcttagtcgatttctctcgaaggcagccgaaagaggtttgcccttcttcgagacccttcgaggcacgggaaaatttagctggacacccgaatgccaagtagcgttcgactagctaaagcagtatctgcaaagcccacctgccctggtcagtccagcgccgagaagcgaactgctgctttatctagcagcttcgccggtggcggtcagtgcagctctcgttcaagagacggagccaggccagaaaccagtgtatttcatctccgaagcgttacaaggggcgaagacaagatacatcgaaatggagaagattgcctacgccctagtgatggcttcgcgaaagcttaagcactactttcaggcccgcaaagttactgtgccatcgcagtatcctttgggcgaagtgctacggggcaaagaaatcactggccgactcagcaagtgggcggcggaattatcccccttcgacctacattttgtcgcccgcaccgccataaagtcccaagtcctagctgacttcgtggccgaatggacactggcattcgcccctgaacccgagcccgtcgaatagccttgggtaaatgtactccgacggctcatggtcgcacaacggggcaggcgccgcggcagtactcacttcgccagggggtgtgctgattcggtatgccgcaaggctgtagttcgacacgaccaacaacatggcagaatacgaagctgtactattaggcctaagaaaggcgaaagcatttggggttcggcgcttgctcatccgaacggactccaagctggtggcaagtcatgttgacaagtccttcgaggcaaaagaagaaggaatgaagagatatctggaagcagttcggtctatggaaaagtgcttcaccggcataacggtcgaacacttacctagaggccagaatgaggaagcagataccctggcaaaatctgcagtctgtggaggcccgcattcatcaggcatcttttttgaagtcttgtacgcaccaagtgtgcccacagaaagcctggacatcatggcaatcgaccaggcaaagctgggcgaagacccagaagattggcgaaccccattcgtcaagtgtcacgtcctgataaattcatcccgaaattaaaaatcattctctaaaaggaataatagaattaattaaaattcgaaaagaaattggcaaacactaaaatacgtacaagaaaaattcgaatgtggcccggagaatttttgttaaattctccttggtc

SEQ ID NO: 49831 - DNA, 1398 bp, Oryza sativa
gggtgcggctaacgcgtgggacccacggcgccggccggcgcaagccgcgtgcacccggtccaccgtggaccgtgaggctgccgcgtgggccccactcccgtggacccggtccgcgcgcccctcccctcggctgacgcaataaatccgattttaaattaaaatttaaatgaagaaattcgtaaatatccatttaaagagcatataaacttcaaatggcatatcttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcggcttcggaagatccgctcttcgtggaggttgaagccgacgtttgggaaagcgagcaaggcaagtcacatcatccttgagcatattgaatcccagtttataaaattattttaatttaaattaatgcattatcgctttatttaaattcccgcgttatcactgttttatttagccatgcctatttacctttgttatgaccttattattgttgttattgttattattaccttgttcaccctaggataaataaaaccccaactagtgggtattctattcatggttccactagtatgaatttaggtagatgcttcgctgattaattaggcaacattaggtggttttataactttagactttgggaattctcatatcatctggacagtatggaatggttggcttatgttggaattggacacacacctccccctctattcaaaacccccataatggttttaggctgggctcgaggtgcgtggttgggtttggttagtcgtacctcgggtactataaggattaagctcgggcctctgttgcaaagcactaccgtacttccacatgtctagtgggtaaggcttaatttgtggctcagtctggttataaacaaaagtacacggatggagatggatgaagtcgggggtcgatggacattctccagggcaaatgaaggctacacgagctgcggcccggtagtcgagatgtcatggcacagggccggtgtcctgctgctagggggctcaatcctgcctgcctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgtttcaaattcttaaaatttgcttaacaactaaaatgtggaat

SEQ ID NO: 49832 - DNA, 3673 bp, Oryza sativa
aaaagagtgcatcaccgacaacggcaaacaattcgattctgacaagttcagagagatgtgcgaagggttaaacctggaaatcaggttcgcttcggtcgcgcacccacagtcaaatggggcggccaaacgaacaaatggtaagatccttgaggcgctaaagaaaaggcttgagggggcagcgaagggtaaatggccagacgaaatgctatctgttctctgggcccttcgaacgacccccacaaggccaaccaagtttagcctgttcatgcttctctatggcgatgaagcaatgaccccaactgagctaggggctaattcaccaaggtgatgttctctggaggcgaagatgggcgcgaggtgtcgctcgaactcctagagggggtgagagtcgaagcattggaacacatgcgcaaatacgccacaagcacttcggcaacttacaacaaaaaggttcgaccgacagagctattgcttagccatctcgtcctaaggaagaaggcgaacccggtggcggtcgggaagcttgaattgaagtaggaagggccatacctcatcaaacataggtccaggataggctcctttcgcctagcaacgctggaaggcaaagagttcgaccattcctggaacgctgcttcccttaagcgtttctatgtctagaacgggtggcacccaaatcgccaacttgtaaaaaatgtacatactattgtataggccttccggcatctctcattatgtaagcctttcggcacaaaaatacaaaaaaaaagaggaaaatgaaaaaaggaaaaagaaactggatgtagggctattatccaccttggaggcccgaaccagtataaaagccttgtgtctttcgcacttgtgtgaatgataattcgtggaaaaaccccaaggcaaacgcctgatcagcgaaaacgccgggggggggcgaaacaaatcggccgaagcattgctcaccaagcgttgaaaccgcgatagcttgtttcgggaaataactaaccaacaccgttacactcgatccatgtgaaaacataagcgcttccttcagctcggaataccacagaccgaaaacgaaagacgaaagctgaaaagtcagcatacctatttcgctagtatacgcaaaggggccgacacagttcgacctaacgaaagcacgaaaggtgacaatgcgaaaaacagcgaaaaggaaataaaacacatctttattaacttcgaaaaataatcggaggatgcaatcatacaacatgatacaagtacaaatagcaccggctttacagcctagcttacaaataaattacgtctccacccccaaagcaatccccactccctaaggaacgattcgacgaacatggttcgtcgtcactactaatgtcatacactatcctaaggggggagggggggcgaaacacaaactagactataatgacgctaggcgatcgcttcctgacgatcagtcctttgatggtttcgccaaaagcaaaccatgtcctcccggcgttctatatggacacaatcgtagtcctccagggatcgcctggggtgcgcccgtatccagccggcaaccttcaaaaccttgtagctgttgccatttattatcatctcgcagtaaactggccaaaacggacatcgcaccttcagcaaacccttcaccgccacgaacttctcgttcttatttcaccaattcccaaagggaggccgaacaaatgggcgaaaagagtagacaccctttcgcacgcgaaaacaaggcgaagataacgcaatagttgactatactggagtcatccattcatcatatatcaaaaaggctgtttccggctacaataagaaggggagaaggccatcggccaaatttacatcgttcgccctccacggcaaatgccaaaagaaaactacaaaatctaaagagagggcggtgggcctcacacctctgggtgatcttcggcatcgcctccaccctctctggccgcagcatcttccccttcgccctagtccgccgcctctgcctccgctagttgctcaaggagatgcaccttggcagtggatcggccgtccctctgccagaactgtttacgctaggcacgaagcgcgggcgaaacgtcctgcgcactaacctcctagtccccattcgcaaagttagggaactcagcgacgtgctcacagccgaactgctgcaggaggcccatggtgaaggccgccgacatgcgtgcacagcaatcaccatatgcagtggcgcagtccgagaccgcaccgcgggcctgctgagtccactccgagaagtcaaaggcggaagcatcttcgctagggactccacgcaccctcgcccccatgtcggaaaggcaaggcggagcgtctggcaagcggtcttcacaaactcggttgccttcaccatctcccgcgcgaaccgttgcgcctccctcttggtttttgcctccgcttggctaacctcttggcgaagagcctccatcttcggctcagtgaggttgtagtagtcggtcagagcggcggaatgagtttgctctttttttagctcggccttgaggcgctcgatctccgccttcgcctcactccctttttccagttcagcctggagccgcttgttctcggccttcgtctctttaagggcgtgggcgaggccttccatttccaggctcttgtagcccagttcgtcgtccttggctcgaagacggttcttcaaaccgtcaagacgagcccgcatggttcgctcggtcaaacaatgggctgcgaggatctggttcgaagataagagagagaggacgaatgttaagacaagttgtcgaaaaacaacaagtaaaaaaaacaacacaacatagttaagctacgtacccgaaccaccaagctcttaatggcagagcatccctcgtcgaactcgtttagctccgtgaacaggctcgagctaccagctggggagacgagggcgctcaccccctcgacaaaagggataagttccgcccgagtctcgaaataggcaggggcgaaatggggcgccgcaagggagtaatccgaaacggatgtttcgatcgccgtcttcctccccttcccaaggccgagcggcaaaatgaccggctagcgaactgggatgctcaagaccctagccgcggtcttgacaacctaatcggccgaagccgaggtcccggcaacactccctcccgctccacccgcatcgatcgcggtgccaggagcagtcgaaagccccaagctccggccagtaggcgaagtaggggtttcatcggaggactcgtcatcgctaaaagcgcgaccgacctcgacgagccctatccttttggaggtcttcttgaccggaccccgctttgccaccttggccgacgcgatcgcgaccagtgccttcgccctctccatatcctttcggcgaaggggggagcagttcgactccaccccagtctcaacgtgctcggggcttggagttggagtgtagccaggcatcccggcgcgattgtcggcagcctcttccgcagccttttcggccgcaacttccgtctcccccacatcctccccctccactccgtcgtcgttgtcttcgacgatgtctttgtcatcggcgtcggagtcagtggaggcaagggcccttcgcttccgaggggccgacttcacttccccacgcatccgctttcgcgaaggacctgcggcgtcatcg

SEQ ID NO: 49833 - DNA, 1826 bp, Oryza sativa
gtcataaacccggttcgcccgaccagccgcctgccgtttgagcagctggctgaactcggtgaccgacacatcgccgatcatctttcgggcttcggcgtcggcctgatcaagagtcaacactgcgaaaacaaaaggtgtaaccatatcaagcgtcgaaccggggaaaaagggcgaagcacagatgcacataagaaaagcatggactcaccattcacccccgcaggcggaaccagcttcggcaagccgtcgacctcctcgtcttgatcgaccacaacttgccacgactgggagagggggaaaatgtgaagcatgcagaactcctccaccaagtcgcggcaactaaggcgggaacagatcttgcgcagcagggcgaaccgagcttccatggcaccgtcaacagcgaccttgggcttcctgttcggtgcaatcgccctgcgccgacaccgtagggctttcgccgcttcggacccagcctcgaaggtgatggagtagtagtaccacttcgccatccaatggcgatcccacttcgacatggcggcgttcaccagccagagatcagagcgttcgaggcgaacattgaagttcacactcccgaacgccgtcttcttcgtcctagccagggtgaccaccgtcttcgagttcatggtggcgaagaatacggcaccgaagagctcggcactcggttcgaacctggcggtccagcatgcctagtcgaagatggcgatccgaacgagcgccgatggactcagctgggggagctccacctggaagaggcgaaggatctccggcaaccacacgttgcatggaaatcgaagccccgcctcaaagaagatggcgaataccaccgtccggttgtcaccgggcttcggcaccatggccttccccggggtgaaggcctgctcctccaccaccacgccggagctgaccaacttcgccagctcatcgtcatccacgagcgaagcccctaaaaaggcggtagtgtcatcgtcgatccggccgggatcggggcccgtcgctgaggctgggtttggcttgcgaggagccatggcgaaaagcgtgcgctgtggcgaagagggagaacaggcgaaagatctagcaactcaaagggcgccgtggaagaaaagacggaggagggaaagctcgcggtgaaaatgacgggggtgtgggggtgaaaaaggggaaggggggaatatatagcccacccaggcgacggttcgccttcccacccaatcacgacccaccacgtatcataagggtaggcgaaacggtaaattccacttgaccgagccgcacagtgacgagcccacaaagaaaatcccatcactgtttatttcagcccagtgaaagaacaagaacagctccgccgttcacagaaggcgaaagctgcaaaacattactgcgtgttctttgcaggattccaacgttagtttcggtaggagcatcggtcgaaagggggcgcctcataccataccacacggtttgcacggtctcggccgaagctcctatctcacccttgcccgtgaggggcttgttggcgatatgtcatgagacccttcgaccagacctgccgaaaccatgcaaccagctagggttcaggctcaaggcgttaagcttatcagggcgaagctccatggcgaagacaatgcagcgaagacgataaatgatgaagcctcatggcgaagagcgtgcatcctgggcgaaggtcgaagggcgaagagtatacgccgaaggaggatgacttcgccatatcgaggccagctccgggaaggcccaaggggccatcccagccgcttcggcccgttggccattgggccagcgatcgccaa

SEQ ID NO: 49834 - DNA, 1408 bp, Oryza sativa
aggaagcgaagttgatcgtgctaaaatcgatgtgatagatcagcttcctcctctcgtgaacatcaaaggaatccacagcttcttgggtcatgccggcttttatagaaggttcattaaggacttttctataattgccagacctctgacaaatttgctagccaaggatgcgccttttgagttcgatgacgcgtgcctaaaatcttttgaaattctcaaaaaggcacttgtttttgctccaatcattcaacctcctgattggaccctacccttcgagattatgtgtgatgcaagtgactttgctgttgctgcggtcttgggctaaaccaaggataaaaggacacatgcaatctgttatgctagcaaaattctaaccagagcccagttgaattacgcaactacagaaaaagagctgctcacggttgtttttgctatcgacaagtttagatcttacttagtaggagccaaggtgataatttatactgatcatgctgctttgaaatacctgctcactaagaaagatgctaaacctcgtctcttaagaaggattttgctgctccaagaatttgacttagaaattaaagataaaaagggagtagaaaattctgtagcagatcatttgtccaagctgcagatcactaacatgtaggaacagccaatcaatgatttcttaagaaatgatatgctgatgacggttcgcgactccaacccgtggtatgccaatatagtgaactacatggtatctaagtacataccaccaggggaaaatcaacgaaaactaaagtatgaaagtcgccgtcacatatgggatgagccatacctatatcgggtgttctccgatggcctactacgaagatgtgtgccaactgaagaaggacttaagatcatagaacgatgccatgcctcaccctatggtggccattacggtgcattccgcacccaggccaagatttggcaaaatggtttcttctagccaacaatgtacgaagattcaaaagaattcatcagaaggtgcacaagctgccagaggcaaggaggaatcactactcgcgatgcaatgccccttacatacaatttacaagtcgagatattcgatgtttggggtatagacttcatgggacctttccctaagtctcgcaactgcgagtacattctggtggcagtcgactatgtctccaagtgggttgaggctatgccgtgcagcgccgcggaagcgaggcatgccaagaagatgttcacagaattcatcttcccaagatttggtacccctagaatggtcataagtgacggaggttctcacttcattgacaaaaccttccgagacctcctacgagaaatgggagccaaacacaatgtggccactccttaccacccacagaccagtggacaagcagaaacatcaaacaaacaa

SEQ ID NO: 49835 - DNA, 4884 bp, Oryza sativa
ctagttttcacaggttagcaggtgagcatgtcttgtatctgtatatctccaccatggtatagtactagagctggaaattgagacccaattggttcaagcataagtaagagataaatttccgactaatgaaattcttcatgtgattgatcttgtatattcattattctcagctgaactttgcttgtgaacaaccatccatgttttgggaaccttatacatctaagtaattgctttatgtgagatgattaagatgaaaggaatccttgcaacatggttatgactcttgggaatttattttcaaaaataaaattattttaagaaggctcaatcctccaattgactttaccttatacctaccaaggccatatgcaagtacattaatgatcaaccttatcatgcatatgactgcttgacattatattgagctttgtcaaaattgtgtgacttgtgttaaatatctttcatactctcatgatcaaggggtcactatcatttccactttccagttccacatataaaaaaaattggctaagcttctacactggaagttggctttccacaaaaatatccattcaaataaactcctacattggactatgctttcttctcctggaaaagttcttggcaaaaaaagaatgacaaaagggggaaaggcatggctatgaaaaaaaagagaaaagaaaaaaaagaaggaaataaaatttgctctcaaaacattgagcaaagaaaatatagccatgccccctccacaatcatgccaagaaaaccaatttggagagaaagtataggaaaaaggagaatcatttctttattccatcattccacaacatatttcacttttccattttcaaccacaaataaagatccttgatctaggagtatgattgatgatcttcttgagtccatatttttggctttgcaatatatatgatgcaagtatgtcaccagtttatccctaccaagctccacatatcagccttagaataggggtaaattctggcacactttgccttggtgaggatccaaaagaaaatatacatctttgagagacaagagagaaaagtcaatataaggaaaagagctagtttgcgaaaattcataaaaatcccatgagtatggcagagaagcagaaggactggaatcaagattgttccatttatcaattactcaagatggtaagatagccattgatatagttcacaagtgcaggtatgggtgtgaatgatttatatgcttaattcatatcatgaagaaattcattctacactaacctttactcagggacgagcaaagggctaagtgtgggggttttgttggtggctattaaatgccgattctataccgccaacatttgcataaagtacagataataaagcatccaacatagagataggtgcttaatctcacatattccataagtgttggtgtatatttttatgcagaagataaaccctgaagttggaaggaaaatcagactaaagtgaggagaattatgtatccatacaaggaggggttatgaacatcatcgaaacatcagtaaatcaaccaaaaactccaagaaatagatagaggaaggtccagggagtccaccgaccgaaggtcaggccaggagggcccagcccaggttcggctgaaccccctggttcggccgaaccctggtgatcgccgttgatcccaggttttggcatggacatcccagatcactccctgatggcggttgcggggcagttcggacatttccccttctcacaaccatcataactgccctacgataggacctcacttcattcactctcacacacacttccaagcttgagctgaattataagaggctttattgtactatattgtatactagaataggaagagagtagagtagaaggagtcggaagaattccggagttgtcggtaatcttctcctatttcttttattctgtttattactctgaattcattataatattcttcttgagtaatttagatttatcttgtgagaattatctcttggttagttcctaaatagcatacgggattattgttcactataatcaactaaaatatagtgattgctttggtgagttataaacactaaagtagatagtaattgcttagacgttttgtttaggtaattgttatccagtaattgatgcgtatcccacagtacgttgaggtgggtgtagaggtggtgacagccctcgagatcactaaagtcttccttgtccgggtacgtagtagagcgacatctgggaacagcgggttgccagtgcctgaagtactgcattaggattaaaaataagctttccctagaaacagtttctcactagtaaatcctctctatcctggcctatcaattgcttggtgtccttggatgaaccggaggaagtctgatcacacacgttcccttggattcgatacccttggaatactccgtaagggaagtgctacatcggtatatccgtgcgcttgcggattttatctgtaaccgtatcaattaccaacaagcatttctggcaccgttgccagggaacggttgctgatcatttccaaacccagttcatcctcatatcctttttcattttttttattctaccttcacccctgctatcctagagaagtattcctatcaaactcttctcgaccatcgtgcaacctctgtttgagctgtctgctcctcggggcgaattctatgagccaccttcttcatcggagcccatttatacaactggctatgaaattcgtcccgagctaattagtattggttagggaaaatcctttctctggttttgatctaaaaaatccctaccatcatctgcgagactttgaacaagtctgctcatgccataagattcgtggcatgagacaagaaactgtgcggtggaaattgtttccgttctctcttcaagagagagcaaagaaatagtacacctctaccgttggatgtgtaaacggtagctaggaaaagctgcgagatagattctgtcttgccttcttcccagttactcgtattactgcccttcgagtagaaattctcaatttcaagcagatcgaaaacgagtcaattggtgcagcttggtccagattcactaatttagtacagtccggaccaaccctgtccttacctgagtatgtgcttctccaacatttccatacgggtttggataaggagtctgcattctatctggacataaccgctagaggatcattcatgcataaaacgccgtcagaaggaaaaacgatcttggatcgcattctagaaaatacttccttcatgacgcagtccaatgaaccccagctggaggcatccgtgtccaagatagaggaacctctaacgatcgagccatttgctgaaccgtccacttctgctagctcgattgatgagaaggttcctgagcagccatccgtcaagaatgaagaaattcagactccggattgtgccacaattatgttcagggacggttttgacgtagactacggcaataccctgaactattttagcaagaggaaaccacccgttcctttgtcacctcccgatcctatggaactcgggttcctacgagaaactgtccgggagttgacatccataatgagcgacgaatggcaaagggaggcagagctttcatccgaagtaatccggataaataccgctccccgaatcattccttgtcacctagaagggaacgatgtcggtattctctacagtccaactatcggggccaacctcatctctgtgtcctttgcattcgcttatttaagcgataaggcagtgaccccgacaaacaaattcttcaagcatccgaatagaaatattatcgaaggatttgggattgtgcaagatgtgcctgtcttctttgaagacagggaggcgatcttggatttccatgtctttgaaatccaagactttgatatcctaatcgggctgcccattgagcaacttctcatcaacacatcccgattaggtagcctcaaaataacactgggagagaatgaattctcaattccattctcgcgggcaaggatcaccttgaccgaccctctcccagaaactgagtcagcggaagaggttaccgcagttcctcctcatgagtctaccaaggcccttctagaagatgaggtccccgacttcatcaaggaagaagcagatcccagtgagactctcgacctgccaatcatggaaccaccacctcgacctccgctagagcttaaacctctacctccaggcctacgatatgccttcctacacaatgacagagaggctcctgtcataatcagtgacaagctctcggaagacgagactcaacgtcttctcaccgtgttagaaaagcatcgttctattcttggctactcgcttcaggaccttagggggattaatcccgcgctttgcacccatcgtattcctattgacctcgagagtactccctctagggaacctcaacgacggctcaataatgcaatgcgagaggttgtaaagaaagaggtcttgaaactcctgcatgccgggattatctatcccgtaccatacagtgagtgggttagcaaagttcaggttatgccaaagaagggaggaatgacggtcgttgcaaattctcaaaatgaactaattccgcaacgaaccgtaaccggatggaggatgtgtatcgattacaggaaactcaacaaggctacaaaaaaggatcatttcctgctacccttcaatgatgaaatgttggaatggctggcaaatcattccttcttctgtttcctcgatgggtattccggatatcatcaaattcccatccatccggaggactagagtgagactatattcacatgtccgtatggcacctatgcgtatcgtaggatgtcctttggactatgcaacgctcctgcacctttcccaaaggtgta

SEQ ID NO: 49836 - DNA, 2437 bp, Oryza sativa
ggtgacagccctcgagatcactgaagtcctccctgtccgggtacgtagtagagcgacatctgggaacagcgggttgccagtgcctgaagtattgcgttaggattaaaattaagctttccctagacaccatttctcactagtaaatcctctctatcctagcctatcaattgcttggtgtccttggatgaaccggaggaagtctgatcacacacgttcccttggattcgatacccttggaatactccataggggaagtgctacatcggtatatccgtgcgcttgcggattttatctgtaaccttattaattaccaacaatcccccctcctgaccgatgatatgatgggattaaaaaagggttacaaaatcatacgtgttattactcatacgtatgcacgggtctaaagctaaaaaaacaactcaataagcacaacccacccaataaatcacgcagtaatataacgcggctaccgtacataagtaaatatttaactctaattgccatcatagcatcatctataatatatctttattcaaatctacacctcgaaggtctcatgtcacatggtttaactacaatgtagttaatttataacttgttacattgtagcaacgtccaatatcgccacattgtttgttacagaacatttcattcggtaccaaaaaaaaaataaacgggctgagcattaatcggacaagccgttatcacacaattaaccccacgatccgtttttttttaaaaaaaaaacccaaaaaactgggcgtgcaacacatgtagatccatcattatcgccagtgcttacgtccaaggcgtaactccacacagaaagcaaaaaaaaaaaagaatcagcaaccaagctagcttcaagttagtgggggctctcggagcacatccttccagtcactccttcatcttccttggctgctcatggcatcgccggagatcactagctccacgtcgttttgtccgccactcactcctcgctcatcaatgggttgccctccggcgagctctccacaccaacaatgtaccccaacgcgccaagcaggagatgctccctctcaatggatgccgccatgcttggatgataacgacattgcaacccccacgccgaatagggtctacaaccatgtaagttccactccttcaatcccactgtgttctatggtgaatattatcgacgtctagtttgcgatagtgatgcaccaaaagcacattatttcgagccacgattattttttttcgttgctatcgccgtgtgacgatactaactactcccactaaaaatataccattttttatattttatatatggtttgccaatatttcatgaatcacattcaccgattgattcttttaacgacaagcaattctcattgcattcaatagttaaaaactaactcaactcccattcctagaacaactaggttcaacaaacatctatgcacgataacttcgatctataagtaattttatatctctaaacctgacactcttgctacgtaattttggatgttttatatcactaccttcatgaatacgaaagttatttttaaactatcacatgatcccgaacgcacgtctctgttttattaaccgaattaatcccatacctaaggaatacactagcaactggatgacaagccattttttaactggcaatccacgtgctatactcagcagccataataattttagaaatggtatctaactttcataatgtttccagtatttcatcgataatttattaacaaaacttatctttgctatataacagggtcctagcgtgccaccgcatatggtgcccaccgaaggcatggctttccctacatacgacaacgcatacaacttctaccagaggtatgcatgtcacgctggatttgacatcaagaagagccgtacgcacaaagcgtttcgcgaggtgtgttgtacgagggagggcaagcacgtgtcgaaggtcaccgatggtgatagacaacggaggagaccgtccaagaaaatggggtgcaaggcttttatgaagctgaggcacaactacgacggtggtgcgctctcatcggtggtgtatgatgtggtcgagctacagcacaaccaccctctaacgccatccccttcggcggtaaagcacatgcgtgcacataagaaccgcgacgacacagttatgcaatttgtggacactatgcaagaaagtcacgtgccgcaaagttgtatcatgggcgttctatctgatctccatggaggccaagacaatatccctttcacttcacgcgacgttgagaacaggtgatttttttaaattattccgtttcttggctttgtgatgttgctttcatgaaagtttcttttcgtgctttcttgcacgaagacacaaatgtggattgtaattaggacgttcccatctgaccgatgcaggaaagttgccaatgtccgaaaggaa

SEQ ID NO: 49837 - DNA, 714 bp, Oryza sativa
accgccactctgacccattgaacaccatttttgcacgggacgctcaaattgaaccagacatgatgttgtgcatcaatcaaacctacacgccttatgagtttgaaacatcatgggatcaattcataaagagttatgatttggagggctgtcccatcatgaaagctttatatgatatcagggaaaagtgggtgcctgcgttcttcaagaaggaatactgcaggaggatgacgtcgacgcagcggagcgagagcatgaacaagttggtgaagcacaagtttgctgaccaccaaaccgcgctgcaccgttttgctcggagaatgttggaggttataactgacaggaaggagaaggaggctgccgagacaagagcatgctcggttagtgatatttttactgggggaaacggtctgacatcactcctataattctactaaattttaactcacaccaactaattatatttctttttgtacatggaaagccaatgttggctgtacggtggccatctgttatacagatgtcgagactttacaccagggcggctttcagattgttcgaggaggtgcttcaggacagcactgacttcaggatcacacaagacgacaatttccgcaacgggtgggtagttgtcgacgttcgatgtcgcaatttcggtatttgcatagtatgggcatcgttggtacaaggataaatgcggggggatccactagtcta

SEQ ID NO: 49838 - DNA, 791 bp, Oryza sativa
cgaggtgtgtgcatgactaaactacttgcctgagtttgcatggtcaaagcaccttcctccggtacaatctgcatggagatggaggagaaatcgacaatcatatgtgaccatgccactgcccccgagatttcaaaatatacatcatgctggcggcaagtacacttaggtatgtgaaagataagacaaggttcaccattccttttactcatacttatcttcatttgaatgagacttgatcctacatggttatgtttcttttgtctatttgcatatgctctattttgggtgttcgtgcaagacatctataggctttttaaattaagcatggtgcttaggtcaaaatagtctactttaatcaaattggacataaagtttagtttgactaatgaatttcagagttaatatgttcatggacattggatatatatcttctgtggactaatccctacaggaaagtttttgttggtatttcttacaaccacagataagtccggaaacccacggaataccgctgtagcacttcaccttcgggtgacccctaaaggatatcgaactcagggaacgtgtgtaatctacctaaggctaagacgatccaaggacaacaactataggtaggcaggctacagagaactttctatgtattttaattacctaagctaagttgaaggtaatttcctatctgttgcttcgggcaccgacctctgctggtctaccagcgtggttccggctatagctctatgatgcatccgaacgtggaggatttctgggacagaattcagggctgtcaccac

SEQ ID NO: 49839 - DNA, 5361 bp, Oryza sativa
ctagcactagtggatccccctggtattactagagcacttagtataaatactaaacaatgaacccacaaagatgcaaatatatcttacttagacaaagtaattaaataacataagaaagaaacacgaatgcttactttatagaagaagttctccgaacctggagcagagtgtaccgacagctccggtactcctccagaattcctcctacgaagctacactcgttgaggtagaagtcggatgagcgccaaacttccgggcactcctccagagcttcccctcactctctaccttattctaatgtataaaagatacaatagagcctcttgtaattcagctcaaagttgtgtgttggaaatgagagtgagctcctccttttataggcaggtatgacgattacagcctatgcgaaatgaccaaactaccccagaaccgccattaggatgtgatcagggccgtccacgcaaaatttgatgatcaatggccaccaaaacggttcggccgaactcccgggatggctccgttcggcccgtttttcatcgtggacactaattttgaggccctcagcccattggcatgatagttgggcccatttggatttgtttaattgacttatggggcctccaatccgtgtaaatgtgtcctgaatgcgcggaggtgcagtttgtcgcttgacggatgtgttttcttctcaaaatacctgcatacgcatatttcaccaacactagtgcaaatgattagtaataatacctaccactatgttggatatcatgttttattttattataagaaatgcttattggtatttcttaacgacattactagaaatataattcccagtaatggcgcagaaatacttctggtatattatggttacagagttcatccgcaagcgcacggatataccattgtagcatttcacccgagagtattccaagggtatcgtatttattttatcccgtgggaaaatcatgtagagagaactcaactaataaattatatattacttgtgataatcatagtctaagcaggggttaagataatccatgggtagagtgacacacaagcatttctactcatcctcataataaataatctaaactaggtggaaagaaaagagaaagagaatctattccaatacttctaatatacatagtatacatacattctagttaactgatatactagctaataccctctattcgatgccctcctggtacttcgagaagccacccctgactgccgagttccttacgacagcccgtcatgaccatccaaccagggctaaatactgaggaataccctccccagaaaattaacttaggatatatataggcgcggaggaatacccgtactgagttgtcaccatcagcggcccacctctcatccgcaatatataaccccaaataatgatatcccgtaatctagacaccacgtctaaactaccagatactactctaatatcatcatcatgacatagagtaattgcataagcaaacattatacccgcaccaaagcatctcccagataagctagcagtatattcagtataacaagaacataatgtaaagtaggtactcgtatactcagaaagtatttcaataccataaatgtatatagaagagtattctaataaaattacaaatctgacaaaagaggaaaggaaagctgctagagccatacccgaactcttccgaagacttccggactcctgattcctattctaattctattccaccagctagatactactaaactaaacttgagaggaatgagagagctcttgcttgaggtgtgtgttgaagtgaagagagtgagctccttatatagaggtaggtatgacggttgtggaaggggaattgtccgaagtgccctccaaccgtcattgggatgcaatcctggacgtccaagccaaaacctggacccaacggcgccgggattggttcagccgaaccaccaggttcggccgaacctggggctggcccaatccagcccaatttcggctggtggcctcctctattgctccactcctcagacttgtgaattttggcccaattcatcgtgtcaattctgagttctttgcccattcatacataagtctggtcctcgacatcgtctgattgatttatcgttggtgttgatgttgattctccttcactttattgtcattctctgcaaaaaggttagtagacctaataatagtggaatattattgttctaacatatttatgcattgcaagcatcactagttctctcctgttttagtaatattgacggtcgaaactgatcgataacgaccgtcaacaatatgcaggtattgacggtcagatattatgatttaaggaccgtcaacaacacccccacacttaacctctgctcgtctcgagtgaaggctatggactctacaacaaagttatgacttccttactaataatcatgcaaacaaattattcaaagtcatacctgtacttgtggatctttgcagtgtctaccatgcaatcttggacaattgagaaatggaacaatcttaactcaagtcaccctaacttttcatgaagaacaacttggggtttttttttcaagtaacacaaaattataactttgctttgctccttaattgattctcttgatctctcaaagtgtatgattcctcacaaaggcatatgattgtgccttttcttttcctaccatctaataaggcttatgtggagctcagggtatggaaaagagtagagcattacttgcatcacatatattgcaaagtcaaataaaggatctatggaaatacaagtcatactttctggtcaagaatgcgcatgtgtatgtctatggtaaatttgtgggtggaagaaaatactataactccttttatcatcctccatttattttctcttttcatatttgggagagtgcatggctattttttttcttttttttctttttcttccattttttttcatcatcatgctccacacttgtatgaacacttttttcctttctttttgcatagccatgcctctctctcacttttttttaaagaactttggaggaagaggcataaacgacatggagtatttattttgtggactatggatgaaatgaatggtaaatgagaaatgctaacttccaatgtagaagtcaagcataagtgcgtgtatgtggagtgtatatgatcttgaccatgagagtacgaaaaacatttcactagggtcacaaaacttgacaacgctcaatgtaatgacaagcaacgtatgtagcaagctaatcatgactgatcaacctatggctctagtgggaataaaaatatcaatgaggagtttagcatcgttatatatttttttctttttataaaattcccaagtgtgcaacatgaagagcaggatttctatcatcagactatatctcattcatcaattgtctggataacatagggtccctattggatatatcaccacaagcaacaagtaatgagctaagaataataggcatgcatgttattttcagggagatcatgaactctaattgtaccatccctagcttgagtttaattatctttgatattttagaactgataatcaaattaaactcaagatagaatggatgtccaaaggaaaatttgtgcaaacctgcactctgtataaaacagaggacgattcatggtagaggtggttcagccgaacaggaggtttggcagacccctcattaggtctgactgcatcaattttccatgtgtggttcatcatggctcatcacttctggggtgatcttgcttttgttatgccgttaatgtgcaagatcacccccccacacttgtctttgtatctgctaggctttattggacacaaaaaaaaacaaaaacaagagtgaaggaaaaaggactcacttggttggaagaccaaggagccacatttattttgttttgttttatttttttccttttcttttcctttttttatctttttttatggcaacaatggatatgctggataccctggcaggatggagacatgagatgaggatgcacatggtgtatgagattcttaccagatatgtcttaccaaggtttgaaccgaatgcaagaatacaacaagttttgcatttgttctacttggttccctatgcatatcttttctcatagataaggagcgtgatataagtgttcgaagttattgtacactcctccttgattgtctttttatttcctgcaaaaggttagcggacaacaaatactcgaagcaatacaaagattttattgtagcctcaagattaattgttcacatccacgctaaaaaggaattggattcaaaacttaagaagcgtggatcccacaaagaaaatgaggttattcaggaagcgatttatactagagcagaagatatgaaggaggcggtaaagcattttgcagtgtcactacatagagagttttgggttgccaagttcaactggtcgcaatatgaagttaggtgtgttaaggaaaaagatgggtgtccctggagagtgcacgtttataagggaaaattggaaggattactggacagtgtcagtggttaccaagcatacatgttttctaactggtgttcagaaataccacatgaacattacattgtgcatttgttgcatctgagatgtatgtatgcgcatgtcatcttaggtgtgttacaagcggcttacgaacgacaatgtcgtgaacaacagtgcaactggcgggtgctaactacggcactcgctccatgggaagcccgtacaagatgcagatgcagtgatcgttgtcaggttcttcgttccataaagcctacgactttgggttgaaggttctttgtttgtccaaatattcttgacgacaatttcatggtaagaatattttgattatcatgaatccttattttctcacaatattttctaactttgttcgctttacatctattcgtttctcacaggaaccaccaaggagatgtcaatacagagaatgggtagacaccagaagagaatgggtagacaccagaagggttctactccacctagccgtgtggtgcagcttgaactaccagaggaatacagggttactaaagggtggtttgagagaggagagggatcctcacgtaggggttaactattatcggacaacttgccatattgaaatttgtaatctcatgcttccttgtcacattactacatcgtcgttgtgatcaactcttgcactacctccctcctagttcgaatctaatattatctatgtaaccgcaatggaacctgatgtatcatgttcaaattctactgctatttcttcatgttacataattctccttgtttatgtgtatataatgtttctatgaccgagactgtgataggcctatatcaatttcg

SEQ ID NO: 49840 - DNA, 3348 bp, Oryza sativa
aaaattggctgtgaattttgcatttcgctccttgcgccctctgtaagagcggcaaggacctaactgaaaaattcgcagacggcgccgtcgagccactgtctgccacatcagcttgccgccctagtggagggcggtagggtctatttttgtaaatttttccaacgataaattatttatgtaaatattaaaaaaattaaaaatgaacaaaattctggtgcatgctgatgcagtcttgggtcaccctctgcgtgatgattctaggttttgtgttaaacaactcttcagcagcattgctcacgaatggtcgactccaactcctctctaaaagatttagttaagcaagggtgagtactaaccgtactcagcaagccaccactacataatgcatttagtgcacacaggggttcaagggtggttggtttattcgcataaagctagatttcacaaatcatttcgcaaacctatgacctagcagctttaactgaaaacaacgttaagttgaatttgtcattaatccgcgagggttcatccaccttggttcggtttaccctcgcatccagttttccacattcccaacatcatcatgaccttcccgcccatcgggcaaggtcacaccactttcctgaactaagcaagatttaaaatctatgaggctagtcaagtgtagtacaagtcccggcgctcaataaccgcgagcacggctattcgaatatatttgatttactcacactgcagtggatgtatgcttttaatcccgcactccgcggcttgcccaacacatgagcctagtcccaacccacgagacttgccgcggcccggtttttcaatcaccggggcatttcggcacccgctccaaggactatggatccccattgcactcccggcacaacacaccacctcgagccggcagtgaggagagtcctggcactcccaggatcacaatgggttatattacatataggttaggtgcattttagatttttggcatcattaaccaatccatatcccttcacaacatcacaacatctcacatcagaaccaccatgacaggggtgccgccccacgaggatttcttagtccaccgggtctatacccactcgagaagtgcgttcgtactctgattgtttcttgcatagcttcttgactcggtctttaactgactagggtcggcgactagccgtttctagaaccacccatattctatccatgccgccccagtcgaaaacattttgtttcattaggtttttggttttcgcaaagctttttgtgctgcgggtggcgctcatgtctccacccgccttctggcaatcactcttgacgagtgaccgccaccacacatccatatccaactactatggagtgtatatcataagcaatattaagcaatgtcaataattgaccatgcataaataatagactcaggcaacatggatataataaaggtaacaatataaaggatggttcatgaaagtgcatctaggcccctaatgattttggtgattaattacaatgcgattagagaggactaacatttttatttaagcaaatgtcaaggttgttatgtcctcaatgagttagcgtaatgcatatcccgccaaatacgttgacatgatgtgatgcagcaaatgagcaaatggtatattgtaccttttcttttcctttgagtcaataggaatgccacactattaagagggatggtgcattgacatatgaggagtgatcaaagtgctcaaaatctatttttgaaagtgtctctcctcagtttgaagtgttctggattttttcggagttgtccgaaactcattttcggaccttccaaaaaatacacagaacctgttgggcgcttctagaaatttttggatatgtccgaaaaggattttcggactttccgaaaatgactatgaaggcaaatatggttatgtatattttcggacttttccgaaattgatttttagagtttccgaaaatcatcagttgtcccaaaatcgcttctgtgtattttcggacttgtccgaaagggattttcggactttccgaaacatccagaaggtggtttttggttctggaaattttcggatttgtccgaaaagttttcggaatgtccgaaaaatctttcgttgactttattgttagtgctgagctggaattttcggacatgtccgaaaatctttcgaaatatccgaaaatctcaattattgtgcataacgagcagattttgggctgtggctataaatagcaccctcccctcacttgtgagggctgctggtcacattggatattcttgtgcccttggcttgctcttgttgagattcacttttgagccttgctttcttgtttcccctctcacccgtgttcgattcggatttggtgtgtgtgtgagttgtggattcgagtttgtgtgagtgcttgttgttgacttcgtgaagatttgtgagcacttgcatcatctccgggagttcattgcaccatttgttactcttggaggttgaggacttctaggcggctaggtgtcgctcccgagccaccgatctacttgtggttggccgggagaagtttgtgaaggtcggatctcacctccgaaagggaagagatacccttagtggaaagagggtgcttagtgcaacctcttgaggaaagggttagctaagacctagctcttagtgagctcctcaactgagagtagaatcccctcaaggattcgaacttcgggaacaacttcgtgagcttcatctttggtgactttacttcctccctctccactagctttgcttgtttgagtcgctataggtctagttgctgtttgtgctaacatattcttgttgtaggcaactagatctaggatttactttgtgtttgtgctgactccgaaaattttcggatatatccgaaaatttcggaaatatccaaaaattactgcttccgcttttaattgaatttttgaattagcctattcaccccccctctaagcctaattgacactttcaattggtatcagagcctaatctcctaattaggcttaaccgcttggagagatcatgtcgggccaaacaggggatgggaatgatggtgataagggagctaagatcccttatgactacccccctacatctacatcttatgtgagtacctatagcggcaaagctccgtacttcaatggtacggactatgccgcttggaagcataagatgaagatgcatttgaagtctattaacccatctatttggagaatagtcgaaaaaggctatattttacagaatcccgaagatcccactaaggaggacgacgagaacgagtacaagaatgcttaagccgctaatgcaatacttagcgccttgagtggaagtgagt

SEQ ID NO: 49841 - DNA, 1714 bp, Oryza sativa
  unsure (1)..(1714): unsure at all n locations
ccaaaagtatcattcctaatgaatatgcttcacactgttcttttaatgcatcttatgttcttaggaagaatgctagtgatcgtgttgttgctaagtatgtaggcccaaggagcaagaatatttctaatcaaaagagtgctttgggtgcctaaggcacttgttactaacatgagaggacccaagcaagtatgggtacctaaaactagaaattgatctcttgtaggaatatgtctccggtggaagaagttgagtaattgatagcagatgcaccaatcacatgaccggagaagaatcaatattttcaactcttgatccaaatggcacttcacaagataacatagtcttcagggacgatggaaagggaaaggttatgggattgggtaagattgcaatctctaatgatctttctattgccaacgttctcttggtaaaatctttaaactacaatattttgtctgtttctcaattatgtttcatgggttagaattgtctttttaccgatgttgatgtgaccgtctatagaagaaatgattcatcggtagtctttaagggtgttctcaagggaaagctttaccttgtggatttttcctgaagtaaagccaaacatgagacatgcttagtggcgaaatccaacacggggtggctttggcatcgaaggctagcccatattggtatgaagaatcttcacaagcttctaaagcacgatcacatccttggactaacaaatgttcaatttgagaaagatagggtgtgtagcgcgtgtcaagtcgggaaacaaattggagcgcatcacccggtcaagaatgtgatgaccactacgagaccattggagcttcttcacatggacctctttgggccaattgcttatctaagcattagaggtaacaaatatggtcttgttattgttgatgacttttcacgcttcacgtgggtgttcttcttgcatgacaagagtgagacacaagccatcttcaagaagtttgcaagaagagcacaaaacgagttcaacctcaagatcaagaacattcgaagcgacaacagcaaggagttcaagaacacgtgcatatagagtttccttgatgaagaaggcatcaagcatgagttctcggccccatactcacctcaacaaaatggagtagccgagaggaagaataggactctcatcgagatggcgaggacaatgttggatgaatacaagacatcggaccgcttttgggccgaagccgtcaacaccgcatgccacgccatcaaccgactatatcttcaccatcttcttaagaagactccctatgagcttcttaccagtaacaaaccaaatgtctcttactttcgtgttttcggtagtaagtgttacattcttaataagaaggctagatcctctaagtttgcccctaaagtggatgaggggttcttgcttgggtatgggtcaaatgaatgcgcataccccgttttcaacaaaacctccggcattgttgagatcgcgcgtgatgtgacatttgacgaaactaatggctctcaangtagagcaagttgactcacatgtgttaggtgaanngaggaggacccgagtgaagcaatcaagaggttggctcttggggacgtacgtcctagggagccacaacaaggggcctcttcctccacacaagtggagccaactacatcaacccaagccgacgatccctctacttcaaacgtggatcaaggtgaagatggc

SEQ ID NO: 49842 - DNA, 2899 bp, Oryza sativa
tgtgtgccaaatatatgtcgatgacattatatttggttgtactaacaagtcttttagtgaagagtttagtaggatgatgaccaaacgttttgagatgtccatgataggtgaattgaagttcttccttggccttcaaatcaagcaactcaaggaaggaaccttcatttgccaaacaaagtatttgaaggacatgctcaagaaatttgggatggagaatgccaagctaatccacactcccatgccatcaaatggccacctcgacctcaacgagcaaggtaaagacgtcgaccaaaaggtataccgttccatcattggctcactcctttacctttgtgcatctaggcccgatattatgcttagtgtgtgcatgtgtgccagatttcaagccgctccgaaagagtgttaccttgtggccgtgaagagaattcttagatatttggtgcacacacctaatcttggtctttggtatactaagggagcgaggtttgatctcattggctatgccgatgcggattatgccgggtgcaaagtggataggaaaagcacatcgggtacttgccaattcttgggtaggtctcttgtttcttggtcttccaagaagcaaaaatctgtcgccctatccaccgccgaagcggaatacatttcggcggggagttgttgtgttcaacttctttggatgaagcaaaccttgagagactatggcctaaatgtgtccaaaatcacactcctatgtgacaatgagagcgccattaagatagccaataaccccgtccaacattcccgaaccaaacacatagatattcgccatcatttcttgagaaaccattcaacaagagacgacatagacatccaacatgtgagaaccgacaaacaattggcggatatctttaccaagcttttagatgaagctaggttttgtgagttgagaattgaactaaatatcttggattctcggaatgtggcttgatctattgcatgcatgtttgtttgctagaataggtttgcataccactttgtgacaaaatggacattcaactcatggatggacactagtcatatttgtggagatcttgaatctatgtgtatggggatctcatttttcaatgaattttgttcctaacacaatttgaaatagattcacacattccctctctcgagggtgaattatcttatctcatggtaattccctctcttttgatccctcggatagatcatttgatttgtggctattgttttgtatgcttgtgtgtgctagccgcaacttcaaatggagcctttagtgctcgaccatccctccattcctttaatcctttcaaaactccttgtgaaaagtgtttttgacaaaaaaaattcccggtgctagtcccctgcaaaattcctttagaaagtttgcaaaactgtttcttcaaaattcccagcgaaatccctttgaaaaactgttttccaggaattttcggactttccgaaaaattttcggacattccgaaaatctcctgtcctgtcgctcttcattcaaagctatcccaggatttttcggacattccaaaaaatcttcggatatatccgaaaatctacagaagcgtgcgcaacctactggatcctttcggacttatccgaaaattttcggaaatatctgaaaatatcggggtctttatatttcaccccgtggactcctttctccctcctttcaactctttttcaccacgggcttgactccctcctccgctccccaccggtgaccacctcctctccgacgacctcccgcggctcccctcctctccatcctcgtgggagcgcatttggggcactacttgggacctacattgttgatcttcaccgcgttcttcaagtgttcttcgcgttcttgaggtatccaccctaaaatcaaatccttcgattcctcaagtcttatcttgcgatttcctttggtggagttcttcccctagtgcactaggacctgcagattcattttcccaagtttttgttggcggatttgtgcggcatccggatgatagggttcggaaaattgttttcggatatatccgaaaatctctggccgacccctatcacctcggttttgcacgattcttgccttcacttacttggttcttgcttctttggcttccattcactgatcccttgtctatatcttgtttgaaggatgcctccccgcaagcgaacttcccgcaaatccaagcgccaaagggaccgctctcccaccccatcctctcatgatgattcggacagtgattggtccgggagagaggatgcggctcctcagtatgcgtgggtggctcgaggcggcactctccctcctcggcggtccactcaagctcttggtggtggtggtgatggtgagggctcctctcgtcaaccgcaaacgccgccgcaccaacccaatgtccctattgctcctcttcacattcatacccccgagagggatccggcggtgattcgccaagtgtatgattggaggcggaagactgaagttgttgctcctcgctgagatgaggatccgcgcccccttcgccgcaccgccacggattcgcggttttggactctctttcaacaagacttttatgagtctgtgatcaagtccaaagctcatcccaccaatcccatgcaatggatcaactgggagtagctgcaggcgcatgatgatccggtgctcaactttgtgattgccaattgtgagtgcatgggaattcgctctttcatgactttacagcaggattggtgcaacgaagtcatcgctcaattctatgccaccgttttctttgatccatatcatgccatgcaatggatgacccaaggatcctggtctttctgtctcctatccgcgattggctgagatttgggggtttgatgtgcatgacttgctaaacctttctgatctgca

SEQ ID NO: 49843 - DNA, 3165 bp, Oryza sativa
atatccctccttcccctccgggttttgaagccgagcccgatgagccagaggaagagctcgaggatccatttgctgggttgcctcctgacttcgacttcattattgttactactttttattgtgagttactaccattccatcatgacgttattgtatgtgtgcagtaacaactataatttttacagtaacagtgcatgttactgcaatttcttaatagcgttactgcaaaacatgtggtaacaaccaaacacacaggtacatgacctaccacccactttgaaccagtaaatgtaagtgcaagtgatatcttttgaattctcatctttaaacaatgatatctctcacaccatctattatatttttgaaccgtttgcatcgtaatgctttaaaaaaagaactctacaaaactagatccgtcatgactatattttaactatattttattagtgttactgcatggtggttgttgacggtccttaaatcataatatctgaccgtcaataccttcgtataatgaaataaaacatggtatccaacgtagtggtaggcattattactaatcatttccactagtgttggtgaaatatgtgtatgcaggtattttgagaagaaaacacatccgtcaagcgacaaactgcacctccgcgcattcaggacacatttacacggattggaggccccataagtcaattaaacaactccaaatgggcccaactatcatgccaatgggctgagggcctcaaaattagtgtccacgacgaaaaacgggccgaacggagccgtcccgggttcggccgaagctccagttcggccgaaccgttttggtggtcgttgatcgtcaaattttgcgtggatggccctgatcgcatcctaatggcggttccggggtagtttggtcatttcgcataggctgtaaccgtcatacctgcctataaaaggaggagctcactctcatttccaacacacaactttgggctgaattacaagaggctctattgtatcttttgtacattagaataaggtagagagtgaggggaagctctggaggagtgcctagaagtttggcgctcatccgacttctacctcgacgagtgtaacttcctaggaggaattctggaggagtaccggagctgttggtacactctgctccgggttcggggaaacttctataaagtaagcattcgtgttcctttcttatgttatttaattactttgtttaagtaagatttacatctttgcaggttcgttgtttagtatttatactaagtgctctagtactaggactccggatagagaaggaagttcctgcgcaagtattagagtagtaattaataacttagacatggtgtctaggttagagattacctttgtttgttgtgtatcccacggatttgtcagaggtaggcggcaggtggtgacagccctgaatcccatcctagtaatcctccacgttcggatacatcatagagctatagccggaaccacgctggcagaccagcaggggtcggtgcccttagcaacagataggaaattacctttgcttagcttagataattaaaacacatagaaagtcctctctagcctgcctagcctacctatagttgttgtccttggattgtcttagccttaggtagattacacacgttccctgagttcgatatccttttggggtcacccgaaggtgaagtgctacagcggtattccgtgcgcttgcggatttatttgtggacataagaaataccaacagtggttgtcctgttactgcaccgttcatacgagacgaggacaacaaataggtgaacgtgggaggaagttagcacatgggttgaccgacgtggcagtgttggtatttcttaacgacattactagaaatataattctcaacaatggcgcagaaatacttctggtatattatggttacagagttcatccacaagcgcacggatataccattgtagcatttcacccgagagtattccaagagtatcgtatttattttatcccgtgagaagatcatgtagagacaactcaactaataatttatatattacttgtgataatcatattctaagcagggattaagataatccaagggtagagtgacacacaagcattaactactcattctcataatatatcatctaagctaagtggagagaaaagagaaagaaaatctattcctatacttctaatagtatacatacattctagttaactaatatactagctaataccctctatccgatgcccgcctagtacttcgagaagccacccctgactgccgagttccttacgacagcccgtcatgaccatacaaccggggctaaatacggagtaataccctcccagggaattaacttaggattatataccggcgcgaaggaatacccgtactgagctgtcaccatcagcggcccacctctcatccgtaatatataaccccaaataatgatatcctgtaatctagacaccacgcctaaactaccagatactactctaatatcatcgtcatgacatagagtaattgcataagcaaacattatacccgcaccaaaggatctcccagataagctagccgtatattcagtataacatgaacataatgtaaagtaggtattcatatacttgaaaagtatttcaataccataaatgtatttagaagagtattctaataaaagtacaaagcttacaaaagaggaaaggaaatctgctagagctatacccgaactcttccgaaggcttccggactcctgatttctactctattcctattccaccagctagatactactaaactaaacttgagagaaatgagagagctattgcttgaggtgtatgagtgaagtgaggagagcagctccttaaataggctgccaatgacggttgtggcagttggaatggtcggaattgccctccaaccttcattggggagttgatccacgctttccatccaaaactctgtatccaacggcaccgggggaggttcggccgaaccaggggccggtccatacctggcccatattcgtgtcaggtggcctcctctgttgttcttcttcgtagacttgtgaaatttggcccagtatgtcgtgttcaattctgagttcttggcccattcatgcataagtctactctcaacatcgtccgattgatttatcgtctatgttg

SEQ ID NO: 49844 - DNA, 2733 bp, Oryza sativa
tttcctcttttttcttttttttagttttgttttcccacacatacaatgtttccttgagtaacaaatttactaattgggtttatggtagacaatgcttttccctttacaatgaagtaccccaaaaatatcatatcagtaaaaaaattactactggttctatatagggtactgctcgttcttcttcttgcacatattacacaggcatcttctcttagtaaaaaaattactactggttctataaatggtactgctcattcttcttacacagattgtagaggcatcttctcttagtaaatagattacttctgtataatcaggtagagttgcaaatgtagtaatagatttactcttcgactaaactcaaatggcacaaaatttacattttaaccatactgccacataacgtagtaatacttttactcaagtgtatttttcacgtgaagtaatacttttacttttagtcaggtatatttttcactggatcactcaggagaaaccaaattaggagtaaacgatcaacattttcaccaaattaggagtaaatgatcaacatgtcactgtatgggtaaaaaaaattacacatccacaggcaaaaaaaaaaaagagaaggaaacatgaagctaaatccacaatgtgtcggcgtgactgcttggtacgtgttggatctggtgttgagggagcagtcggcagaggccacttcgtcggtgcatcaatcttccccagcggcgagcagaggggcaagccgtgttgatggatagaaaaattacgcatttgtcatctccagcatgaatttaagcacctcttcaattctgatttctaaactggataaagagattccacttgaaatcattcttgcaagcagcagggttaggcttcataatcctgatcagcaagtgcagctaatctatggactggttgcactgcttcccagcaatatctggcactatattttcagtggatggttccatgcacacaatatgttaatatacctgtgaacttaggctgtgtttgaggagaaggaaatagagaagattgggaagatatgcaaaacgaggtgagccattagcacatgattaattgagtattaactattttaaacttaaaaaatggattaatatgattttttaaagcaactttcctatagaaaatttttgcgaaaaacgcaacgtatagtagtttgaaaagcgtgcgcgcggaaaacgagggacaatcccccctatctcccctgaaagaacgcagccttaatgcagttgttagtaagttttttgtatgcgcttgtaaattacaccaaagctgttatccttcgacctcaccaaaccccacaactttcacaatatttcagagcttcgatgccaacagagtatcaaactgtccagccaaccaaaatgaaaattttaaaatggcttcacttggacaaaatgacattcagagctctgaaaaacatctctctcaatgaagattctccatccatctttcagccattcaaagaagtattcttaaaaaaattcagaggactgtttagcctatcagctaggtgttgtgctgaactacgaaatttcagaagctaataagatatcaactactactacaaaatttcagaaacttatcaggtagaaaatttcagaaactgctagcatatcaactaaatgttctcagaagactaatgaaaacaatacaagaggcagtcgagctgctctgctctattcaggaggaaaaaaatccccaaaaataaatcctagttaccaacatatttggatgcatgtgaaaaacataccgcaggcacccagagagatcaaagcatgtgaagggtcatatttgtacctggagggtggggtgttgatgatcttgttggcaaaaatagccaatgcagagaaacaccagagtatgtgcatgttgcaggtggtgttctactgctctgatcaggaaacctgcaaatcaatgaaaacggaatgcaaaacagatgtatgtatcccaacaaagatctgatgcactgttgtgtacattatgaatctctgatcaaatgcctacgcctggccaccgccggaagctgccgcctgctcctccaataggtctcaacttgggggagtggagcagcaccagtcgtcgctccagccaccgcaggatgccaccgccctctcctgctgacggtcactcggttggaggggagcaccaccaaccgtctgaatgcattatgagaacagtactcagcaggcatcaccacagtgaaatctttgcaaaatcaatgggcgtgtcagagaaaagaaggaaagaaaacgaagacgaacaggagaaagaagatgatcagatcgatggggttgatgccaggcgcacagaggagacgttgcattgcagcatcactggcatccctttcttctccctctttgtctctcttcgtggggaaaagaagcaagaagcacctggatctggtccgccgcatcactggtgtggatatggagccggcaacgaccagtcttcccacccctttgatggcatcgtcgcccacctcgatggctcggattgcaccagccaccgcatggaggaggtgaaccggacgccgggatgtggcctcctctccgccgctgtcgattccgtcatatccgccctatccaggacctccaccaccatcggcagagcaggggactaagcataagtgaagagggaacaaaccatcgccgcgtccctgatcctcctccatcctccacctccgctgcagtgctccgaccctagggagga

SEQ ID NO: 49845 - DNA, 2293 bp, Oryza sativa
gctatagccggaaccacgctggcagaccagcaggggtcgatgcccgaagcaatagataggaaattacatttgcttagcttagataattaaaacacatagaaagtcctctctagcccacctaccactagttgttgtcctttgctagtcttagccttaggtagattacacacgttccctgagttcgatatccttttggggtcacccgaaggtgaagtgctacagcagtattctgtgcgcttgcggatttatctgtggtcgcaagaaataccaacagtggttgtcctgttggtgcgcagttggttgggggtgaggtgtgaggtagggatgaaaacggagcggatatggacggataatgtttataccatattcgttttcatatttttttaccggatacgaaaacgaatacggatagctcgaatacgaaaacaaatacggattatctcgaatacgaataagaatcgaatatgatcggacacgaatacggaaataaatttttctcggaacacgaaaaccaactcaacttctaatagaaacaaatatcaacatatataattagctcattttatataaaatgaggtataatttataaatattttttaaaatttaaataatattaatagtatggactagtgttagagataaactactattaaaatctataaaggtatattgaaggttatagagttaaaaagaaatggggtatgtctcatgggtcctgcggatatccgaatagcactgttcaccggatatccgaattattatccgtatccgacggaaaccctggtaccatattcgtatttgtatccgggagaaaatatccgtattcgtatctgtatccgaactatccgagaattatccgatccgaaagttatccgtatccgtttttgtccggagcggacggaaactatccgctccgttttcatccctagtgtgagggggagtgttttagttattaggatgcggtatagtatgtctatatatagacacacatatatatatatatacacagtggcgctcacatgcgcttcgcgccacggtttaaatggcgccacacacaaatgaggaatgtcagcccaccaaaaccaaaccaacctattagagagttaaaaattaactgacggaaattgtggcgcaaacgatacctgcagttcgcatgtcaaagggagagcgaatgtgatagtaaaaatttaactgttttaaatattggtgatgagttaagatgttgcagataacaagttaaatttttaccgtggtccacccgtacgacagagtcatgtttatgttaaaatcggtggtggttgattgtgcatatgaggtcaaatagtttaaaattaacttgcatagaccgatcggtgatgaagacgttccgtgtgtgagaagttatagtttaactgattgagataattgttttgcctttcgatgtcgcatgtaaggagttaaaaatttgtctttgtttcgggagtactatagggccatggggagaatttaagtaaacgttggcaaagttaaaaaataactggaatgagcctatagatgctgaaagacgtatcagaggatttttttacacgacatgatttacatattgttatttaataactttacacgacatgatttaaatatagttatttaataactttacgtcgctatgctgtggtggcattatggttgtttatccatgcgcacattactccagatatatcgcgcatgcatgcaaacaagaatcgctacaaaatcgctgagattgtttgccctgatatgtgggaatcaaccatcctgtcagtttccccaatataaactgcccggctcatcatttgtattacgcagccaactcaaccatgggtgataaacaagagaccgaatccacaaagacacattttgtcgatcccactcacaaccccaccaccgatgccacgctgcaacaggatgagcatgagagtgatctccccgaagagtttggggtgacaagccctcctccactgtcgccacccccttacccgctgtcgccatcgatggaagatgatggcatgatctacgcggaggacttggggtacatgtctaccctatgcccttcccccccttctgacgttgacgatctaaatccgccggaagaccccaacaacaagattattctgcacccagctttcatcgacgacggcggtgaccttgatattatacaagaggacatttacaactttcgatatgaccagaccccgccaagagatgctcagtcaccagtaacccggttcaagcgccataaacgtgattagttttgatatgtctatttaatttttgc

SEQ ID NO: 49846 - DNA, 1251 bp, Oryza sativa
tagtcatataccaaaatgaccaaaacaaaaaagttgtagatattgatgatttatacaactttgttgttgatgactttttctgttgaaatcatttattatttgaaaatgttgtttgaagttgttataatttgaaattcaaattcaaattattgaaacagagtcatatagcaaaatgaccaaaataaaagttatagatattgatgagttatacaactttgttattgatgacattttcagttgaaatcatttagtatttgaaaatgttgtttgaagttatcataatttgaaattcaaattcaaattattgaaacaaagtcatctagaaaaatgaccaaaacaaaagttgtagatattgatgatttatacaactttgttgtttatgacttttttagttgaaatcgtttagtatttgaaaatattgtttgaagttgtcataatttgaaattcaaattttacataggtcaattaaactcagatggagaaataaccaaaataaaattggtagatctcaataagttatacaactttgtttttgacaacttttttcacataagttcatttagtatgataaattccgattcgaagttttaatattttgaaattaattgaaaggggggaggcaaaatgcacttctcggtgagggaggagcaaaaggcctgttatgggccagcccttttgcttccgctagtgtttaagcagtcggacttaccgttagtgttgtcaatgagcttgctcgtgcttctcggtcaccacacacaagaagcgacagacaagccgactggtgagagacagctcatggcatgacagacataaattcattctgagattggagtcagggggcgtactttgcaggggttaaggcataagcgcatacctgcctatccatacgactgtatggacatatagccgataagggtataccttgcacgtatatggagttgttcccagtaaatatcgcggtggaatctgttttgcaaatatatggaacaatatgctgctacgatgtcagcgtgattattgccaagagtgcctactacggcaagggcatagaggtttgctgttatactgtactaggtcctatatcctcaaacctttccttgggggtcaagatgatccacggtataaaagggaccccctgggaggggttcaggaaatccaattccatcaccaacacacgcaccaaagtttacgaagtcggagtacacggagccaagtcgccaggagatcttgtcgaatccctcgactacgatc

SEQ ID NO: 49847 - DNA, 2119 bp, Oryza sativa
tgctgcaaaaattaggattcaaatatggcattaaaattaacaaagtagcacccgacagacaaaggccagcattaaaaaaaaatactctttaccttctgaaaatgtgatatgtcattgtcagtcagctttgcacattgtgcacgcagatggtcgattttttgtttggtaattgcctctttcctctgttcattttcaaaatattttgaacccttgctcatttcgtagattaccttctgcaccttctctttgtcaactccctccattcctaaggcagaataacaagagaataaagaccaaagccatgctttgcacactggggttccatgttgtttccacagatatcacatattcacctaaacatgtaatataacttcctaagtaaagctccatctaattcgtgttctctctaccttaatcttttggatttatttgtaccagtgatttgcgcgatgcagaccccctaatgcccaaaaccctaccccctactggcaacaatcttacgcgacgggaagaggggaaatgcacactcaccagctttggcgttggtgtaggcggtgtggtacgactcccacggcctatctcctccgccatcgggtggcgtccccgccatcgcgtgcgacggcgaggttcttccccccaccgcaggcgggcgtcacgcgaggctaacagaggatgggaaggactgatcgagccgtcggtacgtcgggcaccggcgagctctccgccgtcgttggcaatcaggacgaggaagaatggaggggggattaaactccggcgaggtgaggtcggctccgccgccagccagcggtcgcgcgcgaggaaaggggttgccttttcctctcttttccttagaaaaaatgtcccgcccgtgggtgaaagctattttaattttattattagcttaggtaaagtaaaatttattatagaaataggatatatatatatatatatatctttttagaaaattataagctgtaattaggagtttgatcgtgtcaagttagcatgtaagtttttttttaaaagatttcttatacgacttcatttgtatttccaaaaacgaacgagcttgaaaactaactaaaatacggatttgtattttcaaaagcgaaccaacttaaaaatcgactcatagacggatgatttactaaagtacaggtaaaaacatctttaatttttataataaaatagagatttcaattaataactttttcttttttttctattcttctgtgagcggaagggaaaatttatattcacacaccacttctgcaattcgaacgctttttatatgagtttctaatgtttcaatgtgcatctttattattttaaaagaacacttattattttagtgcagctttattattttattattttagtttgctaccatgtataatcatagatatatacagagtttgtcagggttatggataaggtataccgtctatcctcggatatacgatgggtaccgatacggtatacccgcgcgtgtacgaatagtttccgaatacattaaggaaatctatcccgcgatagaagcagaatctacgtttggaaggagtcctacttggatgaggctgggtttttaccatatcgtgaggactccgatatctccgagtcctacttggagatcaactgacctgcggtatataagggaccccctgggcgggacctaaggcatcgaatctcaccgccaacacacccatcacagcctacggagccggagcctacaggagtcaagtcgccgggagatctagtcggaccaactcgactatggtctcgtcggtatcatcgagttctgttattccctttgtaatctgtggtgtccatcatataatcccataccaactggattagggctgacggagcgtggggctcctcaccgggagaccgcgcaggcccccctttgccggttcggccgggggcgctacgtgaggttcttcgcccttgatctgaagaacgtcagcgagagaggaaatgcacaagacacgagcgacgtagacaggttcgggccgctgagaagcgtaacaccctactcctgtgttctggtggatctgtgcgtgaaggaatccagagagccggagagcgagagagagttcaggctctcccgcccattccc

SEQ ID NO: 49848 - DNA, 2423 bp, Oryza sativa
aatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccggtcacggaccggataagcgtgcgcggcgccgcattaaatgcggcgtggtgcactcgtccaacctgctataaatgcggcgaggtgagccccgctgcgctcacctaacccacacacgtggcgccaaaaccacagggggtcggggcgccccagccctcggggccgaaacgggagcggtccgacccctcggggagacagagggaggggtggccacgtcatcctcgggcccgacccccccgagggggtcaggccaagtgggtgaccgcggctacccaagcctctagtcacgatacctccggccccatgtcaccgacagtagcccccggcgttacgccagggcgatcgcccccctcgagggaagcgctcgggcgtgacgccactccttaggcccggtgacaggtggggccggtccctacaggcggacagaaacccagcggtcgcaaatcgcgcgcatcggcaagggaaaaccgaccgacaataatgagcggcctctttaagaccgctacattactcgagcagcgcgcgaatcgggatgagccggttcgtttcgcctggagacatgatgatggcgcttttcacggttggcaaccgtagttaatgcgcgcacaatctgccccatctcaaccgccacggccgcacatttgccgcgtgcgccgcaaacgggcgagtggggttagtggaggcgtgggcgcgagaaacgagggggcgaggtagtgggcacgggaagcgaggagccgggcatagcgttggcaagggtgtaaagacgccgagaaagggattcgtttctttcctctcgccactcttccccttgccttcgccacttgtgctctaactcttcgtttcctgtgccctacccttgccgcactcgctcgctctcaagctcctcctccgccggcgtcatggcacggggctccgcaccgctcgacggtagcgtgctgccgccttcccgcatcgtgagcgagaggcaggccaggctgccgcgccgattcatgccggaatctgccaccggccgggaggtggtcgcgctgggcgagggacgcccggcgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttatcggggtgcgcccatttctccggctgttccggtggttcttcaccgtacagccggtgtcgccgccgacggtagtcggtggctgctacttccagccgcgggggcaggtgctgaaccgctacattccctacgtcctccgcaaaaagtgggacgactggaagagcgattggttctacaccccctcgccgacgaagcgcacctccgacttccgagccagcccccggcgcaggcctccagctggcgggcggcggtagatctgggagacggctacgacgccgttcttgaccgcctggcgggctctgcgaatcccaggggctcacgggggccatgtgttcggcgactacgttcgtcgccggatcgcgccgctccagcggcgcgcccgaggcgcctgggagtacaccgggcccgaggactacatgaggacccaccaggggcgcaaatgggactgggaccctgaggacttcaggatggtggtccaacgggtgctgaatctcagctccgtggaggcatccctcatccctcaaggggtcctccccctctgctgcgatccagagcgcgccaagattctggccatcatgcaggcggtcggggcgtcgggggagcgggccccccgaggccacgatggcgtgggcgggagccgcaggggggaacaatctaccccgggagggggtcgtgcttctgggccccgcgacgggggcccggggggcagccgccctgccgacgcccgggggaagaggaagcaggagggtacccctcccccatctcctccccgagggggcggggcggtgcgtgccagcagcaggcgcccggagggtgccgtgccgacgccgcagcccgagggggagcgaaagaagaaacggccccgcaagatgggggggatcgtgccatgccgggggaacctcatctcgccgccgaggtggtcgtttagccgacctccccgcaggttcgtccccgcgcccaccgcggccgtattcattctcccatctcccaaggcgagttttcactcacccgtttctttttgtcttctgg

SEQ ID NO: 49849 - DNA, 1917 bp, Oryza sativa
atctgcaatcaagtaaaaggaaatttctgcgtcagttcagtttgttgtgtgtgcgagacgaggatggtctgtgccgcggtccttctgtgtcttggcttgaacaagggctcgtgcccaggtcctagcctcaaacggcgcgggtcggggctagtgcctggggagatcctcgtgtcgagactggccaggccgggagcgcggtgaccgagggttatggatgacccgattgtgggcctttgccgattcccccccggagttcaccacgccccggggcacggctcggttttgggccccgtttggcgattttagccggcccgggccaccgagggcagggtcgagcacgagcgtgctaattcaagccaagattcttcagaaggaaacgatggcacagacacagtcctcaggaaatcgaaaatgcttttattgaaatacggaagagaaaaaaggtaagtatatgcatgtggtagcccccggccaaccctgcacgcccgggggggggggtgcggggttggcccgagcccgagacatgacacccgacccccactaggggtagaagcgacgaaggtgttcgatgttccacgggttaggcagctctgtgccgtcgcccgtggccagccgaacggagcccagccgggggacgccgatcactcgatacggaccctcccacattggtgagagcttgctcagtccagcacgcgtttggacgcggcgtaggatgaggtcgtcgacgcagagtgatcgggcccggacgtggcgctgatggtagcgccgcaggctctgctggtagcgcgcggctcagagggccgcgcgccgccttcgctcttccaaatagtcgaggttgtctcggcgaagctgatctatcagcctcgcaatacatggtgacccgaggggacctcagggtgagctcagatgggaggaccgcttccgcgccgtagacgaggaagaaatgcgtttccccggttgctctgcttggcgtggttcggttcgcccagagcaccgctggcagctcctcgatccacgagtcgccgtgcttcttgaggacgttgaaggtcttggttttgaggcccttgaggatttccgcgttggcgcgcttcacttggccattgcttctggggtgggcgggggaggcgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagccccctgacagcaaacggccacgaaagaggtatggtctgcagggcctgggccggctgatgggtttgcctggcgtggaactggcacgccctgcaccgtcggaccaggtcgaccgcatcgttgagagccatcggccaatagaaaccctggcgaaaggccttgccaaccaaggtgcgtgaggcggagtgggctccgcactcgccttcatggacatcggcgagaagctcaacgccttgttcccgaggaatgcacttcaggaggactccgttagccacgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcgggtcccgaggcctggactccgacgggcctcgggggccgttcaggcgcgtccgtctcccctagggggtcgggtcgcgccgatggctgggcaagcctttcttcaaaggcgcccggtggggtctgggctcgcgaggaagcgagcctta

SEQ ID NO: 49850 - DNA, 2189 bp, Oryza sativa
tgttcttttgctgaaatatctatgaaatgcctgaactgatttggcctatgtcatattgagctgaaatttgctgagttttgttgatttggcctatgtcattgagctgaaatttgctgagtttttttcaacaaaattggcacctgctatgttggtctgaaaatattgccttacaatgatgtcagattaattggttcattctacaattttatcatatgtggcctattgcacaattgatttgctcaaatttgtatcaaactaatcatttctttattacctacccattttcataatctaccatttcagagttcaaataacacacaaaatttgattcagaccatttcatcattcagctgcacaaatcctactcaaaattgcatcaccctattccatccattataccatttgttttcaacatccaactttccacaattcatccaacaaaaaccacaaacttagcacaattccattctagattccattacacaataccaaccaagttccattccataactgacaacattacattccactgcgactaaaaagatgccagattcatttcctacccatcaacatagcaaacacaacaacaaccagtcctaaatctaccaacaacatcacacatatctcaaactttaacctactattcctatccttcaacacccctaccacagcttccttctcaccaacaaccttcctcgatgtggccaactcattcctagctaaaaccagctctgattgcacacatcttccttcttcaacagcagccgaaaaatctcccttctccctcctcagcttccacacttcgtcgcgcaaatcgttcaacacttctctaacgaaactgttcgacggaccatcaacccaagcaaaataatcgcaacatccactctgcaacagtgaaccaatttaaccctagaactcagctcaacaaaatcatggaccccttgaaccctagaacttagctcaaaaaactcacccttgcattcacacatttgaagtaccggcacccgggattgtctgggatccacgaaatccacctcgccgccttgttgctgtacctgcataccaccgctggctcatactccaaagggccaacccgatacgggatgggggaggcagatgtgcgcctagaagacgccgacgagccctcactcctcgagctcgccattcaccgccactcatcgcgctagaaacttcgccgccgtcaaccgcgccgccactgtaaccccccgcgtcgtacccctctccgccgccgccacaacctactcgtagcaacaatggggaacgaacgagcgacagagataactctagaagagcccccgctatttattcccaactaccgtcgctgagtcagcgatgttgaccaagtcaagcagccacgtcagcgaaaactgcacgcaaaacagccatgggagtcagtttgctcgggatttcaaagtttaggggtcaagatatctggttttgcggcaaagggtcacgatttagatccggatcacttttgagggtcacgaatgaacttattcctactagaaaatctgtgcgcctattatcacacccactatatagcctgtttatttgtttatccatgtgcctattagtttattgcatatactttcccaccatttagtacataggattccatatttaaaatatatttttgaccttcatgaggccaaacaaaaatgatcatccccttattttctctcaacttgggtgattgtatgattttgcagatattttctctgtagtaagtcgtgccatactccttgctcaatgatcaatttaagaagacatttgcttaacattctggatttctatattatgcaccccaagtccatcatggtcattttcaataaatctatgcatagtagtttgacacaacttcagatctacatcatgctagtcttgatgactgaatgttaaattataggggtttgaaattttatatttaatttaacacagaaaaatgattcatataaatgttattaacatatccatatatttgtgagcctaaaagtacctacctttgatcgagttgtgtcaaacaagacctaagtaaactctgtcgacgggggatacccgtagaccggatatagagggtattggggtccgttggtacgaggatctacgtagtacgacattcaagcaaacagaagacaaggattatactggttcaggccccttagtactta

SEQ ID NO: 49851 - DNA, 5858 bp, Oryza sativa
tgcaaaattataatggcatggttccaattcaccctagtaggtaatagccctaatccagttggtatgggattatatgatggacaccacagattacaaaggaaataacagaactcgatgataccgacgagaccgtagttgagttggtccgactagatctcccggcgacttgactcctgtaggctccggctccgtaggctgtgatgggtgtgttggtggtgagattcgatgccttaggtcctgcctagggggtcccttatataccgcgggtcagttgatctccaagtaggactcggaaatatcggacccctcacgatatggtaaaaacccagcctcatccgagtaggactcgttccaaacgtagattctgcttctatcgcgggatagatttccttaatgtattcggaaactattcgtacacgcgcgggtataccgtatcggtacccattgtatatctgaggatagagggtataccttatccataaccctgacagtagcccccgacttctgcttaaatgaactcatgtagtcgatcatgactcccaatgtcggaattgttgtcgttctcatctggttgatctcggtgtaaaaaaccatagagacaaagagccatcgacaacatcgcatgaagtccaacggtcatgagtgaatttaaattgaagtctgaaaactaccgagcgcaacgaacccaaaaatttccgacggcaatctctctcctttccttggaatacgcactgtcggcagagcgcttattgaaaggaattttgggaatccatttgaagtccgtttgccataaaactcttctgccttctagcgcccttcgtcttctctgttccccgcaaagaaaaccctagcttgcttcttccctcttgtttctcggcgatcctccggcgacgatggaccttgagaagtctacctcaaccacagggagacaggaggtatagaacctgaacccatcatgtgccacatggttgtggtcgaagattacatttcttgcgattttcttcctccgccttcggaatttcttcttctcgtcttgaatttctatggcctttctttgcttcacttgaaccctaactccatcgcattccttagcatcttttctcatctttgcgatgcctacattggggtagagcccttccttgatctattccgcttttactatgagctgcgatggatggaacccaacagggtatctggatgcgttggattccgacttcaggatcgcctgaagtcgcgttacatccccttccaatgcccctcttctcgcagcaagtggcgggcgagatggttctatcttcagatcgaaaactcggatcccgtccttgttgtccctgaagaacagccagaccaaatcccagagtggactgccaaacccgccctgactccctccctccaatcttttatcgagatcgtcgatgatctccgaaatcgggggttgtcggggtatgaagtcgctgtcgacttcgtaggtaggcggattcaaccgctgtaggcccgcgcccatccggcctttgattactctgggccagaggacacgacccgggtctctcctcgggatattttttttcttgcatgtcacatcctgatttttgtttcaggatttataaatcatttaataaattattattagaatttatattaaatgttctttaatttacaagtgaagttaaatgtgggaaataaaatttcccaaatataaagcatggatggatttaatttttattaaattctccatgattaagtcaactctctgaaatattctcggatttttcagagctcaattcctaaatgatacaaagaacagttcagtaattatttgatcattaatgatctaattataattgttaagagcttttcttgtttaaaaatccttaaattataaattgttggttaaaaggaattattagaaatgatcttaaaagcctaaaagagaagatctaattttaatttgctaaatctcaatataaaattgggctagataaaattttgttaaatacttctcttgaatctttagttcctagatttttctgggatttatttgagccaaggaagtatttttaataaatggaattgcatttcatgaataatttaaatagaaaaaggttttaaaatcctccttttggctttgggccgaaagtcagcccaagtctctctttccttctccctctctcctccccggcccagtcggcccagtccgccgctctcctctctctctctgtcgctgacaggtgggtcccgcctgtcggagtcgtcgtcttcctccggccgccgccgcccgaaccctagcgccgcgccgccgtcgtctccttccaaattcggccgcgcctttccttctccggtgaaatctttagaggggaaatgatctccgggatctcctctaccttttctcttttggaatcgtcggctaatttcctttggaaataggcggattcgagtttgattcggattcgtgtttccccaatctttccttccgacgccggccgccgtgggccttcgccgccgcctccttgcccctataaaaggacccccggtgtctcctctacccgccgccaccctcgccttcgtctctcggccgtctgttttggataggatcgatctcggccgttcgttctcgtgaaccgccgccgtgcacccggtccaccgcaaaccctaggcgatgacgcaataattcccttttccttctcaaaaataattcattattgcgtcataattcaattaaaatccatataagtgttttaatcctatttaatctttaaaaattcataactaattctttgtaactcagtttaatgtggttcaagttgcaaaagttgtataaaataaagatctacatattaaaattatccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcccacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacactattgggattacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatggttcattgcggagcaccagactgagaagtggtggagataagcccacgggggtcgctggggagtccatgccttgtttataagggggtgactatgatccgggaacggtgcactgtggtgggttgtgttatgcaaggggtaatgtcacagctcctttccgaggtaccgtggtggtaccgaggcacatggtgacatgttgtggggctgtgtcttgtgggtacagtggtacacctctggccagagtaaaactattcgaatagccgtgcccgcggttatgggcaggttgagcaatgtttttcgtgattagtcccacacctctcacaataattatggatgttatatctggtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaaagctgcttttgcaaatgagcctatattatgccatcctttggtatccttgtgcacttgcatatttgctgtgtggcttgctgagtatgtcatatgctcaccttgcaataatcaatcaacctcagttaaagaaaaaggatccagaaggagaagacatttggcttataccccagttgagctgcctgtgggagtggagccggagcttcgctagattttattttccgctgcagttttcttcttggtgaggacttagtgcctcttaagtaagtatttattgttttagttaatttgatgaatctgtatattaaattgtcagtttgtgtacctcggctgattcctggacgaggattttatgcacaaataagttcggaaattactagtgaattttcgggcgtgacattgcatttctaatcttgttccgagtgcatctgtttctcctgacttatcgagttctcattttcgattcacaggtctagacagtgacaccgtggggtgccgcgtcagtcaggtgatgatcagcgccccctcagcagggagcgacatcccgatccccctttgcgaaaagggcccagccgaacgcgccgctgcgatcaatgtgagtgtactcgatgattcctttacatctttctccttgagatcacgtcgtgacttcacattgtgcaggctctccctttacggacgtcatcgggccactagtggaccaccaggcggcggtgtcattgaagaagggcgtcgccaaggaggcgtccgacgctgctgctgctaccacgagtggcagcaatgttccgaagaaggggaggaaattctcctccgtacttgggacccgtcggaagatgccaaactctgctgtaagcttctctatcgttccctagtgcgtagtcggaacaatttgatctcataccatttcatcttactcaggactcggacgcgtctcctccgcctcaccgaaggcaaaggttggtgactatcggcgagaagtaagtaaacgttcttgagatcttgttattttccaaattccgatcacctcgcctcatggggaagagaaaaaactttgcagggcggcatgggcaaaggcggcgcaaggcgggactgatgccgcttccagcgcgtcccctacggcgacctcgacaggagtcgtggtcgctactatggaccaggaggtggcaccgagcggccctgccgtcagcctcgtgcctacccggggtccgtccaccgatgccctcacctgggggggagctccaagcagagatggagcgcatcctctaggccggtactcgcggcgtaggtcgcgagatcgaggaggctagggcggcggcggcgtcggcaaaccagcgtgccgaccagctagtgcgcgacctggcggaggcccgtgaggacctcctaaagatgagggagctggtggccggcaacgagatgcagcggcgcggactcgagcaccggatattggagctcgagggccatatgattgacatccgcggttcgctgcgaacatcgttcaccagcctgcaccaactcgccggggagtgtggtgtcacgactaccatcccggcgcaccccgatgagttctcgctgacgtcatcgcttgtggaactggctacggtgatggaggagatcccctccaagcatgcggctaggatcggcgaggagacgtccaacggcatctacaccggggcatgccatgtccttgcgtgcatgaggctggcacatcccgatctggacctta

SEQ ID NO: 49852 - DNA, 1894 bp, Oryza sativa
cgcgggcagcccgacataccggtgatgttcaggcgcttacgctcaagccgttcgtgcagtgggaggaaactagtcaaagcccatccgcggaagtgaacatggcgatgacgtcgctaggtttgtatcttgcacttcttcactccttgtgttcggattgacttgattagctgtgttctcggaggagaagaatagcttgacttagtcttttcccatagtcttttccctgtcgggcagatttcgagaacatgttggctgaccgagatcgtcgaatccaatattggaggacgaaactcgaggtggccgaactcaaaaaaaccatggtggaggtgaagaaggaccaggccgtggaagctcttcgaggtcgcaaggtgtggttcaactcgtacctcaagagctgctgcgcggtgatggtgagggtttgcaaggagctatgatcccgaggagatcccaagaagtcggcggccagttatatctcgtggttgaatggagccagtgcacaacttgaagggattggccagcacatcgacgatgccttgaaggaggagtgtcgtcgggcgagccgctacgccggaggtcatgtgctggcctgcatccgagatcaccgtccgcagctgcaactcgagttccttcgtgaggggttctcgcgttcccggaggacacccgcggagatcgacggtcttgcacagtcaatggcgctgcttgccgagaaggttttccgctccatggattggtgttggccgtcctggtagtttttgtatcctgtagaaaaatatctcaaggaagcatgtaatatactttgaagtatttatgacttgtaagaaatacttgtaaaatagaaaagggatctatctaactaagttttcttactctgggtatgttgcgtatgagtgttttctcactttgcgacttcgatcagtcacttgagctatacactctccctagccccagccttgtcatcggagaatcgttctcggaggataaggctcttagatccttgacctgccttggttgaaaaaagcattgaccctagctcccagccgtgaagttggaaaactcaatttccgattacacggcttggttaatacgcacggcctgaactcttacatgaccagatcttacatggtcatttgtctctacatgatctgacaaggccttatccgctctgggcgtccccagccgaagttcccttagattcctcagaggctttgccaggacggcgtaaagggacatgaggataggttttaactctaggtgtcgtcgtggtaacggatcgtcgggaaggaacactctgacaatattctttacctgaaatcaactttattgaaatcgtgagatgccttacaaatttggagactattgatttatacataaaatttacgtaattgatcaatgttccaggaatttgctaactcgcgaccatcgtcgtctgcaatcttgaatgcacatggccacaagacttgcgtgatcgtgtatggtccttcccacttgggtgagagcttattacgccctgcttgactttgaacccatcggaggacgtaatcgccgatcgaaagtgtgagtgctctgatgcgcttctcgtggtatcggcgaagggcctgctggtagctggctgctctgacggtaactctttctcgatgttcctcgagtagattcacatcgtcacttcgctgctcctcctgttccttgtcggagtacttctgtactcgtgtgctttgatgttgtagctccgtggggagcatagcctctgagccatacacgaggaagaagggtgtctccttattggatgttgtcggtgtggtacgcacggcccatagaacagaggggagttcttcgacccacttcttatcgtgtgacatgagtctgtcgtagacgcgggtcttgatcccttgtagta

SEQ ID NO: 49853 - DNA, 1954 bp, Oryza sativa
taaaagagaaagggaggagaacagttctacttttccaatatttttagagggcttctatggataaccatttggcataacctagggtcaaggggctctgataccaacttgtcaggcccggaatttctatccaaaattccaaacgcttacatgtgtgtgaaccctcgtccaggaatcagccgaggcacacaataacaaattgatattagagtacaattattactctaattaataagcgaataaaatgtcattacagaggtagatagttcctctcaatcaataaagatctaagcagcggaaaataaaataaacggcgcggacggctccactccacaagcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttcagaatttaataaaacagttaagtaataattaaacaatattaatccaacgctatacaacataccctgttgtataggcccaaccattctgaacaaccatcctggctgcacagttctatctccaaaccaggaatataccattccaaaccaggagctaatcaaattattaccaattatagcatcatttactatgatgagaagtgtgagactaatcacgaaagacattgttagacctgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttaaaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaaagaatagtgagtcataagttatcccaataatgtgctaatgtttctaagcatggctaagcaatcacatctaatatctagctgaaccaatatgtaaagctcaactagtcaagttataataacccaaggtatcaaggaataaagtaaccaaaaacaaaagggctataacatataataggttaattccacccaatgacattcgaaaataaatgcaatagttgaatagaaacaatagctttaaacgggatcaacatgctcaaagggttgtttgggatctgtgtgacttgccttgctggccttggaactcttcaaactcttctcctgtgaaaacggactctccggaaacgacggaatctaaacagaaaagagcaaaatcaccaaaacagcacataaacaagcatgaacagttttattaaacggaatctcgtcctcgagattcggaagaactggcgaacagatgcggatgagctgacttcaattcatcttctcgttcccaagttgactcttcttccgagtgattactccattggactttgcaaaaacggataacccgattcctggttcttctctcatctatttccaagatacggattggtctctcaacataggtcagatcctcttggtcttttatctgttcaagattagcttcttcggtaggtacccttaaacactttttcaattgcgaaacatggaacacattatggactcc

SEQ ID NO: 49854 - DNA, 13371 bp, Oryza sativa
catgtggattttttaacatgtagatctcaattttagaaaaaattagagacttgaaccaactaaaacggagctaagatgaattagttatgaatttttgaagattaaatcggattaaaacacttaaattgattttaattgaattatgacgcaataatgaattatttttgaaaaggaaaaggaggattattgcgtcagcgggctagggtttcggtggaccgggcgcacgggcgacggttcacgcgaacggacggccgagatcgatccatccaaaacggacggccgagatcgatcgttctacgaccggctcacggaagagggcgacgatgacgtcagcgatgacgtcaccaccggcggcggcggctcggcggctcgggcttgcatgctcgccggcgaacggcggcgcttcggcacgaacggagagcaccaaagggtagagcgcgacgcggcgaactcaccgatgaccaaaggagcggcggaagaccaagggacggcgacggcgacgacgaagaaacggcggcggtcttcgggtcgacggcggcgatggtgctccggcgatcttcggcggcggcgaaggagcggacgagaacggcggcgacttggcgatcacgacggtggccttcccgagcgatgacgacgaccgagacggcggcggcgcacagctggagcgacggcggcgacggcggcgctaggttgcacagcgctagagctcttccggcgacaagaggcgaaggcgagagtggcggcaggtagagaagagctcgggggtccttttaaaggggctaggaggcgacggcgaaggcccatggcggctggcgacgagaaggaaggtttagggttcggaggagagagacgaatccgattcgaactcgaatcaaacacattccaaaccgatttagccgatgtttccaaaggagaaaaggtagaggagatcccaaagattgtttcccctcaatcaatttcaccggaaacgaaaaggaatggccggattttggaaaggaacggcggcggcgcgaaactagggtgggccccacctgtcagcgggcggacgcgcgcgcgcgcgacggcggactgggccgacttgggccgaggagagagagagcggttttgggccgactttcggcccaaagccaaaagaagactttttaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttcaagacttttaaaattatttctaaaaattccaattaaacaacaatttatatattttgaattttcagggtgtgacagtagtcttgtgtgtttgctgtgaaattgacaggcttcacaccgctgaaccatgtcgcaggcgtctttgagcgcggttggccagaaaaacccttgtcgaaaggcttttccgaccaatgtctgaccgccggcgtgtgacccgcagatcccttcatgtatatccaggaggagatgtttgccatcgtcgaacgatatgcatttgagaagtactccgtttggcgcctttttgtatagatcgttgctgatcatacagtaaatcttggcttgtcgggttatcctctcagcttctgcgtcgtcctcgggcagctcatcactactcaggaacttgatgagcggggtccaccattcttatgtggtctcgatgtcggcaatgacgtgttccgcctctgtagcccccgagatgatgtctggggaacagccgtgctatctgcgtcatttgcttctttcaccgatggttttgtcaagacgtccagaaaagtgccaagttccagtggctctcgtctggatgcgtgccgtgctaggtcgtctagttcgatgttgtgcttacggtatacgtgtcggacctcaatcccatcaaaccttttctccagcttcctgacttccgcgaggtacttggataactcggggctagagcacttgtagtctttgtgcacctggttcgcgactagttctgaatcccctttcacgattagttgcttgactcctagtgcagctgctgctcttatcccggcaagtagtccttcatactcggctgtgttgttggtcgccctgaagttgaggtggattgcatgcttgaactgatctcacaaaggtgatgtcaagatgaaccctgcccctgctccttggctgttgagtgcgccgtcgaatgccattgtccatgtttcgctgtccgtttgactgtccgacctgttctcaagcatagtccagtcagctaaaaaatcagcgaggacctgggacttaatagctgttcgtggcacaaagtggacatcaaactggcttagctcgactacccatttcgcaatgcggccaacaacgtctttgtttctcacgactctccaagagggaaggaggaaacaactgtgactctgtgggcttgaaagtagtggcgtagctttcttgatgtcatgattaccgcataaagcagcttttggatctgtgggtatcttgttttcgcgtcgtggagagctgcgctgacgtagtaaaccagtctttgcaccttcgctctctcgacaatgatgatagtactctcagaatatggcgtggcagcgatatagaggaataactcttcattaggttggggggcaacaagtacagggggatctgacaggtagcgcttgagtgcaatgaacgcatcttcggcttcctgtgtccacacaaatttgtcttgtttcttcagcagggtgaagaaaggttgtcctcgctcccccatcctagcgacgaatctgctcagtgccgccatgcatccagttagcttctggacttccttgagtcttgtgggtgacttcatgttctcgattgccttgatcttctcgggattttcttcgatccctcttccagagacgaggaatccgaggagcttgcccgatggtactccgaacgttcacttctccgggttgagcatgaggcgataccgtcggaggttgtcgaacgtttcccggaggtcatcgatcaatgagtcgcttgtttttgtcttgaaaacaatgtcatcgacgtaggcctcaacattgtgtccaagtaggtcattgagtgccccttgaaccgtgcgctggaaagtgtttcctgcggttatcagtccgaatggcatcttgacgtagcagaatacgccgaacggcgtgattaatgttgtcttctcctcgtcctcttttgccatgctgatctggtggtagccagagtaagcgtcaagaaaacttaacaactcacaaccagctgttgagtccaccaattggtctatccgaggaagaggaaagtgatccttgggacacgccttgttgaggtcggtgaaatcgacacacatcctccatttcccgttggccttgcgcaccatgactgggttggctagccactctggatgaagaacttctctgatgaaactagctttgagaagcttgtcgagctcttctcgtatggcttgtttctagtctggtgcaaatctccgcagtttttgttttactggcttggcatcgggtcgcaccatgagtttgtgctcaatcacctcgctggggactcccggcatgtcggacggctgccaagcgaacacgtctgcattgtcgcagaggaaggtgatgagcgcgagttcctatttcttatccagtgacggcccgatcttgacattcttgtcggggttggcactggagagcggaacgatcttgattgcgccgtctggcttcggcgttttgttggtttttcttactttcttgggcggctcagttgtggcgggcgggttgggagtgtgctcgaccatgtcgaggctccgcttgtcgcactgcactaccagcttcgtgtttccctgaatagtaattgttcccttcggcccaggcatcttgagcacttgatgcgcgtagtgagatgcagccatgaacttcgcgagtgcattcctcccgatgatggcgttatatgttgtgtcaaactcagcaacatcaaaggtgatctgctctgttcggaagttatttgcttggccgaaagtcacaggtagcgtgatcttgcccaacggcttggacgatgactgaggagtaattccatggaaggtttgatcagtgggcgtcaactcgcttcgtgggatccccatcgcgtccaaggtgctggcgaagagtaggtcgatggagctgccgccgtcgatgagaacccatgcgaccttgatgttccgaatagtgggctcgaccacgatcggatatcgtcctggagtgacaggagtcttggggtggtctgcctctaagaattcgatcttctgctacgccgtggaacctccgaagatgttcgaaacatgaaggtcggagtctaggttggctgagtctgagtcctgagtagccgcttctgcggcgttctcgactacacgtactcgcttgcctttctccaacgctagttgctttgtgagtgcatttttgaagacgaaacaagtctccagagagtgcttgtctgacttgtgtatgggacaccatattttcttcgtgtcatcgccttgtgggtccgggtgtttgggtgggtcagcatattctgctgtgaggacctccgtttgagccttccgtttcccactcctgcgactctttttcttgcttgactcaggcgtgtccttggctggtttattctctctccctgtcttcagtttgtcattcttgcgcctcaaggcgtcatccacgtgagcgcatcgatcgacaatctcgaataacttgcgagcagttgtgatccgtcttgtcgccagttcctgggttgtgtagcgatctcggacaccagacttaaaagcgcggattatagaagcatcggtgatcttggggatcgtatttctgcactcattaaagcgccgaataaagtccctcaatgattcacccgaattctgcgtcaacgcgtgttagtcgtcctcgatcgcgtggcgcttgtatgttccttggaagttagtgacgaactgctgccacagatctgcccatgaagaaatcgagtaggacgggaggtgaactagccatgaacgtgcagatcccttcaatgccgccgacaaataatttaccaatgcgttgtcgtctactccggcaacgtagagtactgtggaatagacctgtagaaactcctcagggtcggtgcttccgtcgtatttctctatcgctcccggtcgaaatttctcaggccatcgaacatctcgtagagaacgagtgaaagctctgcacccgccgccaggggcggtgggttgtcgacgatcatgtgctcgtcgtggatgtctgtccgatgatgaagatgacgaagatgacgaggatgatgacgagccacttggttccggggcagggttctgaggacgacgctcgggttcttgcgagcctcgtcgtcgtccatcgttgttttctcggcgtcgatctccatcgtcgtcgtcgtcgcggcgtcgacctcgacttgtatcgcccggcagccgctgctcgtgattagcatgttctcgacggttgtggcgatcatcacggtctcggtcctcgctcggacgtcctccttgctcttcgttctcgcgatgtcgcgaagagacgcgatgtcgggaacggttttcattatcttgagtgcgtcgtgcttctcggcagccattcagatggtcacggaaatcactgttgccgtgaggtggagggtagcttgacgaggcggagtccgctattcaggtaattctccgttagcatcgccgatcggcggttgttttggcggtaccctggtagcggcctcctcgaacgcgttattgagattaatcactgattcccatagtcgttccgccctgttaacgaccaaatttggtaatctgagtatcaaagataaagatcagatcgaagcggaatctaaatccaagattgtttcggaaacagagcaagaatcggctgaagtccgaatcggctgtgatcaggatcggcagagtccaagttggacagggttagccgattgagctggatccgacaatatgacgaagaatacgttgtcaggttgagttaataagcttcatgatgattgccacgcatggatagagtcctgagaaggcaattgtatctattaattaggatattttatgtaatttccttagagatatgtttgggcaaaagtctgccgcaaagacttatggtatcttagagtttgttagagataagtgtcgtgtccgatatggacatattttgtaatctcggatataaatagaccccgaaccccatgtaatcaacaacacacgttcaatacaacctcggcgcatcgccacccttttacttttgttttgtttcgacgagttcttgctttcgggttgagctgcatcagtttcgatcttcaacaagaggtaaaacttgttatggcggcttgcgttctcaggattagtgcttccatctttatgatactctaatcttgtttatgtaattcgtcgagttatcatatatcttatataatctctgacaatatcgctatctaatctccaatcggctaacgtttgttaccagaaggcagccgattaggttaaataccgacgttgacttagattatataagatatctaccactctatgaaacatccaacggcttgattgtctagatattgtccttcttttcatacttatagctgtatcagttgagtttgatcttataagtcgtgattagaatcctaatctctagcctgcttttggttgccgattagggtagcatcggggtttcagccgatcttaccttatttttatgcttgattgacatgttaaatatgccctttatgttaagatcttgtcgcatttaagtatattaggctgtttgtttggtatattctacttgccttaatatcttaatatagagtggtaccggagtattagccgatacatgctagatttatctgatcggctatgctatgaacatatatggtctcgttgttaatatatatttcgatctaagtgatttatactgtctcggcatggcgaccgatctatcccaatcacttgacttaagtatatatcgacataaggattatatattgttaatatctacagctgatcgagtagatttagttctttcttacatattaataactgccgatcgatgcacatatgacatcggctcaaagataaatgatatgtcatcggcaactagccgatcggctatcatttatagatttaaccgcggtttctttgtctttatttcttattgattgcaggatcaaatcaactggcatgctcatacatctaaagacaagcttttagacctgcactggagttaagcagatctcctaggcctcgtgtttttacatcaacacgcccactgatcgagatcagcgttcaggacaggatcaaaaggggtttccctcagtatcgcgttgagggttctgatgtgttgggctggtgtaatcaattgatcttccgtttctgcgccgcctctagatgtgctggtcccatcgatagcgtacacgtcgcgtggtgtacttgttgatgatgaggcttggtcttcgagcagatgtaggacatatggctcgaggggatcgatatcgattgccccgatgagtcgatctgaaatagtcgccgctccttgttccttgtccgcatctctagaagagattcgtgactgctggaccttaggaggtgacgtcctcatggcgctgagaaggaccttgcagcttgagaggtcgtgagtctttgccttgtgaatgggacaatagacatcacgagttggagaagtacattgaattccacgctctttgcaggcacggatttcagcttgtacgtcgaagaaaaccgaacaagcttgcaaggtgtgccttctggtcttgtggataggacaccaggtccttgtcgcctcggaagttatccttgttggctcatgcttcttatcaggaggacaagatttggccgcgttaggatccttctcaggcccagatgttgtcgatgttccgttctctgcttctgcgggaggatctttcgacatagagtcgaccggggtcgtaaccacgccgttctcgctcccggtaattgatgggccagtcgagatcggcatcgtggtgtagaccgggaagacaatttcgtcgacttgagtccacaccagcatcgttgaagttgaagctccttggttgatgccggggttgacgctatcgtcgagaaggcttgaagtcatagtagtagaaccttgagcaccaagtttccctacctggcgcgccactgtcgacgggggatacccgtagaccggatatagagggtattggggtccgttggtacgaggatctacgtaatacgacatcaagcaagtagaagacaaggattatactagttcaggccccttagtaggtaatagcccttgtcggtgacatggggctgggggtatcgtgactagaggcttgggtagccgcggtcacccacgtggcctgaccccctcgggggggtcgggcccgaggatgacatggccacccctccctctatctccccgatgggtcggaccgctcctgtttcggccccgagggatgggcgccccgaccccctgtggttttggcgccacgtgtgtgggttaggtgagcgcagcggggctcacctaaccgcatttatagtaggttggacgagtgcaccacgccgcatttaatgcggcgccgcgcacgcttatccggtccgtgaccggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccgggaaggcaggcgagcggggcaggaggcatgtgctctgcttgtcagacgttacttccggctgtagactagccctcattgtaaaaagcatgtttcccttcttaggcagggaggggcccatgtggtgacccgggaccagagaaaaaggaggcccaggcctaggagaaaaaaggagggaaggagggggaatgggcgggagagcctgaactctctctcgctctccggctctctggattccttcacgcacagatccaccagaacacaggagtagggtgttacgcttctcagcggcccgaacctatctacgtcgcccgtgtcttgtgcatttcctctctcgctgacgttcttcagatcgagggcgaagaacctcacttagtgcccccggccgaaccggcaaaggggggcctgcgcggtctcccggtgaggagccccacgctccatcatctggcgcgccaggtagggggcgcgcgtgtctttctaagccctcgtcctctttcgtatgcgccaagcttctccggctcagcccaatggccgaacgggcagtggcgcacagcctctctccgaacgctagcggtgacgacgaggagcagaacccgtgccgtcgggctcgcaccccaccgtccccctctcgccgaaatcttgggcggggggaagcgctcggggaggtcgaaggatccgcgacttcgcctcccgcgggcgacgggggaggacggcgagacggggcgcgtcgccgcctcgtctacgacgatggcggcacgccccagggcgcgctccaggctgcgggcgcgctcctgcgtcacccgcccatcgtccccgatccagagactccagcccgacgttggctggatgacgtggccgacttggtcatgacggcgcagcagcgcctaagcgcctgcgggcggtcctccgccaccgaggcctctggcgcagccgccgccggctccatgtcgtcgaggcagagggcgcggcgagcggcggccgttacccgccgttcgtccgccattccctcgccaacgcctccgacccaagaagatgtgtgtggggggccggatgcccgcctcgatatcgagcgccggcgcgacgctcgtcgcgccgcccacgcaacggagggcgcttcctcgtccggagcgccacttcggtccgggcacgggggccggccccccgtgtccccggttggtggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtctactcttgggaggatttgtgccagcagttcaccacgaacttccagggcatatatccgcacccaggcgaagaagcggacttgcatgcggtacagcgaagggacgatgagtctcttcgctcgtacattcagcggttctgtcaagtccgcaacaccataccctgcattcccgcacacgcggtgatctacgctttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggccgcccctgggtccgccgctcggtcagggcggcgggacaggaggaggaagaaggggtcggcccgttccgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagtgccgtgagggcaagaccccggcggctcccgccggcaaccggcgaggtgaggccaagcagaaggccaccgccgaggacattgacgatggcgacgatgacctggggttccaggagcctgaggccaccgtcgccaccgtcgatgggggagcgtgcgctcacgcttctcgccggagcctcaaggccatgaagcgagagctcctggccgcggcccctacccatgaggcgacgcggcgggcgcggtagtcggaggttgccctcaccttcgaccacaccgaccacccgccgtgcgttgcccggggaggacagatcgcgatggtggtttcccccaccgtttgcaatgtgaagttggggcgtgtcctcatagatgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctacaacgcggtcctggggaggcccacgttggtgaagttcatggcggcggtccactacgcctatctccagatgaagatgccgggccctggtggccccatcaccgtccatggcgacctcaaagtcgcgcttgcttgtatggagcagcgcgcggaccacctcgccgcggcgtccaagcccgcgggtggcgacgagaggctcgccacctccgtcccggccgccccaaggcagcggatggtcacgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgcttggagaccggcggacatgcccggagtccccagggaggtgattgagcaccgtctcgccgtgcggtcgggcgcaaggccggtctggcagaaagtgcggcggcaggccccggaacgtcaagccttcatccgcgaggaggtagcgcgacttctggaggtcggtttcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcaggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactacccctatttaagctcctcaaacgctccgggccgtttacctggatggaggaggctgagcgggccttcactcagttgaaggcgtacctcagttctcccccagtcctggtcgccccggagccagatgagccgttgctactctacctggcggcaaccccgcaggtggtcagcgcggcgttggtcgtggagcgcgacgaggaaaaccctcactccgcgcatccccaccctgcgtcgactcgacccgggagagagcagggaggagaggcccccgagccgaacggcggcccaaggcccccgacggccggagctggccctccgcctgcttgtccgatggtgccaggcgcccccgacccccaggatggccccggggccactgcgggaaggccgcgcctgtcgccctctgacctcgaggtcgtcggcacagaagccgagtgcgccccgcgtggcctctcggacgaagagcgccctggagatgcggcccctggcgaagaggatcggccccgccgaaaggtgcagcggcccgtctacttcgttagcgaggccctccgggacgccaagacccgataccctcaggcccagaagatgctttacgctattctga

SEQ ID NO: 49855 - DNA, 1830 bp, Oryza sativa
gcactgtcgtcaccgccctcctcgtcgcagtcgagcgcgaacgcgagccgaggggccgtaccctcgaagctgtggacgatgtggtcgacggcgtcccggacctgcgcgcgcgcgccgtcctcggttccgggagggaactcttccagtgctgcccacggggagaagtcagggtccctggcctggtagcttgccagtacgagctccaccgccccccgggcgaggtccctcgaggatgacttgatcgtctcctcgagctcctcggggagccgctcgagggccccggccatctctgagaggcgctgggcgaggcccccctggttggcggcgtacttcgcgtaccgcccgccccagaggcccgcctgccgcccggagcggtctagacgggagacggcgtcccgaagcatgccgggccctacctcgctcgccaagcggagggcctcgacctccccggcggacgagtccagcgcgccctgcagctcagcgatggtgtgttcggcggctgcgaggcgggcggctaggtcgccgtggccgcgccgccccgccgctgtgcgctctcggcgtccaggctccttcgcccgcgcctcgagctcagcggcccgctgatccagtgcggccctctcggcgcgggcgccttccagattgcggcgcgcctgctcctcccgcgctgcctcgcggaggaacaggctgtccgctagccactgcgccgcggcctcggcctcctcgagagctcgcccccgctcggtgagcgcgtcctcgcggaggcggagtgtggactcctcttcggcgcaggtggcatcgtgcgccgccagtgttgcctcccgggtggcgacggcggcctcgcggtccgccaggtctctctccttcgcgaccaaggcgcgggcgcgctcctccagcaccgtggcgcgagcctcaagggcctcttcgcgctgtcgggacaccgcctcgttctccgccgcccgccgttcccgggcagcggcagcgttaaggactccctgggcagcgtcgagcttctcctctagctccgccgcccggctcccgtattggaggcggaggtcatcccgcgcctcgtcgagcacggcggtggcgatgagggcagtctcccgctcctcctccacctccctggcgatctccgccaggtcctacgacgggcctcgagctgtgaggcgtgccggcggtgtgccttgcggcccgcctccaccatggcctccaccgagcgccgcccctcctcgacgcgcgcccacgccgcgtcgagctccgcccgctcctcctgcagggcctccatctgggcacttaacccgtccagcaccgtgctgttcgcggcggccaaggcctgcaggaggggctccgcgctcagtggggcagcggaagacagaggggagagccgcctcggtatgggtgccgcgcggctcggcccgccgattgacgtgccggactcgggggcgtcccccgaagctggctcgtcccaagcgtcacccgaggggtcgggcccgagcggcgcgcccgcagcctcgtcgtggttggcctcggaaatcgtcatcgcctcgggcggagtcgggtcgggggtgtggcaggctgcctggcgtgcgcgcgccgcctctgcctcccggacggactccccggcccggcggagtctggcctcctcccgagcggcctcctcagcctggcgaacccggacggcctcctgggcagcctcctcagcttcccggaggcggtccgcggcttcccgccggtcagcttcccgcctccgggcctccgcggtcgccgtctcctcggcctcagaccggccggacttggaatggcgggggggcgcgacgggatctcactgaggca

SEQ ID NO: 49856 - DNA, 1541 bp, Oryza sativa
accgagacagaagtcggtatgaaaatcctttttccaaaagtatctggcctgttcctcatgtcttccttgaacagaatcgagctgaacgggtctatgaatagcccctctgtcagattcccattggagaacgatttgagtacatcgtatccatacgcaacggagctgtcaatctctagcaatttcacgctgcaagcataccatgaaaaaataacacgaaaacccgtaaaaatgaaagcaagccaaaaaaaggaggggggaacggatgaaaacatgatgcaccataaggacataatcaatagtgtgatgtacaccgacctgtccatacgaccaccattggtcaataagaagtccctgagctgaacgctcagcgacacgtcagatggcatgatacttgggccaacaaccaccggcgacaaaaatcttggaggctttcgaataaaccgctttggctgagaccatggtgttgaatttacgacatcggtgtcctcattggtctcggccaatagctggcagaaaaaaaaagtgtttaaggtggaaaaaaaaggttaacccaacgtagttgtcgatcgaactaagtgaaatgttaacttccatctttacgtgagtcactgtatgactccacatgcatatcacactataattgttgactgctccttttatatgtgacaaaaaaagacagatagttgaaaacatgtgtggaaaaagggtatttcagtaataagttaacaatcggttttgtcattgggataagtctagaacagagttttttaagttggagttaattatttactctacagttttgcttaaatgtacactagcaaaattacccttgtgttgatcctaaaaaagatgaactaaatgaattataacttaactcacaatgaaaacttgttgagtactcatccatatgtaataagattatttgtttgaaccacttgctgacttattgcttggtcagtggagttaagacatgactgcctaactataatttattactctactatttgttatattgtacactagcatatatacctctgttatattgtgcactagcaaatataccctaagtgtacatgctccagccggtgcaaaaaaaatgtgtgcagggaaaaacccaactatgtgaataggaatttatgctatgaagcacaagtgaactcattaaaaatggatggttgggagtacaacctctgacagtgtaggagccccctcgaccctgcaaatctcctcgattttatcgtacacttgtgtgtcggttgtcacgtcccaaaacgaccctaaaatatatcccttaaattatgcttagaataattaaaatcctagtgaaagcctccaaaaattaaaatgtgcaaagctaaaagtcaaataaggcttggaggatttttgtatatttcctaaaagcctaaaatgtgtaaataaaatttagtggaattttcagagcacaaataataattatcaagaaataaacaaagttaaaaaggtttataaaaagaaaaacaaccctaaaaccctcgcccctctctcttgggccgaattcggcc

SEQ ID NO: 49857 - DNA, 4429 bp, Oryza sativa
  unsure (1)..(4429): unsure at all n locations
aagtcaagaacccatttttgtagctttgcctctgcttgttatatggagtttattagagtaaaagcctttttctttccgttggtcgtgtagacgctgcagcttcggaagatccgctcttcgtggaggttgacgccgacgtttgggaaagcgagcaaggcaagtcacatctcctttgaaaatattgttgtcctatgttttgttttaaattaatgcattatcgctttatttaaattcccgcgttatcactgttttacttagccatgcctatttacccttgttataaccttattattattgctattgttattaataccttgttcaccctaggaaaatgaaaccccaactagtgggtactctattcatggttccactagtatgaatttaggtagatgcttcgctgattaattaggcaacattaggtggttttataatttttagactttgggaattctcatatcacctggacactatggaatgattagattatgtggaaatggacacacacctccccctcctttcaaaacccccaaaatggttttaggctgggctcgaggtacatggttttgatagcagcacctcggccactataaggaccggtcttcggggctctgttacaaagcactaccgtacttccacatgtctagtgggtaaggcctagtttgtagctcagtctggtcataaacaaaagtacacggatagggatggacgaagtcggggctcgatggacatctctaggacaaatgaaggctacataagctgcggcctagtagtcgagatgtcataacacagggttggtgtcctgctgctaggggctcaatcttggttacctgtctcgggaatcccggccgtagccagggttgggtcggtactcttgtttacggctaggatgggttgggaactatgtcatgtcctccgtccgtatgccgtggtggtatgtggcacgtggttacacgtgaggaagatgtgtcttgtgggtaaagatgtacacctctgatcagagtataatctattcgaatagtcgcgccctcggttatgggcaagcctagcaatgtacccaagttagtgttttaattcctaaaacctgcttaacaactaaaatgtggaatggttagcctgggttggcttgggacgagctgggacccagggtcgggttgccagttctgtctgaatcatcgtaggccttgggttaaggcaggttcgtgtgggttcacggccttgattaacaacattgtgtagcttcaggatcgcctttacaaaatggccctgagcaactaaaagtcttggaaatgctatttactgcaaaccctaacccctttattataactcccttgtactcctttgcatttattctgcattcgtgggtgtttcttgttgagtacggtggttgtactcaatcttgctcaatttttccccaacccagaagtggagttcctggaggatgaaggctttggtgtctagctcgtgcctgccgtcaagtgcctgtggtcgtcgccctagtcttccgctgttttccgtttgtcttcgtgtgtgctgggccttcgccgcccatgtaataatttatctatttacacttctgcttgttaaactctgaattgtatcaacttttggtgtaccttgcctcctgggacaaggaataatacacgcacgtatggaatgcatgttgggttaattccagtcgtgataagttggtatcagagcctccttgaccctaggacgaaccctagaacccaagccttagcagtattttgaaataaaaatcatctcttatttgtgaaaatcctttagtctctctctgtcttgctgcttcatttctcatcaaaagctgatctctaaaatttttcttttgtctttatttatagatggccgccaacctcaaccgtcgtggtctggatctgactggctttgctttggagctgcggggcatgtgcgttgtcctgggatatccgcatggagtggactaccagggcaagaggcttccggagcaggatggtgacgatgcggagccccgcgccgcttgggaggtcactgcgatgatcctcaccggctcccctaagaggacttcgctggccgtcaccgcgggtagggactccttccccgccacctgccagaacgctgcactcctcgccatcggcactcttcaccagcgctacccggacgagttgcagcactcgccctaccgctactaccctcgtcgtggaggagcccgcgactacgccaccttccaggatgctagctcggaggatgacgctaccatcatgcatctggcgcgcatggtagaggcgtacgacgcggcccgtatcgacttctaccgcatggcgcgccgtggcctggtcgagaacaacatgaagatcctggagctgcgtcaagagaatctgcagttgaaggacttggacgctatggaggcgcagctgtgtcagctcaagattgctcagggggagatctgccgccccaagcgccgccgcgtttgccgcagctagaagattaccgcccgcaagagtacctccaggcctgagctggttcgtcagtccttggcatggacctgcttcgtggagactccttgcgctgagcctgcgcctgtggttcctcaggagttgggagcctctggcgttggcagcacggaggatgtgctattgctcaccttccgccccgacccatcgcagaagtagacgagcagctagtaggcccgcgcgtgtgttcttttcgtttgttctcttgctgagttgtgtggggcatggttataccggtgtgtggtataactgtgtcggagcctgtctttattttatttgcgtaagcaacttgaaccttaatgaaccaatttaatagcagaaataaatttaagaattatggtagtcgtgggtggttagttttaatcgtcagctctttctgtttgctggttctgtgtggaatcttcatatggtgacaaccaggagaagcactgctaccggttagggcagtcaccccgaaggcagccacaacaacaaccatggcagtccacctccacctccacctccccctccgccgccaccaccgccacatggcaccagccccatcctcacccaaatcctcgcccagcaggccaacatgatggctgctctcctccaccatatctagaatccgccgcaacacaatgctccaccaccgccaccaccacccccacagcactccaagcttgccgagttcctccgcattcgcccacctaccttctctagctccaataaccacgtggatgccttggattggttgcatgccgttgggaaaaagttggacaccgtccagtgcaatgataaggagaaagttatcttcgtaacccatcagctgcaggggcccgcatcgctatggtgggaccatttccaggctacgcagccagaaggacagccaatcacctgggcccgcttcaccgccgctttccagaggacccatgtgccagctggggtcgtagcccttaagaagagggaatttcgggagttgaagcaaggcaaccgctctgttatggagtatttgcatgagttcaacaacttggcccggtatgccccggaggatgttcgtaaagatgaagaaaaacaggagaagtttctggcagggatggaccctgaactttctgtgcgtctggtctctggggactatcccgatttccagcgcctggtggacaagagcattcgcctggaagccaagcacaaggaactggagtcgcacaagcgtcgcttggcgaatttccgtaatcaacagggggctaaccaaaggatccgctacaccaatccctatctagggggatcctcctcacagcagcagcagcagcagcctcgccccgtgccacgccctcagtatgtggttcgtgtcccacagccgcagcagcaacggcagaatcaacaagggaaccgtgcaccccgacctcctgcaccggctatgcagcctggtcaaggtcgcaaggatgctcaaggccagcagcgtctgtgcttcaactgtttcgagcctgggcatttcgccgataaatgcccaaagccgaggcgtcagcaaggcccagcgccaaagccgaggcgtcagccgaggcgtcagcaaggcccagcgccacccggccccaacaacggtggtaaggatgccacccggggtcgtgtgaatcacgttactgcggaggatgtcctgacaactccagatgtcatcctcgatacgttcttcattcattccatccccgctaccattttgttggactctggagcttcccactcatttatatctgtgcaattcgtggggagaaatcaactaagggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49858 - DNA, 1539 bp, Oryza sativa
ttttgagatgggtgaccgaccgggaagatgtaagcctccatatttagccccggttccttggtaattcatatttagccccggttccctggtaattccctgggttctactctcaggtgaaatgctacaatggtatatccattgctgggaattatatttctagtaatgtgatagaaaatagggggttctactctcaggtgaaatgctacaatggtatatccattgctgggaattatatttctagtaatgtgatagaaaatagggaaaaaggttgtgtgccactctacccttggattatcttaacccctacttagaatatgattatcacaagcaatgtataaattattagtccagttctctctacatgatcttcccatatatccgtgcgcttgtatttctgcgccattgctgggaattatatttctagtaatatgacgcgtcacgtggagtcacagaaaatagggaaaaaggtgcagaatctgtgagtcgaactcaaaacctcctggtttccgcgagagcctcaaccaccaggctatgccacaagctgtgaaacacatgtaactcacatctatttgaaccgtttttaaccggcggtttgaccggtccaactaataaaccagtgaaccgagtgccttaacggttcaatcaccagtctggtcttaataactatgaacagaacttgttgtagcagtggctggtgccttccttttttttgctctacacaaaactctatggagtgtttgatagtgtcgaaacaatattttggcaatattaaaagggggtggcaatcaagctagaaaagtggatgggttagaagacacaagatttatacaggttcataccttctagatgaaaagtaataccctactcctgtccggggattgattcgccgagtgtattattgatcgtatgatcagagagaaaagttatgcctctagaggctcccggacccctccttatatagggggaggagccggaattacaagatacaacccatgttcctaacggactaggcatgtaaagataaattataatcgtaaccgatcaggactatcgggtatttccttgatacacaagttaacataacaatcgagtcctttactagatatattctatctgtatatggtacccccatacctaatcgaatatccacgccatgtgggtatggggtatccataatctccacagatagcaccaagttgttatcttgctgtggggctgtgttggtactacctcttgcaactgcatggtgcctattacaagaggttttgttgtgaccaacttgtttgcatttcttgcatctcattacagtgcccatcctagatgcctttgttggttttgcaggttcattggcctctcttcttgtctctgtccttggtcttccaggcattttgacatagccaggagctttcaaagcctctctgtcatcttcagggcagctgttcatgccctcaactggcagtaggcaatgctcatatgtcttctagaatgcatctactgaatagcattcagctatgtatgcatccagtgaattggtcttga

SEQ ID NO: 49859 - DNA, 1695 bp, Oryza sativa
gtttgccaagcacctgttggaactggtagtggctgcaagaggcctggatatttagctctgtctggcttggcttgcaaacaggtttggcaggtctgcagcttggcctgaatcattttcttcatagcagtccaagcaaacatgcttttggctctcctataagtgacaggaaatcctgaatgtccaccaatgggggtagcatgcaatgcatcgattaatttctcttgcaattcagtattgtcccacccaaattctccccttgtatctgagaatgccttgtactgaagagaaatgttgcctagctgttggtgtgatggctagttctgctatcagctttgttgcatagggatcttgatcatagctgtgaacaatctcttgcatccaagaaggtacacattatgagacagtacacagttctgcagaattggcatggtccttcctggacaaagcatctgctgcagagttagttactccctttctgtaacatatatgatactgcagccccatcagtttagtataagctttctgttgccactgagtatgtaacctctgttcagtcaaatgtttgagactgtgatggtcagttaaaatgataaactctccatgctgtaaatattgtctccattgttctactgccaacataatagccatgtattctttctcatatgtcgacagcccttgagtcctgggtcccaatgccttactgagaaaagctatagggtgtttatcttgtgagaggacaaccccaatgcctaactcacttgtatcagtttccagaatgaactgtttagagaaatcaggcagagctagcactgaaaagcctgattggtttctgcaatccatttatatgggatgcccttccttaaaagttgagtgagaggtttactgatcagtccaaaggtttccttagtttcttgacagtggtaggaattgcccaattagccacatcttgtattttttggaatctgcggatactccttttggtccaattatgtgccccaaataggaaacctcttgctgtgcaaaagagcatttgctcagcttaacattccaattgttgtcagccagtaattgcagaattctcctcaaatgttccaggtgtgttatcagatctggactttaaattaatatatcatcaaagaagaccacagcaatttttcttagaactggagctaatgttgcattcatggcactcaggaatgttgctggggcccgtgttgtcacacccggagtttcccctttccatagttttaatccattaataaattatcaatagaaaatgctatgtttaaccaggagaaaaccctaattaacaacgggtctaataatcggatttgtcagggagaatttgtttttgaattctctttgctttaaaccattaacaagcctatcagcggaattttcagagcagagtaaataaccctgttaatttaaaatgcttacggatctgtaacagttacactacactctcctcttgctcttgttccccttcccttttgcgtcctgcggaaactcgattcgcttggtctcagctcttccgatccacgtgttcgcttgtaatctgctgactcctttgtcgttccggcttcgttttgttcccgcaggccgagtccttgtcgcattccttttctggctgccgtttcctttcctttctttaaatggcaccgcctttccctagtttttcttttcttttccgaa

SEQ ID NO: 49860 - DNA, 2614 bp, Oryza sativa
tttcggtatgttgtggtggcatgtcggcgcatggtaacgtgttgtgaggctgtgtcttgtgggtaaagttgtacacctctgatcagaataaaaatattcgaatagccgtgcccgcggttattgggcggtcaaccagctcgccgtgattaatctcattcttaatagtatgattttatgaactggtgtagttcaggtggtttggttgggcctgttgcaacgttgtttagcgttgggcagtgatgcttaatattgcttagtaatatttattgttttactacattcaaattatgatttataaatgttgttttatgcaaatatcctattgccaatcctttgttattaccttgcatcataccttcccattggtatgacttgttgagtacggtgccccagagacatagaattattcggatgatgattatttcgaggattaggcttgatccggatgttgaggatgcctgtggatttggaagaagctatgtttttctcgagaagatcttcgttcagagtttcaattattaattttattccgctacgtttgtaagacttatttattatttttgtaaggcgtggatctgtgtatcgatgtgtcgtttgtgtactctggctagtccttgacagagattttaatacacattccgcttgaaattcgagttagcgaatttctgggcgtgacacctgttagtccaaaggacatcaccttgtactcataatgcccagaatgtgtttggaaagctgttttgtgttcttcccctttagccatcctaatttcgtgataaccagctcttaagtccaatttggagaaccaatgtgaaccagataactcatccaacaactattcaattatgggaactggatatttatttttaacagtgattgaattcagctgcctgtagtcaatgcactgtctccaggtcccatcttttttcttatctagcaatgcaggagaagagaaagggctttggctatgttgaattaccccaatgttcaacatttcagtcacctatttttcaatttcattcttgtcaggcctaccttgatggcccaattgagttccttctcaccttgtaccgcacgtggaaagttgtttaccagctgctcgaccttagaactcagaatcccgagtgccgaattcagatcctccacctactaatcgacttggggaagacgcccctccaccgctgacttgagctcgacaagatcagctcgcgtgcgaccctccgacgcttccctctttttctcattctctgcgatcgtctttaggagcgagtcaaatttcccctccaaatccattccgcccatttactaagaactggatctcgctctcacacccctcaaatcctgctccgaactcagctaaccgattgaggcaagtttccttttcacggaattcctcttcaacgaagtggattccaatccccgatttggaatttcacagtcgagccaagagtttggtaggaattgaggcgtgatcttgtattaactggaaaccaactatacgcctaacaatctctctctctctctctcgctcgccagcaacatgccaactggagctaagctactaggcttcacttggtgttgatgtgaaaacacggcggcctgggagatctacttaactccagtgcaggtccaaggctagcctcgagtgtgtcaaggacgcgccaattgatttgatcctgcaatcagtgagaaagacaaaagcagaattagtcggccaatagcgtatcgttggtggtctcagccaatggagttagaccaaatcggctatgggctgagtatatcaaagaatattaaatcctaaatatgcctaatcagttgtaatactgtctatcaagtttgataaattggtttaagacaatatcataaaagtagccgatgtgacagtatttcgagcatgaaagataatgtactagctaatactctagtacaaacctatataaataaattgatctatataaacatgtcaaacaatgatcaagcatgatagtgtaaggatctggttgatagtgactaaagcttgatatgcttatataaaatgacctgtatgtataagtggcgaatatacatgaaacgaataaagaagcatgcatattaggtaagatcggctgaaaccccaatactatccttcttatgtctaattgcaggctagtttgcattgttctaagcacgactagggatgatgcatttgaaagtatgaaaagaagcatgcagtctagacaatcaagcaattaaacacttttaaggatggtagatgccttagctaaatctagcaagacaatttagccgaaaccagcataaaccctaaagcgagcaataaccgatagagcaaaattgagaagctaagaatatattaactaagacatatgatagcaatgactcgcgatatcgagcctaacacgtctaaagcgacatgttagccccgatagcgcatgccattgagacgggttacctcttgcgaagaactcgtcgaaaacgaagaagagtaaaaagggtggcgatgcgcgaagttgtattggattgtctcccgtattacaatgctatggggttcatatttataccccgagtacaaactattccattatggacacgactcgaacctttctaaaaacaagat

SEQ ID NO: 49861 - DNA, 4674 bp, Oryza sativa
ctgcttcaaccttgctccttcctctccgagtctgatgcaaaattatgttgttaacacatgccccccaattccgctgtattatataatgaggcagaattttctttcgtcgaacccgtgaaaatctagggtttctgctttgactgttaagcttataagcacatgcccactgtttcaaattttctttctccggctaagtccttcacaacctcccctgctgcacaagctctattatctccagtgattcctctagcgacccaaactcccggcggcgagcccctttgcttcgtcagctcaaactcttaacaatggcgaccacctctgacattcctgaggtaaattccttttctgccagtatctttcgtgtacagttctttcttaggccttagggtttcccgctctttcggcttttgttgtttcaacaccttagaagccaaatcttgattcatgtacttcatgtcgacacccaacactttcttggccctatgggtaatccagtgtaacatactgaaattttgaagaaaaaaatttgcgaaaagttttagttgtgctcttctcgacttttccattggagcaatcttgcttttaatcttttcttttatcttgaacctaaattttatttgcaaagttaaatgctctcttttaattttataaaatccttcttttattctctttttatttctttcgaactttataaaaacccctccatttatttttccctagcctctaacttttgttctggagcatatttcctttggatcctttcccaaacatttccagagtacatgaaacaccatttttcaatatccctagagttaacacttttcctttagaagcttatcatactatcaccaattctgttcctatagaaattcttacgattccccatctacatttatttccaaatccagttttatcctccaacaaatacttttcctttggaatctcgtatatcgaaattatccattcaaaatttcaaagcctactatttagcttggaccaatatttccccaatcggcccgtctctctgttacatctcattatccatttttaaccttgaggcaaaaccagcataattctaattttattggaatttattctagatcaaacctctatctagacctatctccaaaaatctttacttccactccatccaaaaatattatatcatttattctttggtcatgctcctatcttaatccagccgcctgtttaattgcggtggcttaatatccttcttggcacaagaataatattagcacaatattagagtgattgctcttgtgctaagaaaattattttaatccctttcttacaaaaatccaaattttctttagcccacaaatattttaccaaaaatccataccacatattttggggctacagtcctatttatttccctccatctatttctgccaccttcccaaaatttatccaaaattagaaaccttgccatttgtagtttctttccttcctatttgagtacttcaatttaaatttcaaattattagagaaaatttttcgtgacaagttttacatttgattcttattgaattctattaaaattggagcatttttattttgcatccttttcaaatttatatctcaaataaatatctttagttttattttaaaaatatttcaaacctctttagtactttaaaaactatattttatattatttgtcaaaatccaaaagtccacaaatatttttgtttcctttggatttcatctcctttgaattcaattcaaatttatctatgcaaaattctcaagagttactattcatccaggccaaatttccctctattcagcccattccttttctctccctccctccactttttttcttctcgggccacggcccagttggcgcatagcctagctgagccggcccagccgaagccgcctccttccttctctctctcctatgggcgcgccgctgcccacggcatggcgccatcgcccgtggtcctcctgccgccgccgccatcttgccgaccacggcaagtcgtcgtcgtgccgtgaatctccttttccgccgcccaactccactgtagccgccgtgtgtgcacgccgccctggccagccaatgaatggacgaggccagcaccgtgctccccttttccaagtcgctgccaccatggccaagtcgcccttctcctctgcgaactgccatcggcaaccgcctcttgtcgcctataaatagccggcaaggtttcctcttccttccccacacacaaccaagcacctcgagctctagctatctctcctgccatgaccggtcaccaccttgccactagccgatctcgtccaccggctctcctcacactaaatcctcacaccaccggcatggccttgcttcggtgattccatttttccactttttcccttcccttcctgtcgtaggctctccggaccttccattatatttgagagatgaagtgaataattcaagtcatcaaacaagcataatgaaacatccgacacctcgagagaggaatattggagacattgctgggcccttagcctgccagtcaacttcagcctgagatgtgcccgtcaaaccactcgaaggcggcgaccaaatgtgttacacattcaggagacttgacaaaaatggctaaagatctacaacctctcaaatattcctaactcatactcatgtgaatctagttcccaggatgtgcactagattcacactttcatcttaagcatgattacacatagcaaacacaactaagatgaaagaaacttaagacttacaacaacttaataattacataggccgaccggccaaatagacttattagagaacagcggaagcttgactacccaaacacaagcacaccgactaggggtataccccattaagttctcatcctagaagaagcaatcggaacccgcatcactcaaagactaagactaaacctgcaaacaaaaggttatatcaacagcaagagtcagtacattaaacaagttaatgtactggcaagcacaagtcaatcctaccatactacatgtaaggcatatattcaaaggaaggcaatatgtagttcattttcagcataaagcagttttgtttcgcaattcttttgtaaaagagttgatgcttcaattaacaaaacaaattttaagtttcaatatttaattcatcataattccattataatcaatctcctgttgtcatcctttgacaacaagtcataatatatcacctcacacacacacaactcaacacatttatcaatttcaaaccaatatcacatgatcacatttttaaaacatagtctatactcatgacacatcaccaaagcgctcatgaccgtgagcacggctaattgattagtttaaagaaccctgcagagtttgtacagctttacccacatgatatgaactctctagtttgttttgagtttgcaagactccatcacactcttcatgttgaatgtgatctagaggtcataacgaagcctttacactacttagaatctagccttgcaccagcacgatacgtgttcctccatcctaggcatacttggaaatatgtctagaaccgttaagtggcgggcccacgccttaaacttaacgccgtggtggcggacacaacgggaatccacccacgtggcacaataccgttgtattggacagacttagtcacctaaactaccacgtcggggcaaataggaagttcctctgaatcatcgactaattcctcagaattatcgactaactcatacacaccggcctaccagaatgcaaggctagtcctaaatagattaatcagcttaggccatcccatactagcacatgtggatgtacggataactttaaatgggtgacacaagttcggtccttatggacttgggcaaacacttcccctatcggtatgcaactaacaccatatgcacaccacttgccgcccaagtataaaatcacattttacacattttaattcgcaaatacccatcatattcattttattccagcaaaggttcaagtatcaaaaccacattttaattatagatggaatgagcatttgcatatttctaagcatggctaagcaagtaattgcacatagagcatatataaacccatttgagcacaaagagtgtactctaaccatttctaggggttcaaacagcaagaggatcaattattcaaggtggaatatgcagcaaataggtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaattgttagcacctaatccacttcttcaccgattatgcaattatctagataaaggacacgacatgcaattaaacaccgaaagagctgaaaatccaaaatgctctaaaatgcatgatttatgcacagtgggttggaaatgatctaaaatgaatttaggtgaaataattcctattttattttattccatttgggagttatgaattttagaagttttatcggtttacaatagtatagtcttaggtagtgttatgaaatacttttgtaaagtgatttcttattagattagacttcacagggggtgtggagatgtgtttttctaagactaacacattatggtttcacaatttttgg

SEQ ID NO: 49862 - DNA, 3651 bp, Oryza sativa
tacttaaacaacactatgtgtttaaattcttatttcactaagttaaggttttgatcaatgttctctacaaaaggtgacaaattttattttactatgttgaagataactatttgctggttctatagaaactttgttcatttcatttggactaaaaataaattttctacaagttttacaaattaaaggctgctctatgttagtaaatccttatatgaatatttagagacttttactacacagtaagtatataatattatttcataacatggaaatacatgtgttagtgatcctacataacttaattttattcaaattgaagctaaattgggttctacatgaatttctaaagtttagcttatctaaaactagtcattttaaagataatagttttagaggcttttgatgcaaagtaagtaattacttttatttcacttaatcagagactgtatgatgatgaatgatgaatctgtagaatttgattttgtttcaaaatgagttgaaatgaattttctatgtattttataagtttgtacatgttttatgcatgacttatcttagataaatcttagagacattatttgtacagtgagtgtcaagttttatattcctggaataaagttcataacttcaagaatctacagaaactggaatcacttcaaaatgagctatatttgattttatatagattttacaactttgtgcatctttctgctaaacatataattgtttgggcattttcctaatttttcttcagattttaaaggatgggtccacatggctgtgagggaccaatatgcacaaaggcccttgagttttctaggaatcaacccgcagtcctaggcccatatgtcagtgtgtttctacaattgtaaacggatccctgcacttaatctaattcacagaagtcatccctctgctctaggcagagcagagctagccatggctgagctcgatctggagctcgccggcggcaaacggtggctcatttgaggttgaggtcaaaagataaaatgaagacaaagctctcgcgattccattcctctagttttcttggttagaggacatcggagtagcgccgatggcgagtgtgagcggcggtggttttggggtgaaagtgcatgtgcgcatggaagtcgattacgaacgaaaaggatgcatgcatgtggtcttctagacttcaggatgctcaccgtgggtcgagctagggttgtcgaggtcttggcggcagcggtgacttgtggaacggctcggcgacggcgctcctcctcgggtgaacgacgacggctcgaacgggacaatgagctgcttcaagcaagcatgcacgagggttgtgaggtcaaggagatggtgtatgcgcaaggaatcgaacaatggctcaccgaggcagcggtaatcgacgatgacggcggaggcgatcctagattggcgccggtgaagaaaaggatgtgttctccgtgttcttgatgtttccggctggggttcttgaggtgttttgaagaggaggttgaggcgatgacaatggcgcagcggctttctctgaggtggatgagaatggccggacgacgacgatggttgaagcggcggcgctccggtgcgtgctccaggacgttgtcggcgtggtcgcgttcccggcgatgcactgcacgagaggggtttaggtcaaaagaggaaatgctcggcattgtgtggagagatgggaacgcgaaagagatggaggtgaccttgactcaaacggagatggcgaaggtcgtcgtcactacgaccggcggcaaggtttggggcgatggagaggcagagaacctcctccctcggcttcttcagctccagagtgatgaatggagaatggcgacgcgtctgggaggagtagagagcgagaaaagggaaaccgagatcgacgacacgttgcggccacgcgtcggctcgctcaatctcttcctctctcggctggaacagtggaggaagtgatggacagagtcaaggcaagcttaagaggctgtcaggtgggtccaggtcgtggcaaactaggctagggtgagagggttgggtaagattctgggtaaacttgatttttagatcatttttttttcggaattattttctcctctaactttgtagcttcataacttaatgtgtagaccagaagaattagtgtagattttactggtggtagatgattacacctagattccattttctttggttgcactcaaaaataatgggtggactgctcacagaaattaaacaaagatgggctattagaaagctagattgaatttttaggaggcttaaacagaggaggaaaaatctagaaaaattacatttattcatgataactaatctagtatttgaataaattatttcccatgttcacttatgtgcagttaaatgtacttttggatgaaatatggttttagccgattaaatttaatttgatttcttttagttgtctgcttcgaccgattaatttgagatttcaacttgagtgttaacatgttaccaaaattacagaggatatgtttgtgctaatcactgtccacataaatttttccatgattttatcttgcacaaaatattttagagaattaggatgacctttgtttgtatatgtgttcccacttcataattgcatctaatattattatagggattacattaaacttcttttagactgagaagatgatatttgagtttaatattaagtccacatgttatcacccaagattaactataggtttgtttagtgaaataattcttttagattatgctcatgggacctattatggaatgcaagaccaaaactccaaatgcacaaagaactcgagcctaggcatgcattatgtacatgtatgcttgatgacatttctagtctaatgttgggaatgaaaagattttattttgttctcaaattataatcatgcaatggtttaaattggtcatcacctaaattaaaacggaaatttttggctctaaaaattggagaagttaacctctaactattttgacaagaaatttttaagtcctaaaatttcgggtatgttacacttccaccccaaataatgaggaaataggtcccgatcttttgataggtattgattaacaatcgatttggtggagtagcgacacaactcgatccggcttctgaacaaacacgctcttaagccccataatcgcagcaccatattttctctggttatcaaccatgccgaaacccggttgaccttgtcgagaaggctaatccctatatgcgaattcaagaacacaagcaagaacaagatagattgcaacacaattgcatatgaatgattagcactcgaatttggggttccacaaaccgatctagcggcgaaactgttcttgacagattaatctaagcaaaaccccctctaaacgatggtggctactgaataaatatgattagggacatcgtagggttgccttagggtgcacacccgcttgggttaagcccacgacacaattacaaggcccaaaacccaaatcagattcggactggataaggtatgtggcttgttttgcagattcccgacagctcggtaggaattttgatgtgggaccaaaaccatctgaaagtagactccataagtttttcaaaaccatctgacagtactcatgggccccgaaattccttctata

SEQ ID NO: 49863 - DNA, 769 bp, Oryza sativa
tggatccccccatttttgcgcacccaccaaatggtcacccatcctgaaattgctccaggacaagcacgcttaacctcagtgttctttcgagatcgatttccggaaaagaagttgcaacttgttgatatgagtattctattaatcctattaagccctaggccgggatgtcacatcctcaccccgggatgtcacatggtgccccacgaatacgtaactgcccaggatgttgatgttcagttacgcatcaaatgatataaaagcataaacttcgattatacaatacttaagtcacttagttcataacacaacataaatacaaaccattatatatatggcttataaagccttatttctacaaacagataaactgctagactccaccacaggaactgcctgagcgtaggatgacctagaaaccatagctgtcccactctaacggatcaacaggttctccacaagcatcttcctcctcatgatctgaacccatttatgagtacaaaaggtactcagcaagacatgcttatgataataaatacaataattgcaatataaaacatgcagtatcgagagctggaaggtttaaaccctaaccttaacagttatttcatatagcctaacataataaacatttgatctaaacaacactattgaacatttaatttaaacaataataacgagcataacaatataaatgttacttataaataacttgaatagaacattaaacaataaataagttaaccatattaattaatagccatttagttta

SEQ ID NO: 49864 - DNA, 2444 bp, Oryza sativa
ccttgggcggcctggagcggcggcgcgccgtgcagccggcggcggccgaacagagcggcgatgccgggaggcgacgccggcgacactccggcgtcggattggattgggaaagaaagaggaaagggagtactcagcatggagaatccatttttacattcaatttcataggatttgcgatgtatgcgacgaatttgggagctctatcaatggcccaaatttagggttttggggatttttcctccggtaatggcgatttgattcagcgggggtaggggcgaatttgaggaggtgaaagaggtttaaattgtgcttcttttgcctccggtattgtgccttctagttaaggaacgaaggagatacggaggcgggaagctggaggtgtcgcggcggcattcgttcgtcgttcgtcctcgtgcgagcgtgtgcgtgcgtgtggcgcgcgcggggcggcacgagctcagcgcgagcgtgcacgggattggcgcgaggcagcaggagcttgctcggcttggctcagcctggcttggcctagccgtgtagaggaagaagaaagaaaagaaaaacagagaaagggaaggagagggagaagaacagagaagaaagaaaagaaaaaaaaacagaaaaggaaaacatggggaaaattaaaatagataggattggaattgatgtggaattagatgatccgatattcggaatagatttaaatcggattcaagggaattatttgagggatgatatgcactttgcgacaaaattaaacgagaaaagaacatcgaaaataaacatggaaaataatattttaaatgaactattaactcgacggttatatttttagagaatcaaagcaaactaaatcgattttaaatagttgtcaaattttagggcttttacatgtacccgcaccaaagcatctcccagataagctagccgtatattcagtataacaagaacataatgtaaagtaggtaatcatatacttagaaaatatttcaataccataaatgtatttagaagagtattctaataaaagtacaaagcttacaaaatagaagagaaaagttgctagagccatacccaaactcttccgaaggctttcggactccgatttctactctactcctattccaccagctagatactactaaactaagcttgagagaaatgagagagctattgcttgaggtggtgtgaagtgaagagagtgagctccttatatagaggtagttatgatggttgtggaaggggaattgtccaaagtgccctccaaccgtcattgggatgcaatcctggacgtccacgccaaaacctggatccaacggcgccaggattggtttggcacgaaacctggtgagttacggccgaatcctggagctggcaccaatgccagcaccaatttcggctggtggccctcctctattgctctactccacggaattgtgaattttggcccaattcatcatgctagttctgagttcttggcccatctattcataagtctggttctcgacatcgtccgattgatttatcatctaagttgatgccgattctcctccactttattgtcattctctgcaaaagtttagtaaacctaataatagtagaaaattattactctaacatacttatgcattgcaagcataattattactctaacatacttatgcattgcaagcatcactagttctctcctattttggtaatattgatgttcgaaactgatcgataacgaccgtcaacagcgtcccagcagtcgaactaccccggtttttccccggttcttcattaaaccgtccggttcaactagtttactgccggtttgattgctcgccgatcttttagctgaaccggaccagccggcgccctggttccgatttttcccggtcgaaccgccggtctggtccggttctaataactatggttctattagcctaacacacaacaacagttcaactaaacagaaggttagatgttttccaattgttcttactttaatttgcatttcccaattctgaacctatatgcttattcacactgtctacataatttttcaggggctacatgatcatattgttaggatgaatgctaaggcggttgcaacacagtcaggtggttccgcaacagtcaacctgtaggcaattgtgccatattcccagggttctacatcagcttcaattcagatcatatctgggaaggcatctgtttcagtctcagctcaagaaccagcaaagaagaaaacatctactgggcctgctccatccaagaaggccaagactccaggatcaattctcatgctgccaccatgggaatctgacaaactttgaatcaatctgtgtgtattgctaagtattgacatgccttagctatttatcctatctgtgatgtaatgccattcatgccatatgtcatgtaatggttagaatgctgctatgccagacttgtaaggc

SEQ ID NO: 49865 - DNA, 2284 bp, Oryza sativa
ggttttgtccaggagttgcgtacaatgtcctttgccataggatttgggactgcccctttttatgcccagattactcatgatcgtcacgaagagaagtgccgagtcaaagtcactttgaacagtaatagtgaagatatcccctcagtgatgttcgaagctggaggaagaaactacatccatgcatgtcaggaggtggcaaggatcgccataggagagctccgcgatcgctacagtgatcagttggccgacacggagtatcgctatcatcctccagtcgtcaatgtaagtgatgatgaaggagaagaatcgaagcgcactcattccaagattgagtggggagcaactcaagctgataagacgagccgaacgagccttcaatcaactccgatgctcggaagacctagaaagccttgtcgaaccgttgtcttagatcgttgtgttagtttgcttgttttaagtttggttgtgtgtcttgcatgtgatttacatcagtggtgggatgtaagtgcatgcgtttgtttgcttttgagtgttaggaagttggtgagtttagtggtgtgagagtcttcagtttgtaataatgaaactcacttaagatcaataaaagttaaagtaattctctgtcctaagtagtttcccccggtttctcttcttgtgccctgcccataccagatggtgaatactcgcagcaatgggaatggccccaacaaccccaataacaacaacaatggagagaatcccacacttgcccaagttcttgctcaacagacacagctaatgaacatgatgatgcagcaactccagaaccagcaaaaccaaggaaataaccatgcacctccccagaacaagttagcagaatttcttcgtgtaaggccgcctactttctctagcaccgctaatcctgttgaagctggtgattggttgcatgccatagagaagaagttggatttgcttcaatgcactgatcaggagaaggtctcatttgcatcccatcagttgcatggccctgcctctgaatggtgggatcatttccgcctgaataggactactgcggaacctatcacttggcttgaattcaccgctgctttccggaagacgcatataccatcgggagtggtgtctctcaagaagaaggaattcaggtcgctcacccagggatctcgctctgttacggagtatttgcacgagttcaatcgtttggctcgttatgctccggaagatgtgcgcaatgatgaagagcgccaggagaagttcttggaaggacttaatgatgagctttcttacccactcatgactggagattatcatgatttccagaagttagtggataaggctattcgtcaggaggacaagtacaatcgcatggagcagaagaaacgccggattgctcaattcaagacacaacaggggaataatcagaagccgcgtcttactttaggaccccagtccatgccacagggaggttcttcgtctgttgttcgtccgaagcgttagttcttcaacaacaatgctggcaacaacatccgcaatcaagctccacgtcctgttgcagctccagcacagcaacaacctgccaagagggagcaaagcagcaagcccgtggtgtgtttcaactatggagacccaggacattatgctgacaagtgtccgaagcccagacgcgtgaaggttgtccctacccagagcaactctaccgcaccagcatcaaaggctcgtgtcaatcatgtcgctgctgcagaagcacaagatgctccagatgtgattttgggtacgttccttgttaactcagttcctgcaacagtgctttacgattctggtgctacacattcattcttatctatgagttttgcaggaaatcatgggatggaagtagaagatcttagacgtcctttgatggttagtaccccaagtagtcaagcactctctttgcaacgtagcccctctgtcagaatagaaattaaaggagtaccatttctggccaatcttatcttgttagaatccaaagaccttgatgtcatcctagggatggactggttagccagacataaaggtgtgatagactgtgctaacagaaaagtaactctcaccagcaatgatggtcgagttgtgactgttcatgcattgtcttctgagtttttaaggtcaagactgaaccaaataattctggaaaagattcctatagtccgggagtatcccgatgtgttccccgatgatttgcctggtatgccgcctaaaagggatatagagttcagaatagatttggtaccaggaacaactccgatcc

SEQ ID NO: 49866 - DNA, 8176 bp, Oryza sativa
  unsure (1)..(8176): unsure at all n locations
nnnnnnnnnnnnnnnnnnnnnnnnnnnnnnnnnnnnnnnnnnnnnnnnnnnnnnncgtagtcactacacgaaacacacttgcatttgcacagttatctctcaatcgccacgcgcgctcaccgtcagctttctgcggtcgcacgtatgtactacgcgctggatatatacgtgtgtacaagtgcaggttgctcggttgttttgtgtagtgtagatgtgtgaaagttaaaaccagccgggtcacttcgcttcctgtggcagcacagctagcgcgtggccatggacgaccaccagagcaaggtgcagcggctgtacgacgcgtgcgacgccgtcttctcgtcggggagtaaagcagggttgccgacgctcaagcagatcaggtggctgcaagacctgctcggtacgttatactcctatctttcattgcatcttggttcatacgtgtgcaaattaattaatgtgttggttcattttgctgattttgcagatggcatggaggcggcggacgtcgggatcgaaggcggcggcagcggcggcgagaggtcgtcgtcctcggaggacgacgacgagaggagcccgccggggcggcggtttctctcggcgcgggcgttcacccggatcacctacgtgcacatccacgagtgcgacgatttctcggtacgcatgcacgcgcgcgcaatcgnnnnnnnnnnnnnnnnnnnnttagtatttttttgcactttcgcaaaagggtgagatggtaccaatttgacgctcgatctggtggcggtgttgcgcggctgcgtacgtacgtgcagatcggcgtgttctgcttcccggccggcgcgacgctgccgctgcacgaccacccgcaaatggtggtgctgagcaagcttctctacggctcgatgcgggtcaagtcgtacgactgggcgaacgcgcccccgtgctcgggcccaaggaagagtaagcatttgtctcagctgcatgcgaatgcatgcgcctgtttgccgtcgattcgctcgctgatgatcaatcgacaaaaaaactcgatcgttttctgatgtcaagttgtcaactgcatctaacatttgttccttgtctcacctacatatactagtttgaggttacctggctatgatcaaggacagaaaaaggtctctgataatttacaagcaggatgagattaatacctccctacaaaatccttgtaaaagacggtttcagatagccaaatcccaccgatgtctcaccaaaccagcattttttttcagcaatataaacaggagaacctatctctccctgtccactgctctactcttgatacagtttttaatggtttggaatttgcaaaagatagctctcgcctgaaactggaataactttttggatacttgcagcctctgtcgattaatttttgaattactactagcttacttcggttggaagcccaagccacgtgctgttggaaaaacaacagtgtacatagaatgaaacaactgcactactagtagtatcagaaattgccgtttttatactaagaaaaaaaaaagaaaagtaagtgacgccatcccactgctttccaatatggcaagatatccaaaagtccaccaatcctctcaagaagagacagtaacgaaattctcacaggaatatagtatttttcatgcaggtggtttagcccgagtggtcgccgtcgacgagatgcgggaggcgccgtgcaaggcgtcggtcctgttcccgcggagcggcggcaacatccactccctcaccgccgtcacgccgtgcgcgctcctcgacgtgctagcgccgccctacgccgaggacctcggccggccgtccacctacttctccgacattcccatcccctctctccctggtacgcacacaacatgcatgcataggaatcgctaaccttcattcgatataaaataccttcaaatattacatattttggatcattgggtgtgcttcacgtttcatgctcctgtctttttttttaagccccgatgatctcctcatcttttccaacactggcaacattccaaactttgatagagaacttacggattagagtcctaggttagagaagttcgttagttttagaggataacctaggaggcaacagttcgggtgggcagcaaggcgaccgcggtattgccaaaactacagggtcggaagtggatagtgggccggtgggctggtggggaaatgtagaacaaagttaggaggtggtggcggatccagttatggggagccacgggaagatggcggcacaggggtagccggcttgaggacaaggtgaggagaggaagcggggaagaggctagcttagggatcttaccgatgttgttgaccacttctagtcagttgacaagcttgggtggcagcggcgatggtggtggtagtggcgatgaggggaagtcggaagaaagagagagtaagggaggggtttgaaggtttggttgtcttgtactccctctgtcccatagaaaacctaataggctagtacatatatctagattcattgtattagaatatgtcaaatctagttttagattttttttttgacgaagggagtagtacacaacataaagtaatcgggcggtctaaaatattaaaggattttttgtcaaatgatgatagaaggtccctaatttgcatagcagcacaggtgaccgtggaatgatgatctgttgagatttctgacagtgtgatggctttctctcaggttttgcagtactggaagaggcagacttgcctgacggtttccgtgttgcaggggccccatatgtaggccccgagctcacaatagacatggacagcatgtataattagatagctgatctctgcttttccagagtatcagatcagatagctctcactgcttttcttaaagtagcatttgcatggacaatacattgcacctcgccatcttgtatatacgattatgcatgtgtgttgtcggtttgtctttctaccatgcttatttaccagttggtgttggaatgcttttttgacagttttgctcttgtgctcctctacgcaatgtcaatggctaccactagttttctaagctgcccactgtttggaatagacctctccatttatgaactactactacgtactcctagttaactttgcattaccgagaattaaccagacccggtctttggtgccagtatgccacctttggcttagccttatcactcatactagaaaggagagaccaaaccacatcaggcaatgatcattagctcgatttctcagttatttatcaccattcaataatcggcaataagcgggtaaccctgaaatcacaagcttacaggtaggtgcaaacctgccatcggaccaaaaactcatatatgaatagccacaacactctcatatctgagcagctcctctcgaacaccaacagctggggagtcaggggactagcagctcgttcgtcagaagtccaccaggaccaccgccttggacgtcgccgccacctccgcctccacaggcggcggcgccggggcattggcgacacggcagttgcgtcgtatctctcccttcctggggttctgcagctcccccatcttgatcatcccttcgacgaaggccctgaagaaggcgccctggtcctcgccgaatttcctcacggcgagccgggtcccggcgttgtcggagaagagcgtctggtcggagttgaggaagccgcggaggcggacgaggtccttgaagtactggttgtcgaagacgagcggggtggcgtccatgcctccggtgacgttctcgtcgccgccgcgggggcagagcgagtcgagccccgcgcggtaggcggggtccatgttggggtcgggcctgccggagccggactggttgtagaggcggaagacgatggagaagcagcgggcctcgccgatggagtgcgagccggagagcgcgacgaggtcggtgacggtgaggttgtagccggcgaagagcttgatgagggtggtggcgttggcgcgtgggctcggcatgatgttgtccgagtcctcctggctcgccgtcaggctgtcctcgcgcccaagcctcacgtcccagaagggcccacctgtctgtgatacagacacaagaaaggaggagagagagtcaaatcaagtcaataatttcactgaccagccaaacgaacctggaaattaacaacccaaatcttccaatgttacagcattgtgcagacatggatattgattgcaacgtatgatcatttatttgtatctacatttgtacatttgcatgcaaaacagcaaattcaacccaagatcgtaatgacaataagagcattatgtgttttgcttacatccaaattagtacggcccactcatgacagaacagttcagttactagtacagttaagagccgctgtttacgttatcaaatgtcagaaaatgaaaatgcaacggaaggataaatcatactcggctccatgtcaaccgcgtgaaaagtgtaaaactcaaaaagaacatggctagctagcaatctagcatagtgacaaatcggcagcgtgacccactgcgaaagcaatgctgctttgtctccgtcctaggtcctcctcctcccctcggcgatgagccatcaacaaggacaagttttgacagcaccccgacacagtacacgatcgcctgcacggaaaagtctaaaaaggactatacaactgcagctccggccgttcggcttcacgtacgtagccatggcccctagctcccccaccgtccggcctttcccggctcgctgcacggcggctacgtcaaacgcgcttgtcttgtgcacgccgaggggacggttcatgcaaccttgcccccgcttgatgttcagtgtggtggttacagggagcacgggtacatgcactgtaccgtccctatcaggggcataggactatagtgcacatgaaaggataagggagaggaaaacgaaagatggttttgacaattcgggtcactgattctttcggagattttcgtcagtccctatgattttcaaacacacgcacacacgcctttgttttggatgattccgaatggaattcatgcggagtaatccaaatttcaagttcatatgaaacggcatgtgacacacacgtgactacggccaccgtacgcacgatgacgagagcgccaaccgccggattttactcccaggcgaggcgattctcaatcgctcgttggttcgtcaacgaggtcagggctgtgttgtgccacctgggttgggggtgaccaaccatgcagcgaagagatgaactaactttttgttcgttacgcataggcgttgcatcgcacagcgggcagccagccatgacaaaaaacgatcgagatatttggcacttttcttccttgtcttttgcctgggggaggctgggtgcctcctgagaggagggaaatgccgggttggggagaggcagaggcggagcagcggattttgcacggaaacgcgaggaaaatggaagagaaacgtagtactactagtactactactagagtgggcgtggacgcggcggggcggggcgggagggggtgtgtgtacgtaccagggcgacggcgtcgcgggcggccatgacgatgatgtcggcgcaggagacgacgccagggcagcgctcctccagcgcctccttgatctcgtcgacgacgtcgaaggagcggagcgagttgatgttggagagcgcctccttctcccccgccatcgtcggcgttgcgtccatcagcaccgacccgtcgcacccctgctcgaacacgacgaaccaaatcacggcagatcgcccgatcagatggagagaaaaaccaaacaaaaacaaaacacacacacacacacacacagaaacccacgaagagtgaccgcgagagggcagatcggttcgcggcacggcggaggaggagaaacggaagaattcgaatcgcatcaccgatacgaggacgtacgttgacgaagcagtcgctggaactggaggcgcatgacggacgcgacgctgccggcctcgtgcgcgcgtgcccgggccatggtgtcgcggacgacggcctcggcgtcggggcacgtctcggcgtagtacccgaccctgaagtccctcacggccgcctccgcgccaccaccgcatgagaggacgagcgcgacgacgacgaccgcgaggaccgtggccgcagcgaagccgccgccgcgtcggaggaggaggagcgccatggcgaggaggaggaggaagcaccgaaacagacacgcacacgcgcaggtgggggattgttgctgctgcctgcctgccctgcctccgcttccgcctgcgggtctgtctgtctctgctcgatctcctctgctgtgctctgctctgtactactagcgcccgggcggggtggtgggtagttatagaaaaggggaggtacgtgtcgggtcgggacggggagaggagtcgagactcgagacgggagggtgggagacacacgggccgcgcggtgcaggggaacccagccggccagtggtgcactgcacggacggacgggaggacgcgaggtggtttggctgttgtacagggtagagtacggccgggcgcggcgcaggctggcatgcgggtgcggcgttggtgaatggtgctgaccgtagcgtactagcgcgtgcgtcaaaaatatcagcacgggtgcatccggtgatagggagtagggaaggaggggggcattgacttggggcgcgttctaagcagctacttcacgtttcacaatgtaaatcattctagcatttttcatatttatattgatgttatgtctagattcattaacattaatatgaatgtggaaaatgataaaatgacttacattataaaacggaaggagtactagccttggctatctctttgtttttagggagagcgttttcaaaccgttaaatggtgcgttttttatgaaaactttatattactttttttgaaaaagtatggtgccgttaatttttcgtacaatgtttgatcattcgtcttattaaaaaattttagtataaatatgtaaaaatgtgagttaaattatattttatttaatgataaaacatgtcacaacaaaatatatgatatatatgttttgattggacaaatgatcaaacgctacacgaaaagttaacggcgttagacattttaaaatagaatgagtatatatagaagatatttaaaaaaatcaaataaatctaattttagggttttattaattaataatccctccatctatttttcacagtcatatttctaaatctaaaaaaattatttttgatagacatatttcaatccaacaacctatcatcttaatgattttctcgaatttaatgcgttaatctccattcttccacacaaaactgcctacatgggcatcgagaaatgtaaatattaatgaatcgcttgttacgaggaatgactagtaacatgtttaaatggatgataagtagacttatttatccttggtctgtgtgtcaagatgaaatataactatcaaaagtagatggaatgagtatttaattagttatatgttaatcatgtttatttattttacgtgtagttaataagctaaaaacataatcaaaaggaccttttagctatgggacactgattgtgtagtgtgtgatgaccgcgagttgagtgtgattgacgatggtgtgtgtggtgtggattttgatttttgttcatgttgacccaggaaccgggatggaatcatgggaacatggggagcaaatggagagcagcggtgtaaaaaacgatggtgacttggggtctttttccggttggaaaaagaaggcgtagtattttagtgccattctttattaggaaaaataaaggcacaaatatttaatgatatataagaataaaagatagaagtagctaaaagtagataaacataataaataagaataaatacataatcaatggtgagactcttccacactaggtcaaagataaagatagttgcataggctttggcacagctatacaacagagtaagatttaccttatcgtaagaggccgagtcaagtcttctcgtgtatatatcgtgcataatgactaataaattttatcaaagtttttataaaaaattgtacatatacttctaatagtattgtttgtaatgtctcatattcacatttataatatacacgtagcataaaaaaattctgtcagatttataacctttaaaactgtcaaatttttattcttttg

SEQ ID NO: 49867 - DNA, 5859 bp, Oryza sativa
ctttcgtataaaaacttttttgcaaaaaaacacaccgtttaacactttgaaaaacgtgcgcgtagaaaacgagagagaggggttgggaaaaggcgcatccgaacacagccttagtatggttttgaaacggatcagaatacttacaaggtatgataatgggactaatgaattcatcaactatccttttcttttgtaagaaaactcctaaacaatcaagtcggctacttactccattttagattataagtcgttttgactttagttaaaaatcaaactactttaagtataatcaaatttatagacaaatataataatgtttataacaccaaattagtttcattaaatcgctaattgaatatattttataatatatttttcttgggttaaaaatgctactagttttttcaacaaatttggttgaatttcaaacaatttaactttgaccaaagtcaaaaaaacttataatttaaaatggggagtattaaattaataaaaagttagctacacgtacgtgtatatcaaacacaaatttcatttcaaacttttttatggtcgttgttcacaaatgtagtactagatcatttcatatcacaatataaattaataattaatcacaatggagtcggcgttttagtcatgctttcctaatgtttttgccgaacaacaagttaaccaccaataaaatcttgggtaggactcctgtgaggctgtgactactgtccccgcccatatgagaatatgactgcacttttctggtcccccaacccatgaccgggaacaaaggaaacaattcgatcgtagcaatagtgcgtttcgcactatcttgataaatgaaacttatcttggcctcgaaagatcacgacaagtagtccatctgattcctcgtgatatgccctgtatcaaaccatatcactacttcaactatttatttcgattattagtaacttgattatataaatataaaaggctacaaagctatataaagattggcccaggcaaaccggccatactagccgatcccattctcaacttgaaggaatatctctgaaacatcaacttggagaacttttttcttttgcaaccatcaacttggacaacttgcctgcaggagtgtcgcaatactggaagagccagctcgcactgtcacacagcttagaaatagcatccaggaactttctccaggaaagaaacaaaatgccaaagcaagcacgggtacggtctattcgggagccaggaacagcactggacaggtacgtacgtacagcttctgaatttctgacgacacacggcccatatgcatgcagacatccatgttacttttgagggtgcaaacgagcttagccaacgacagcacacatctcatcggtgcggtgcatccggtgcagggatcgtgcaagtagacgagcgagacgacgtcgatcgacgatcgagattgtcggtgacatgggaccggaagtatcatgactagaggcttgggcaacagcaatcacccacgagacctgaccccctcgggggggtcgggcccgagggtgatgtggccgcccccctctttgtctccccgaggggtcggaccgctcccgtttcggccccgagggttgaggcgccccgaccccttgggggttttgcgccgcgtgtctgggttaggcgagcgcagcggggctcacctaaccgcatttattgcggtttggtcaagcgcgtcacgccgcatgtaacgcagtgcagcgcgctcgtttatccggtctgtgaccagtcacagaccgatcagatcgtggattaggtggcgacaggcggtctgacacacgcctcgctccatcccgtcaagatgagagcctccaagcactcgtccctagccggagccggcgtgttacctcctggagatggcacgttagtcccggtcagatatatgccaggcttcatcctaaccattacaagcaagatattgtatgaagaagggcgaacatgcagattgataaactgacgcgtggtggacaagaatgaccgatttgtgaccggtctgacactggtcatatcgtcagcagacagccatgttcccacgtcgcgcctgcttccggcggaagtggaggtaggtatgggccgtcccatcagaaggtcattcagacggcaaccatacaaatctccgtccatttatgaaaagataggataagtccccacacaaaagagagagatggtgcatgtggtatccccttgagatataaaaggaggaccttgcccacttagaaagggagggaggatctggagagtagatcccacgagaggaaaaaaggggagaagagggtttctagagtaagagctctctggctctccagctctttgtagcttcttcatacacagatccaccagaacacaggagtagggtattacgcttcttagcggcccgaacctgtatacatcgcccgtgtcttgtgctttttccattctcgtgagccttccacacaccgagagcttagaatctcacccagggcccccggccgaaccggcaaaggggggcctgcgcggtctcccggtgaggagccccacgctccgtcatctggcgtgccaggtagggggttctgcgtgtgttcttctaagctctcgcactctttcgtgtgcgccaagcttttcctgttcagcccaatggccgaacaagcaaaggcgcacagcctctctccgagtgttagcggtgacgacggggagccgaacccacgccgtcgagctcgtactccaccgccccctccacgccaaagtcctaggcgggaggaggcgctcgagagggtcgaaggatccgcgacttcgacatccacgggtgatggggaagggcggcgagatggggagcgtcgcctcctcgtctacggcgatggcagcacgcccagggcgcgctccaaactgcgggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggctccgtgtcatcaaggcggagggcgcggcgagcggcggcggttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgatcgggatcgaggccgccgggggtgacgacagggtcatggcgaatttctttcccatggccctgaagggacaggcacggggttggctaatgaacttgccacccgcgtccgtccactcttgggaggatctgtgccaacagttcaccatgaactttcaaggcacatatccgcgcccaggtaaagaagcggacttacatgcagtccagcgaagggatgatgagtcacttcgctcatacattcagcggttctgtcaagtccgcaacaccataccatgcatccctgcacacgcggtgatctacgtgttcagggggggtgtgcggcacaaccgcatgctcgaaaagattgcctctaaagagccccagactaccgcggagcttttttagcttgcggaccgagtggctcgtaaggaggaggcatggacctggaacccctccggttccggagtggcagcttcggccgcccccggatccgctgctcagacagggcggcgggacaggaggaggaagaagaggtcggcccattccgacgacgagggtcatgtcctcgccgtcgagggcgtttcgctggccacccgaaaggggaggcctgcgagcgacagaaagaaggccggcgctccttgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgattggcgtcccccggccgggctccgttcggctggccacgggcgacggcacagagctgcctaacccgtggaacatcgaacaccttcgtcgcttctacccctagtgggggtcgggtgtcaggtcttgggctcgggccaaccccgcacccccccgggcgtgcagggttggccgggggcttatcttttttctcttccgtatttcaataaaagcattttcgatttcctaaggactgtgtctgtgccattgtttccttttgaagaatcttggcttgaattagcacactcgtgctcgaccctgtcctcgggggctcgggtcggctaaaatcgccaaacggggcccagaaccgagccgtgccccggggcgtggtgaactccgggggggaattggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacagaaggaccgcggcacagaccatcctcgtctcatacacacaacaaatagaattgacatagaaatttcctctttatttggttgcagattaaattagtctatacaagaagggggcccgaaggcctcggaagaagaaagaaaaagctattcaagattggcgggggcctgggggctcactccgacgcgcccgggtcaccagccttgtcgtcgctgtcgtccgcaccaccgtcaccgccctcctcgtcggagtcgagggcgaacgcgagccgaggggccgtaccctcgaagctgtggacgatgtggtcggcggcgtcccggacctgcgcgcgtgcgccgtcctcggttccggaagggaactcttccagcgctgcccacggggagaagtcagggtccgagaggcccccaagccgaacggcggcccaaggcccccgacggccggagttggccctccgcctgcttgtccgacggtgttaggcgcccccgaccctcaggatagcctcggggccactacgggaaggccgcgcctgtcgccctctgaccccgaggttatcggcacagaagccgagggcgccccgcgctgcctctcggatgaagagcgccctggagatgcggcccctagcgaagaggatcggccccgccgaaaggtgcagcggcccgtctactttgttagcgaggccctccgggacgccaaaacccgataccctcaggcccagaagatgctatacgctattctgatggctccgagaaaagcgccatcaccatatctccaggcaaaacgaaccggctcgtcccgattcgcgtgctactcgagtaatgtggcagtcttgaagagaccgctcattattggcagccgagtaaccattgccgatgtgcgtgatttgcgatcgttgggtttctgcccaactgtggagaccggtcccacctgtcaccaggccttaagaagtggcgtcacgcccgaccgcttccctcgaggagggcgatcgccctggcataacaccgggggctactgtcggtgacatgggaccgggagtatcatgactagagcttgggcaggagcaatcacccacgaagcctgaccccctcgggggggtccgggcccgagg

SEQ ID NO: 49868 - DNA, 4984 bp, Oryza sativa
aaagataggataagtccccacacaaaagagagagatggtgcatgtggtatccccttgagatataaaaggaggaccttgcccacttagaaagggagggaggatctggagagtagatcccacgagaggaaaaaaggggagaagagggtttctagagtaagagctctctggctctccagctctttgtagcttcttcatacacagatccaccagaacacaggagtagggtattacgcttctcagcggcccgaacctgtatacatcgcccgtgtcttgtgctttttccattctcgcgagccttccacacaccgagagcttagaatctcacccagggcccccggccgaaccggcaaaggtgggcctgcgcggtctcccggtgaggagccctacgctcctcaccgggatgggccagggctgcgaggacgacggcctgacggagacgggataaaatctcgtggaaacggtctagctctacgctgctaccggccactagtacgtagacgtgtgggtgcaagtgtgcaacgcgtacgcgcacggctcagcgtacgcggcccccatggatgcatacgtacacagtacacaggcgtacatgtacaggtttgtgctttcggtcgacgcatgcgtggttcccctgcacgggacaaggagatgagcaaaagcgattgatgccaactttggggcaaaggccggcgcgcgggtttttgacgaattcggcttcgctgtggcggaagtggttttcacgggcgaggaccaacggtttgcttttgcacggcatggggcgctcgtctttgggcttatactttaagttacacggttgatgggcttcggggtgcaggttttgccggtcggtgagatgatggaccatgtgctgacgtgcatgtatttgggcggttgggccggctaggcttcggaagaggcgaaaagcggaccgggattggcatagcgggtttggcgcggtcaattccacacatgattagtaggcacgcatgtggttcccatcttcttttttctttttttgtgggggaaaggaatcaattactcaaaaataaaatcgacttttacaatctgtgctaactcatcacaattagaatctaaccaagaattcgaaaaagcttcatatctagccttattagctaaagagtggctaacaaagttttgacttcagtgattttcccgagcaagatctccctacttccattcatgtggtcacacacctctctaactaagaaagccaattctgacaaattcttctcttttgtttggatcaattgcagcgctagaaagcaatctgtttccaaagcgatcgggcatagctagggtccattgaagcgctagaacaatcccttttctgatcgccaacaattcagcttccagtgcgttgcaacacctgttcagataagtgcaagcagcggaaataggtttccctgaacacccccttttttgtggctagcctcaaaggatccatcaacattgatcactttcatccaaaggatccatcaatattcactttcatccatccaatgtaaagctaggatttggtaaatctttttatctcgactagtaaaaaatctaacatatttccgtcgtctcatatgacttcatagttcctcgcacgatatcagttacaccccacacgtctgactgcacacgtttgcgacataccttagtacctcagagagcccgacactttctactctacttagtctctttgctcttcagtggagcacttgactccgtttgcatcattgcatggactcctaccgtgtaggttgtcactgcatcactattttcccttcctttttctttttggaaaattttattacatgacacccaaagtttgtgtaattttctatcagacatagaaaagtgtgctatggctgcatgataccctcaaattttgataatttcctgaagaacactttcggctcgattggaaaaattctttaaatagactagaatgcttttggggccacaagcttctaagttagtgttggattttaaaaaataaaaattatgcaactctaaatcttccatcagccgaagtatattgctagcatatatcatattccatcaacactccaattctaggttagaagtttttggctataggggtattctcgtttttaaaaattctctttgattgggttaaaagtgccctatagcaaattatgagttttttggtgtcctccaaccgtgacacgcttttgcgatgtctagtagaaaattacacaaactttgagtgtcatgtgacaaaatttgactttctttttcccaattcatgagaaatattaaaagtctatgatatggtgtgtatgtggtagaaaagtttataagcggtgaattattccccacgcttgacatcctttgtttctgttcactaatattttccattgatttattgatttttctgttgcaacacacatgtcctttgctagtaaagaaaaaccccagagccaagaatacgaatataaagataggcaattatcacaacaaagagaaactaggagagcaaacaagacgatgcagccaattgcctttgcctttacatcaaaatttgcatctgcatatgtataattatggtgattcacagccccgaccctgaaagactgacaagccatacatcctgtacttaaataattaaatataatttctttcaattcccaagatacagcaaggcatatatgataccatacgtgcttcaacctatgatacactataacatttatgacacaatataacaaacttctatttaacggcctgattctagacactgaagttcactattgatgctgaaatttcctgtattctcaaccgttgagttgttgatctcgtaagaagagtccccaagtaagctctccatctcttcaggattttgttgtgcccatggatgttgcattaccttcctcaacctatcgagcttgtctgcaacttccttcatcaacggtctattctcaccagacatttccaagcattgctttgctaactctgcaatctcttcaagaaactccaaattatctcccgtcatgatttgatcatctaaaatatcagaaagtcttttttccttcatggctgatagaaacctcatggctaggctcctctcatcttcagggctttcaaggttgaatgctttctttcttgtgagcaattctagaataacaactccaaagctatatacatcacttttatctgttaactggcatgtttgcatgtactctggatcgaggtatccacaagttccttgaacgagagtgacgaactgcgactcatcagttggtgctaggatggaagcaccgaagtcagaaacttttgctacataatctttgtctaagaggatatttgaggacttgacatcgccatggaggatcggtggtgatgcccatgagtgtaaataggcaagagcctctgcagattcatgtgcaatacgtaagcgagtatccaaggagatgtgttgattgtggttcccgtggatgagagagaacaatgtgccatttggaatgaactcatagacaagcatcggaacttctacttcgaggcagcaacccaataatttgacaacgttcctatggttggtttgggacaagattagcatttccttgccgaattctttcttttgtttcatatcaattgtgatgcatcttttgacggctatttccgtgtttcccttgagaagtcccttgtaaacagttgcattgcctccttggccaaggacttgttgtttgtcaaacttgtttgttgcttgttgcaattcttcttctgagaagattttgaatgaaatgccttgttgagattttatctcttcgaatagcaacataccaccatgttggcggaagtaccgccttttgacatactgtagctttctcttctctctgatgaagcatgcataagttactataatcactagtaatacggccccaacacttgctcctgcatatataatagaaaactttagaattgctatgaaaagattattggaatgtgtagttgatccctttatgctagccccaaggaagtcccacatatgccacatcggcattggcagaggaagattcactaaattatttttttctttagcaacttgaggagttcgtgaggatttcatcattagttggaacatgaaatgttcatgatcaaaaaatgtgtccattcttcttactatagaaaaatacacaccatgcatgcatgattcatcagtggttgctggtcttgctatggtgtacaaattaatattaggaatatctagaaaagagatatagttgcaagaatgaatgtatactaaatgctaaagtaaaagggtagataaatgagggctagcttcagaatgaaaaatacattaattatgcatacacaccttattgtttaaacttgaaagccagaacgaataccatttttaaacatataactatatatatagtagaggcattgtaaattaggattatatttttctatatctgcatgaggaaaacgatagagctactatatagtaaataactaaatatagcacaaatgtataagcaaaaacataaatgtatatcgatctcacatgccattttaattcttataggaagagacgaactcacctattacaagatttttaggaaaaccagacttctgatttggaatgcaaattccattcatcatatagtttccagggtagcatgagcaggtgaaattccccaacgtattcttacatattcccggacaagggtaagtagcattgtcgaggcactcattaatatctgaagccaaaccatcaacacatttggttaaaattgttgcattatcttatacatttgtaacaaagataggcagcaggcataagaaggtgtgtatgactatacctttgcatccatccttgacgtatggattgccttcatatccatcagagcacttgcagcggtaacctccctttggatcatcaacacaacgactttttccactaatgcatgcatatgaagtagtgtttcttttgactcgatcacatgaatcc

SEQ ID NO: 49869 - DNA, 3952 bp, Oryza sativa
ccgtgtttagattcattttttttttgccaaaaacgtcgcatcgaatgtttggacacatgttagagcattaaatgtggacgaaaaaaaaccaattttatagtttgcatgtaaattgcgagatgaatcatttgagcctaattacaccattatttgacaatatgatgctacaataaacatttgctaatgacggattaattagtcctaataaatttgtctcgcagtttacagacggaatgtataatttgttttgctattagtttatgtttaatactttaaatgtgtgctgtatacttaaaaaaaaattggccaaggaactaaacacaccaagagtatgtttgtattcacaatttcatatactccatcaaaagtatcaaaaggctctgaattgtaggtaggcacatgtatttccattgaacgaatatgctcatatgtactccttactcctaatgtcgatggacactaatatgaaatgtaggatttaaacattgataggcttacaatcacaccacccagccatttggccacatgccaacttccaaccactacaaaattatatatacttatgctctgaatttctcatatatacacactacctccaattcacaagtaagtgttgttttggatacctacacaatcaccaatacatcactttgattattaattactaatattaaaatgtacacaaaatatagcacatttataatattttgaaagtacttttaaaggaaaatattgtcatatcgttttcaaaagtcaacttgaaatagcagcggtcaaattttccacacgcattccacatgcatgtgaaagggagaaactaataatattctcacatgacaaatcctaagtcgtccttgatatataaaggaataataatttagactatcatgtattttaaaggccatatattatgaacacatttgagtatttgtgatctaatgcaaccagattgacgaattatgggcatatacttacattattgatctgcatatacgaaaacgtttcgcacccgatgacgatgatcttgttatccctgtccgatatccagaaaggcgagcggctgaagctcacagatgttgtgttggtgttgtcctccctggtgcccgtcgactggttgtagcagttcttggatatgttcatcttcatccaggccttgccgtcttccatggagatcttggtcacctccatacccctgaagaaaggcttgctggtgccgtcaacgggcttgcagtcgaacttgaacgggtagtttgtgtaaggcgcctcgagcccgcagtgctcgccgatgccgaacgggaacgggatgtccacggcgccgcacttggtcgggcagcccggcttcgagacggccgccaccggcgccggcacgttgccggctgcggccggcggcgccgagacggcaaggcagagcagcagcagcgacgagtactgcagaagaagcggcgggcggctggccattagcggcctgatggcgatggcgatggctctggctgctccggcgaaagatgtacacaaagagcaagcaagtgaaaggacttatgtgatattctaatgacaaattaagaacttgtgtgtcagtccaaggcatatgatgccgtagctttatattaaaatgggttgcttggttgggtgcatgcactggcctaaataagactctctctgcttatgttggatgcatgcatgttgttattgaaatgacaccagggaggcttcgcagaaccggtcgtttgatactttgatgtatagtgacaggtctatggtaattggaagggcaaattttacgatacttgaaaaagtatcgacgtatgaattttggtatctcgaagtgatgtacttaaatatctggagcagggtataacggtttgttttctctatttctataagtactgatatagctgaaatttcggttcaaaattatttgtaatgttgaacaaaatttgattaaataggaacattttttttctaaatacgcgaaaaaatcacccgcaatcatctcgtttttttgggtgtgttttgggggagggggggggggctcgatggacccgaaatgttagaaatttcagttccaaattttaaatcttaatctataatgctaattttttttaaaaaaaatatgtaacttttcggtaaatttttaaaaaggtaaagttacttagttggaagagctttgtatgcttaacactatcaaagacagtgcatgacttgatacaggtgctcgtagttacgactaattattattttagttatagacgatgtacctatcgacaacgagatgtccgtagtgatgacttcattattctcaagatatactgatctagtctttagaaaatgtttatagggataggatgtgtgtatttatgtttacaagggtgagtatatgtatgaggacctgcgtttgtactgactttctttaggaaaaaaaaagacattgcgtatgacatcgacacgctgcacaaaattccgcgcgctatactgctagccggtggtgctactgatcggctacgtgcagaattgatgtacctttattttttcacatttttgaagagaaacgcattaatgtctgatcaaatatacgtgtcattttgatgcaagtggatacctagtccattacaggtcgtgtttagttcgtgtgttaattttttctaaatatacggacgcacatttgaaatattaaatataggctaataacaaaacaaattacagattctgcttgtaaactactttctccgggttgataatacttattgttttggacaagagcacggtctccaaaaaataactttgaccattattttctattataatatgtataaaaatgttaacaaatatatgattttattaaagtactttttaagactaatctatacatgtagtcaccatatttaaaagacaaatattttaaaaataattgataattaaagattctaaagtttgacttcacccttgtctaaaataacaagtattatcagcccgaagggagtacgagacgaatttattaagcctaattaatccgtcagcatcacattgtcaaatcacggcgtaattaggctcaaaatatttgtctcgcaattttacatgcaaattgtgcaattggtttttttcgtccacatttaatgctccatacatatgtccaaacatttgatgtgacaaaatttttgaaagtttgaagggaactaaacactgccatagttcaaagtgctatgattagatagggtccctgtgcacactagcttgaaaaaccgtcggagtgaattatgctgtgtgaaattcatatgtccaatttactctttggaaaggttagtgtgagaatccttgagtctgtttggcaaagttccagctccaacgccagttttaccttttctggagctagagcttagccaaacaatttcggctacctagaataggagtggagctacgtggagctttctcacaaaataaaagaggtggagctgggtttaggcaactgtaatagagagttggagctgggtttaggtagcttcacaacttcactacagacccaactcctgaagttaaatttaggagttataactttaccaaataggcacctagttatttgtgcttctggtcgatccatgcttgatgctttagtttggcaagttgatgcaatggtttctaaagccacacgcttcagacctaaatttggatttgacgggagtgcatagattggggtaggagaaaattaataaaaaaaactaatatttctcagtaacgagaaactgcaatataatgtttcacattccatgaaattattagttgtcgcgtacgaaatgggggaaacttgtagattttccggtaattaagccgatatttaatgactagtgagccctcaaaggaagactatgtcaatatgcatgtgcacttaactcacgaaaacgaccttactacctgatggtaatgggtcctttgttttgttaataccacggtgtagaag

SEQ ID NO: 49870 - DNA, 34439 bp, Oryza sativa
gaatacaaatgagttatcacgtgaactcacttgtagactaaattattgggtaatccaccggtcaatttgtgagttacccactaattttgtttatgagtggattcatggatcgatctatttgcatccctactgattagaactccttatctctggcgtgtaaagcaaaacacgcatagcacataattaattaagcattagcttaaaaatacttttaaaaacggattaacatggtttttaaagtaattttttatagattttttttaaaaaaaagcgtattatttagccgtttgaaaagtatgcacgtggaaaataaaaaaatatgagcctgggaacaagtcgtcgctgatgctaatttgaatttctatattgtcgcaatcatcgatctgcttgccctccaaagccagcttacacacaacacagcaatgaaaatggcacggcgtacatcttgaggacgataaggcatgcaggtcctttctccaggaaacaaaccataattaattaagtatcacaaagcaatcatggtaaaagtgttacgaggggatttatccggtaaaaataatcaaataagtgaaaatccataaaaaccaaacttaaaagttttataaattcataaaaaaattttctagagtgcatgcatgaaatacattattatcaaatatcaagttcaattcaccttattatggagtaataaaaagataaatttctaggtgaatactaacgtaatattcccttcatccataatataaggcatggtaaaagttgacacggtctccaaaattaatctttagattataatttctcatatactataagatttgtagcaacaaaagtataatcatatgaaagtaaatttaaatgtcaatctaatgatataacttttaacaaataaaattcatttcatattatactaaatgttggtcaaatattttaaatgttaaatcttaaaatacgtgcgcgccttatattatggaatagagggagtactacttacctgaaatttgtcttttctttttctctctaaaaggaaggaagttgagtttggagttaagatctggtatgaatacattttatgactatacctgatagtattgtttttataaatttagaaatcttttaggcattgtttttatgaattttcactggcacgatggttttcaccggatattctccctcgtcatgaggaaaaagttcactttggctccctcgaatataggtcaaaacaagagtgcatccctcaaccgtaaaattagatataacagctccttcaactattaaaatcagaacaaaatgactccaaagacaacgttgaaagtggtttttacttaggtggccgcctatagtcaataaagtaaaaaaaatattcatgtgatccacatgtcggcgacttggcgtcctttctttttcttcactctcttcttttcccagccatatcggcaatacggccctccgcgacgacggcgccctacgctcactcaatccgccttctcccccttctctggcatcgacaaggacggtgatggcgctggctacagctagccacagttcgcgacgctgcagtcccacactcgcatcccttggggcgttggattgacgtcgtggtcccagactttgcacacaaccggccggcaaaggaggggaaggggagagggaaggtggtgaggaggagggtgtaggagagggtggagccgatggagagcgggagcaaccaacggtgatcgacggcagcggcggtaggggagagggcggtgccggtggtgggctttcatctcatttcatctcgtgggccttgcggtagctctctactattggaaagtaatgtgtgtacttttcttcatcagtagtacaggtggtgtggatgaactgaagcaactaaagtcataaacaccttgaccaaccaaccaaaccaaacaaaattttatggcatcatatgattgaaagcttgtattacctaaagcaagcacaagtgcacgtagggtgtcgacgatgcccatcacctcaaatggccctggagatgccggagaatagctgttaggtactgcgctgccggcgctacaacggcctcgcacatatgctgccacgagtgccgctacaagtgcaaggccatctgcaccgccttacaccacatccaagtccagggccatcaggatgtgggcaaggctaggtggataacaatcaccctgccttccgtgacggcaacgtcgcagagggcagcatcgcgaaggtctgctagccgcagcctaccaccactactacacataagatttttctagacagggacctcccattttctcgtgcggagctttttcatgtgcgtctgtaaaaatcactcctattttcacgtgcgggcctcctatttttacctgcggatccttaagaggccgcacgcgaaaatcgattttggcaggcggccctcttaacatgcccgcacggaaaaatacacaattttcacatgtgggcctcctaatccacccgcacaggaaaatatccattccctctcaacctattcaaaaaatttcaaatttccttctctctctctctcccctccgcccctctctcctctctgtccccctttaattatcttctcctcactatcccctctctctctctcccccggcccccttctctcctctctctcgcgccttctccttctccttctccttctccttcggtgcgacaggagtggcaggctcggcggcgggagaccgccccccgcccggatccgcgagctcgggcggcggccgggtgcagcgacgggtgtttctagggttaaggttaggttttttttttgatttttttctattttttgtttggcttttttttttggttgcgtgcgggcggtataatttgaccgcatgggataatcaattatcccgtgcggtccacttaacccaaccgcacgggtgcggttgggtgcagacacttggctacagatggacaaaagctctgcacggagaaatccttcttgtagtagtgcacggcaccaccgcctctaccgatgctgaagaagggggagaaggcggatcgagcgagtgcagggcaccgttgttgtggagggttgtattgctgacgtggtcgaaaaaaaagagaggggagaaaaagaaaggacaccgacatgtgggccccacatttattttttagtttatttagtgactaagctgccacgtggatgccacgtcagcgaaaaccaccttcaatactatcttaggagtcattttgtcccagttttaatagttgaaggagtctttgtacccggtcttacggttgagggatgcactttagattcgacctatatctgagggactcaaactggactttttgcctcgtcatcaacagctctgctgatgtacgggccagttatccgttatccaccacgaggcccaattcgaactacagaaccatgtaaaacccaattaccgaaacaaaagtcctattgggctaccagtgccaccaatctgaattttggagcccatcaacactggcctctttttcacctcgcagcctcgcaccgcaagcccaagcagccgcaggtttcttcccctcatcatcaatcgatgcggcggccgagagacgggcggaccggcggtaggaagggcggcgccgccaccaccgcatcaagcaggcgcggaagaacgcctagatcccgtcctccggtaatctcctgccgccaccgcctgatgcagcatcccgaggtccaatgctcccatcccaaccctcgtgtgcataactgcatactggttggagtaccaaccctttttttagttgttggttagagtatagatttatagttctggtttaaattaagcgttttaatatttctctaaaaagtctatgttaattggagtaggataacaatcggtttgttcagaaactgccttcagattaatccttttttttatataatttaagatgctgatttatatttatgtatacttcttacaggagcagacaacgattctcaaggaagggtgggacaaatagtttgatttcaggagtatatgctcccaatacggatgccattaccagccactgtaggactgatgccattgtgaggtaatgttgttttgctatgaaacaatttacatacacatagttgctctattttttttctttggttcaattggtctgatggagattgacctatgggtaataaaactatttttttttcaattggtctgatggagattgacctatgggtaatagaatgtttaagcggttggcttacaagcaaagtatattatgccactctcttgattattggagtatgcaagattataatgaacggtagtttcttatgaggagatctaattatagtatgtcggcaggccttggtgttcaatatatgtgcaggtgaatggttactgataagctatttctgagaataaataaacttgcaaagcatatggatcctaacctcttgaaaagtacatgttgtcgtgatttgttagcagtatgagaattgatcaaactataaaaagaaaatgtgtgtcaaatatcaaatcaattactattgtacatagatttttgaaaggtaaagctacaatagcaattgaaacaacaacctcacctttggatcttaacaatgatgcaaccttgagctacacatataaaacatgtatgaatcattccatatatgatgacgattacctatacatgtaatacttttggagtatacctatataatttcctgggatatgatatacaacaaggttattagcgattatcttcctgattctaggcctattaaagatttcttctcaatgctgaaatttcccgtactgacaacctccgagctaacaattgatgactctcctagtaagctctccgcctcttcaagattgtgcagtgcccaaggatggtgcaaaacctttctcaagctatcaagcttttctgcaacttccttcattgatggcctattctcaccacacatttccaagcatcgtctggccaactcagcaatctcttcaagaatctccatattctcctcgctcttaatttgatcatccaagatttcctcaagcttgttctccttgacagcagaaaggaacctcacagataggcttttctcatcctctagcccgtcaaaatttaatggtttctttctcgtgagtagctctaggacaacaaccccaaaactgtatacatcactcttatccgttaatttccatgtttgcatgtactctgggtcaaggtacccacgagttccctgcacaaacgtgacgaactgtgcatcatcggttggcgataagatggaggctccaaagtcagagaccttcgctgtgaagtcaccatcaaggagaatgttggatgacttgacgtccccgtggaggattggaggcgatgcccatgagtgaaggtaggccaatgcttcagcagactggtgagcaatctgtaaacgcgtggatatagagatgtgcctgccgtggccatcatgaatgagatggaacagtgtgccatttgcgataaactcatacaccaatattgggacttccacttcaaggcaacaacctaatagtttgacaatatttttgtggttgacttgggataagattaccatttctttaccaaattctttcttttgttgctcatcgattgtcttgcatcttttgattgctacttcagtgttgccgtttagaaatcccttgtaaacggtgccatgtcctccatgacctaggattttcttttcatcgaaattattagtggctttctgcaattcttcttccgtaaagattttaaatgcagtacccttcatctcctcaaatagcagtcgacctccatgctgtcgaaagtacttctgttttatgctgtgtagcttatttctttcttggatgagatatgcacacgtcacaatagtcacaagggtgacaactccaatacttccacctgcatggtttccaaagtgatgttactccaaaatgatgatttgaaagcatttccggggttttcaaccttaaattttaatgaacatgaataatatgattgattcctactatatgttcagattggttttactgtaatgcgctattatgttcaagattggtgtcaatgtacaatttctcctttttttttgagacgctgaagagtgtaacggacctatgacaggtataatccaagaagaggaactctgcttgcaaacaccgtcaatcagatgttttcctcgttgacatgtacatgtgtagctcccctgcgtatttatgcaaattcccgtgcatggatgagcatcttggcactcgtcgatatctgccaaaaaaagacttaaaaatataatactttttctacatctcttaatttgcaggggtagaggaatcaaaatggccggaaagggaccttcgcatccatccgtgatgtatgggttgcccttgtatccatcagagcacttgcaacgataaccgcgaccattggtggcatcgacacagtaactgttgctactaacacaagcgtaggaagttctgttctcttttgcttcctcgcattttttccattcaactgtccaatccaagacagtgggaaccatccccttgtacgtatcactgaatactgtggagtcgacataagtggtactaaagttgaatgctgaagtttccatgactaccatgtagttgcaagggctgctcctccatattgcagtggtgttgtagtttgcattgaaataaccttggtaataccgtatgcctttcgggatatctgcctggcagcagccagcaccagagcatgagccattcttaaggtctacgttgtcgcatgttgatgagcaaccgattacgtactgcatggattggcgggttataaactgcaaataacagcacgaccccatgagagtttgcaattatatttgttaaaacaagtgctgcaaaacagatagctttcttaacatagtagaactaggattagtgtcttcaacatagagttcatttgtgattcatatggaaatgggctctaagccctctttggttgtgggcctgttcggcagctgcaccttgcagccgaacatgccctgtagtgatatagttggccgcacacaaaatccacccaatcaagttctttttattttttttgggagggggaatttcgacttatatgtatgttatgacaagtcgaactagttttcacatgtcaaacatgtctcatttgaaaaattaagatatgcaaagttttttacagaaaaaaattgaatcctaattttacctacattacccttaccctttgaaacaaggataaatgattgcacattttttgaatcaaacgtcaaaaaacacataaatatccaatttagttccagtcaaaaaaaaaacatgcatcgacaattagaaatgacccatcaatataacataatgattatattaagaattagtataagaccttacatgagaagtcagaaattatgagatgcaactagtgaactagaatctatagaagttggctttctcaacttctgacaaatagtttattgagtgaattgcactttggcctagttgagtgaattgcactttggcccggttattattgcctgtgttttattttggactaggttatatctaacgttttcactttggtccaggttttcttaccttctattgcacattggaccacttttttgtttgccactccttgatttcattagcgagcttacccgcaacacaataaaccaatcaatattccacctgaccttgatttctttactcattgatttagctgcttgatttctaccatttttcccttaatttatcatgtgagcttagaacaagtcactgtattgagcttgcaagcgacagctacagcagccagctaccaccagtcttgattttgctggttcctcaagctcggaacagagcagagagagaaggaatcctggtactttgcttgatcatccctcagattccatagcgcggctgcttaatagagaaaaggagggaagattgatggagaagaagggtggtccaatttaaaacttttgtaaatttatctagtccaaagtgataagataactttatccctcgtccaaagtgaaactttggtaaaaattcctagcccaaagtgtaattaactctactttattttatggattctataacttttgagtggctgagaaacaccaagtacagtgggctagcttgaatgaggtaaagatgctctgttttcggaattggggttgtgaggtcatgatttgcgattaaaaagaatatcaacctttcctattccttaagaaactgataatgtataaaatatgcaaaaattacttaccgaggtactgcgcatgtaagctagtgagttgcaaccaacaacgataagtttgttgtcctcgtttgacagccagtaaggtgaatatctgaaactgttccatatgtcatcgtacaaggttctgtttgtttctgggtcgaagcactgggaggatatgttcgtcttcatccatgcttttccgttgggcacggagatgttggtcacctcgatattgtgaaacataggcctcgcggcgccgttcacggacgtgcagttcagctggaagcccctgctgtaggcgcagtctggcctgtctgggtcgatgatgccgaaagggtaggggatgtcgacgtcgccgcaccttgtccggcagcccggaggctggccaccggccggaattgcgacgtcggccgcggcaagcgtagcgatggcgccaaggtagagaagaaggcatccgggaagaagaagaagctgatgacgctccatatgctgcacttgcttgtccgtactccttaggtagccggtttgttgtgcgttttggttggtgtgcttgggaatttcggcagcggcctccttaaatatgatgggtaggatatgcttgtggcgatggaaaaagaattcagagggggataaacttgtctcgctcgtgagattctagactaagtcccattttaagtgtaagtataattttctgcgtccaattttaatcgttcgtcttatttaaaaaaaacttttgaaaaaaaaaattaaaaacataagttacgagtaaagtattattcctattttatcatctcataataacaaaattactaattataaaaaaattttaaataagacagatgatcaaaattgggcaaaaaaaaactcattattatacacatgaacttaaaatgagacagaaggagtaataaagatctcgaaaaatgtatatttgatcataaatatattccaagaattatggacgacgacttactcccgggtcttcacgtcgaaaagaaagagtgcatatatttttatttttcaaaatgtttttcctccatcgtaatcgatcctccagctctactaactacacataacaacggaagacttcgaacgactgacgtgacttaagcgcgtaggccatgcgtgatagcagcattgagtgacaaccgcttcatctcccctgttgtcatccatgttaattctatcctgccactgtagcgagaggtctttacctatgtgctattaaaaaaaaaatgatgcctgcctctgtgtcactaaaaagttcaagtctccctctatgccatcgtcgaactttatcgcgccctccacatcattccatctgttttttttctaacagtgggtaacggcgcagccaaatgagtttgttgcccatggggttgcttggcgacctcacctggcgcgtggcgcagccgatcgaccaggccgcgatggccgggtacgacgccctcgtcgccgacgtcgaggcgtctcttgcccgcgccttccggatgctgctcgaggccgtcgaccgcaagatcgacggcgaggtcggcgccacccacggggagctcgccgcgctactggaggagagctggagcttgagggccagctcaagcggctcgacgccagggccgatgagctgagcgatgcgcgccggatcccgtccgcgccacgcctgtcctccaccgctgccgcccgcgccgactccgcggcgagcgcgaacatcgccaccgcccgctcgatcgccagcgccgcgcctgtcctccaccgcgcccgcagccaaatcggcccgcgtgagtgctgccgctgcgcacggccaggccgactccgcggcgagctccacctccacggccacgtcgccctgcacgacagccttctcttccaccggcgccgccgtccaccgagccgaggcagcgacaccgccggctgcctccccatccggcgccagaccgcctcctgcctggcgctccgtcgacggtgctccccggccgtctcctcctccattttgccgaagggccaccacggccgtcggacccgcatcgccctccctcaccttgacccacgctgctgcaacgtgccgccgcgccagcaccaggcgccgccgtgcccggccgtcgccgcgccacgcgcgctggctgccgctgcttgtgtgcgctcgcgcgtgggagaagggggaaggagtagaaggaagaaaccggaggaatcgaaccaccaccacccctctccgacgacgacaccactgagagacgcatgtatgcctccctgtcctcctccaggctgccgccgcgccgccgcactcaaccgcccccccccccccctctctctctctctctctctcgcactcaaaagaagaaagggcaatagagacatttttttccgcccggcctacatgtcagagctgccaaacagttaaaccaaaacagaatagcgacggaatggtgtggagggcgtaataaagttcgacgatgacatagagggaggctcgaactttttattggtagatagacatgctccatcttttttaatggcacatagggaaaaacctccgcaggcgaactactgtgagctagcctagctactggtctcagcagtgtgtacaacagtacaaggaaatttacagcgacctgataagtgaataaacttgatccgttcaatttgtgtggccgatagtctaactgtaccaatcggccactgttcacatcacaatggccctgctttaatccaagaaaaaatttgagtaaaaacaggccgcgttcacctgagaaaacctggcctcgtccatatcacacaatttctcggcaaccagaactgtcacaaggtcggtcttttctagtgacagttctggttctcttcgctccgctcagtatcatggaagactcgactgtttcacagcccacagggtcctgtgacttcgaacggtgaattccgcgtgatgctctgttgcgtgcaagactacaaatgtacattttccattgcgagctttagctctattattttcggttaagattcagattttacttcgattgcatactaaagttactaaacggtgtattctctgcctttctgtttagaaggtactttaaaatatcaaatatatttatcaagtttgtaataattaaaacttagttaatgactttctcgtttcgtgcgtgtcaacttaatttttattttcatccgcttcaaacacagcttttataattaaaacacagcattgacaacttaatttttagagatggaattgctgaaaaatgtccggaccaaacgcagcttttgtcaatgcgcaaccgagtacgatgagacaacattttttgggtttagaagttggttaggataggttgcaagatgcatgggtcagcatatcttgcaaggtttggtcaagaaaatgctgaaaccaagtgtaccataggcaattaccacacggtagacagaatcacatataaatcagtggggaaaatagtacagcgatagaaaattaacttgacttcgtatgatttgcttcttattctcatatatgatgaaacatagtcccataaagactaaaggtgtacacaaacaatatttttttatttttacacaaaatttttttaataatgaacataactgagtctgaatttctagggtaagtgaaaactatgatacaatatgacgcggtatgatatggtgatatgatgtatgctgggtagcaaagagattccagcttaacgccctgatgctaggtccttgacaactttcttctcgatgctgaaatttcctgtactcgaggctcctgagcttataatgtaagaagattctccaagcaagctctccaactcttcaggattttgttgcgtccatgggtgttgcattaccttaaccagcctatcgagcttctccgcaactttcttcatggatggtctatcctcaccacacattgccaagcattgctttgctaaatctacaacttcttcgagaaactccatgttctcttcattgctaatttgatcgtccaatatattctcaagcttgttctccttcatagctgagagaaacctcattgacaaacttttctcatttccaggagcatcaaggttgaaaacgttcttccttgtgagcagttctagaagaacaactccaaagctgtaaacgtcactcttatctgttaattcacatgtttgcatatactctggatcaaggtaaccccaagtcccttggactagcgtgacaagctgtgacttgtctagtggagctaagatggaagcaccaaagtcggagacttttgccatgaagttaacatcgaggaggatgttggaggacttgacatcaccatggatgatgggtggtgaagcgtaggagtggaggtaggctagtgcctcagctgattcatgggcgatccgtagacgagtaactagagaaatgtgttggccatggttgccatggatgagattggatagcgttccatttgggataaattcatatactagcataggaacttgtacttcaaggcaacatcctaatagtttaacaatgtttatgtggtttatttaggataggattagcatttctttaccaaattctttcttgtgttgctcatccattgtcatgcatttcttgacagctattttagtgttgtccttgagaagtcccttgtaaacagtgccatgaccaccatggccaagaatttggtttttgtcaaacttgtttgtagcatgctgcaactctgcttctgagaaaattgtaaatgatttcctttcatttgaattcatctcttgaaacagcagtagaccaccgtgtagcttaaaatatttctgcttgatgtgttgcagctttcttctctcgcggatcaagtacgaacaagttgccatgatcacaagtatgacaaatccaacacttgcccctggttgccgaatataaatttgtcagccaataacaatactaggacaaacgacgacttgacttagaaaagcaagcgttgtagtacgtaccaatgcactaataagataatcaatatgtaaatatatatatattagcaaagaatatctactgctagttgtagtacgtacctacaacaggcatcacccaagcttgggacttctgaatcttctgatctggaacacagacaccccgagccagctcattttgtccttgagggcaagaacatttgtaactcccgattgtattttcacaaattccagcgcatggataagtagtgttatcaagacattcattgatatctgaaacaaagcaaactttcgtgaatataagttcttattgtatactttgctgaatagagagagggagagagagagagagacagagagacctctgcatccaagaagaccgtccttgacgtaaggattgccatcgaaccccttggagcacttgcagcgataacctctcccattcgttgaattgaggcattcgctattgttgctaacacaagcatatgaactcatgttcgttttcgcttcctcgcatgtctcccatgtaattatccagtccatcacggccggaacagtcccgttgtagtcatcccagaagtttgttgagggaatgtaagtggtgctatagttcaaaactagaagtccagccactcacttacacagccttttccatcactaccacgtagccacaactgctgtagctgatttctgaggagttatagtctttattgaagtaagcctcaagataacccaggtctggcgggacatccaccgaacaacagccagcgccagagcaagaaccattttttggttgatcggagcatgtggacaagcaacctatgacatactgcataagtcacagatgttaatttgtatctatgacgttaaattaaatgagattatgtaacgatcagtactgagcgcctagtatattaatataagcaaaatgtcgtcaaagcataaatatgaggagatacttacggaaacacctctcatgtaggccattgtattgcaaccgatgatgaaaatcttgttatcctcgtatgagaacctgaagggcatgtaggtgaagttttggaaatccacccattccttcattttgctcgaggccgagtcatagcactaccaagagatccgcatcttcatccaggctttggcatcgcgcacagagattttcgtcacctcaaacgaccccttgaaaggcctcttggtgccgttgacaggcttgcagatgatgttgaagccatggtggattgcgcagtgatcgccgatgccgaaggggaacgggatgtcgacgtccccgcacctcgtctggcagcctgggtgtccagccacggggacgtcggcggctaccatcccgatggctgaaacgcagatcagaagaatggtggagggaagaggcttagtcattgcgtgtgtgtgtggagactggaggagacaggagagtgtgtgctttgctggggcgtgacgcggtgtgtgttaaatagagatatccgctttactgtccctgggcagcttgccctgcagtatgtgattaataaaagctggtggttgattattgatcattcccgatatgatactttcgtccatgtatataaataattttacccttttatttttttgggattttgtaatcttaagatagtattttattttcccatctatcaacttgtgtaatagtttattctttacctatcaacttttgtcttattttatccttccacctatcaccttttatactatggcatatccttttgctacttctttaaaaaaaatttaaatgacataattccttatagctaggcacacgcacgaggaattaaagtctgttgtcatgtactctccattctaaaatatatttttttaacagaaaccacacgagattacgctttttcattaaatatagcaggagaaaaatacaacccctaaaggcaaacattctaaaatatattaaactagtattagatttgatataatttaattctataaatctaaactagcatgatagtatcattatattttctctcatataatagcatatatattttcttattatattattcaaatatattaaaataataacataattttaaattttgcaataactttacgaaactactaatgttaatgtgtaatattcatatagtattttatatatgtgttagttcttaattatttttaatatcaaattttaattatttgtaaattatatatattcctacattgactctagactcgtctattaatatttcttttttttaattttaaattttctgtaaattgtatttctatatatagactctaggctcttcttccaatattatttatttttatttctgattttttattatttctaattgtatttctatgtggactctatactcatcttttaatattctttaattttgaattttgaatttcagttacttctaaattgtattcctatattaactttaaactcttcttcccatgtttttcttaatttcaaattttagttatttgtaaattatatttttatacggactctaaactctactttaattttattatgtttatttcaaattttagttagttttaaattcctatatggactctatactctacttctaatattccttattttttaattccgaatttctttttttttcttaattgtatttctatatggattctatactctacttctaatattccttatttttaattccgaatttctattatttcctaattgtatttctatatgaactctatactctacttctaatattccttattttttattccgaatttcagttatttcctaattgtatttctatatggactctagtctcctattctaatattctttatttttaaattccgaatttcaactatttctaaattttatttctatatggactctagtatcctcttctaatattcattattttttaattctgaatttcagctatttctaaattatatttatatatggacactgttttttctttttctttgattaatgtgagaatttctagaccatgagagcgaacgtggagactcatttttctatgcctttaataatataatagataggttcttgttcaatttcatactactaaaatatgtcttttatcccgattgctatattttataatacgtggcgtctaaaggattcaggatggtccatcaacgaaatactcgccctcgcccatgcacgctttactcagtcagccggtcagcttagtatatgtcgctctaattggctggattaactctagggtcccagggagacttgccaagtcaatgccgctgttgttgagctcagagcatatcagagcaactagctagctggagtagcttccaagaggtacagtagcagtcggtccacgattgtggagactgatgaatgagtccaagtcttgtgtgactgagacagtgagacgtgtgattcccccggaacaagttggaggttggagtagacaagtgttgcaccagctaaaaagactattttttgtcttgctcgtattagggcctgattagtttaaaaaaaaattttcacgctgttatatcgaatatttggatacatttatagagtattaaatgtaaaaaaaaaataattacacagttcgccaggagattgcgagacgaatctttcaagcctaattgcactataatttgacaatatggtactatattaaatattactaatgacagaataattaggcttaacaaattcgtctcgcagtttcctggtggaatctataatttattttgttattagattacgtttaatactttaaatgtctgtccgtatatctgatgtgacatgtagggcaaattttttttctaactaaacaagcccttaatcctctgtctagccatcccgttgatatatatatttttctaaacttaagcccttaaacaagcccttaactccggatcccaaacttttttttctatttttctagagcaaagtacacggccggtccttaaagttggaacgaggtgtcacttaggtccatgatctaggaaaatcgtcattcgggtccgcggtcttgtttaagtgaatcatttaggtccaaagcgcctttgattggattgactggcttacgtgaccgtccacggtggcagcatgtttgcattttagcccccctcccatcttggctcccccttgtctctatctcatttctctatctccacatgttgtcagttgctgaccaccacgcgtgcatgcatgagccactagctgcacccgccgaacaccccggagccgtcgcctgcacccgcgttgtgcgtgtcctgggagaaaccgagcacggtctgagcttgttgttgctcctgctgtggcggtggcggcatgcggaactcgccgagatggaaccccacggctgcatactccgccggcatccctagcggccccatctgaggcagaggaacgtagcagccaatgctcctcagcaactccatcgccgagaacacgcacccacgctgcccctgccaccaacgccgttcgccaccgccatgttgcctccggggttgcacatgttgctactctccaagctcgggaacgctgtgaactccggcgactgcagggcgcggccgtggtgatgcgggaacgccaggttgaggtcctacgcgcccttgtgcatcgacttcaggttcttagccgccagccccacggggaccgagctagacaccgtcgcggaggtggaggccgacgcggccgctgatgacaccatgaggacgacgaacgcttgttctcccttaccgttgccgccgtacgcgcctccctcatcgtcgttgtcgtcctcgcggccgccgccacatctacaccgccacccaatcgccgttgcaatcgctaaccctagaaatcacacaggaggagccgaggaggatttgggggagaatggttggatcgtatatgggagagccaagatgcggggggctaaaatgcaaatatgctatcaccgtggacggccacgtaagccagtcaacctggtcaaaggcgctttggacctaaatgattcacttaaacaagatcacggacccaaatgacgattttcctagattatggacctaagtgacacatcgctccaactttaaggaccggccgtgtactttactcatttttctataagtaaattgcgacggatggatatgatttagaacaacaacttgaaattcgaactaactggtgcagtaactttcttggtttgtgacagtttgtgtgggtttttaatccaaatgagtgccacgtcgacaatccagttattatagctagagagtgtgctcccatgggaaaggaaaaagtacaccgaaggtccctcaacttattatcgggataaaaaacgtcctcgaaccgcaaaaccagatatgcccaattttaatcgttcgtcttatttaaaaaaacttttaaaaaaatttaaaaacataagtcagtaatgagtaaagtattcttcatgttttatcatctcataacaacaaaaatactaattataaaaaaatttcaaataatacgaacgatcaaagttaggcaaaaaaaacttatcgttgtacttaaaataggacataaaatagggcagagggaataagatctcagaaagtgtatatttgatcataaatgaagtatatcccaagaattatggacgacgactgactcccgggtctttacgtcgaaaagaaagagtgcatatacctttttttttttcaaaatgtttttcctccatcgtaatcgatctccagctctattaactacacatagcaacggaagacttcgaacgactgacgtaacttggcagtcatgcgtgatagcagcattgataagtgaataaacttgatccgttaaatttgtgtggctgatagtctaactgtaccaatcggccaccgttcacatcacattggccctgctttaatccaagaaattgagtaaaaacaggctgcgttcacctgagaaaacctggcctcgtccatatcacacaatttctcggcgacctggcgagcgatgtttatgggtcttgggtacaattggggggcttcacagggtcggtcttctctaatgacagttctggttctcttcgctccgctcagtatcatggaagacttgactgtttcacagcccacagggtcttgtaacttcgaacggtgaattccgcgtgatgctccgttgcgtgcaaaactacaaaggtacattttccattgcgagctgtagctctattattttcggttaagattcagattttactgtattatgtgcctttctatttagaagttactttaaaatatcaaatatatttatcaagtttgtaataattaaaacttagttaatgactttctcgttttgtgcgtgtcaacttaatttttattttcatccgcttcaaacacagcttttataattaaaacacagcattgacaacttaatttttacatatcgaattgctgaaaatgtccggaccaaacgcagcttttgtcaatgcgcaaccgagtacgatgagacaacattttttgggtttagaagttggttaggatgggttgcaagatgcatgggtcagcatatcttgtaaggtttggtcaagaaaatgctgaaaccaagtgtaccataggcaattaccacacggtagacagaatcacataaatcggtggggaaaatagtacagtgatagaacattaacttgacttcgtatgattgcttcttattctcatatatgatgaaacacagtcccataaagactaaaggtgtacacaaacaatatttttttatttttacacaaaaaataattaataatgaacataactgagtctgaatttctagggtaagtgaaaactatgatacaatacgacgcggtacgacatggtgatatgatgtatgctgggtggcaaagagattccagcttaacgccctgatgctaggtccttgacaactttcttctcgatgctgaaatttcttgtactcaaggctcctgagcttataatgtaagaagattctccaagcaagctctccaattcttcaggattttgttgcgtccatgggtgttgcattaccttaatcaacctatcgagcttctccgcaacttccttcatggatggtctatcctcaccacacattgccaagcattgctttgctaaatccgcaacttcttcaagaaactccatattctcgttattgctaatttgatcgtctaatatattctcaagtttgttctccttcatagcagagagaaacctcattgacaaacttttctcattttcaggagcatcaaggttgaaaacgttcttccttgtgagcagttctataagatccaaagctgtaaacgtcactcttatctgttaactcacatgtttgcatatactctggatcaagataaccccaagtcccttggactagcgtgacaagttgtgacttgtttattggagctaagatggaagcaccaaagtcggagacttttgccatgaagttaacatcgaggaggatgttggaggacttgacatcaccatggatgatgggtggtgaagcgtaggagtggaggtaggctagtgcctcagcggactcatgggcgatccgcagacgagtaactggagaaatgttctggccatggttgccatggatgagattacatagtgttccatttgggatgaactcgtacactagcataggaacttgtacttcaaggcaacatcccagtagtttaacaatgtttatgtggtttatttgggataggattagcatttctttaccgaattctttcttgtgttgctcatccattgtcatgcatttcttgacagctatttcagtgttgtccttgagaagtcccttgtaaacagtgccatgacctccatggccaagaatttggtttttgtcaaacttgtttgtagcatgctgcaactctgcttctgagaaaattgtaaatgatttcctttcatttgaattcatctcttgaaacagcagtagaccaccgtgtaacttaaagtatttctgcttgatgtgttgcagctttcttctctcgtggatcaggtacgaacaagttgctatgataacaagtatgacaaacccaacacttgcacctagttgccgaatataatttgttagccaacaacaatactaggacgaacagatgaccacttaacatttaaaagtaagtgaatctcaatattacaactaatgcactaataagataatcaatatgtaaatcttagcaaaaatattaatcttgctagacgtacatacctacaacaggcatctcccaagaggacttctgattcttctgatctggaacacagacatcctccaccttatgttgtccttgatggcatgaacagtcgtaaccccccatcgtattttgacaaagtccagcgcatggataagtagtattatcaagacattcgttgatatctgaaacaaaacaaaaatgtatatgttattgagtaaaagttttaagtgtatatatacacaaatcgatcatttaggaggtggaggatagaagtagctagacctttgcatccatccttgatgtaaggattgccgtcgaaccccttggagcacttgcagagataaccatgcccattcgttgaattatggcagtcgctattgtcgctaacacatgcatatgaactcatgtcccttttcgcttcctcgcatgtctcccttctgattacccagtccatcacagccggaacagtcccgttgtagtcattccagaagtttattgagggaatgtaagtggtgctatacctgaaagcagccttttccattactaccaggtagccgcacctgctgtagttccagatttgagaggtgttataatctttattgaaataagcctcgacatagcctaggtctggtgggacatccaccgaacaacagccagcgccagagcaagaaccatttgttggttcatccgagcatgtggataagcaacctatgacatactgcataattaagtcacagatgttaattaattagcttagtgtaaaaaatcagcttatcttgtgatctacgaattgagattgaaattatgtaacgatctggaagcatagtcacttaacataagcaaaatagatacaagtatttgttaaaatttccaattttgacgtcaaaaaggttgaaagcataaacataaataaaggaaatacttaccgaaacacctctcatgtaggccattgtattgcacccgatgacgaaaatcttgttatcctcgtatgagaatcgatagggcgtgttggtgaagttctgcccaaccatcgaatcattcatctgttttgtgaccgggtcatagcactgccaagagattcccatcttcatccaggctttggcgtccggcacagagatcttagtcacctcgaacggcccaatgaatgtcctataagtgccgctgtcgttcttgcagtcgaggccgaaaccaccgtggatcgcgcactgatcgccgatgccaaacgggaacgggatgtcgaggttgccgcacctcgtctggcagcctcggcgtcctgccgggacgtcggccgcggctaccacccagatggctgaaatgcagatcaaaagagcggagagaagaagcttagccatttcgttgtctgtgtggtttgtactgtacatgttctgaattctctgggctgcgtgttaaatagagacatacgctgccccttgctagctatatcgacgttgacgattgagagtacctgaccaatgccgatagaccgcgaggtcgctcacaatcacatcacatgggacaccgcattatcagaactattcgtggccagacgcccagactcggtcccagccgagcccattcgtggacgttgacgacgacgtggtgtatttacgcacataaagcagggtcgtttccgctaatttccgtcgctacgcacgtccgtgaaaacgcgaaccgatcgatcaagcgggtagcaagacttgcagcataggaacaggtgcatcgcgcatcatcgaaaggacggagtttcagctagcttgcctagttgcctctcgggcactacgcttctcagtaattagccgatcagctctaccgctcaacaaatctccctcgatttggcttggattaactcttcgttcctagggactagggagacttataataccaagtcaatgccggttgttgagatgagagctagctagcttccaagaggtcccgtagccatcagctagctcaggccatctccggtgtgctaaaaaaaaatcgaaccataggactaaaatgtcaacgaaattgctagaaaacttcagcaaatacttccaaaactttcagagttatagctatcggattgcctcgagatttgtgcataaaaagaaaaatattgctagaaacactactacacaaagacatagttttataggtgccggaagtgtatactacaaaatttatatgtaaatacatacgtatggtatattagactacacactagagggactagagggggtacgtcgcgcggtacctggggcatgcgcccaggcgcgcaataacaagctcctcgacaatacagttattacagatggcaagcgtgtgctctacatatgccaaatgggccgctaggcctgggcctgggccgagattagtcgggcttacacggcctaacctacacgttgggctgccccggacctacccacttgttgcaccatcggcaaaggtacgacccaataagactcgggccgtgccgggccggcccaaaggcacgaaagcgcatcgtgcttctccttagaaaaaaagtctattttgcctcctcccccatctctttggtctgcctcttatatggccttaataagtctattttttgcatccctcatctttttgggctgtgacttacatcgcgagaataagtctgttttgacttcctcatctatttaactctctgatcgttgaattgggccatgccgggccaacccatcgagccgaggcaaagggccaagcacaatccaaaggttgggccaagccaaaaccccgtcccatgggtcggaccgtcgtgcctcggcccttttggccaacttgtgctcctataggaaaggaataagttcaacctggtcccttaactttacacttaatccgattttcaaccttaaacccaaaaaccagatacaactggccctgaattgtcaaaacaggtgcaaacgagatccctcggtggtttggaaagcgcttttggctgacgtggcacctacgtggttagtttgactagatctttgtcccacgtggcaattcgatcagaaaaataaaaaactacgggcccacacgtcagctccacacacaaaataattaaagatagtggggcccacgtgggccccacatgtcatcctcactcctttcttccctcttccctctctttcttccttatcctcacgtttcatctcttttggggagaggcgggcaacaacctcggcgagcgaggctagcggcaggtggagtgaaccgacagcggtgacaccctcgccgccgccttcctctccaacgggtcgtcgtcctccgcggcctccgtggtggtgaccgtggcttctcacgctgctggcccaggagctgcaggagtcggagcgccccgaccgcaggctccgccgacgaggacgacaactccagtgccatcgccgccgcgcgcgccaagaacgcgccgccctccatcgccgccacgctcgagacggagatggagttcgacggcggcgacggtggtattaagggcacggatgcgactgacgcagcctgacagcttcttgcgcttcccgttgccagcgcgagcaggtgcgcgcggagacgtcagtgagtagcagcggtggcatcggcggaagcgtcggtccaatccgacgcaagggtgtcgatgagggaggcgaggccggggctgagatcgttaggggaggcggaggtcgcagaagccgtcggagcaatgtagagaagggggagccctgtcgcgggcgtgccagcgggccacgctaagggagccggaggtggacatggctgcaggtggcgatggaattggtgaagacctgggctgcgtgatgaagttggcggtggtgtgctcgtcctctagatcgggcggcgaaatcaacagccggcgaggggctgccagatccgcccgcgacggattgaggtcaaggtcgggggttcttgggcagtagtgactcggcactggcggcgagccgtctcacaaatgagaagatggggaggagatagagaaaggaggggattaggtggggaaatgggacccactgtcatgtggtcccactattatttaatcttattatttgaccgacatgaggtccaacatttttttattttttaaattgttaaattttgctttatatgccacgtcagatgaaaaccgagtcaaattagccacgcaagggccacgtcagctgaaactgccatccaaatcgtcttgggtcttattttgtgctggttttgacagttgagagacccgttgtatctggttttccggttgaagaatgaaaatcagattcgttgacaagttaagggacctcatatgaacttattcccatagaaaattagtctacggaaaaagtatactttgactcccttaactatcgctcgagtatgattcatgacctccaaccacaaaaccgggtatattgactccgccaattatcaaaaccggtgcaaacaatgtcccacggtggttttagaggtggtttttgctgacgtgacgcccacatggcagtcttgaccgagtttttgtcctacgtggtgcttacgtggtattagaataaaaacaaaatcaaaaaaatatgtgggagccatatatcattcacacaaaagaaaagtattgtgggacccacatgtcatcctccctctcctttccttcttcctcccctctctctcccttatctctctctctctcccccggcctttctcttggctggagcggcggtggcggcggttggaagcggcggtggcggtgggggcatcggaagagcttaacggattcttgcgggatgttggccttgccgtaggcggcgataagggtggcgacggtggcctcctcgggggcaatggagaaggagggcatggtgtcgaggaggaggcagcgggcgtggttgagcatgcggtgggaggcgacgatcgggatgaggagggcgaaggtggacggctcggggttgaagccggcgcggcggtaggcgaagcggaagaactagaagacgaggtcgacgcggccagcggcggcggccccagagatgacgcgcgtggacgagcgtcggggagagcaggcggatggagttctcgaggcggcgagcctcatccccaccgccaccgcgaccgccgccgccgccgcttcccaccgccaccgctcccctccgcctcgttcccatcggccatcgccaccgccgtcgctcttgagggagagagagataagggagggagagagagataagggagagagagggaggatgacatgtgggtcccactttttgtgtgtgtgtgtgaatgacatatgggtcccacatatttttttatttttatttttattttgatgccacgtaagcgccacgtaggataaagactcagtcaagactgccacgtgggcgctacgtcagccaaaaccatctccaaaaccaccaagagacattgtttgcaccggttttgatacttggaagagtcgatatacctagttttgtggttggaggttgtgaatcatactcggacgatagttaagggagtccaagtatactttttccttacctagcgtctcgattccagcccaactagcgccactcccacctgggccaccacccacatcactcgtcgccgttcctaaacccaagagaactcctcccctcacgccaatgccggcctcgtccgcgccgccgccgggagagagagtgaccgaggcggcggcaggagcagcccgtgcgagagagtgagagggaggaagggaccatgcgaggaggcagtaaagcgcgggcgcacgcagcgccgccacttcaagcaggggcgcgaggtcctctggaagcacaatcccccagcgccctccagccgcttttgcttccaatttccctaccaaagcacggtaatcctgcaattgtatctccttgaatcccctattctgcttgacacacgctaaacgtttggctgcgtgtcggatccatgcacaatctgtggggtcgtttttgaaaaacatccctacaaacggtggcagatctttaaatttttttgaagcctagacaagattaatattatcgctgataatttagattttaaagctagtgtcatcttgaacatcggtgctagtaggttgtattgctttggcctttataactacagcttgatggtttggtccttgctatctcgttttctgataatctgattattcatctaattaatcttcattagaacttacgagacaaagtgattatgtttgtttcagcttaagattattataatctagattatagaactagattactataagctgaattataataagccgacatagaataagctgctagctgtttgtttctctaaattattatctgtttgttagttgtttgccacccaataatctaagaaaagcacctttagagtggctcaccagattatagtaatctggcttatagattataataatactccctccgtttcacaatgtaagtcattctatcattttccaaattcatattgatattaatgaatctagacatatatatctatatagattcattaacatcaatatgaatgtgggaaatgctagaatgacttacactgtgaaacggaggaagtatatcataataagctatctatttgtttcagcttactcctaataatccagattaaaataatcctaagctgaattaaacatggcctaagtatatggttaacgagtaatacgctgcatatgcattggagcagtgtgttgctgtacgcatggtgcccaggcaattgcgcgtgatggccgggcgccggcgccgccgctgcctacaaattttaactttcatgtacaaattcaaaaaattatagaaatgactccatttaaatacaaactagtagtaaccgattttaaagggttaaatttctagctccgccactagctgcgtcatcatggttggcggtggtggtggcggccattcatgcatttaggcttcagctatttgccttcacgacatcgtgtatagaagtagcgcacctgggcacgttcaatactcagcatatcctactctgttttaggctgtgttcaggagtaggggtttcctagcacgcaaaataaaattcgtattattgcatgattaattaagtgctaactaactattttttttaaaaaaatagattaatatgattttttaaaacatctttcatatagaaaattttttataaatcacaccgtttagcagtttgaaaaatatacatgcggaaaacgagagatgtgggttgaaaaaacagggagaagaacacagcctgaggggactaacgaattgttgacacattgtacatttcaatgctcttgcctgaggggagcagtacggcaaaaaaaatgtactacctgcatggctgcatctaaatatagttaagtgcggatgtgagttttcttatttaacatttgacatacgtcttatttaaaaaaaattataaaaaaatagtcacacataaagtattattcatgttttatcatctaataacaataaaaatactaatcacaatttttttaaataagaataacagtcaaatattaaatacggaaacttacaactgtatttatatcgggacggtgtgttacgttccaacatcaattttgacagatcaagccaacctcaagtaagcacctcaagtaagcacaagcaaaaccagcatcaaaccactgaaatattcatatacaaaacagagagaaagaagagtttagacaaggaatagcaggagattgggttggtagaaaggagatcaggaaatcagaggaaatagagtaggatttgggaagaagcaagagggagggaacagccaggcaataggcttcagttcttatattctttgatccccttcccattgtgcctggttcctttttgtagtaattacttgatgtagcatattgggcctaacaggccacaatccaccatggatgtctagcccaacgcgagtccgtgacacggagagagtaccagatttgatcttgaaatcctttttgttctgtagtggtagaaattaaagaggaatttgaaggttgcttcattcgcgtgcatggctgcccaaacaacccgtcttgtcactcaggaggaaaaacaaccatagaagcatccgtttctctttctttggaatgctattatccctccgtcccacgaaaaagatctaggactggatgtgatatatcatagtactacgaatctattacatccagtattaggttgatttttatgagacggacggagtatgtggcaagtaagcagttaaaaaagagcaagaagttggcacaacaattaccgactggataaacttgtaaaagatatgtaggcatggttataaataatttaactctgaaattctaagcacagactatgttattccacccttcacattttctggccgttttcagttcagaacttcagatactagaccaaaacaaccaatacaattatataaactatacaatctacaattcattctaccaatgcaaatacttacctagtagtcttcggtcagattcctgcgttttggggatttttcaattttttttgacccctccagtgttcgccacgtgttaaactgttttgcttccaagaacaagatattcgtttatgatcaatgcattaataactataatagactagagaaaaatgtgcatacatacatagacaaatcattgttaggcttcttatcttgttaatttccttttattattgatcctcttttccgttcaaaggtataacttagaattatttaagtttctttccttccttgtggtgagttttctatctacctcatgagccaatgatttctgaaattgcgatgttgcctatccaattaaagatatagtgatatctataaatgtccccaaggtgttatcaaagcgtttaaaaaaccatagcctatagttctttagaaaaatgataggatgcattatttaattgttttgttaatacacaaagaatcaatgagaaattagttgttcatcaataggagaagcatattatctaaaagaaataaatatagaaaagccataattcatctttgtagctagagagagcggttaattattgataagactaaaagttcttttattagagaaacttcaccaattttttttcatacaacaaataattttgcacacattctattcactcttatactcatgtaaagaattactcatttgttccaacacaaatatgcaatcccttctattacctttggcaagaatttcttaaatttgacactctattgtataactttccttttcatctacaagagagatgaatgatctgtcttaaagttaatacatgttttgaatcccaatctaccaagagtagtgataccaggaggatattctaacagatacaattaccttgccttcacaagatctcaactttacacaaataattgacatagatgagtaagagttccttggctctacaaggaatctatgataaatcacaataggattggacataagctataccagagagagtactgcttaacgccctgattccaaacccttgacaactttcctttcaatgctaaaatttcctgtactctcaacctctgagatgaccacacatgatgactcaccaagcaagctctccaattcttctgggttatcgtgtgtccatggatgctcgatgactttcctcagcctatcaagcttatctcttacttccttcattgatggcctatctacaccggacatctccaagcattgtcttgctaactcggcaatctcttcaagaaaccccatattctcattattcttgatttgatcatccaatagatcactgagcttattctccttcattgcagagagaaacctcatagacaggcatttctcattttcaagcgcatcaagattgaacggcttcttgcgtgtaagaagttctagaagaacaactccaaagctatatacatcactcttatctgttaattggcacgtttgcatgtactctgggtcaaggtatccacaagttccttgaactagtgtgacaaattgcgtctcatctgttggagctaggatagatgcaccaaaatctgaaacttttgctgagaggttgctatcaaggaggatgttcgacgacttgacgtcaccatggaggattggtggggaagcacaagagtggaggtaggcaagtgcctcagcagactcatgggcaatccgtaggcgagtaaccagagggatgtgccaaccattatagtttccatggatgagatggtaaagtgtgtcatttgggatgaattcatagaccaatatagggacctccacttcaaggcaacaacctaatagtttaacaatgtttttgtggttgatttgggataaaattagcatttctttgccaaactcttttttcttttgctcatcaattgtcatgcatctttttactgctacttccaagttgtccttaagatgtcccttgtaaacaattccattgcctccttggcctagaacttgatgttcatcaaatttgtttgtcgcctgttgcaattcttcttccgagaagattttgaatgcaagaccttgtttagatttcatctcttcatatagtagcaggccaccatgccgtcgaaagtattgatttttgatgtgctgtagctttcttctatcatgaattaagcatgcacaagttatggtgatcactaggatgacaagtccaacacttgtgcctacacaatcataaaagcttgtgtgaatgactagtaaggccagtcccaacccaatgactagaatggtgtctatagcattaaataagctaccacctaggatgaaagatgatgtggcaagtgaataaatgaggaaagaaaaggaaaccaggtcttgcatgagacatgcatggtttttacacaacatccaagacatcatatgagataagtagcattaaatctaagtatgaaacaatggtgtttgcattgaaagagcagtgtcttgtactagttttttttatgatgtggagtttatggaaactatgtctagtgtgttgggttgggattggcctaagatatggaattatggaagatccatgagctagccatgtgtaatgactagtaaggcatgcaaaatttatatattaacaattctcatattggtgtgcacaaatggttggcgttatcattagttctagtgattacggaagaggggaaccaacctactataggaagtgcaagaaaaccggacttccgatttggtatgcaagtgccattctccatatagtttccttggtggcatgagcaagtgaaactccccattgtattattgcatatccccggacaaggataagtaacattgtcgaggcactcattgatatctgaaatcaagcaaccattgcaagtttgattgaaattgtcatatcaaggaagaagaataacgaaaaagtaactatggtaccttcacaaccatctttaatatacgggtttccttcatatccatgtgaacaattacaacggtaacctccactcggatcatcattgcagatgctgtttgtactaacacaagcgtaggaagtggttttgcttttagccttctcacatgtatccaatgttatgacccagtccaacacaactggaactccctctttgtacgtgtcgttgaataccgtggagttgaggtaagtggtgctaaattggaaggccttatcctccatcaccgccatgtagctgcaagggctgctcctccatattttgctatcattgtaatcttcgtcaaaataaccatcataactatatatgtgtcctggaacatccatctggcaacagccaccgccggagcaagatccattcacaggtgttgaaccattacatgtcgagaagcaaccaattacgtactgtggaatttgcatatgtattattagaccaagaagtagtgaactctgccactgttttctttattaaaaaaagaataaacacttatatggtagtgtgtatctgtttttttttcttgttgtgaaaacatactactttgacgatctttttttggagggagcaatattgacaatcttgatggttgaatgcgcattggcaacctcactagttgcacatagtgactcatatcactactatagagtcggtcatctatgcacggaaatggtttgtttggtcccttgacgtgcaggtgacttgaggcgacgtttggtcaatggacaagactaaattaagctagagaagcatattttatttattataaaagcagcatgcttttttttaatattaaaaaatggcaatgaaatcattatggtgggtctagttaggttttggaggggggttgatcttcttcctccccttctctcctccccatagggatccaacagggtgggaaattggggcgggggggggggggggcttaatccacattagatttgccccgggcagcgagacacatgtggtatgcaccgccacggacacaaacacaacgtcccctgaattagctggggaacatgcgcagaagaaaaaaaatactagatggctacaccttctaggatttgagcaagaataccttactatgatttttaccggaattgataattaaattaaaaatgttcgacaatttttcaaccaaaaccttcagatttatgattgtcagatcaccttgatattcatgcggagaggggaaaaaaaatctgtgcaatacgtacaagttgaacatgcaacatgtgaggtggatgtcgtgctgctagccaaccggttgcatgaacgttttattcaactacatataagttacactataatcatattataattacaatataatctcaaattatactacattatatttaaaagtcttttattaaaaaaactgtagtgtatactgtacagtagctcctaatttttattggaccataactaatatttatactgatgtatattatggggcagggtccctaaattattttttttaggcttaaggctgcctctccgcttgcgccctgtagcgcccgttccgtcgtggcgcctagcgggaaaactatctcttaaaaatcctatttgcgaaatccgtttctttgcttgttgtctagtgtccgtgccatctcagatctcaaatccccgatctatcgtcaagttcaatcccgaatccaaatccttcccaaatcaaattcctccgcaaaagtctattttgcctccctcgggttcgatgggccgaatccctctaggcccatctccccctcgctcggcggctctgtctctctctgtgtctgcccgctctgccgggagccgcgccgagccc

SEQ ID NO: 49871 - DNA, 24974 bp, Oryza sativa
gtgcgcgttaggacgaggaaggggactccgggcgctcgtcttcttcctctcccccggcccgaggccggagagatcgctcccgtgccgtcggcccatcgtcactgcgccccgtccgcacggtagtgaatctccccgttctccctcctcaatccatctcttccccttagttttcggtagtagcatgtgtagcctccccgtagctagccggcgccgccccgactgctgccgtcgctcgccgtgtgctcaccgcccgagctcagaagcgccactcgtcgccggcctccctcgatgcgattcctcctaatccggcgcaaggggtgggttcccgtagccgcgtagatgctctcgccgccgggaatcggcccctcgtgacctcatcgccgtttcccccttctcccgccgccggttgccgccgccgcaatccgccgccgtcgagcatcccccggcgaatccgagccattggctcgtctcccctcgtcctgtgcaacatcccggtgtgctcgccttcgcctgtatcgccatggttcgctccgccgctcgccgctgtcgtccgccgtccgttccggccggcgtcgtcgtctacctcccgccggctcgcgtggcagccacgtaggcgccacgtcggcgccacctcggccgcgaccgggtcaagcagaccccggtccgccgcttccctccgcccctcgcgcgcgcggtccaccgcgagccgtgaggctgcgcgtgggcccgtcgcaccacgtcctccgcgaaacgcgcgcatgcgccgcgcctccctccccaaaccctagcacgccccgcgtgcacctcgctcacggtgagccgagtcgctgacaagcgggtcccacccgggaccacgcgggatggacccggcccaccggctctctctctcccctccccgcccgcgcgcgcgccttgggccgccttcttgggccggccggcccattaagctcggccgagccgcccctttctctcgggccgcgccctagccgcccgagggaagtctaatttccctccctccttcttttctttttcaaaaaggatttaaataaatccttttcctttagaccaaaaatccaataatcttagaaattcaatatcttcccaaccgtaagtccgtttgactccgttcaacttccaaaattcctcaaatctcgagatctatcgaatggcacgcttagaggtcaataatagggctttatttttgccgtttgctgagctgtcccgtttcgcgtgtagtttcggagcccgaagacccgcagtgcgaggatttcgaggatcaagctcaagatctcgagcgaggcaagccacctttgaacatcttgagcctatatttgaacttaattatgttgcttgaaaaatattatgcattgataggatcgcacttaatctgcttgtcccgtctgcaaggcagattggcggacctacctaatttgttgcatttgaccattccattgtaattgttataccatgttcccttgtacccacctagttgcgcctcggtaatcgtgcactctgcacgggtatcgacggtcgccttcaaacttaaaatctgagaaacatcttgggtaaaacttgcgttttacaaaagacttggaaaatccgacacctgggtcggtgcttgcgaactaaatgaatttccaaaaccgcggaccggggaacgtaccgggtgtacggtttcccgctcttgcacctaaggactgtttccttggaatttcatccgaacataagacaagtacgaccacatgggtggaatgggacacccctggctgagtaactagcttatcgggagagccatgatgctaagagacatgtggattcgccggggtggtgtcggggaggacccctgggcttcctggcacaatatggtctgggacctaatctggtgttggtctgggacccttctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttatgaaatttgctgttgtgggatgggtttgatgtttggaaaatctgcggctgatgggatcagccaggcccgggtggccgtttgaaagctgttggccgggtgccaatcttgatcaattcaaaagactgatacattgcacatactccgaccggacgagacgcactgtctcatccgtgtcgtttgagaagcactcacttagttgtttcagaaaagagttcaaataaaatcaattgcaaaaacaacagcctttctttgaagcctacattaaacacttatttcccatggcttgctgagtactcccgtactcacccttgctctatataaataatcccccctagttgctgaagaagatgaagcggatcccgctgacgaggagttcttccaggagcaagccggctacgatgagttttagggtttcggcctagtttccaagtcgcgcctgtgatgtttggtccaagtcttggcttccgcttcccttttgtaatgcagttgtgagctcgggatctgtccgcagcccaacatgactatactcctactctataataaagagacctctgttgctgtgatattctgtcttcctgtgataccagcactgtttcctgggactggtatcgattaacaggttaatttggagcgtcacgggctagttccggtcgggactagttcggggcgtgacacgcccttaccccctaccctggctgggtcgcaccttggatgagaaaaaaggagcatttgtataggctggtttactttcagactacatttcttgagaagtgttcaagcttgtactaagtatgagatcttgttaacttttctttgaaatgttgtgcatggaaaggtgtgagttgtacgtgttgagttaatttgcttctttatttgtaaattatgtgttctattgtctttgtgatatggtttttcttttgatttatatgctgagtttttgtggtgagaagaaggatgaatagatgaagctttatgctccttttgaatccatctccctcttgagcgcaaaagatgttcttgttgatttgccagtttttcttttcttcatggaaatatttggagggccttggtcagtgacttctacaaagtatgggattttgcttatggagaaacaacacagcattaacggaaggaatccaatataccatcattaatttggaagctgacgggcactggatcaatagcacagtgcgcagttagcttttttttttttttgagaattagcagttagcatatcaagcgcaatttgctagccaaatacaatcagctggggcaaggcaaatctgggaaccctccaaatgcaagttattctcttggttactccttctgaacagaatttagacctctgatagactacaaatcagagggtggctagctgaataactatttctaccaattgtgttttagaagccttgagacaacacattttcgaggattgtcagatgttcaaatccatatgggaggccattacgcgaattaaggactagttaaaattgggtggcagcatattacagtccacttgattgctaggttggtggaacaaaaacgcaacacaacatgacaaacacaaatcaaaggggatgagattccctattactttgggtggcgtgggtggcgtggatagcatagtgtgagcggaaatacggaatagacgagtcttaaaaagtaaagagatgatcaaaacgtgtagatagtgacaagaatcttgggagaaaccggtttttggcaaaatcatatcggatcactgctgcccatccaaaaacttccctcctatatatacttcttctatctcataagtactccctccattttatattataagtcgtttgactttttctaaagttaaagttatttagatttgatcaagttttttaaaaaaattagcaacatttataacatataacaccaaattagtttcattaaatttaacattgaatatattttgataatatttttgttttgtattaaaaatgttaaaatatttttctataaatttggttaaatttaaagtagtttgactaagaaaaaaaattaaacggcttataatataaaacggatagagtatgtacattttgcatgtggctgggagaaaaaaaaagaatacacttgccaagtgaaattctagataaacgacggtattggccttgcgacagttttcgggaattcttttcccccctagtccccggccgattccctgtttgtatacttaacatggtgtgcttattaaaatgcctctaaatgataagcttaagagatatatatacttacagcgttgctctccatataagccatagtttgacatccgatgacgatgatcttgttttcggtcgatagccagaaaggtgaatcaccgaattctgccgttgcgttgctgtcgtacaggatatggcctgtcacgtggtcataacactgactggatatgcccaacttcatccatgccttgccctcctgcaccgaaatcttggtaacctcgttattgttgtagaaaggcttcttggtgccattcacgtccaagcagtcgagatcaaacggatacttcgtctgcatcgcgcagtgcttgccgatgccgaacgggaacgggatctcgacgtcgccacacctctccgggcaaccggggcgttgccctgccggtatatcggccgttgctgccgccacccagacagccgacagacagacacaaaaaaggctggcaagaactgcccgtgtatactgcaacttcatctttgttggttgtgcccgttgtttgcgaggtcagcgctccagctagcctatatatatagagaatatatagagagatagcctacagtggagttctcaaaaaaaaaaaagagagagatattctacagcgcaggtatcgcgtatagtacgtaattttgttgacgtgggcggctgaataccgtaaagttttctctattttttttagggagggggatgtgtgtacgatgaagaagcattattattattttatacagtaaatgcaactagcagaaatagtagtagtaatcaaatacagtacatattcacacatacttgtatgcaggacttctttttaatttaaagcaagttgcaagagcattgcagtactccataaccgtcccttaccttggctaacgaacacaggcacacacggacacacccttagaaataggaggagctagcactagaggaggaggtgaacgccgtcaccgacgaatgtttcatgtgagcaattagattagcctgatcccttcgttgtcatcatctgcacccttgatgagttgtgcagccagatctaggtgaagagcccgaaatagggagaagactttttgtgtgcatagggtatgttcctgtctaaatgagactttaaattttattacgtactccctatgcttcatattataagtcgttaatttttttttcttatttaaacttttttaagtttaatcaagtttataaaaaatatattaacattttaatacataacaaacatattatcaaaatatattcaatgttaaatctaacgaaactaatttgatatcgtagatattattatttttttatacaaatttagtcaaacctagagagttttgacttaaacccgtatgggcatatataccatgttatacttgcatgtgtaaggtcaacgtttaaacgatatacttaaaaaagtgaaaggaaaaaaaaaagagagagagaaaacaaacagtaataaggttgacggcaccttctgtttgttttttactttctttttctattttttaatatggtatctgtaagggtataataggcatttaaatgttgacttttcttgcaaggatgacacagcatatgttgagcatacgttgaactgtatgacacagcatatattatctaatacggaatgctagaaatcaaggatcgttttcgctatgtacccttattaaatcatatataaagcttacataactgacgccccagtaaaattcaactttattattttataattttaaattattaagtcgtgaaaatattatatttgagagtgatatttattaatttctaattctataaatccacgtattctgtaatggaatatctccgctctagatttgatggatgacgggtataattttatcttttttaattaacacaagaataatatttttagcttgtctcttactgattttgctacttctagcttgattagtgtgagggttgtacgagatcctttgctaattaatataaggaaatagatgttaccgttgggataggctgactttgaccaataaaatgctaagtacttgtatatggccctatgggaaaaatatgtatcgtaaacctaaaaatttaaaaatggatgtgtctgatatttgtttacatcaccattagtaaagttttactcaagataacgtggataattcataaacaagttcattttttatccgatgatagttaatttacatattgatattacatatgttatgtgatttgcagtactttattttcacatgtacctcctcacgtttttaattaacttcgtttgacaaagagcctttgtgttagtcaaaagtgtactccagtaggccctaaatgcgatggcgtgactgggtcatggttgcacgctcctgggattatatagtttctaaggtcctatttcagcttaaaattattataatctagattattaaatcagattactataacctggattataataagccaacataaaataagctaagctgttagctgtttaattctctgtattattagctgttagacacccaataatctagggcctgttcactttgatgcaaaaaaaaaaccttaccaaaattttggtaacttgccaaaattttggcaggatttcttatatagttaccaaaattcggcagcaaactaaatgtagccacttttttggcaactttaccaaaatttggtaaggttgaaaatggtataaaaatgaacaggcccctagaaaaagcacctttagagtggattattatagtaatctggcttatagattataatgatttatcataattagctatctgtttatttcagcttactcctaataattcagattatcataatcttaaactgaatcaaacaagaccttaacaaatgataggggctcgcaagttcgcagcggtctcggccttctccaatattcatagggctagtggcaggtgtacggttaatgaagattgcatgaagctgatccagtggttgcggttaggggtgaaaacggtcacagaaatttctggtcgactaaatatcgttttcgtatttgtataaggggtaccgttttcgatcgtaccatttttggctatttatgaattttgattttactaatttctttctgtatcgtattaatgttgatacttaccagtttaaatgataaatatgatcaattattagtcgatcgagtgtcatttactgattctgaccgttttcaccctagttgcggtaattaaatgcgccatatgttgtcacctctgcgtaatctgtatcaacttcggagtactgctcgatcgacatggtcaaaatgaaaaacgcggccggtacatgaaattctcggcgtcctggctcggctgcgtcgtgcagaattagtttttccactacaaggagtagacttttgcatttcggagatactgctgaaaagtaaagtgatacatgtaaaaagattcttacaatttttttttacaaaatacctgatatgaatgccacatggtgatatatctttgattttccatgactatcaaccaattaaataattaaacagttttataatacgtttgtgtattagaattttttacatgcatacctgaaaaatgttgcattcttaccggctcatccaaaataagtttgaggcaatttaagatgggtcacacgatgggctgcggggatgagtacggagtacggttggatacaacgcatcccctaacttacgaaactagtgcgcacgaggtcctaaggcggtttggatggtggttttggcttatatgacacctacgtggctagttagagtagatcttcatcccacgtggcgcttgcatggcattataggcagaattttttaataaataaacaaggggatccatatattagtcataagggaaaaaaagatagccccacatgtcagcgggttgtcggttaaaaaaaatatgtggacccacatgtcaccaactctcttctctatattcctcttctctatcccccatcttatctccctctaaaggacgggaggtcgtagactggtcgacggacctctgtctcagcctctcggagctccggaggtcgacaggccagcgatggacgagctccggagcttgacgaggtggtagtggggcacagagcttgagcagcggttccggtgaagggtggcggccggccctttcctcttccccacgtccctgctgtcggctggccgacgcccaaatcttgcagctggtcggacgctatcatttgtcagtaaggaaggaggcagatatcgaccgcctccttcgaggaggcccgctactgtagttgtttgtcagcgaggaatgtggcagaggccgcctgtctcccctctgggacatcctccatgcgctctaccgaaagctaccacacgtgttgggccctcagtggctgctgttgggtcatctcgctgacaacgatgttgaggtcgagcgcacacaccaccgtcccagcccggtggacctgacggccctgtcgacctctgtccagtgaggaagaggtggaatggcaaggattgcttccttccccatcctctcacgcgtcctcgcccatgccacgatttttcacacaccaccagtgtcattcctgtgtgaacgagcgagcgatggtggcagcaggtgtggagcttgaagtcgacgtcgtcgcctggggtgaggagaactggagaagctaaccgccaccattcgggcatgtcaggagtgtggaggagcagtagagggaacggtgaggaagagattagagagggggaaagaggaggaagaagaccaagagtatgcaagagagaggaaagaaagaagaggggaggtgtgaggatgacacgtggggctcacatgggccccaccatttttaaaattgttttgtggtgtaactgacacgtgggccctatagtttttattatttttctagactaaattgtcacgtcaacgccacgtgggataaagacccagtcaaacaagttacgtaggcaccacgttagccaaaaccatcatccaaaccgtcctaagacctcgtgcgctttagttttataagttaagggatgcattgcatccggtttttgtggttcagggtgtttttgaaaactcgacgacaagataagggacgtaaagtgtacttttgcatagttaaatgcccatcgcagcttataattctacaacgagtgggctggcccacattgagcccaaccggtgccaccatcgacgacctccgcctctcgcccagccgccctcatcgctttccggtcgccgtcgctccgaaaccccatgaacctttccccccctcccttcgcgccgccgccacccctatccgcgccatcaccgggagtgagaaaggcgacagctgcagcaggagcagaccgcgcgagagagcgagagggaggaaggtatgggaagcggcaggaagcgagggcgcactgtcaggagccggccagatgaaaggtcctgaacgcagcgccgccacttcaagcaggggcgcgagaacatcttgaagcacaaaccccagcgccctcctgtggcgaaggagccgaaggaagcggtgatgggtgcaggggaacccctcgtggtagcccttcaccaccgagaacccggcttggaggactacttacaaggtgcggccgcttgcttcagatcatgcgttgcttacgcattttaacatttttggcgtgttttggtttgattatagccttattggcttataccagtagcttttatagtgtagaatggaggtgtgctagctcacgtcctctcaatgtgttagttttatattctgttttagaatgtgataatttgttgactgcggttattattattgaagtcacaactctatttcgattcttatactgagtagtgagcattgatctctagatttaccttatggtaatagaagcctaaagctgggacgcactgaatcgatttacgggtgggggcattcggcggttgacagagtaaacagggcagcggcacagcagggtagcttagacagcttggacaaggcagagtttggtgtggtgaagtggtttagatgactacgggaacgggctggcagaagcagaacctggggaaaatccctggaaaagctggaattggaaggtagctactgaaagtctgaaatttatacctacttctcggtcctgttcgtagaattcagatttcagaagctgggagagtgggaggttgataccgatgggccagtgtgccactgtgcgcgatgtgcactagctgtatgatatgcgtgcgtccttgttgtgctggaccgataaacacacaaagtgtagtgcaatgtcaccaattgtgagcaagccaggcatgcttgtatgtaaggaatgctgaaaaaagcactcatggactagctgtacatgcagtatgcatgtttctatgaccactaagatgtgatttgaaatatagtgataaccaataatcaatgacaattcttctcgacactaacaccaagattgttgagggtattccttgagcagccgccaacattactttgttgtcctacatacaatgcaagtaattttgccaacaatatgatattgcatatttactgtaataagatctgtgatatgattattttaagtagataatactgacattgcccaccaagattttgaaaaaaaaagtatagctactacctccctgaatctagctccatgacaccttttctctctatgctgaaatttcctgtactggtataccttgagctgaccatggacgattctccaagcaaactctccaactcttctgaattctgttctgcccatggatgttgcataacctttctcagcctgtcaagattatctgcaatgtgcttcattgatggcctattcacaccagacatctccaagcattgtgctgccaactctgcaatctcttcgagaaatggcatattctcactattcttgatctggtcatctaatatatctgcaagcttgttattcttcattgcattgagaaacctcatcgataggcttttctcatgttcaggtgcattgaggttgaacgctttctggcatgtgagaagctctacgagaacaactccgaagctatatacgtcactcttatctgttaattgacacaactgcatgtactctgggtcaagatatccacaagttccttgaaccagtgtgacaaactgtgactcatctgttggtgctagaatggaagcaccaaaatctgaaacctttgctatcaggtttctatcaaggaggatgttggatgatttgatgtcaccatgaaggattggtggtgaagcacatgaatggagataagtaagtgcctcagctgactcatgggcaatctgaagacgagtggccagggagatctgctgaccatggttaccatggatgagatcgaaaagcgtgccgttcgggatgaactcgtatactagcatagggacctctacttcaagacaacaacctaatagtttgacaatatttttgtggttgatttgagataaaattagcatttctttaccaaattctttcttctgatgctcattgattgtcatgcatcttttgacagctacttccatgttgcccttcagaagccccttgtaaacagttccatggcctccttgcccaagaatctgttgttcattgaacctatttgttgcttcctgtaattcttcatgtgagaagattttgaatgcaacaccttattgcgatttcatctcttcaaataacagcagaccaccatgctgtcggaagtaatgttgtttgatgagctgttgctttcttctctctttgatcaagtaagcacacattatggtaatcaccaggacaacagatatgatacttgcgcctgcacgttgttggaaaatgatatggatgaaattccatcacctagccagcaattacatttttttttctatggaccaatactgagcagatttaaggctatccctgcaatgtcgcaatgaagaaaggtgctagagttgtgtcttgttggccaacgcgactacacaaaatttggccaaacaagttttttttttaattattacttatttcagaaaagctctggtgttgtttagagggagaagtgttggattgtcatattgtatggtatgactacacactacgcagtatttaaactggtgatccatagacatggtagtagttcttacagaatataggagctcacctactaccacaggcactgagtcaaaacgtagtttcttctttggcatacaatctccattcatcatataacttcctggggagcatgagcaggtgaaattccccaacgtgttggtgcatatccccttgcaagggtaagtagcattgttgaggcactcatcaatatctgaaatcgaaccaccacattgggtcagaattgtcacattacatacaagtgtacataagcagcagacacaaaattaaaggtgcaacacagtacctttgcaaccatcctttatgtacgggttgccttcatatccattggagcacttgcagcggtaaccttgtgcattcgtcaggttgtcaatgcactgactgttgttactaatacatgcgtaggaagtcttgtttcttctagattctgtacatgtttttgatgttatggcccagtcgtagacaaccggaactccccccttgtacgtgtcataaaatacgctggatgtgaggtaacttgtgctaaagttgaatgctgcggtttccatcactgccatgtagctgcaagggctgctcatccatattttagtggtgttgtagccttcgttgaaataaccctggtagtactgtatgctcttaggaacatttgcctggcagcagccagcgccagagcatgaaccattcttgggagttagtttgttcactttgttgtcgcatgctgacgaacacccgattacatactgcatttgttacatatggatgcagaaagctatttagttgaagatcaaaagcaacgaatattcaatgaaatttgtacaattctttacaccttgcgcttttaattccttagaccttgcccttttttacagttcttttttattcttgtaattgtaacttttacttctatattcaataaaattggcacatctttaccagttcgttaaaaaaaagcaacaaatattttttttcatgattaacaaattactctctctgttcctgttacatattctaagttgttttagttttatattcaaagtcaaaattttctaactttaaacataagaaaagtgcaccacatctacaacatcaatttagtttttattaaatccataaaaaatatgtcttaatagtgtatttatttggtatatattataaatatatttttctataaacttatatcaaagtttgtaaattttatcccacccaacctaatagctaatagttgactgtagaagacaacaacaatggcaattgatgcaataaccgcacattattgaaatgcatgtgaaaaaccggatcgttcttaatttttacttttcctcttattataaatatttgacatttagctaagatgagatctgatcagaccttcgaaactttgattatcaataatttctcaaatgtttaattttactagaaaaaatacacgtgtgttgcaacgggtgaaggttattttaatcttattattgttatacggtttagttaagataaaattcactatgggaattcgcgtgaatatatagctttttatgaaaccatgaactgcaattaagagtccaatcatctcaaaataacatacgagtttttttaaagagatttcttatacgactccttatgtatttccaaaagtaaacgaacttaaaaactgactcaaatacaaatatatatttccaaaagcgaataaacttaaaaaccgactcatacacggatgacgtacaaaagtaccgacaaaaacatcttcaatttttataatagtagagaagagaaaaagaaataatatatgtagattttccttgaaaagttctaataatattaaatatggagtatcataaacttacatatgttataaatttatttaatatcatgcttcacgcacttaggtgtagtattcgactgcaactagggacacaactagcgtgtttgaatctcctgaagatgaagataaagattaagattaagtgtttaacgcaaaatcaggtggtaataacgtgtgattaattgagttttaattattacaaacttgaaaaatagattaatcttatatttttagaacaactttcatatagaaaattttcacacaaaacgcaccgtttagcaatttgaaaaacatgccacgagtatccaaaagtttatccaacttttattggagaaaagaacataagcaaatgggataataatatctattcccaatcaatctatggacgcagggacggaccaacaaaacaccgtaatatttcaactctaatcttagaccaagatgacatgggcctgctttgggagcttaagattctgagaagcagctggttggtagcaagctggcttctagttcattttatagattctacaactacagcttctcaaaatctggaccaaaagctggactgtttggggggagcttctgattctaggagaagctgcaacagctagaaactcccccaaacatgcccataagctggtccaggtcttatgagaaaccttggtccaccccttatggacatctataaatctctatctctactattataaaaattgaaaatatttttgttgacattttggtgcattgttcgtatttgagtcagtttttaagagcatcaccaacagattatctataatcttccctccaaaaattgtttttgggtttcctaaactgaaaataggaagtgaaaaaactcctccctctaacagatagcctaaattaaatccctaaaacttaaaatggacccttttgttaaactactaacaaaaaattctattttttcttccatcgcaaaaagatcgctatctcccacacgcgggaacgggaggagagatgcgggagtgcgagattgggagcgacttttgcgagaacacgcatccgcatataaacggagcgaggaatcgggagaagagaactccaaaacttgggtaggtgagtaggggatctgttggagctattttttttattaaaatccctccaaatcagttttgaaaatcagatagatagactgttggtgatgctctaagttcattcacttttaaaagtacataaagagtcgtataaaaatctttttaaaaaactcgcatattaacttgggacgagagttggacttctaattgctttagaattcttgctaaagcataaaaaatagcaacgtaggatatagccatcattctaataaaagttccaaattagatatcaatactatcaaaataaaaatcccatatattgtttaaaaaaatctaacaataatatgattaaaatagttttcacccgttgcaacacacgggtattttttttctagtttctaaaaaagtaaaataaaaataagggtgactcatttttacaactttgtgaaaatcagatttactaaattatactgaaatagtacttacagaatcggtcgtcatgtaggcgagagtcttgcatccgatcacggtaattttgttatccgtgtccgataaccagaaagatgaaccactcaaattcgccgatgcgtcgctgtatgacataccgcccgtggattggtcgtagcactgcctggacatgtacgccttcacccagaccttgccgtcttccatggagatcttgatcacctcgaagtccccccagaaaggcttctgattgctggtgcctttcgtggcgttgtcgcactcgagccgaaaaccctcgtgaatcgcgcagtgatcgccgatgccgaaggggaacgggatgtcgacgtccccgcacctcgtctggcagcctgggtgtccggcagcagccgcggccaacccgatggcgcctgaaatgcagatgagaaggcaggcggagtggagaagcttggtcatttggttaattctctcttggtggttgtgtgtttctgaattctgagtacgtgtgatgctgctgggggcctggggctgggccgagtgttaaatagatgagaggaatgcactaactgactgtatccctggcccagcaaatttgagaagctagtgacattgacgattagttaactaattagttatcaacgttgatcaatcccggtatatatagaccgcatcatcacaaccgaaaatcactttattattgtctaattggacgacgatgacgacgctggaagcgacttagaaagcaaaagggcaaaacactattttgttggtgcgccaatgatgcagaactgtcagctaattaagctcttctcacttcctcagccggccggtcaaccggtcagctcctcctctaccgctgctcaacatctctctaatcttgattagggtcccagggagacttgccaagtcaatgccggttgttgaggtgagagctactactagcttccaagagatcccgtagcagtcatctagcagtgccctactgtccacgattgtggagactgatgaataagtccaaatcttgcatgacgagagacgtgtcacacacttgcacttaatttctctctgtatcaaggcgagcgatctgtaccatgtatacgagttgttgctcaacccaaaatatcggcagccgatcaataattcgcattgacaagctagccagggccaagataataatttcctcaacccctgccttgttgatcacatcattgaagtacaaactacaaattgtaggcgaaatttacagattgaagtaacgacatatccatcatgacttgtataatttgagaaacgcaaactactacaagaaatataatatttgtctctttttggggaagccacttcataattgttacttctagtttacttaactgccaacaacagaacgagaaactaaaaatgtactactagtagtatcttcaagatcaatgctatcattgagtctgtccactacatcggtcacttcttgtgaactcaacgtctgcagtacagggaattttcagtgacgaactgacgacgtgatcaattgtgtgaatgagcataattttgtttgtagtcacagttcaccggcagccaggaatctgtcccgattcaccgtctaccattcacaaacacaaactgtaaaaccatgccaaccgctgaagtagtgctgaacacctcaatcctatggtcacacacaattactctctgtatcagaggcgagtgctctgtagcataagtagttgcatgccgaacccaagatactggcagccgatcaatatataatgcgcattgacccagcaaaaccaaagtctattaccatggatgatgatggattacttacacgcaggacgggagacacaccacatttattagaaccaccctgcagccaaccagacgagagcgcttagccgatcgagtccgctgcatacgacaacgagtcaacgacgacgacgagtgacgaaacgcggcgcgcgcacgcacacggcggaacaggaacaggcggatcgcgtgactcgcgtcgtcgtcatcgacgaaggggtaatttgtcggtgtgcgccattgacacgcaggatttttcaccatttcagctagcgtgccctataatgcttaggtgtttagttcagcgcaaagtttggattttagttgaaattagagatgatgtgactgaaaagttgtgtgtatgacaggttgatgtgatggaaaagtactgaagtttggatccaaactttggatctaaaccggcatggacttgatcatgagctgtgtgcgaagtttccctggatgtttttatttcttccttttccattttgcaagtttaaatctgtctgcttttctgatatgagaaaaggggaaggctgtcaggcctttctattttaaaaaagaagaagaaattccccgattcaggctaggaattgattctgaggtcccagagggactcgctagtctccaagtccatgccggattgccggttgttgagatgagagctagcttccaggatgtctagtagcaataagcttatcagtgcagtactgtcattgtggagactggtcaatgagtgtcaagtcttgtatgattgagacatgtcaaatagtagtacatgatacccattcaaccgggagaatttagaggttgagaggaaaagagggagagaaaaggatggggaggatgcgagtgcacgcactctccctcatgcgcgcgagtcgcccggtccctcggcggccaattctatctgagcctgttactccatctaaatacacaaagataatcttactaaaagaaagatagatagaagcgtagtttgctttgtagcttttgtaactaatgaatcaattcaacatctcttctttaaattgcacagcggcctcgatgagacgggaccgcggctgtctcgatgagacggcggccgcgggacggcgggctggatgcggcagcctcgttgcggcggcagccgcaccggggtcgatgcgatggcgccgtggtgggagaacaggctcgatacggcggcgccggggaagcttcgatgcaaccacgatgcggcagaatggaagagaagtgggcggcacagacgaactccctattggccgagtgggcggtcattagcacgggcacctcattttcattagacaatcctacccctgttaaaccaacagttagattagattggtacctgatggtacctcgtggtacctccttaaggatgggaaatatgctcatagctagatacatttagagtgcgatctatcttacttttggaatcaagcaaccccgtaatagctcacacttgtttggaaattggttaagaggttttgaatctaaacttaaaagacaaacttgggtgggcatagcaacgatttgttgggctttgtggctcagtaggaatgacttagtctttaatggctacaaccacgtatctttcttgcaggtaattttcaaagcaactcagttgggaaggctttggtctttgcttcttaaggaagacgaaggcattgaagtaatcgcgaaatgcaatcttttagagaagcgtatgatggagcttttctctatctttgggtggaactctagaagaaggattgaagcttagcttttagttccttttgcttgttgtctgtctttaaaaactttttatgctttacccatgtaatgggagagtcttatgtactcatgtttgtgacttttaggctgtcctcacaaggtgtagaggctgggtttaatgtaatccattatctaaaaaaacacacccttagaggtttgagaagtattgcactagcaatatttactctgttttttaggtaatgttggaattctattgattaacttgcatcataacagagtgtttcccggatacagtccggaatcacagaacgatagacagaacaagagaattgctcataacaatgagccaaagtgtgagccgctacattacagcagaggcgtagctagctaggtggcactgtgggtcctggaccacttaaaaatttgatcgagattaaaactatagtatatgtagtactagttaatataataaaaattttatagtggactacccttttaattgacctattatatatatagatggaccacttttactctaaatcctatctacgccactgcattacagagacggttaacatgcataaaagaacaggcttggaaaccaattgcaatcttcttgatatcttggatcagacaccccacccttgatcgatctcgagatggtgcctaaattcgctgtattgctgacatgcaatcagaggctaccaacacctgctggaaaccctcttctgttgccagtactagtgcccgacgaatagccagtgcctcagccatttcagggaggacgatgttgttcactcgttcgctgcatgattcagtacaagtaagcagatacctgtgtgatcacggatctgattcccacttgacgagtagattggaaaactgcagcatcggtattgatcattactgttccttccggcggtggaatccaccttggaatggaggaggggagatttggagcaatgttgcattatcatatcgacataaccaaacaccttctgagccacgcgccgaggatgcagggcgctaatcccatttcttgcattgttccttgcttccctgatatgccaaaaagttactataaggacagtgtgttgaaagcttgaattctgttccaggaagtcaaaaatccaatttctcaagtgcatgatcccccttctcttcaatttgatatcatatatctgtttaatttcctgccaaacagagctagcaaaggggcatgaaagaaagacatgttccaacgtatcatccctattacagaaaacgtagccgtcattagaatcaatgtgacgccttctcagctggaagccagtgggcaaacaatcttggactgcacgccagaggtttatcttcatcttcccaggtgcattgatcttccacagagctttccagcttttctgactctccagtagagaagaaggaagtcctctcccattgttacactgtgaagcaaggaaagtgttagaccgtgccaagttataagccgagcgcactgtgtaggtgccatgtttgtcgtgtggccaggacgtgaagtcctcgtcaccaaaacgattgatagggatttgaagtatctcattggcaattaaccccttcctcaaacagtgccttgacagtatcactatcctaggcatttgcttcatcattcatcaggactgcaccttggtatcttcaggaattgggattagagttttcagatgtcccgcaacaacgccgggatccaattgtcagtgaggatattaattgaactcccattgccaacaccccaccaaaagcccttcttcaccaagtcccaagctgagttagcactgttgattcgggttaaattgtcacattggacaaaaccacctgctatactaccatgagacacatattgcaccggtttcaacagttgagggacagggacccattgtatccggtatttcggtgcaggaacgaaatcaaacttgttttcaagttaaggatctataaatgaacttatttatggaactgaagggaaacaaggcccaacatcttattgggcgtagaagacaactagcacatcaggtttatggcgtgaaatagtgggcccataactactctaccgcgcgtctccagcccacacggagcccggcccaactaattcacctcgacgacctcctcctcctcgcccagccgcctttcctcctcctccccaccccgcatcactcgccgccgctcctaaacccctcgaagagaaccccctcctcccctcgcgccaccgccgcccgcatccgcgccgtcaccgggagggagagcagcagcggcggaagcaggagcagctcgcgcgagagagggaggaagccatgggaggcggcaggaagcgcgggcgcacgcagcgccgccacttcaagcaggggcgggagaacgtctggaagcacaacccgcagcgccccccggcggctggcggcgaaggagccgaaggaggcgctgccgaggggcgcgaagggaacccctcgtggcagcccttcgccaccgagaacccagccttcgaggactactacaaggtgcggttgcttaatattttactttttttgggtgtgatttggttgtgttagtaaaaaaattgagctgagctagcggcatctcggttttgatcgtatggtctcgctctaggtatgtgtacttcgtttagaatgtgatgatttgttgtcttgttgattgcggatattatagctttcaagcaagaagcaactgctctattttgattgtgatgctgagtagcgagtactgatctctagacttaccttacgataagagaagcctaactggacgcactgcattagcttatactgttgttgcttattagcttagtttttcagttggatgcataacttctgaattagaatgtttatacatgtttatggcttataggcacagcaaattattccggagggagagtgggacgacttcatgaacatgctccggaaaccgctgccagccactttcaggattaatgcgaggtaatgttgttttcatctgaagcaacatgactccatccacatgtttggcctaatgatttattgtttgttggtcacattgtattgaatggcagtgcagttagcttgtttatgacactaccttgattattgcaatatagcagcatcacattttaaagaaaatcattccttgagttctgatgattgtgtaatgtagcttttcatgaccaaacagcttgcgatattgctcgaaatcaccaagaaggcaaaaattccttggtggtgttgtatatgttctgggtgaaatatctataagctctcaaaactttgttccaacaaaaatgaatctgggggattatcctagcttataaaaagatatagatatagattttatactgttttctatacaatcaaaacttttaatcttatcttgctaactctctattgctgttatttaaactctaatcatatataggttctagatatctgcctattgtttgaattgataaaaaccatgctctgtttgaataatcttttacttgactccatataactttcactgtccttttgtaaaagaaaaggacattatctctatcctgattctcctgttttttccctgccatggttcattcttcagatataaccatctccagttctatgtgcaattgatcatatagttagaacaaaagcatttgcatgaaatgcactggtgattttactgataccttatcatgtctggtatcattgcacataactaattcttgttttatgatgattattctgttctagtatgctaatgttgtccttacctttccagctgtcaattttatcaagatatttgctcacagttagaaaatgacttcaggaagtcattggaaactgaggtagcttctatattttgtgcataaattttagttatgtccttcacaattctattttgtaatccttttttttttttttgcatggacaggttagtgatgagcatgaagaagatgctattcggcctttgccttggtaccctggcaatcttgcatggcatttgaatttttctcgaatgcagctgaggagaaaccaggcacttgaggggtatgcataatgtttatcttgggagaattgtgtcaacaatgcgcagtatataggatgattgttttttaggagtgtggtaaactgatgtttttgttacaataaaactcccttcacctggtttttgtcatctcatgtatataccatcattactaaatatcaccatagcgttagcacgggcacattactagtttgtgtaaattgatgaatttattgagaacatggttgccccttaaatgatgaattactaaccaatttatggctttatagatcagtgattgccttgaattctctactaaaccatcaccaaaagttcaccaaaacttctcaaatatttgtgtttggctttttgttgcagatttagtgttatatcactgttagcagtttttcataagattttttagggctagtttcttttgaaaaagaaactgaaaaaaattgcacttaacaattgctgccattgaaacattggaggcgctcatttaatattctattgagacataatacttttttgtaatatttgtttccctctccagttttcatgaattcttgaagcgagagaatgaagttggcaatataactaggcaagaggctgtcagcatggtaagttccttatatatattaagatgagctatatgagtatattgtttattgatgatggtctatgtatattgcggatattcttcttgttaaaatgatatgtaatatttttacaggttcctcctttgtttctgaatgtgcaacctgatcatcatattcttgacagtatgtatatccacgttcttttccatcattcctcatattgtgctatttatgcagctggctgtctgtctcttgacctgcatgtttgacctaactttgctcttctgtagtccagcttgtaatgtttaaaactaattgctcaataaagcatctggcgcaatagttcctaataaaagtttataagtctcaggaacatgttaatttattagtaccagtaaaaaggaaaaaaatgagaacaccagaataccccgtagttatcatttagacctagccttttctgtttggctttagctttatatcagacttagcttttgaggcatttgagcttaaaagtaggttacacatggactatttgaaaattttatttttagaggaggacttctccaatattggtcttgtgaatttttgtggtattatcctatgcagtgtgcgctgctccaggatcaaagaccttccagttacttgagatgatccatcagtctacaaagcctggaatgcttccaaatgcccttgtatgtttcacattctattacacatatctatagtttctggtaacgatagaaaaaaaaactttgaatcaaaaccttttttctgattttgtgtttcatactttgtactcaggtggtagctaatgatgttgatgtgcaaagatgcaatcttcttattcatcagacaaagagaatgtgcacagccaacttgattgtgacgaatcatgaagcacagaactttcctggctgtaatcttgcaaagtttagttcagaaacatgcacggatgagtccaaactgcagaggttggaatttgatcgtgtattgtgtgatgtgccttgtagtggtgatggaactgtgcgtaaagctcctga

SEQ ID NO: 49872 - DNA, 22646 bp, Oryza sativa
  unsure (1)..(22646): unsure at all n locations
ttaactttacttccttgcccctctctaatattaagtagtaatgtttgattgatcaaattatttttgttgcctttttctttgtcatacacttatacttgatgagaccctaaaatgttttcagtgtgtcaaatctaccatgggagtaacttttgttgagattagaccatctaggaatgttcatttttcaagtgtagcacttgttttcatgtcctgtgtaccttgttgtgacattgaccatatttttcataactaaatagattctacggagatgtggggattctgttgaacttcttgatgtttctaatgagctacctgaattagtcaggcgtcctggacttagcacctggaaggtcagtgtacatttctctgaatcatgcatatttccttgtatattttgtatcactttgcaattttgcataattagctgcgactgtgatcttctgtggccttagagccaaaaaagaaaaaaaaaagtcaccctaggttcacccaatctgctgtaatgtgctgaactgcgattactacatgttttaattatcaatatcatggacacatggttcatcttccatttatatggtctagattagatctgtctgagtttttcactggataaagtggtgactgagtttgcatttacatgtagcaatacacaactatatcttgaacatctttttatttactgttttgatcaatgttgctactttgtttgttttagtagtttcttagatgtgatatgaagagtagtggatgggtgtccaattttgtaaatattctactgtgcttttcagtttatgaaacttgtgcaaggacaatggaggtagcagccattgttttagtttttttggagttatttcttagtcagagttgtttgcattctgctctgttggttttgttattctgtcacagaagtattctccgttggggggcccctctaaatttgatatcccacactctggagtatttgattcttttgcagttattgccttcctaactgttgcaggtacgggatagagggtcttggtttggcactcacgaagatgtccctcgctacagaaagaacgtgatatcaccaagcatgtttccttcagggaagggcaccatggatagccatgtggctattggcagtgttgagatcaacacagatgtaattgatgctgatatgaaagattcaacaaacatggtagagggagaacaagaaacgaaaacagcatctgatgatgtcaataatggtggtgatcccaatactgaagagacgagcaaacttgagtctaatgaagttccaaacgactctgataaaaagtcaaattctacgtctatccgcacagaacattcaaatttccctctgcatcgctgcatgagaattgttccgcatgatcaaaacagtggggcattttttattgcagtccttcagaaaatctcccctattaatggtaatctttaggaatttattccatgtatttcatgacttgtatcaaattgcataaacttattagccactgcttattaatgttcaagtgtgcataccttaatatctttggttctttgcagggaaccaagaggcagaacttataaaaggcgagcacaatatttcaaaggatagggctgagaaacttgagaaaggtctcggatcagataaggtgccacataaagaaaataccgtgcagcagcaaggagttgatgatggtaatgttatggatgaacagcaaaatggagatgtggataatgaaacatcaaatggtaaaagctcagaggaagctaaagtaattgttaatgaggcagaaaatgatcaagcaggaccaagagataggaggaggaagccacagaaccaaggaaggtggagaggggttgatccagtgatatttttcaaagatgaagctacaataagaagtatagtatctttctatggtatcaaggatacatttccgcttgagggtcaccttgtgactaggaatcctgatgctggccatgttaaaagaatatactacgtgtcaaaatcagtgcaagaagttttggagctcaatgtaaaagttggtgagcggcttaagattacctcacttggcctaaagatatttgtaagtgtctccttaatttatgttttctttatcaattttagcttttatcagtggggcaaatggcacgacactaagctgtgattcttgcaatatctttcaggaaagacagtcatcaaaggatggctcaccatgcacatttaggttgtcttcagagggtttaccactgctgcttccatacatcaccaaacagattctctacgcttctgcaattgacttccagcaccttttacaatacagaactattaaatttcctgattttgtggatgcaaaattcggtgaagaagcttcagctttgttgcctggttgctgtgttgtagtactttgggaaggtaacatcacatcccacttataagctttatagagaaacaccacaacttgatgacagctaaacatgtttgaaatatttcagggcatcagaacatagattccatcgccatggatccttctgcaatcgccattgtttgctggaaagggaagaccaatttgtgcgtcatggtttctcccctggatgggaaggagctgcttgagaggatttgtttacgttatgggctcaaaatccccaaagcggatgatgtaaaacccagcatgaagattgatggatcagacgagcagcctgatctcagcactgaggcagttgatccagaagctgtgcccgaaagcaaagcatctgacatggagattgcagatgctaaagaggtggagtaatcctgctgaatgctgatgctatccaaggccacatattatagctggatacaacatcgccccatcatttgcctaccggtattagttgagcgatgagccgccatttttcattgattctggcatttacgccgttttcctgtttgatttatcatattctgtttctgaagaatgggtgaatgaactcgcccattagtgaaagggcaccacgttgctctaaagcccatctgtccatgtcatctggtaatcgtgcacgtattgccccctccatacttccggctggctcatccacctgtaacctatcagtatcagcttatttttcttcgaagagaatgtattacagggagtcttaacctgaactcttgaacctgataaattttgatatgacaatatttcagacacatcctcttgactaaatgcttgtggctgtacgtcttgtcgctaccacggactgaactgtctgaccatgaatgcattatcattgtgacgtatccatcaagtccatgcagaactcgtgcttgaaagttagaaacctgttacggagacatgaatggatgttagaaaattctatgcagaaacttgaataacgaggaggcaatgagaatggatagaaaacccagaggctgtgaagcttggattcagcatttttaccactgaatcgggtctcgtactgccgccggccaaggcagaagaaagatgcatgtacgtgctgtttacacctctcggcgacgcaaaaaaccggtgcctgtcagttgttttgttccatttgagagttgactaatttattgaaggccacaagcaagaaaaaactgacgcactgaagcgtgggaactttctcaatattttgaccctcgtgggaacgcacagttattgctccccctccagtcaaagacattgtttatattccagtccagtaaaaaaaaagagagaatgtttatacagttctccatccaaggaagttgtttagaacagcgacacggtatccaaaacacaattttgacttcttatttctataaaaatatttattgaaaagtgatatatgtatacttttatgaaagtattttttcaagacaaatctatacatataatttttacatttcaaactcaacaacttaagagttattcatgatttatattcctaaggtttgacttaaatattgttctaaacgactttctttgtgacttatgagtatggagggagtaccttgaaacgtaatttgggttgatttgtataagaaataaatggaattaaattattgcagatgtgccttctgagatacgaatcttctcgtactattttggtgtgcccacttgaaatactgtgtatttgatgacttattgtttactgatgtcacttttaatttgtgactgtttccacaattgccactaattcgccgttagacctgttctcacttttgccatttgtgaaacaatgacagtacgacacatcacacaatgacagccaaaacctccatgggtccacttgaaatactgaacttatttgacattttgtttatttatgccgctattagtactactgtttccacaagtgccagctaggttttcactgtcgttagaccacttctcactttcaccgtttgtgagaacaatgacccatcacactagtgacagatagaaaaacaaaacgactatatatatgcctatatggtgcatgatagccaaacaaaatcattattttcgtgtgttcacttgaaatactgaacatatctgattcttttttacttatgctgctattagtattactgttttcacacgtgccacgctgtggtctaccttgtatctcttctcccttttgccatttgtggatacaaaaatgatacattccacaaaccagtgacacatacaaaaacaaaatcgtatatcccctacgtcgacgatggctgaaactttgactggagaagctaggttaattcaaacaaaagcaatgttgacaggatcatgtcatcacgatcacagctcggtaattgcggtcacaatttttacaacgttagtaattacggcatgcatactcgtcaaggctgccttcctttcccctgacctcagacacagtcgatcccaacaacaacagcaacgcaatctgaccatcaaagaaaatttgtatcctgacagtgactgagtttacctacacactgaatttttgggatcgatgaccaccagtatcctttagtgcagtgaaattctactccctccgtccccaaaaaagacaaactgtgggttcccgtgccaacgtttgactgtccgtcttatatgaaatttttttataattagtattttcattgttgttagatgataaaacatgattaatactttatgcttgacttatctttttaaatttttttataatttttttaaataagacggacggtgaaacgttggacacggaaaccaggtttctcttttttgacggagggagtacgcacttccacgttttcaccgtcgcatccacgttatctaatcaacgtcgtcgtcgacatcgtcgtcatcgtcgcgtgaagcggtgaaacactgggacctgcagaccggttgttcatggaaagagaaggccacgaaaaatcagacgcccgcgcgtgctgcaaaaaaatcgctgcactgacgtccatgaacggtgctggtttttgttcttagtgttgatttcttgcttgtgttagtcttcacgggaaacgtatagactttgccaaatgatgaagctaattagttgtatgacggtgaacaaagtatatattctcccatttgtagttagaaattaatcacgcatctaactaccctctctgcctaggaaacattaggttagatagaatgttgcaaaaagtctttagccagctcgttcacatgcatgcatggagatgcaaatttctgaattctgaaaaaaataacatgcatggagatgcatgcgtactgcgtgtagtgtaggcaccagctaaggaaggtattgtactctggagtgatctgattggactggaagaacagggcaagggagtatatatgatatggagttgacaatgatctattagttaggttttgatcgatgacaaatgagcacattattacacctaattgataatgccatttcatgaagaaatagtgaagtcttctgacaagaccaattaggaaattgtcgatgaatatgggactagtgatcctacaaactggactttgaaaatggaagtggggggttttgtataaataacttatgagtacattgtgtaaatactccagacatccgtcgaaaaatatgatgtatattttgtttcattagaactactttgactaacaatcaactacttactaatatattctttacgtgatacaatagcataaccataaatatctactttcaatatgaatctaaattttgacagcatcattttgtgtctaaaatatattttaatagagtaattgtttattaaaatcttatcgtaacgaaataaaatatttttttatggagagtgaaaaaaatagtgtcaaaacctcattgccaccgcacctcctctctctcaatattcctctctagcacggcttgacagggaggctgtcgtgagaggagaattaaggcagtgccgtttttttttttgggggggggggggagcggtactggacggaacatgggggaggtggagaaggaatggccacaccagaggttctcctgcttcgaatcttggacatgggcctgttgctgggagacgacagtggtgagctttctagtgtttttcatctgttgttcttgactgttggggttgattggtcctggatagtaatcgaatcaatgtaataccgtgtgtgatgtttattgaatcatatattggttcttgatttgtttttcaatgggcattgattatggttatggattgggatgtgtggagttcttgaattgttcttgaatggggattgattagggtatggactgggatgtggatcggatggccgctcgaagcatcgactcttcgagctgacctcccatttctttggctcctagagacacataagtgctacaataatggcatcacatcatacgtgtccaaagagaagtgccggttgagcaactgcaggtacagatcatgagagttcccaactagcagtgtgtggtgtgtttgtattctcaacaagacatttcctctatcatatctctgtctctctcgatctctgtctcaagacctcttactatgcggcgaagaaatattacatgaatataatgtaccaaaagtctaaaggggtattaatcaagtctgacatatgtctacatgatgtaaacccttatgttatcctttccattttcatatatataattaattgaaaagtttatgattggtttattaggaaactaggggatacacagtacgctttagttactattgattatcccctccataaaaaaaatggaattgtacataacattcagattttattcaaaataatacaattatagagtactattttctctgcaattacatctcatttaaatttctcccaaccttactctaaccacctctcacttctcatttagtgagggacatctaagttatttacctttcatactaagtatattatcttttcaatgctacaattgtattccttttggatggttgggagtacttgttagaaaacgataggcaaataaacgacaaagaataatagatcaatcacagaagacacgagatttaacgtggaaaaccctcccaaagcaggagagaaaaaaccacgagcactagccagcaaaatatcttcactatatcagggtgaggttacaacgccgaacggtggcttacaagaggtatgtatgaaggtgaaaccctaaaagataacgagcatttacgggcctccgtttcgctccagcagaagctggcctttattatgtgcaaatgaatttgaatcacaactcaacggtactcaccggttcacataaatttcaagagaaataattcctaaaacaaataaaattgtactcctagctagttgccgaactttgacgtgacgcctatgtactccatgtttccatgttaacggcggctgaagaaatcaattgaagatgatatgatgcttatgcttcacattctttcctactattatactgaagttatggtgagatcaatgtctctatcagcattaatatatgctcgcaaggacaacatagaccgttataattattctttcacgttgattgaaaggttagttcaagccgtatgtcattatgaaatttcgccccaactcaactacgacgccgtgaacgtcgtctactcttacttttcctcgcacagtacttaatcgatattattttgaatatgatatatttgctttctagggacacttattccaaatacttccaagaacctgtatttttctttcaccgtgcctaaatttcgtgtagatttctttggcggacggcctgaagtctgaaatcaatcgcaccgttacaaatttaactggggttgtattccacaacccgctgcaggtttttgcaagttagctagctaggaaaagatgcacgaatagatgacataatttatgcacgttgaatatattgcatgtcgatcgtgtgcgttaattcgctacattaacgtgtgacattctgcgcgtacgtacgatttatagtcttcctagtcagtccatggagtctacaagtcactacttaaaaaaaacaatctacgcctaggattttgtttccacgtgcggcttaaaaaaaaacaatcaattgtgttgaggtgttttgtgattttggctttctttagttcgtgaaaagaaaatttttgggtgtcacgtcgaatgtttgaccggatgtcggaaggagttttcggacacgaatgaaaaaactaattttataattcgtctaaaaaccgtgagatgaatttgttaagcctaattaatccatgtttgatgagatatataggaaaagaaaaacgtacaagaccgttaacacgtcaagagtttagccattaattatatacagtagtactcgtacgagtacctacgtgcatatatatatactatacgtatcgtgttgcattttcattcctttggattacactgcacatttctcacgtgttggtcacaatcgttttcggtgcactgatgagcatcatggatcaatcaccgactgaaaaggagatctggatctgcagatgaatactatatatagcaaaagaaaatgagttcgaggccggtgcggttctaatacacactactgtgtcaatagtatgcggttctactgcacactaatatgttattattgtagcagttgaattaagccatctatttttgtccaaggttgatatcaattaacagtgcttgtgtgtataggataaagcacgcctattgatctattagtggagtcgtagtacatgacttcacactctgagattaaaaatcctagtgctcacatatatatatatgtattaatttgtgcttgcgggtacgctatttataggaatatactaacactactatacaaaatacagaatcaattccaattcaaaaacccacattacaatatagtgatacttacggtctgtttggggaagcttctaactgctgcagcttctcctagaatcagaagctcaccaaacagtttaattttttgtctagattttgagaagttgtaattgaggaatgcagaaaatgaactaaagccagaagctgaaaaacccagcttttccagattttggaaagctggctaccaactagccgcttattagaattttaagctcccccaaacaggccctaactcatatcactgtcggctagctccagaatcgacagtaaaaatgagtattgccagacacgtgagaggagagatggggtcagattgagaaagaagagcagaggtttaggttgatttaggacttagcttgcactgatctgttcgccataggttgtggagaggagacagggctggccatcacccacactcagagcatggattggccagatctagcggaggtcatcatcattacgtcctcaattgccattgactacactatggaagacagaatggcggtagccatggagaaagccttcttgtcgccggatcaggcaccctaggcatcctcgcctttggatctagcggtgcctaggacggggatggtggtggtggtggtggtcattactacaaaactccatatttggaaaaccacatttataacagttagccaaaaaccaacactaatagtggtttcctgcaccctcaagccatatcggtgctggttcattaagaaacctagcactgatgttattagtgcttgtttatttaaaaatattgttaataataaaccacatagatgagccgaactaaccgagggaatatctactactctctcgctcccttggtctctcccaaactattaattatcttacactatccagctttcctgtcaataatctctccctcccactccctctaatccccgctctccttctcactctctcactgcctccctacatcgacagcaacatgactttacagaggtgatgcgacggtggctccatagggattatggcgctggcagattggcaacctagatctagcctatttggggctagcaagggggatggggcagcaacgcgcggcgacgagggcaatggcactgatatgtcagatctcttcttccttgccctcaatgcctctgcctagggcctagtacgagctgaatctagagtgcctcattctcttcatcacaattagcaacactaatgaagtggaggatggaggcattagcactaggcaggaagcctcgtccttgtcattgatctgatccgccaccctcgagtccaacaccaacatccaaggttaacgtccattcaccatcttcctccatccgcgcctttccctctcatcctcctatcctaccccctctctcttcagctgatctcgacatcaatggttgtctgtagagagcagcgggtgggcggacttcttcaccatgcggtgaatagcggtggcgggtggtcctagagccatgtaattccatttctgttcttccaattaaaaagtgaggatgttataaagattggccgtattatatatatgttgattgattatgtgatgggttgattctgggagttttttatttggatatttgattcattgttttttgttggattcaaatcgaaaatatgttttggagggcagtatcgttgtctaaaactttaattataaaaatgggaggaagtatttattagaaacttgagataagttaattacgggcatggaaagctagctagcaatcatttatttgataccaccattaatattattactgtgagctaactactcccactagctagcttagccgtcatgtatcatcattactctgcattaactactcacaagttgcggatagtagggtttgaattttcggttagaaaatttgaatttacgtacatgtccaaaaacttttagtatctttatatttagcgaaaatttgtttacattcagagaaaaaactgttcaaatttgaaataccattgctattccgaatttttgttccccgagattgatcttttacatttcggaatgtaaaaaccctggttggttagctaaaacacagcgtcacagcggtcgatcaatcgatctccctgccacaggaagtactctacgttgctgaagctagctttatattaccacgttaatttaggtccttgtacgaaaatcgaggtagcttattaaccaataattaattaaatgttaacttagaaaatagattaatatatatgtttttttaaagtaactacgtactagcttagaaaatatttgaaaaaaccatttaaaagttcgtgaagtgtgttcatgataaatgagagagtagaagtttgagaaaaaaaaagtaataaagaacccaacctttaatctactctccccgtcctaaaatataaggatttttaaggttggacgcgggtattaagaaagtaggtaaaattaaataggataaaattgtaattggttgagaagtgaagataggtgagaaaattgaatgatggaggattgcgattggttaagaagagaatgttggtgaaaaagttgttatattttgggacagacctttatgtctagaagttgttatatatttggagagagagagagagtagaatatatcccatgtctgctcagagtagttttatattagtggcgtggctaccgcttctaatattagttatatcatctactcatgaattaggaataagaggcatcatgtatatataatatatttatctctaataaataaaccttgataactttttggttggttcgctctagcactatctcactctctttgtatttttcttgaagttttgtatagaggttacgcgttacatgagagttggcttattctctatctcctcacttttttcctccacctaattttatgtggcactaggggcaaacatctctactcttaggagtaaatctttatggtacttgctctgatctagctagatactcactccgtcgtaaagtaaatcaattttgataaggatataatataatctagtatagtgagtctggacaatcttctatccggatttattgtactagattttatcatattaatacgtaaattggtttattttaaaagggaggtagtaagtcgctgcatgcatgctccggtgaatgtcgagctacgtacttatcttttctttattattggatactactactacgtaacgtgagaaagatcagtataaaacaatactagtatagcaacttgacacgtcatatattattcagagtatctcttcaagaattttgtgacctgactagcttgcataggacttgacaattggctactcctatatatcgaccaatcctacgttacagtaattacgtacagtaatatattcctttgacaagtcttcatgcattcttgcttagggcagcgagcgaataaattcgggtcagactaattgggagagcccatgacttggctagctgcgtggaaacaaccccaaattgcatgtgtccccaaaatcccaaattgcatgtgtaatgtatgctctcgtggcatctcacacaagtcacaacgacggaagctggagactatcaatgtggtgcggtcaacgtctgtcgacgtgcatgcatggtgatcatcgcgaccattccctacctctctttccgagcagaaaacgaaacagcagagaagcaaacgatctgatctggatttttgacgttttagtccttttttgaaaatgtatttcatgagtagacaccctatcgaacacttgctccaaatatatgtgctggcgtcgacattaggctttggcaccagacatcgccgaactccgagattgctagttcgcgtgcgcgttaccggcgcttacttccggcccacaaggtccacggtacgtgcacacgtttcttctattctttttctttttttttcgcagtttttttctaccgctttttcttctctttttttttctttttttcgcagtttgctatcgcacggataggagaaaaaatcgtaattagtttactagtgattagttccctatttttactagtgattagtttactagtaatttttaaatcttaacttaaaaattttcaattttggacttgaaagtttttaaatcttaagttgaaagttttcaaatctggacttgaaaggtttcgaatctcgagttgaaagttttccaatcttgagttgaaaatttttaaatctcaagttgaaagttttcaaatctggacttgaaagttttcgaatctagagttgaaagttttcgaatatgagttgaaactttcaactcaagattttttgaaattttcaacttaaatttgaaaactttcaattcaagatttaaaaactttcaattcggatttgaaaactttcaacttagatttaaaaactttcaactcggatttgaaaactctcaattcaaacttgaaaacgttcaacttggatttgaaaactttcagttcgaacttgaaaactttcaaatgaagatttaaaactttcaattcaaatttaaaaaacttcaagtcaatatttgaaaacttaactcaggtttaaaaacttttaactcaaatttaaaaatctaagttgaaagtattcaaatcttaacttgaaatttttaaatctaagttcaaatctggaattgaaagtttgtttcagtcaactaaaaaggaagaaagacacgtgatgaatttttatcaaaaaaaaaaagaaaaaaagttagttagcgctaagcgctattagttagggctaagcgctcttagcgtcagaaaaacgcacgccggcttctcctcctggcgcgtacacgcgcgttaggagtccttgccgaactctcccacttagaattctacgaataactctttcttttgttttccttcaaattttattgactcagcgtcacattttgaaaaactaataaataaatgtatcctaatttatttttactagtttttttatttataaaaaactccatctaaatagaggacgtgggtacgtactagctcctccccattcctagatttattgatttgttatcaaattttgaaaaggaagtaggggaatcgaattatggtatatgatttgtaattttgggtagaggagggagggacctatatatgctcatcccatattaagattttataaataaaaataaagtagcagaaatgagttagggtatattgatctatcattttcatttcaaaattaattgactacaaatcaataggatttgaaggaaacttttctggaggatctatttgtaaattttttctctgaaagggctaaagtgtgaaaaatctagagcctccgaattgaccacctctggcgctgccaatttgctattgcaagttgcagagaagccatccatttttatcgttggaaagctgaccgcccgccgccgccgccgccgccgggtgaccggcctagttgagttctcctccgcgttcgtaatgctggaaatgctttcaaaagttggaaattgttggatatgctatatatgctactattgtttttattattttggatactagtagggtgcccgtgcattgctacggagaattttgttgatcacggaaaaaaaatctagcaatccaaaagaaactataagtcataattgttctatagattaatttgaaagcaaagatatatgttatcattatagaagtatagtgcaatctttttagcgcataaaacaatcttacggtgtttattaaattataaaaaagcaacatagatagaagacaactataaaaatttgatgatgtcatccaaataaagcacaaacaaaaaatctacaacatcaagcattttattcacgtgcagttggagatgctattgttctggatgtttgattattattttggacatttacatgccattgatgtggatgatatagttattgtagcatggtcagaggttggcagatgaactattgtttttcttcatgtcttggacaggcttatacattaattgatgggttgttttggtagtagagacgatatcaatcgtgctatttcagttccacatgtacatcattcagttatattaagcaattttcactgttataatcttttgacaaaagaacttgataaatatttatgtgtacagcgaaacccagcaaatggcagcacgtaagacaaattaagaggggatgctaattgatgggtgattgatagtaacgaaatccagtactcgctccctttcatcatcgttatggaagaaaaataccacaaaatagtcactttttgatatagatgtttatttattgatgtaaaacaatcacatgatcaagatgtcatcatttaataatgtgtttcaagatggagttttctgtattaattatcattccgagctatattaattaggtgttcttagctatattaacatccacatattgctgcggaaatttgtatgaagcaaataaacagtttgagcaaatgactataaatagcatgcggcaattatcaaattcaaatctattagctcaacttcttgaagaagcgttctcatgcatgtgcttctttataggagtaattgtaattagtatatgttgtaaccgtataaaattagagaataagtaaataaatctggctatataacggttcaagagtcccagacagttacaactttataattattatcaattctcaatgtaagaattactaaataaaaaaataaaaactacaactttggactcaagtacaccttgtttttaataagaggcccaaagcaaaatttactctttgtttcatcatggaaaattgaaattatgaccacactaagaaatgaataaatatagccatatatcgatgtgggatcgaatcataatggcttaaatttaagcaagggtctatcaacttcaatttgctaattattaattttcgaattttagtattaaattaataaaatgctaaagcgagagcccccaagaccaatacaacattatatttattaattcagaattttaaagttattaaatcataagaaatacaattaatgactccccaaactgagttatctttgaattattccaaatttaggaactattttatcatgaaaactagcaaatttgaaggcttgtaccttcttcttctttttttgaccgaagaggcttgtacgtacttttgaatgtctcaacattttaataacagtaccctatagtacttaaaaaacgattttgaaaatttcttgatgctattcatttcgtcttgtacatattcttatgcctcaattgattgcttactgtctaaaattacgtggacatcgatcttatcagcttagatgggagaaactacgatagaataacaattcaaatgcacttttgaccgtataatccaattgtcagttaaaatttatcaaaagtcaattgtacgaagcgatcgatcttatctgtaaggcgcaatgcgaagctttggctctattaagcaagagccatggctcgccattcttcttcacacagcgctagcttcacaagcacaccacctacctcctcgctagctagctcgatcgcttccggtcaagctcgagctaggcgttctcgcgttcatggcgtccgggcagcaccaacccaccgtgccgaggtggaagccgagcccgccgcggccgcagggccgcgaggccgacgacgtggaccagccgccgcagttcgacgccgtctctgacatgagcgcctccgtgcgcagcaccgacgggttccccttcggcagcggccgctcctcgttcgcgccgccgccgttcctgccggcgcggcagccgtcgctggagatcagcgcggcggagaacggcggcggcggcggcgtcgcccgcgagccgtcgttgcgccggccggaccagggcgtcgtcctcgcgtgggaggacctgtgggtgtccgccgccggcgggaagagcggccgtgtccccatcctctgcggcctcaacggctacgcgcgccccggcgaggtgctcgccatcatggggccctccggctgcggcaagtccacacttcttgatgcgttggcaggtaacgtgtacacgcacgtcaattaatctcccgatcccgacgaacacgatccctgtcgctgcaaatagcgatcgatcgagttttttttttttttgaacgaatcgacaagctgccaatttcattgaatagagaaggagtgatcgatcgagttgcatgctagctgagacgaactctgacaccgactgaccgagctccatgttttctgggtgcacgtacgtacaggaaggttaggttccagtgtgagccagaagggggacatcctgatcaatggccggaggcaagcgctggcgttcggcacgtcggtaagtcagcgagagatggactcgtcttcttcccgaatgtacagaattaattgctgcatgcacgatgaataattgaataatggatgatctcgtggaacgcatggatcaggcgtacgtgacgcaggacgacgtgctgatgaacacgctgacggtgcgggaggcggtgcggtactcggcgcagctgcagctgccgagcgggatgagcgcggcggcgaagcgggagcgggcggaggagacgctgcgggagatggggctggagggcgcggcggacacgcggatcggcgggtgggcgcacaaggggatcagcggcgggcagcggcggcgggtgagcatctgcatggagatcctcacgcggccggcgctgctgttcctcgacgagcccaccagcggcctcgacagcgccgcgtcgtaccacgtcgtcagccgcatcgcccgcatggcgcgccgcgagggcatgaccgtcgtcgccgccgtgcaccagcccagcaccgaggtgttcggcctcttccatggcctctgcctcctcgcctacggcaagaccgtcttcttcggccccgccgccgacaccgcccaggtattctacacgcttctacgcttccgtatactgtacaaatacgtactcgtatatctatacgtatgtcttgcttaattaatacgtacatttttgccttttttaaaaaaagaataatatttttgctggcggctatcattcaccggccacctgcttaattatacctttttttaagaaaaaaaattggcagccagcctggtcgatctgtgtattcatactgtctatgatattatcatattgtcgatgaatcacttagaccagtactactactactcttctgcgattagtcaatcctttgcgagatgttttcggaaagagaatcatttttgccgagtttgtttagtcacacttgacgggctacatcagctaaccatgagttggaaataaaagatttgggcaaagtcagatgaaagctgatagttgcaaaagattttttattttccgacaataagcaggagctgtgcatctttctatatcaaaggtagaactgaaatccttagttgtcattgaacaatgaatagaaaatatagttctaataagatactgatgaacaattcacatatgcagaaagtacacattatttcagccattactacaaatctaaaaactatttttgaaagaaacaaatctacagattattacatcggaaccttgtgcctgaaaattagtaaggacaaaatgagaactgttctcaaacattgggtagtacgtaggaggaaccaggaactgaactatagctgaaaggagacactagatctaaccactactatatatgaactgcatatatacatgcatattcattttagtataccaactaattgtgacactagcttactcacaaacagaagaacagaacgaatttaatgcactgacagtctgacacagtgactccgatagttcggtgacgtgtgaacttgtctccttgttcttctttggcgagagccgcgtgtcttatttttctgatatctcatcgaatccaatagcgtggcacgagcagcagaacatatccacctaattatggagtaggagtattaagtttcactgcatcggtggcacttaataattcagcttgacttaaagcctgcagattttagctatgccaactgcagcatgcatccatacagcgattactctgcaacggtcgttcagtttgacgaattttcagttctgaaagctgaaagtcccagattactctgcaaggatcattttttttagtagtactagaagtaggtaaacaactttggaaaagagtcctgatacaacaaagtatcaggtgtgattgaaggtgaaactaagaagcaattggatcgtcacacaccacttaactagtttttgaaggcaaaggtctcccatttgacattttaatagcctaccatgctgattacttgaccttgaccacacttgggtcgaagttaggaaaccgtacgaacaaatcatcaagaaaaacacgcgttttcggtgatctacagctgcggtcgcgtaccatgtatgtaggtccatagacaaacgtcagaaatttcagacttgggcacttggccactgttctttgactctctagctagcactacggaaaacatttatagttcagaaatcagaactcagaagaatccttctgaacttttttgactgattattaggtaactgcacaaattcatttaatttttctttgtatttttcgcagttttttgctttgagcgggttcccttgtccatcattgatgaacccttcagaccacttcctgaggactataaacaaggactttgacaaggtgagtagcaaatgacgagatcaagacgatggcaattaaaccatatgaaagctgctgaattattgaataaataaaatgatcccgaataacttagtatcttctaaacgatccatcaatcaggatatcgaggaaggcatggacgggaagaagatgacgactgctcaagcaatcgacacgcttgtcaactcctacaaatcctccgtccacttggagaaagtgacgcatcacatccaagacatacgcgccaccgtacgtcacacaaatcatctctgaattcttctagctttgccaatccatccttgcttctgctttttaattactgcgtgtaaaattcaccaaaatttctttctgtgatttctttttttttttacagggaggggcagtggtgaagaaggaggagagaccgagctttctgacgcagacctgggtgctcacgaagaggtcgttcgtgaacatgtacagggacctgggctattactggctgcgtttcgccatttacatcgcactgtgcctctgcgtcggcaccatttactacaacatcggccacagctacggatccatccaggttcgtcagccatggccatcactcacagtgtcccattttcttttcttcttttcttttttttgttgctttctattagccgcacccatcactgttcattacactgctactgttcattaccctttagtgttactgtgtttgtgaccgtacgtccgaaaacatctctgcaggctcgtggctccatgctcatgttcgtcgctgccttcctcaccttcatggccatcggtggcttcccatctttcgtcgaggacatgaaggtatattcttgaatgtaccatacaatgttacctcttattatttgtatgtcatttaaatagttactatttttttaaaaaaatcaataaaataaattaatatgagatacactaagatcaaatttaacctctacaagttataacaaaatttaacttctaccccagtaacatacttttatatctgaaaatggatatcaatgttcacttaattcattgttttctttatgcagatatttgggagggagaggctgaacgggcactacggcgtggggtcattcgtgatagcgaacacgctgtcggcgacgccgtacctggcgctcatctcggtggcgccgggcgcgatcggctactacctcaccgggctccagagcagcatcgaccacttcgcctacttcgcggtggtgctcttcacgaccatgatggtggtggaggggctgatgatgatcgtggccagcgccgtgccggacttcctcatgggcatcatcaccggcgccggcatccagggcgtcatgatgctcaacggcggcttcttccgcctccccgacgacctgcccaagccggtgtggaagtaccccatgtactacatcgcgttccacaagtacgccaaccaggggttctacaagaacgagttcttggggctcaccttccccaacaaccaggccggcggcgccgccaccatcaccggccacgagatcctgcgagactactggcaggtgcagctggggtacagcaagtgggtcgacctcgccatcctcggtgggatggtggtgctgtacagggtgctcttcttcgtcatcgtcaagctcatcgagaagatgaagcccatggtgcagaggctcaggttcaggagcgacgcgccgtcggtgcacatcgccgagaatggctcggcaggaagcctttgatccaacatcgattggggcagtggtttttacccataggcatctgatatattagtggtgtgatatatgtgaacattgtatatgcaagggtgagatgatgtcagtttttttgtttgagaaaagaaaaggaaaaatgtttttgtactactcgagagtctacccaatatagattatgtatatatatatatatattactgaaaatatcttggtaactttggtagcactaacattctactccctttgtttcatatcttaagacgttctgatattttttttagtcaaactgtttaagtgtaattaagtttatagaaaaacagagcaaacatttttaatatcaacaaacatattaggattaattagactaatttggtgttacaagagtgctacatttctccataaattaggtttaacttatagatttctgatttaggaaaaaatcaaaacgacttatcatatctctgtgtataccacttcagcccattttatcacaattttgcacgtttttcttttcttgaccaaaaatacataggtgaaaattcactcgtggggccaagataacgatgagccagcttggggttgagcccaacttttaacttcataatccaattaaaatctttttttttcatttacatagatgacacacatgcacgctcatcaccacatgagttcgtccccactctcaaagagatggaaataggtggtatatccatgatcccactaaattcctattaaaacgtacttatgtgtgtaatattagtggatatcaccatttctaccatgacagatagagtcatgcacatatgactccaccaccatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49873 - DNA, 2697 bp, Oryza sativa
ggcggcggcgatccatcgatcccctcctcgctcccgcgcgcgggcgcgttgacgtaaccacctcgtcctcatcatcatcctctcccgcctcgccggctctcccatctcctataaattccgatgataataccatctcctgatcagttcaattttgtcataatcggctgcttcttcgcttcaattctgtgttggtagcaggcgacgctcggtgtcttagttcatggctcggagggatcagctggtctctttcctctgcttcttcctgatcgtctctgccgtcgccggcggcttgtgcgtctcggccaccgtgctcccgatgcgggtggggaagcagtacgtcgtcggcggccgtagcgggtggaggacgccgccgccggctagcgtcgacttgtacgccaagtgggccgccggcatccgcttctacgtcgccgactccattggtaaggcccccaagctagctataaaacaattcgaacatcgaagaatttgttcttgattcaattcatccatcgatttcatgctgcaaatcgaagagttcgtgtacaagaacgattccgtggtgaaggtggacaagttcgggtactaccactgcaacgcgacggcggcggcggccaacgacggcagcgtgctcttcctcctcgacgcccccggcttcgcctacttctccagcgccgacgccgatcactgcaagaagggccagcgcctcatgatcaacgtcgactccgccccgtcgccggcgcccgccccggcggcgtcgcccatcgcgaaacctcctgccgccgtgactgcggtcacgccaccgccgccgccaacggcgccgttaggctctgcttccccgagccctgcgccctagaagccgcatctggaagcgcctaaacctccgcttagggggggacatgctgctcacgcattgctcctggcctcgatggccatgatgggcttgattcttgcagagtggtagtaacaacagagtttgcattgagctaggccatcagggtgttagttaattaggatggttaattacttcggtgcagtatggaacgtactggctggagcttaattaccgtcgctgaactgaataatttcgatgtgaattagacgattagttgttgatttgtcgctttagaatcgaagaagaaattaagatctctccattttcatgcaaatttctgatttgtgggaagagcttgttgtttcggttcattatacacaccacgtgtcatcaacatctgcaccgtgtgtagggtgaaaacgggcatctcctaggaaacgaagctcgatcgaccggtaattgattatatatatttattatttaaactacttagtgtcgacattaatatgatgcacaaaaaattagaaaaaacaaaatttataaatagataaaaaacgatatggtcggaaactgtactccatatacgaaaaaggcgttttggtcgatcaggaattttcgtgaccgctttcaccctactgtgcggtatgaaaatgccttacccgcatgcagtctatgctagtggtaccaactgatgactaaactaggtcccgatcttttcataggtattgataattctcgatttggaggaaacttgacacatacgatccgacttccgatcaacacttcaaaccctgcaagcgcagcaccacgtctattctagttatcaaccgtgtcaaaacccggttgacctcaccgagaagactaatgactgcatgtgaatcgaagaatacaagcaagaataaagtatagcaactcaattgcatataaataattaagaactcgaatttagggttccacaaaccaaacaagcggcaaaactgcaatggcagaaataatctaagcaaaacccaattctaaattatgacggctactaaataaatataatttaggacgtcgtagggttgctctaggatgcacgctcccttgggcttagcccacgacacaattgcaaagtccaagacccaaatcaaattcgaactggacgaggtacgtggcttgatttgtagattcctgacaagttggtgggaatcttgaagtgtgaccaaaaaccatctgaaagtagactccataagttttctaataaatactcatgggcccggagattccttctagatcagtggctagttccgtttgaagttgacgttgtcaggagtcccgaatccaaatctaaaacatgtagaaatttatctcttatcttatatggaccaaaagtgacgtgatgaggtagaagtggacttggagaaggtgttgatttggtcccaaattaactttttgatcatccatgcattccttatgattggtctcttttccttcacccatataagtacctctctaaacaaaaatatacgaaactcattgtgtagcaatgtttgttcaaatatataacaagtacatctactatagaccatatgtacccttagttgataaatacataaggtagccatgatcatatttgagctagttgtatcctcgtcaacttggacatgggcttgaatcaaaggtagaaacaactggaatggtgcacatataaaaagaacgcacaaatgtctatgttttctttaataatggaattaaatctggcctttgctttaatgaaaatacaaccaattattatagtattctcttaaaaaaagcaaacactcaagaaaaaaataacttaaataataaagccaacacataaggagtaaataattattgaaatctat

SEQ ID NO: 49874 - DNA, 2313 bp, Oryza sativa
cacaccctacccctacgagcacctctggaagactgagctggcatatctttagattgacgaagttaccacatgtgtctcgctgttgaaaggtacgtcgcctgctactaaaaaaataattaatcgtaaatatgatcactcttgtcaaatcttgaatttgaacctgggtgggctggttccaccacaaggaacttaagtagctgagctacgctcatttcacattaatttttttgttcgatggtaataagcgttgttaactcattaattgtacggcatttgcaggctatattaaatcgcccgattgaaatggtgcaactttgaagatgcatgtatggctattacaatagtgcttgattttgatgcaaaatactactagcatgagtagggtgttcgtgagaaagaaaatagatgaaaaaaatggcaaataataatgatagattaggttggtatcttgaccatgttttttcggagcatatggatagttggtgtcagggtatacgtgagattgaggtaaaagaaagacatgaatttttatacaggttcgtcctcccgcttactgataggtaataaccctattgttattggctgaagtctgtattgcctttatagatcaatatcacacgagtacaatatatgagatgacctagtttgtcgctgtcgacctagcatcatcgctgtcgacagtgtagtgatctttttccttgaatatgaactcaacgagattggagatgtttctagatctctcatgtcagcctctctggctcatacattgggtttgtctatatttgtattggcttgtcttttgacttggcatgtcccctgatttcctcctagggggtcttgtattcatactctgggtgtcccattatacaagtagaactagggaaacaagtatggatacgatccgagtagttcctgtagtgtccgaatagaactttgtttgtccttccttatctagaacatcttccgtatatgaggcatgatttcgtatacgacttggtacatgatgggtcccaccgagtcttaatacaagagtattgggtatgttttatctataacaccgatagtcggctccaagcatccattgcacactaatgccagagataattaaggaattgatagactagctagctaggggatgtctggatacgtttttgttgcacacagcgatgtatgaaccgttctagaacgctttaatttattaagaaatcatgcaaaaactaataaatatttgtattagttggaaattcgccttatagcttcactactacagaaaaagggatcggtgctagttaaaaacttgtcataggtgccagattttctaactgtcatctagtaggcaatacctttgaggaagactcaaaggtgtaggttctaagaatgaaaaaaagaaaagcaaaaatcccggcttggtgcatcgcttcgaatcgagccaatacatcaaacagctctccatcatcactgagatcaacatcatctccatcaaccaaacacaatgatatcaccgtcatcctatcaaccaaacacgatcacaaactcaacaaaatcacaaatacaaatacatagaaaacgacattgtcatcatcgtcgatcccgcctcccccgtaagcacaacagtgatccggtcgcctccgtcgtcgtggcggcgtcggtcggatggagaagaggaggaggaatgaggggaggcgacggttaaggaggaggagtgacggatctagaaagaggaggagggaggaaaaaggaggagcggcggcgagggctaaggaggaggaggaggaatcccttcttacgactataaagttatcacacggagttctggacaagctctcgtcatcattgaattgcatgatgtatgatcgctgaccattcacatgatgtcacactcgagcacatgaccaataatttatcacggacctcctgttctttcagaaactgtactcccgcttcttttgcaggtcatatcactcgcaaacgccagtgaagcaactcccattagttacaagcagtgcgtgcgtgcattatcacaagctcttgggctgatgcacaattaatgtgggaaggtaaggaataaatgaagttgtacaattatatcctacctcttccgttccataatataaaggattttaacttgttacttgtactgtttgactattcgttttattcaaaaaattttagaaatattttttttgatcgacttactttattatccaaagtactttaagcataaatttttttttatatttgcacaaattttttgaataagacgagtgatcaaacagtgcatgaaaaagtcaaaatcttatgggctgcaggaat

SEQ ID NO: 49875 - DNA, 1255 bp, Oryza sativa
atgataagtagaattgcttatccttggtctgtgtgccaagatgaaatatatatgactatcaaaagtagatggagagagtatatcctagcaatttgaatatgaatatgtttcttgtctagattcgtaatcctagaatacgtctctaccacccaaaatcttttatatttttggacaaacggggtataaactagttaagtccaatatattattacttgcttcgatttgataattcttacgtttgaacaaggttaagatcaaatttttataacttttactttcaataagtttaaaaatatttagtttaatgcatagaccatcatatacagatttgtattgtaaagtactaagtaaaagtaaaagtaaaaatgtatttattgattgtatatattataatagaaaaacttagttaaagatatattttgaagatcgtgtcattgtaaaaaatatcaggaattatggaattggaagaagtaagtttttaataattatttaaacaacatataaaaacgatgcgacggtatctgcataaagacgaaattacttctgcgagagcattcccatttgatttgttcagcttattactgccatagccagccacctgtgccatgccaatcaatcgatcactacttgtccttctcttgcagatcgaattaatgaactactccaatcaaagtctaatagcaccatttaatttgacagcaactagctagctagtgacagtctgacagagcagcttcagtttcagttgtcttgttttacccacgtacacgtacacacgttcttggctgggagcaatccatgcatcatgcatgcatgtgtacgtacctacttactccctccttcttaaatataaatatgtgacgctgttaacttttttaaacatgtttgactgttcgtcttattcaaaaacttttatgaaatgtgtaaaacaatatgtatacatcaaagtatatttaacaataaattaaatgataggaaaagaattaataattacttaaattttttttaataagatgaacggtcaaacatgtctaaaaaaaagtcaacggcgtcaaatattttgggatggagggagtacatacggagtacagtagtatacatacgtcgtttagcaaccgttccatcatgaacatgcttgagttgagcttcgtgaaccacatgttttaattaagctttctctggcttgtgtcatgccatgatttggtacgctcttgttggttgggagttggaacaacctagatagataggtcttttt

SEQ ID NO: 49876 - DNA, 1531 bp, Oryza sativa
  unsure (1)..(1531): unsure at all n locations
aaactctaaccttaacttatacttttacatatttataccaaaattttgaataagatgaactagcaaacgttatgtgcaaaaagtcaacatatcatatataaaaaaacgacgaaggttgtattttttttaaagttaactagctacacaagagaacatatctggtgancccttaaaatcaggtcgaaaagttttgtaaattaataaaaaaattaatagagatggatgtaggcatggaatacattcttacttcaaactcaattttatttgagagtaaaaaagaaacaaatttcggctaaatattaccatgacactattcacctaaaatttgtccttttctcttaaatgacgttgactttatactccgctaccaaagatttttgctgatgccaacctatttttttttaagcagacaaagtaaaaaacttgtgaaactgaagtcggaggtccaggttagtaaaccgcttgcaaaaatatatttctacaagcggtcatcttaaaagggctacttgtcaaaataacgctacatatgggatatacttgtatactaaactcgacggggcccaccatatacaaaggtctctacggaatcgagcctgaaacgttgttgacaagaaatccgcgctcagccaatggtgcccgaactgtgttggcgcgaactaagtcaatgaacacaacggcctgggagatctgcttagctccattgcaggtccaaatacgatgagatgcgggcgtaccagtcagtttgattctgcaactgacgagatatatatatagcagatgaaagagccaatcggctgacaagccgatggagtagttccagcctatgctgataccagccgataacgataggatttgagctattggctaaatgtttaatgtagagtctgacacgatgtaaataatgatatgaagacaatccgctgatgataacaatagaataatctagtagaaaccaatcggctaacaatataatagaataaacactaatccgatggttaaagcatacatcggctggagatccgatgtcataaaatctaaatgattagataaacagtgaaacctttgttgccattggctaaatccaacttgcatgttatccttataaaccgatgcaacgtcctgataacttaccggctgaaaccctgatgaaacccttattggcaaccaagaagaagactagagattatggttctaagcacgacttagtagatcaaacttaactgatgcagcactaagtatgaaaagaaacataatatctagacaatcaagcccttgactgattttcagggtagtggatatcttagctaatctagtctggtaaagcgatttagccgatactggcataaaccttaaagcgaatctcagccgatacaagtaaatagagctaccaaactagattaactaagatatatgataaatcggtaggcaaatatattaaccaaaccagagcaatccaggaggtcgaatgtactgatgtagcctttgatgctgccaatgtagccgatacaattgtctgggccggtggaacgta

SEQ ID NO: 49877 - DNA, 1046 bp, Oryza sativa
gagaggccgcgaccggattaattaatcgcgactggacagggagtgtgttagttcattttgggctaaagaatgggtggttaattggttgaaccaactggacggtttactttaaagggcaactgttccctatcacccggctatgatcggccgatggatgcttctatgaaacagggtatgaaaagatggtgtagctaatggaggaattttaacttgttaaaagtggcaccaacgacctacctgctgtctgtgttggggtgtataaaaaggcggcacgcccatgtgagtgttggtggcgagaggtaatacataaacatgcatggtgatataagaatgttgctttgttacatattcttctctcatctctttaataaaccggtctttctagcttgggcgtcgaagaggtgacgggtaaggatcgatcggttaaatgggataattagcttggggacccaagcatgtacttgcgtgcaaccgtgcatggtcatatacaggcgtgcacctacgtagtattcagagtgctcagctcagctcgcgcgaaatcacatagcacgacgattttttttttattttgaagacgacaatactttgcaatatcgtttggatggaaggttggcagcacagctgcacaggcgtatatattggcatacatgcgttggcatattgtgacgtgaaaaaggggcctgcatattttcctgcgccgccacgcagagcattagggaagaaattggtggatcacgggccacgcagtgcatgcatagcagtcgcactcgcgtagcacgtacgggatcgggtaaccgactactcctacacacgtacgcagcgctcctagctagcctacgttcacgtacgtacgcgcgcatcacatcacatgcagtgctagacttgcaggaagccggcgctcgcacgccgtccgctgcgacccgcgcggagagcatggagcgaggcgtgcgtacgtgctcccaactttttcacctcggattcgagcgagccgacccggacccgtgcccgcacgcggagcggtcgttgccgcgctggtgctgctgcta

SEQ ID NO: 49878 - DNA, 3214 bp, Oryza sativa
caccttaggaaaccttatagtacaataaagaaactttacataaccaatcgtatcaaatttggactccttccaaattagactccgcatcccatacgcacacaatacctccatcgtatgccatatggaatctccatcaaccacgtgcatcaactctagcctaagtatcccgcatgatctctgaccaccacagacgtcgtcttatccccaagccgactcccggtccatcaccgcaaatactctcccgaggcatcgagttacctacacatgaaataaacaaagaaaccatattccgagaccaagttatctccaacttgactcattagtagcaaacaacagtattacatatgtatagtatccatctagaagtcataatcatgaaataatcacggatatccaaataaacaacccgaaaccgaaaccgacacagcgtcggccggtcagaccgcgggctgcgccggtctgaccgcgcattacacgccggtctgaccggctaccagagcccggtctgaccggtcacataaaatgacagcacctgtaattcacctgtaaatccaatcatctccaaaaccacttcgtgaataaattccaattaacaaaaccaataatctccaatgcccaattattcatcacagaataataatcaaaaacacctttaattttacagtagataggtaagttttgtcaggcactgatacggacggaagaccatgataaggaaagcagtatctacccagtcaaatacatcagcacacatagacacactgctatggttcagcgtggtccagacagtaatgatgctgaaagggagatttgattcacccatgattccttcgttgaagattgatgaactggtaacaacaaaattgaaatcgagatcttcctgcacagtggcttgactggcttcatcctccagaaccttcagaacgtacagttgacatcgaaggccttctgttgctatgaagctgaaggcaccacattgcgagatgcatcatgtgcattacatcttaagaatgaagctgcatgtcatccatcctgtggtcaatcatatctaaaagcttgtcatttctggcgctatcttgcaacaagctcatcaggtgaagggcttcctctggctgcgagtgacactactacaaaagtgatttttctgtacgaggccccatcatttttccatgtggaccgtaactagtggcgtctgcaaaaatcgagggtcattttcccatacggctgcttaagtgacccgtatggaaaaatcgattttcccatacgggcctcttaagagggccgcatgtaaaaatgagctcatttttgcatgcggctcacttaagcgcctgcatggaaaaatttttccatgcgggccacttaagaagccgtatgcgaaaataaaatttgaaaaatttaaaactagtgtatctcacccatattaactccaaattggatgatttttttcctaaatgtttctaaaatcatgctctatcatgttattgtgttcttactggtattattttggctattttttcttgtgactttgttttatcaattaaaaatttgaatttcaaaacttcaaataatattttgaagtagtaaatgatttcaactgaaaaagtcatcaataacaaggttgtataactcatcaagatctataacttctattttggttattttttcatccgacaaagtgatttgtaagattgttcacaaaatacacatctcttatataaatataaggggcgaccatctttttcatcaaagatccatctgtccagcaatccatttggcatgtactcataaaccagaagcctgtggttcttctcagcgcagaatccgatcattcgaaccaggttgacgtgatgaatgctgccgatagtctgaacctctgtaagaaactcctctttacgccgaccaacactgtccaaacgtttcactgcgatgttttcatcttctatcttcccttcaaatactgtcccagatgcgccttcaccaatcttgctggagaaatccccagtgactactttcaactcctcaaaactaaactttcttggcattccaggcagatgttcaatattttctccatccactcgttctctgcgggttctcatcctgatgagcagagcaatggagaaaagcaaagaaacagttccaattattatacccactagaattctagtcccgaacgtctttttcataggacgaactctttctgcaaaagtgatattgttcaacttgataaatgccctggagttgtagaggcttggtgctgtagtctggagtttgtgcaacgagaatagctgtgactgaaggaaacatgtgccgtttgtgtcgttcatcctgagcttgaaataagcagccttgcaagaacaattcgctacgcagcctgaaagacaatctgatcgcgtcaccttgtcacgcatgattgctccagagccgttgtaattgaagtacgtcacatttggaagctccaccatttcaatacctcgtacatcccggcaagaaatcggcgtcgccagcttacatccgagacctggccgatctctgtagattggagaggaatgaatctctgatgggcaactgcaattcccggcaccagagcagatgccatagctgccacaagccatcgggtactcgcagtcgccgccggcgatgtacttctgtagcacctcgtacatgatcacccacgacgatgaattccacccgtagagcctcatgtgtccatcagactcaacacggatatactgaactgaatgcgccacgggcagcgagatcaggatttccgacgaggaagaaggcgaccgtccaaacgcagagatgctgaccggagcgtccatggtgtttgcaagcgtgtccatggtgtcactgaccggagctgtgaagtagagctgggaaggatcgtgtccaacgaagccggacatggcgttgttcccgacggagacgtagagcgagccctcggagaagtcggccgccgaggcgttcgccgtcagcctcatccccgggcggaggtactgccctgggagaagcacatccgccgggtggtcgaacgattgccagacgggggagccactgtcgtcgaagagcactaggttgccggagtcggagaggcgcacgccggtgacggcatggccggccgaggtgttggtcgaccagacgaacgcgccgaccgcgtcgcggaggaccaggtcgccggcgtcgctgagctggagcgtggcgttgtcgcggaccg

SEQ ID NO: 49879 - DNA, 1790 bp, Oryza sativa
cgctggaggcgccatgcgaatgcgacaagaggagcactacgcggacgatggagccatcgccgtagcggatttggtcgtcggccgagttcgtccaggacgacgaggtgttcgctgccggcaacgtgggatcgagacactgtgctagtagtgagccgccgacgaggaggatgatggctccagggacggcagacaacagcatcatcgcgtgggggtgctgcaattttttttctttttagtgagcaaggctaacaagatcgaagagtccgtttttgaaagttgtgacttagggtgcggttagttcgcgaaaagaaaatttttaagtgtcacatcagatatttttttagagagtcacataggatgtttgaccggatgccggaagagattttcggacacgaataaaaaaaactaatttcataactcacctggaaaccgcgagatgaatcttttgacctaattaaaccatcattagcacatgtgaattactgtagcacttatggctaattatggactaattaggctcaaaagattcgtctcgcgctttccatgcaaactgtataattagtttttgtttttatctatatttaatgctctatgcatgtgtccaaaaatttgatgtgatgtttttggaaaaataaattaggaactaaacaggccttagcaataacacataatatttcgctggggcggcgaaccatagattcagaagtctgaactttttaccaggtaataacccagggtcactcactcctaccatttataatactgtcactgaccagttgacacttcgatgtttcgttgacgtttaccaatccaactgcttcagcgaactacgaacgcactgtttgtgtcccgctcatggttttcttcggttccgtatggcgaagatgaagccaagtttacatgatttggtataattttacgaatatatatacaaagtcgattacaaattaaaacttaaagttataataacgagacactaccaattatagtcgcatagtgacaatagtataggtgtggccacgactagcaacgacatagccagccgagagttgtgatatctggatacaatgtaatatgctaaattagggaggagcgcatgtaatcaatttctccgaaattagctgaaaggtgtattgtgttgggagagttagctctaaaaaggtgtttttatagaactcaactatacgggaactcagttcctcctggtcagaaattattactccatcatgctatatggagtgaatttggcattttcctcttctccatcagttgaagcttgattgcttcaacatacggatcgacaaaccaaaagttcatactagaggtaattaataggtttcatgcatttaaactgatctactaataaccctagcttgattaattggactgtgcggggatgcgattccttattcgacttggtgttgtgcatgatctggtgcatgcagcgggagacggatgcggcgatcttggcgcatggagccgggcggggacgaacgtcaattacagagaggccgcgccggtgtaaaaacgctggcttcctagcttcgctaccataacagattgtgcgacgaacagactcgtcaaaatctgaaacgggatgggaaaagtggcgacagacgaagtactagggaatcactatcaattttgttagtaggtaaagatatgtagagaaattttaccgtccttgaaaatatatctcaaagtaccacgattttatattaaaaattttagcacctcaagataccaagtttttacgctagaaaatatggtatcttcccgtactttgccaa

SEQ ID NO: 49880 - DNA, 1062 bp, Oryza sativa
ttaattattacatgcatgaaacatgaaataaaaaaaaatacatcgctccgttttataatagataatgacattaacttttagatacacgtttaaccattcgtcttattaatattttacaaataaataaaatgtaaataatgcttaaataaagtactttaataataaaacaacactcatcacaaaataaataatacatatttcaataagacaaatgatcaaacatgtatccaaaatcaacgatgtcatttgctagtattgttttagtatggtgtgaggtttgtgagaccctgctcatagtacagtcatatatataggaaaaggtacgaattgttgccctgaactattacggccattcgaattgccctcctaaactcctaaatccgaacgaatcacccctccccctcacccctcccccgcgctaactcaatccagagcggtttttagcctacgtggcatacacatggcagcctagtcagcaaaaaaaaatcagtgaggcagggcttcggtgatgtgggccatacagcggggtgagaggaagcgacacggcggggcacctgccgaggccagtggtatggaggcagaggcgagggtggcgtgaccggcggtgagggcgacacagacaaaggcgaaggtgcggctgaagaggcggccatggccggtatcgatctaggactaggagccgacggggatgtagaggttggggaaggtggcggcgatccgtgggcaatgcagaggaggcgtcgtcgatctgcggggaacgcaaacaaggcggctaggacgagctgtgcgacggggcccggcgtgccggcggcgtcaaatcccggcatgccggagccatgacccagcatatcctcgtccggccgacgagagggggggtcagagcgggattggatcaaattgcatggaggaacaagagattttggtgtcgccgctattgtgtataccgccgctcgccatcttttcgtgcaagtctggcgtcggctatcgctcccccaatcacaggaggacaaggccctgctgatgagcttgacgggccagccactgccggcgcacgccttatct

SEQ ID NO: 49881 - DNA, 3257 bp, Oryza sativa
ctatgcaagtacgaagctttgcccgatcctcgtcgtcgcatcgtctcacaagacgacgccttcgatggatagctctcacatcgtttccactgcaaatggccaatccaaaagcgagaatagtacagaatgacctaatctatatatatgtctatactattataaaaattgaagatgttttgtcgatattttgatacgtcatctgtgtatgagtcggtttttaagtttgtttgcttttgaaaatacatatttgtatttgagtcggtttttaagatcgttcacttttagtaatacagaaggaatcatataagaaatttgtttaaaaaaactcgcatgctaacttgagacgatcggactcctagctgcagctcatgattttctatatatatatatatatatatatatatatatatatatatatatatatatatatatatatatatatatataagcgaactcccacagtgaatttcatcttaactaaaccatataacaataataaaattaaaataaccttcacacgttgtaacgcacgggcattttttctatctctactattataaaaattgaagatgtttttgccgatactttggtatgtcaatcgtgtatgagtcggtttttaaatttgttcacttttgaaaatacaaatccatatttgagtcggttttaagttcgtctgcttttgaaaatacagaaggaatcgtataagaaatctcttttaaaaactcgcatattaacttgagacaattagacttctaattgtaactcatgattttctaacaaagtatatatccaagagaatttaacacaataaatttcacgttaactaaaccacataacagtaataagattaaaatagccttcacccattgtaacgcacgggcattttttctatattataaaaattcaagatgtttttgcctggaaattttgtacgtcatcctaataacacatgcttttattttcctactccgttccatatagtataccaacgcaacacgcgtccgactatccgtatttgagtcggttgttaatatcgttcacttttactaatacagaaggaattatataagaaatcatgatcagactcataactgcaactcatgattttttaaaaatatatatatccaagcgaactctcatagtgaatttcatcttaactaaaccatataacaataataagattaaaatagactttacccgttgtaacgcacgtgtattttttatagtactaaataaatagaaggagtaaaacttcgaacagagtccggctagccccatgtcgtgtcgtccacttgccatgcatgcatgatgatttcacccatggatttgatcgatcgatcgaccatcgccttgagttcgttgtgcatgcgtgccgcatgccccttgtctgtctcgatctccgtccttttttctaaaataaacattccatgtacacctctacagtacatatatatcctacttatataaacacttctaaaaactagacaacagattaatcttagtattgacgaaattatgaccagtgacgattttatatcgacgagcgtatcgtctactattaaaaaatagttagctataaatacgagtatccatgtaaaattttaaaaaaactcgaatgaataagttctactatcagtagcctaattagttcagctacgttcaggtaactttttttccctgtgatttggacttgactgcacgcttgcttgcatgcacacggagggaccaaacggtgaggcatgggagatgcgtagatgcgttccatggatctcgcgacagtgatgaccatcctggattgtccccggccatgcatggacactatatatgtctctctgttttttttgaaaaaataatttcgagggagaatactttgtctctttttcgtttgcttaattaattttctagctactagatatatagctagagtattaaactacatgcatctagctagcatattagagggagaggccttaaattggcctattgttgtagaagaagctagtagatgaatccgtactatgatcatgtatatataggtagattggttggtacaacagtggaatgaatgtgtagggatgtttcatacgtggactggttgacgtcctatatttgttcacatgtcaattaatgtgcatatgtcatactatgccttgttttttgtggagagattttgtactcccaaccctctttgaggaaacttggctcttcatagaatgctaaaacttttgcagaatcagctggctgaaggtaaaatgtcatatcatgatatcaatatataatagaaaaaaaagggaactatttgcacatatttatatctacacggttttgaaatgtatctgtgcattaggatgtgaaaggttggttgatgagtccttagcttgtttttggggctgtctagttttcactcccctaaaaaaaccaataaattctattcacttttgaatgccccaacatgggcgtatctacaagccggacaacccaaaaatttcctagcctaagacccttgtagaaaaatatagtaaaaactaataaaaaactcctgccatgtgaagagtgaagtcgatgcgtggttgtcttggtcccatatcgtgtttttttagttttctcgccacattggcagcaatcatcatgccagacggcaactacgagtctgaggcagagacaacaaactggtatggcaaggatgcaacgcactgtcatagcagcagttaccacgccaaacaaaaattaggaatccgagacagagacagtaaaatagcacggcaagggtgtatcttgctgtcatagcagcagtcatcataccagacgacaactaggagtccaagatggaggcagcaaactaacacggcaaggatgaaaggtcatcaagtagtcaagccgacatgttagcaagcaggaaagggcaaacgtcgtgtcacgatgttcgcgcctttgtggcagctagctaacaacaaggtggtaagggcggcgcacggtggtaagttggaccacccaaacctcaaatcctagatacgccactatgccccaggtcatgccaagattcatacaacaatggtccatgggtagtcctccagccatatctttttcatccttacgtcgcttcacagcgctgcccctgttcacgccatgcgctgcatctacgggcttaggctaccccctctacctcgccaactctgcctctagcaccggtgagccctaccatccccctcctttgagtagccccacaccccgccttcttccccatctagcaatttcac

SEQ ID NO: 49882 - DNA, 3007 bp, Oryza sativa
aatcacaaataaaataaataataattctaattttttttaaataaaatgaatggctaaacagaacaagcaaaaagtcaaaataacttatatattatgggacggatggagtataacgacaaaggagacacactttgccgcagctaccagttggctggctgatgagaagaggtcggtttggctttggtaaagtaaacaatcgcagtagattagacactcctgcctgaccaatcgtcgtgtgacagagcaccataccgtactccttactactgatgccggtcgaaagaatagcttttcactggcccagctggtcgatacatcgatcagaggccacatgttctcgtcgattggtgattaaaaaggtgataaatgtgcagcaattagcgatgacgacgagaagatgaagtgatcatccaactaaactcgatcctttcgttctcccgtgtgcagtgcatatgcacgcacgcttgcgcgggggtggccggcgcacggcaaaagctggtcagatcactgtcgccgcgccggccagcagcgtgtgtacagcgttaggagaggacgatggcgacggaacagcgtgtcacacggcgcggtgtctctttggcccagccgctgtgtaagttaaatttgttagaacataagtataaagaatgtgtgtttagattaggggggtaaagttttggtatgtcacatcagatattatatagggtgttgcatgaggtgttcgggcaataataaaaaaaactaattacagaatccgtcagtaaaccgcgagacaaatttattatgtctaattaatccgttattagtacattgtcaaatcatgaagcaattatactaaaagatttgtctcgcaaattagtcgtaatatgtgcaattgattattttttttagcctatatttaacactttatataggtgttcaaacatttaatgtgacagagtgtaaaattctgagatgcgatctaaacacccccccccccccctcttaagctggtatgtcacgtaaattgttaagggagtagctatatttatagtgccatatttttgatcaaaaatagtcgccatgtatttacattgtaagtccctaaattacatatgtaattttagtgtatttatcatgtaagtttcaaaattacatatgtaagttcaatgtaattataatgtaagtacaatgtaattatgcaacgtctatattttgcattgtagattacatatatttatatactatacagatacatatgagtaaaaccatcaaaatcttaaactaatgaagcatgttaagttttaattaatcgtgtaatgacagccgagagatgctaaggacctgagtggactgaacaacatctgacggtcagaaattcgactgtaatcagccataaaatatggcgacatcattttagcaaatccgattgttaattggctgtggtagaggatagagaaggcgagggaagagaagagtagactattctattaacatagacataatatatattattctttaaggataattgatataaacacggcatttacttcaataaaggtacatccacttattacatagttgttgttttgaaattaatatgatataattaaacaaaggtagatgtaaaaacgacacaccagcatgacaacaccaaacaaagaaaattagcaacttatttaaagtttaagtatgttactaaacctctatccaaagttaatggaaatctacacagcaatatacattatcggtatggtaaaatcaagtaaagtgagaggaagtcgaggaatacaaattttgacataaagcaatggccagagcccctccaagggctaaagtgctcaactattatacagcatatttgcataatagccttttgtaaattgatgcggatgaattagcctattaagttttagaggagggcaagagataataaagataagatacgcaaaaaaatatgagcaattagcgtatgattaattaaatattaactattttaaactcgaaaagtagattaatatgatattttaaagcaacttttctatagatttgctaaaataaacgtttagcggttcgagaagtatgcacttagaaaaggactttctcctccttatgcatggatgcgacagtcccgatgctcagcttggcgaagtgcctatgtgcatcacacagctactcacatctttgtgtgaggaacgcgaagagctgcgttgctcaggagccatggtctgggaaatcatcacaccgagcggtcatttgcggcgatgttcagaaatcaactgggagatggatgggaattagggtttgattcatttattaacaactagagtatttgggccggcctgctaatgatggcctttgttcatgtgttttgatggaccatttggggcccccacgtttgacccacggattaattccatgtcccactcccatcctaacaaaattgcagggttccgccccagttcaccgacgagtagaaatttcgacccgccctagcccccgtagcggtgggtccccgctagatccccgcaccatgcggggaaattaccaccctagcggcagtggtggtggtggtggtggtggcggcggcaagaggtggaaggggaaaggggtgaccggcatacagttgcggtggccattggggacatctttggaggattcatcagcggcattgctttgccatctcaagaagattgggtggtgcccccgaccacctccccgtcgttgctctccacgtccttcttcttcggcttctgatgctccaatctgcatcatctcgtcattgctgtcgacgcgacacattttccccttcatgtgccgccaccgttagagcgacaaagctgctcccggtcctgccaccaccgcagaagctttaccacacgcgacaccttcaacaccgccgaggacgctgccatggcgtacgaccgtgagaccttcaagctccatagcaagaacgtgcggctcaacttttcagaccggttccttaggaagggttgtgtagtgcgcctcaccactggagacatctgacgag

SEQ ID NO: 49883 - DNA, 2770 bp, Oryza sativa
ccttaggaagggttgtgtagtgcgcctcaccactggagacatctgacgaggcaatcgcgcaacaacagtgagaacagcggggcacgacaggagtgtccatggaaaaacaaccacagcctccagctccattctctcattaagaacgctgacacaaccacaccatactcgaacaaaatgcttcacatgccggtgtggcatctagcagcgtgtggattgactctgacgtgtgggccctggatagatggggagatgtggaagtccacttacatttgtgccccacgttttaaattttaatttttttttcttttttactaactaagatgctacatcagcaaaaaccaatcgatactgccatgagacttgacttggatgattttgttaaggtgggggtataaatttctggtattacagtttagggatatcgattaagctcgacgtaaagattaggaataggaatggaaaatgtacttattccttcctcatactcttccagcaggttctctcccggcccatgatgtcgatcgttcacaggccagcaagcaagtcgagcggtgccggcacttgcactggacggcggcccagcccatgaacggacggctgcatgagcctgataatcacggtaaccgaacgattgccggcaacaaactacgggcaatacgacttgagaactgcaaatataggtgaagagaagagatgtgttacaaagctctgtactggtattagaaccaatataagacagtttaattttttctaatccaactgtaggagtagtacaattttataaattaatggttaagatcacttttgacgcataaaggttaaggctcccatcggatagcctaatcagctaaagaaaaagccaaaatttaaattttgaagcttaattttgagattgattttgagatattttcaacgtagtttctttttcaacattggcttttaagtcaccaagaacacatttataaaagttttacctacaaattcatttttattttctaataagctgttttggcttattaggaaataagccaaacgatggagatctaacaagtagcaccgctgttttctctgctcatttcagtttcggatgatcaccgctggcgtcatcacgtcacagcttcacaggtgaagctagaatattaatgtcttgtacatatatgtctcgcgtacgggttaattccacagattcatcctattccgtattgagagttttcgacaactcatccaccaccacacacatgtacagtaccgtgacggggacgtacgtacaacctggctacacaagcaaacgcacacataatatgtatcgcgattgatcaccaccccggatgcccggatcgaagcccggccggacagtagagttttccacttttcatccaggaattctgcccaactacgtactatgccatacaagcacaagaagggtcgcatgagtagtagtagtaggcatcatctacatcgtcagtagtggtaggccaaagtggaagtgaatgaaggatttgttggtcaccatccaactactccgttcttgatcatcactctcctttctctttgtcaccatcctagaaatatatactcctgcttcctctttgtcaccatattgcttcattgcatgtctgtcttatctttagactatgggcatgtttcagattatagccaaaataaaccttaccattaccaaaactttgacaagatgctatattgccaaaattttgacaagatttcttatgtattgaccaaatttgacaacaaactaaacgtagacaattttttgataactttacaaaaaaatagtatagttgaaaataacatcaaattgaaccgtccctatatatggttcgtattttaaaaattaagtaataggtgagaagctaacttttgacttttactttattttctaaatcctatgactatcgtaacgatgagaatcttaattatctcgagagttagtgattctaaaatagttaactggctctattagggcctagtgtatagattactccgtattttaaatttcgaatttagttttaggaataactagtattaagggttttcaccactatttttatttccaaggatatatgtggtaattccggatttcttttaatcagtacttagcagacggtacctttgaggtgactaaaggtgttggtttaaagaccagcagctttgacgtttcagaaaggataaaaaagccagctcaatgcattggcttgaattgagccgaagcatcaagcaactcctcatcccacatatcaccatattaccattcatccatcctacatccatccacaacacaaatcaaagcatttgaatcacaaattttggcacaaataaagaattctatcactccaattataataacaagatgaacgaagaaaaaacaaagtttgtcccacctcaccttgtggggaggggccacgccagatccggccgcccctgagagctggttgcaagggcgtggggcggagaggaggaggggcggcgcttgatccaaccgttcctgagcgcctatggggaggggcggaggtagacctagctgcccccgagcgccggtgggaaggggcggcgttggatccagccgccctcgagcgcgggtggccaatgtgaagaggtgagaggagtaggggtggcccacatctcattgctgccaccgccgtgaccccccggcgtgaaggaagaacaggaaggcatggactaggggaggaggaggaaaagcaggtgggacggtggtttcagagagagtggcgagatgaaggggctgcaggaa

SEQ ID NO: 49884 - DNA, 1128 bp, Oryza sativa
agaagcaggccaagttcgcctacaccacgcagcaggtcaagtcctgcatcctcctcggcctcacctccaaggccgccgccatcgagcaggccgccttgttcaagaaggccaacctcgcctgccactacacctagctacccatacctcgccgccggccggccatctctccggccatctctctctcttagctagttggtagctagtgtcgtcatggtgttgatgatgaataagtccttgcatggatgcgtcgtggcaaaccatgcgtatattattcaagaattgtgtgagtgttcagatctgacctcagctgtggcttgtgtgcgtttgcagttaaattgatgaggtgcacggcgccacgacgacgtctcgtcgtcggtgcttagttgcatgctttgtttgcttttcttagtttcttggcgatgtacttattaagagaataagatgagtttgatttggttagtgatgaactggtctctgcttttacctaagctaacttgcacttgtttcttccctggttgcttggtttctttatgacgagatggatgcaattaattctgtgtacatcttatttcaatttgatattttactcttctgtgaatttacagttggtttttgcattcaacggaaaaaaaacaacagagtttcaaagatcttgtagacatacaagtttatatgttgaattgatttacttaattgatggcagaaaagggttgctgtagattatctttaagaaaaaggtacagtaattattactactgtaatttacagtagtcaacacggcgagctgtgttgtcttgcggccgtatatgagctaggcacattattaccttactgctaatactccctccgccactaaatatttgacaccgttaacttttttaaacatgtttgattgtttattttattaaaaaaatttaaataattattaattattttcctatcatttaattcattgttaaatatacttttatgtatatatatagttttatatatttcataaaagtgtttcaataagatgaaccatcaaacatattaaaaaaagtcaacaacgttaaatattcgagggagtacattattagtcgtcgcctaagaacatgagagcagagactataagcacgtcaaattaat

SEQ ID NO: 49885 - DNA, 4462 bp, Oryza sativa
ctgatgtctttttaaaaaattaaattatactcgatgatcaatctagcgtctaaaattaatccacaaaggctcgataatttcaatgtgaagatatcgcgtatcacaggaagatgccaagtgatcaggacactgatggatatggagtacttcctgtgtaaaaaaaaacgaatttaggactgtatgtgatatatttttttattgtaataggatatatcaaatctactactatattgatttttattgttattgggacagaaggtgtatatatcctaggctggcctagaaaatataagtgtcgtacaaggtgtaattgttgagatctgaaagcatataggagtatatagcatgtagcttaagcccaactgttcggtctgaacacacattatattagatctctagctagatatcatggaaagtctaaaggcgtagcaattatgctccatcaagtcaaaacaagtgtcaatcgactgcatataaattattgtgattataactgctagctacactgcaacagtgatagtacttgatacacatatagccagtacaagcttgctagttggtagtggctatttactctgatttagttttattatgacatcgtcaaactaagcagggccaaacatatattatggcaacattcaaacagtgcaaggtactgttttatctattttttctattaactttttttgacaaccacagctacagaaatacaaatagatgctgactgggaacctagtgctggtttttctaaccgacacataggcgtcaattatgggagaaataaaaagtgccggttttggaactggcatctttaaggttatgttaacgccaaaatttagtaagattgtttagtggattcggttaaggaatcgtgaagacgtggcatgacggcgtaattctatatattaattaggcatgatttagtagtttccttttatctttagaaaagtgtgtttagtgtccgataagaactttatatttttccctttaatctttaggaaaatttatttcttgtttaagaatgactcgtatctacccatgggtataagtttgtgcacccggggtcattgtaaactatctccgatcaataaaaatactctcggcgtatcgccaccatctttttcgaggtttttacttatcatccggtgaaacttggcacctgacacggggctgcatcagctttcgatcttcggtgaaggggtaagtcctactgtttgccggcccagacagttgtatcggctacattggtgttgttcaaggcttcatcgcttcgatctcttgcatcgctctggtttggttagtatatttgcctatctatttatcatatatcttagttaatctagtttgatagctcgattaactgtataggctgggatgtgctttagggtttttgccggtatcggctaaattgctttgccagattaggttagctaagactttatacttcttagcatactttgcaatgcatcattactagtcgtgcttagaatcaaaaggctaacatatctttgattataataagggtttcatcagggtttcagctgatgagttatctggatgttgcatcggcttacaaggattgcatacaagttggttttagctgatcaaaacaaaggtttcattgtttatctgacatcgaaccttcagtcgatgtatgctttaatcatcggatcatttattctatcatattattataagctggttggtttctgttgaattatgttatattacattatcatcagctgattgtctttatattattatttactcaagtgtcaaaatatacattggatatatagccgattgctcaaaaccctaccgacatcggctggaactactccatcggcttgtcaacggatcggctatttgatctgttgtttacatatcttctcagttgcaggattaaatagattggcacgcctgcatctcatcaaattttggacttgcaatggagctaagaaaatctcccaggccgttgtgttcgttgacttagtttgcgccaacgcgccaacacagttccaacaccatcgtctgagcatggaatttttgtcaacaggttccaagaataaaaaaagtggtccgatgcttcaagcaactcttaatcacccatgagatcccatccaagtacacaaacatccatgaacaaaatcaacgagaagtcgccgccactgccagatccgctcgccggagaagtgccatcgcctgatccgcatacgggagcctctgccactgacggatctgcccgccgttgccattgccattgttgtagccacccgcaccgtcagagaggggaggaggggctgcagctctgaagaggggagaggagggaggtactggagccggagggatggcgtcggagaggaggcaggaggggcgggcgagagagagggatgcgatggaggtgggcgagagagcgggaggtgaaggggtgggcgagtggataaggatgaccatgggctctctccctttgcactacaaaggagagacaaaaaaaatcctggctaggatttgatttttacttaattggtacttaggtgtcaattcttttttaaaaaaccggtaccaatattattggtgccggtttttctctataactgacacatatagttgcttaaaggtgtcggttttaaatgaatcgatacctatgagccattccctatttgggattatgtagtagtgaacctacatttttttaaacccggccttatttttataacccgattacactgttgtattcgctgcaattaaatatttataaaaatatctcacatgattatattctgattaaagaaatatatgttgtaaattacttttatcatatatatttagattctatttaattacttcttaaaaggtaattaaattcaataaagcctagctataactaatttacactatgataaaagtaacttggcacaataaaaataagttatcacaacattaaaaataaatctgttgatacaagaatcgagaatgctcgggtggcggccaattatttttttgtggggccaaaatgatactgtcctgggtggtctgtgcccttaagaaaattatggattgtagttgttggggtaaaaacatgcgtatatataaaaaataaatcaaatcaacacaattataactaactaaaaactagaactatattcacaactttatgaatgtataaaaagtaatttaatcaaatctaaatataatatacatatatatgataaagtaatttacatgataaaattaattcgcaaaacacatatttatttcattagaatataattatataagatctttaaggatttagttgcaacaaacattatggtataatcaaaatgtggtgtgtatatatatatatatataggataaataaattttatttgaagactaagtatagtgttaagaatatttttttttattaatgccttcatactcccacgtggaaaagggatgcgtattattttcgttatttattgaaatagtagctgtttaaaactaattattggatatgctctgtgtagttatgtccttgactccttgtacgttctacatatgtccaaccaaaccatgcaaagaaaacttaagtgttgtcaatttggtacgctcgatcaagacaaaattagctatcgaacaccgtagttttataagacattctgatgacttaattaacatatgacacactttgtggcaatttgctaaaacaccaccgctgaaaaacccttcttcactcccgattcgtaaccccctttaatctatgtacgtatccgggaccccaaatctgagactccatctctagtcctttttttcttttttaattgtttgttgctgtttgcatattgatttctaaccaaactccacgataaaatcatcagcattcacataaacattacaaaatcatccacagtcacaaaaatcatccacatccacagtcacaattcacatcacaaatttccagatccaaagacatcacaaatcaacaaattcacataaaactaatctaacacttaaatcacaaatcaaccgccaccctcaaccaccgcgttgtcaccgtcgccgtgtggggccaccgctgcccgctcccgcgcggggccgccgccgcttgctctctgcaaaacagccgctcactctctgcaaaatagaggttaatagagaaaaagaaaaggataagagggaggaaaaagagagtggagagaggaggaaagggaggaggaagtgtttgcgcgcgaggaggagaaaatacgagcaagggattatataatatgcgttgaattttagttccagttggtaataacaactgggactaaagatagtaaggggccggacgatttctaaaccgagactaaaaatgatctttagtccataaaagtgcgtgcggctctttaaccggaaaaaaatgatttttaatcccgaatcctattgaaattgggactaatgtggttttaggctgacccagcaaagatctgttctccagtaa

SEQ ID NO: 49886 - DNA, 4612 bp, Oryza sativa
ccgccgtcccgctcagctgccggccaccgctctccccctctatcgcctcgcctgctcgagagaacccgaagagagaagataaaagaaaataaacagagagaaatgtgggacccacaccattttctcacttacacgtggacctcacataataattttaattacttttgccaactaggatgctacgtcagcgaaacccggcctatatactgtcttgggaccttttatgcacggttttacatagttcagaaatacacatttctgattttgtggttaacggaccttaaaaaaatctcggtgtaaagttgagggacagccgctgaacttattcctcctatttatagcccacaaagcattggcccagacagccaccaaatagtgaggcccagaagagagcggcccattcgacacggtcaggcccacgttgaagcccaacataaagtgggagtgtaaagctcacacaagagcggcccaatgggttcctcacgatgaggacacatgtaaatctcgtccaagaagagaaagttcccagtaaaagccggcaactagccgacacctaatggcagcagaaaagtccatttttacacccatgaacttttagatcaagtttcagtctcatcccttaaccacgaaaccggagatgtaacattctccaactatgaaaaccagagtgtgcacggtctctaacagcagcccaatttgaaaccgaaccaacaaacagcctggttaacacgtctagccatgaaaagctaggccccatacactagcttgattgttctgaatggattaatagatggtagattatatttgattttgtgatgataatcgatgtaaaagcgaaagagagttaactattacccgtataagttatattggcattattccatcttcaagtttaactttatatatacaaatacaaaacataataacagttataacacaaaacatatatcatatacaaatatactactccctctgttttagattataagtcgttttgactttggtaaaagtcaaattacttttagtttgaccaagtttatagaaaaacagtaacattttcaacccaacacaaatatattataaaagtatattcaattataaatttaatgaaactaatttagtgttataagtattatactatatttatccacaaacttgtttaaacttaaagtagattgactttaactaaagtcaaaacgacttataataatatgaaacggaaagagtattttatagtggatgaaactaatttagtcgtctagatcttagtacgtttcatcataaactaaaataacttacaatataaggaggatgaagtacacagttgagaagctatttaaatctaaacaaagtattacaagcaatttaatttaggtatagactacagttttgcgaaaattgaatcaaggccttcgagcaatataatcggtgaaaccgacgacgaggtgctgggccaacaaatatacaaaatattattgtgcatgtgtttgtctttaaaaaaaagttgagtactaaaaaccagtgcaatttgaaggagtggaaacagctataacagccagcgagagaaatgtatatcaacagaaaaaaaatattataatgtaaaaaggaaagacaatatcaaagtaaaaaatatagagtaattaaattgtatttatggtataacaactcgtggctgtgatttagtacaataatttgagaagtgaatattcaagtccaataacttgacaagtaggcacgtacattttagtataggaagttgacaatttatagtattttggtgtaataaataggtatatgttgttttggttaacaagtaccgggtgagttttatcacaatgtcaatatgtcatcatatagcaatcatgtggatatatataatcttgaatttaatccataagaattacactgctcattctatttacaccttagatttaatctataagatttacattgctcgattaatttgcatcattagtttggattttttttcaccttcctatatctcaaccaaaatataaaattttcaacgtagttaaatttatttgactttcaattactagaatgacaaaaattatgtatacttatacaaatctatgttatattgataaaataagttctaaaaactaaatgtgtcgacgtttgatgtcgcaattccggtatttgcatagtatggggatcgttggtaccaggatatatgcgagacatatgtaaaagagacggagacgaggatttttatacaggttcggacccctgaattgtcaggtaataaccctactcctgttggccgaagccggtcgttgctcttattcatcataatcacaccggtacaatatttggggtagcctatctaactgttgtcgacttggcggccataaaaccatcccgtaatcgacaacagagtagttttcctccttgaatccatgttcggcgagatcagagacatcgctagatccctcctaacggttgtcgtaggaactgtatggggactaactaggcttatctccgatgtcgatatccggcggcttgtcttggcgtatgttggcttatatgttgatcttgtgtcttgatctattgttctatgtcccctctcctctttgggggtcttgtatgtatacccataggtgtccccttgtccaagtagaactagggaaaccaatatggatacaatccgagtagtacttatcgcttccatatagaactctattcatcattccttatgcggaagtcctcctatatccgacagttgtttccatataagacatggtatgtggtgggtcttgccgagatttagtcaactactattaggtatgtggtatctataaccctgacaaaatgaatacagaaaaaaatgcttgaaataattaagttgttacaacgcttcaagttattgtagcaaaatcatacccaccttgtaagttgttgtaactatatgctcacttcttaagtccttgtactagcaaataacttggaatgcccctttgatccatcggttcaacaaggtttttctcaatgttgtgtgtgcttggaacattgatcacacctcagtctttgcatgcttttctcccatatttggcatacgaaggtgcggtccttgaacagatgatgtgttatttcgaggttgctagcaaaagtaattattgggccattgctagatttgcagccggtctgccgtctatatcttattttgtagttggagctattcaaaattttgcattataaaagtacccatgctttccatattagttttgtggccactggatctatcctcccattgaattgtgctatgtatgctgactttgcactatactttgcattgttcttccatcaccatctaatggtgtcatcaaccctttctgctaggattgttgacgaggacatcactagctcaaatatgaccatgtctaccttttgtattcatcaacaaaaggtgcttgcttgttatgtaggatttagtgttatatatttgaacaaagttactgcaccatgagttatgtgtcttcttgtttgtagaaatacttgcatgggtgaagaaaagtggagcaggcatacatagcacttggatgatcaatgaagtttattggggaccaaccggttgcctttcccaagtctattcacatgttaccgcgtcacttttgatccatagaagacaagaggtgaagttccccatgttttagattcaaattcgggccttttgacaagatccatttcaaacgaacatagcccttgatctagaaggattctcgggacccatgagtacttgctagaaagcttatggagtctaatttcatatggttttggtcccacgtcaaaatttctcaattgtcaggaatatgtaaaacaagccacgtacctcattcagtaattttattgtcgggtacgtgtaatgccccgattttcgttcgggattaaaaatcaataaataaatcatttctagaatttatattaaatggtaaagcaatttaatcaagtgaaatattgaggaaataaaaaatttcctttaaaaaatcatggccggaaatatttttgtaatactctttgtgtcctaatattctctctagattttttccgtgaattttcggagctcgagaagtaattttaacatcacaaagttcatttaatcaattaaattaattgaaaaaaaaattaaattctcctcctttcccttgggccaactccggcccaagtttccttccgctcgggccggcctccctcctctctcctcccttgcctctctcggccccggcctctatccgggccgcccgtgtgtccgcacacgtggccgcctcgtgcgcactacatggtgcacccactcatgcctccgtggacttggtccacggtgggccgaacccccttagtcaccgacaggtggggcccgcttgttggcgccaccctttttcccctcggtgacgtcataaatcaatattaattgcgcaataattcgagtttaattccggaaattcatttaaatggctcaaaagttctaaaattcatatctaattcatacgaacttcgaattgggccattcaacttgccaaattcatccaaaattgagctctacatgcttgtttactttttatgtacttttacttggtttttattagtgttttccggg

SEQ ID NO: 49887 - DNA, 2094 bp, Oryza sativa
tttgcgtgccaatgtgtagattccgtcgtttcggaagatcgcgatcgcgaggaaaagtgttcagaagattgattgaggaagcaaggcaagtcacacattccccttgggcatattgagcctactttataatttttttaccgtttgcagataaatatgcatgttttgcttattacatgggaatagggtttacctatctactcgcttgtgccatgtttacttgacatccgttctttgttaaacttgggtgataattcgactagcttatgttacttatgttgacctagctagaactgtatgcttagccatgcttaattaattaccactagctcacataatgggataattacattattagacatctagtatcttgacgagctgcgtgcttgagacatccgaccatgtttcattagtcgtaactacccaactaaatacgacttaatggtgggctgtgggtgcatggttttgctagtcgcacccatggcaattaaggaccggttcacaggaaaccctcgaagacatacatcgcttaccacatgtgggagtgggtaactgcttgagctgtagtatagctcgaccctttcctaggcacccgtggcgagggtgggcgtgatggagttgggtcggctggggtgtccggttgtccaacttccggattcaccagtggcgcacgaggggactgcccactcctggttaggggtaggggtgaaaccttagcatggtgtggatggttaggggagggttatgcgaagggtcttgcattgtcacaatcactcgacatggtgatgtgtcaggcctggcacaatgacatgccggtggattgtgtcttgtggacacagttgtgcacctcttgccagagtaaaactattcgaatagccatgcccgcggttatgggcgatcgaccagattcagcgtgattagtctcacctttaataaattggcttaatgaactggttagttcaggtgggatggttaggcctattcaacgtggtgtagcgttgatcagtggagatttaatattaccttaattatcaactattttaccattttcaacaataaatgctttacaaccacctttttgcaaatagccacaaaccctccttgtctcccattgcacgtttgcatcattggtgtggcttgctgagtacggtggttgtactcagtattgctattatcccctcttttcagaagtgtagtgcttcttagctgaagatgaagttagacgacaagggcttagagcccagttgagttttgcctgtggagtgaagatgtagccccgctaggatcgcctttttccgttgctactgctttcttttctgtgtgaggactaagtgtctcttctgtaagtatttacgctttatttacgtttggatgtgtatattatttgtcgttttgtgtaccctggctgattcctggacagggatttaatacacaaaatagtctagaaatttgggcaaaatttctgggcgtgacagtatgcatcctagggctaaccctaggacatccctaatcatatttattcagtagccgtcatagtttcgagtcgggtttcacttagattaattctgtcgttacatttttgccgatggttcggtttgtggaaccccaacttcgagtctttaatcattcatctgcaaattgagttgcaatctacattgttcttgcttgtgtttttcgattcgcatgcagggattaaccttcttagtgaggtcaactggatagcacacgattgataaccaaaggagacttggatcctattgatcggaagccggatcatgtgtgtcaagtttccaccaaatctagagttatcagcatatcgaaagatctaagaccttagttcctaaacatctgtgttgttactccatatctaaagtagcatgtcaaagaattccttcaatagctagatcgatggtgagcctgtgccacttgtatccaccaatcatttgttagtgtttcatataccgatcgactcttctgctttgagtggttgtagagtcaattgctttgcttccatctcctatttgtgtctctgttgctgatgttgcacattcggtacaagataaaatttcgattgttactcattgggctgcaggaatt

SEQ ID NO: 49888 - DNA, 1286 bp, Oryza sativa
tagcttagctcccccgcaccgccatgggagggtggcggtggcgggagttgttgttgttcttcttgttgtcattcgggcttgttccttccaccacctcagccggagcaatcctggacgctactgcgatctgcgtctctgcagcttcctccgtttctgtctgctttggctttcttttgagatgtgcactctctatttttgcttcgattcgagctggtttgatgtcgaatcagctaaagatggcgtgtgcggcttagtgttcagcaatgggggaatgcaatgcggtgatatattgtctctttttggcttcaaattaaggattgatcctagatgcgctaaatttgatctatttgctttgagctttcttgtctcttgcgagatgtttgatttgtgttgccgagtcagggtagggagttgatttaataatggcgaatgcatattttggctacctggattagcaaactccataattatgtatatctaagaaaaaaaaaagatgtgaatacggaagattgaaacgattgtgggcatttcagctgaaggggaagactgttttttttttgaggatgaccggcattgtgtgccatagaatcttttcaccaaaatttgcagtacagttttaatggtttcttgcatggttcaatttacaaaactatacccttatgtactgtagtagtacatttgtatgggaaatcaccaagttgccttgcttgctgggagtggcaagaaggtatttaaagctgctgggttcagttgatgatgcatgttttaatggtgaggtcatagacaaatatgaacataacagagtgccacttacctgcatccaggtaaaaagatataatagagggattcacgattcacatcataaaacacaaagaaggtttctcaacacacacagagaggagtgctaaatggcgctcttgcgatgatcttcgtgttgtgctcatgatgccattgctttcagtgatcaaaaacataatttttaactgcgcttttgcgcttgctgcagaatagattagtagtacaggacaagtgttttgtctataggcacacccacagagggcacaacaaccatacttttctgtggattgatttgtatttagtctaaaaagagtagcagtttcttttacaagattgctaataacgcaccacttgagattttgagtaattgcctatttggaaatataattcattaaatctgaggtatattttcactttgaagtctgcagataaattggcatgtttcttttcaatttttcttttggggatagacatgcttaaattctgga

SEQ ID NO: 49889 - DNA, 3005 bp, Oryza sativa
gtcgttacgtgctgccgcatctcggaatggttttgttttttttttttgtttttttttctttttgggttgggttgggttgggtagttcaccaacgcaggcgccgtgtccgctgcgaaccagaattcgggatcagatttgtttcggttcaagcgtgtgcccgaacgggatttgtgttttttttttgggggttagtggaatcacggaactgggggtggtggatcgctggatcagtagatggaactcactgctcgggacttcgacaattgcagcgggggatccaaaatagatagtgacatatttgtcggttcttggtgaaatcgatccgtcaaactagcttcctcttcttgggtattgtatatctgatatccagagtggttttgttcacctttcagatctctgcatattactatactactagtactagttagtgtggaaagccctgagttgactgaagatcacttcatcttagccctgttacacttggttgcagtaataacctgacagttgaaggtgcacactagcaacttaccaaccgaatgttggacgtcctttgtttttggcttctgattattatatgtattggtttagaagtcgcttacactgaaatttccatgtcatatgtgctctttacttactctattgttgcttcaagaaaggggaattgtgaggtgcatttaatattcatgctgacctcaagtgtggtcttagcaaccaatttctgttactacctttattttttcccatttcactgtgtcgaagtgtacaatgtatctgggatattgtgttttagttttgctaggccttgtttgtgctgttagactttctttcgcccattttgaaggcatgccagagatttttttttcccttctaaaattgaatatttcgttctctcattcgtgccaaaggcaaagagcatgttcttttctacaaactgctagtaaatagtaattgcttctatgctctcactagacctttagatccaatggttgttacttcagattatagaggtactagtctcatgatattcttaagtggagactaatctgtgaccaatcccttcttcctgattgaaacgcctgaaccctggcaattagaacttgacctgttctactagtcattgttacctcccattatctgaaagacttaactctttgtatcaaatgcaagtctttctctagtttgtaacaacatggatggaaaccactctctgaaatgctaacatgttattcattcctactttagatcagcgtttgtaatgcttctgttcatatcagaaagcaatccccagatgctgtgtgccatgcatgaatttgttgaaatatagagctctgtgttgtcagaacagtctaggagatgtggtgagccctgtgggcagtgtagtactaagactgagagttggttatttacttatttgtattcagtatggtccctcttgagacagtttgattgggtttattagcgactatgagcacatagctatagtcccagttatattttggttgtagtcgcagcatgtaattggtagtcttgacaaggataggtgttttatccacgagcatctcctgttctctatctttgcatcagtacataattcccctcaaagtagctttcaaaattccagaggtgtagcatggaagcacttctggttgacactatactatccaactactaattatttgtaccatatgtaagggtttactaattgactatatattgtctattatactgatataatagaattgaacagctcataacctgcaattgtcttttgccttttttagctgccgtaaacatgcttcatcattcgaatagccggcaccaaaggaacagaggatcaagagtcaaaacattactccaggctaccttacttctaggtgttgttgtctggcttatgtaccaggtgaaacattcctatgataagaaaaatgagtacttggaagatgctgagaaccagcttgcccatgatgatagaagcatgttccaggggaggaaagaaaggggaggtagttatggtgatggcattctggaaaagggtggggagaaccctgatgtagtaagcaaaccagacgaagagaacattggagaaactgtgtttgagaaagacaatactgactctcatgatgatgatataagaaacactgacagatcaaaagctggtgaagggcatggcagtagtgcagatgggaatacagaagctaatagtaatgatgaggatggaacgaccaatcactcagaaggagagaagagtgacgctgagtccaattcatctgacgctgagagtaaaggtgaagaccattcaactggagatgatatgccccaaagcaatactgtcctagaggaaagcagtgcagagacgaacagaatgccccatgaagaagttgcacatggtgatgaatctactaatgaagatcagtccaatgtgaaaagtgacggatctaatgaaaaggaagctgagaaaaaagaggcagtggattctcaacatgcttctgaatctctgtccgatgatgcgaagggtggaacagatgatgagcattccagtggaactcttcctgatgaaacaggtaatctaccatcagggcagaatgagaactcacaaagtgatgcgacttccaccacatctgatgcttctagcgaggctgttcacattgagactggatctgagaatgaagatgcagcaaaatcatctgggactgcatctggtgatgatgacaagggctcagccaatgaggcatctgattcaaacgaaacaaaatctgatgaaggcaatgtggcagcagaagtttctaatgaccaggctgcaaacacggaggcagggaactcccaagaagcgtctgctgcaaagctgcaaatggctcttcagaagagaccaagcctgtggagaaccagaatgatgggaatacagagtcgtctaacaatggtgagcaggtggatatcaagatggaaaccagtgcttccaccaatgccgagcagaaggaatctcaagtcggcgatggcagctctgggtc

SEQ ID NO: 49890 - DNA, 783 bp, Oryza sativa
tccccccctctctctctcctctttttcttcatcgcctctccttttcttcgcctcggcgccgtcgccgtcctccactctcccgccgctcgcctgactccctctccctctctctcccgccgccgccgcgagcctcactctccctccctccctccctccctcccgttggcggcggctgtgaagacaatgagaagggctgccgccaccgccggagctttgtcagcggatttgttcgtcgccgtcgcgtcatcgagcggtgaacggcgagcgatgcacggatccgtcgtcggtgccgctcgctgcgccgttgccgtcctccccgcctcacgccatcgccgatctccccacatcgtgtcgtcgccgtcgcgacctcctccgcctcgcaccgtcactggccggaggcggtactctctctctctctctctctctctcgtcgctgcctctctctccttccggcagccggcgagggtagaaggggaaaaacggggggagagagccgtgtccacaggctcctccctagccacagccaacccagtgcggctcctcgcccggtccccagtagaggagctcgtagagccgcgtcccttgcacaggggtcgcggctctctgctaggagacggctccggccggaaaagtggacgccgtgagtagggatacgccccaggggcatccattgctgatgttttaagctgcaaagaagctctgcaacacagtcaaagagagaatgatgaccgctgcgacgagtgatgtggccagccacgggttgctgaagtagttgcgcaccag

SEQ ID NO: 49891 - DNA, 923 bp, Oryza sativa
cgtccgccagctcaacacctatgtcagtctcgtcactcccagttctatttcatcgtctcatcatactccccccctctctgcacttcacatcatgctgccatggattctcagtggtacccaactcaaagtgagttctgaggggcttcggccatggcccatggatctgagctacatggttcttgagttcgtgtgtgcgtgtgttttgggagattctttggaagatgagataaaaaattgttgtggtggttggcatgttgattttgtagacttggagagacaggaggtgagaggtgaggacaacagagtttgggacccatcatttattgttgtagccttaaattgtacatatgcgctgttgtaaattcagctagctgtacatcttggtgtactaaaatctgtagaacaaagcaaagaatagaattcattcatgttctgatgttcttttttcccttttgagtgtgctgcatacttttttaagtgatttttgctcaaatcatggacgtccggaacatattcattttttgcgtcactcagctgtacttcggggaaaaaataacgcaatttggaaaattaatgctggccttgccaacggaagacgatttcgatctctgcacctgaagaaatcggtagtgagtatagtttcatgtttgtgattcgaggttgttcacaaatttcatccgggaatacccaagagatccaattttgtctagctctttcaatttccatcacattgaactttcctacacacaaacttttaatttttctatcacatccttaaactaagggtaagggtgtgtttagttcacaccaaaattggaagtttggttaaaattgaaataatgtgatggaaaagttaaaagtttgtgtgtatagaaaaatttgatgtgatggaaaagttggaagtttgaagaaaatctttgtat

SEQ ID NO: 49892 - DNA, 1495 bp, Oryza sativa
gcggcatttatcctccatggaagtcgtttccgatgggtgcagtagtgcttattggtgacacgcgtgcgagcggcgatggtgcactgaataaagatgtgcttagctatgtaatggaacttgttttgctgtagtaggctgggatatgatgtggcaatggcctctaactattgctgttgtgtacataagcatatgaatgcatgatttgtaatggtcgggtgagcccttaatttcatgtaagcaacttacattgcagtgttaaagagtttggtaatggaatgacatgattagaacttgaactggaagtataagttgtcaagaatttggaaatgtcatttggaaatggaatgacatgattagaagttgatctggaagtataagttgttaccccgtgcgaacaataattttgcacgttatatatgtatgatttagaaaatatatgtttggtaaaagaattttttctgtcaggtactgaatgggtaacgatcaaaattaaaattttatgtagtacagaatgtccaacgaaattttatctagtatagaatgcgtaataccagcaaactgagatggaaaaggtgagggaagcaaagcaattttctgggtatcgaacttggtcagtcatcaaccactcaaagagctatagcacctggccttaacaaccgatcaaagcgaaagagtcgatcgatatatgaagcagtaacaaacgatcagcggatacaggatatcacgtacaacctcactgtcgacctgatgaaggaattcttcgacatgtttcttcagatacgaagcaacaacataatccaatcagaagggttgatgacatcattagatggcgatggacgaacaatggaataccagtgcaaagtcggcatacaacacaattcaatgggagattagattcagtagctgcaaagctgatatggaaggcatgagcactttgaaaatgctaaaaaaaatatatggctcctactataaaataagataaagatggtaaaccagctgcaaatccgtcagtggctgaacaattaattctgccagctctatgacaaaaaacctcgaaactatgcagcatgcacatttgtacgccaaatataggagaaaattatgcaaaaattgagaagtgatgttctaagcgcacacaatggcgacgaaaccttgttgaactagtggatcaaaggacatcccaaggtaaaaaaacacaagacaaatacaatgaaattgatcataaaaaaaagttgtggcatcggagatatggtgtgaaccgaaaaaaagagtgttccacagtaaagagactaaaatgccataactagtgtatgacatatttttgttgaaactgttgttatgtttttctataaagtcaacttgaagatgggataaccccaatatgacttatacgagtagtagttaactcttctgcttgtacctcgattatcatcacataataaaaaaatctactatctattcatccatctagaacaatctcaaattgtgactatat

SEQ ID NO: 49893 - DNA, 857 bp, Oryza sativa
  unsure (1)..(857): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacaatagccactgcatccttctgttcagaggaagccaggatgagaatcccagcatcacgaaatggaaacacccctattaccacgttgtccggtatttccatcttcgtttccttcctaccatagcaagcaatttgtctaaaactacctgtcctttcatccttggattctcaccaccaatggtttgtgttcagtgaatgatctaaccatgcgtcattcacagttcttcgttcttgtctttactctcatgattttctctttgttccagacttgccaatccaaccatgagcatgtcgtttgctctgaatgctgagccaaacactgtgtggtataataaccgctccctcctccagaatacattttcagatgacaatttcttgatgcgcatcttcctccctcatgacattgcagttccaagtataaatgatagcatcgttccttcatttgcttgcgggttgttctgtgcaggatctgcaaccagctgtgatgcctacattttttccatcttctttggctatgttagcaccgatttcagtcagcggctgcggtggcccgagatagtctggtttgccaaccgtgatcatccagttggagagaatgctactgttcaatttactgaacttggggatttagtgctctatgatgcagatggaacacttgtttggtccaccctacagcgaacaagtctgttgtcagcatgaaccttacagggtcaggaaatctggt

SEQ ID NO: 49894 - DNA, 7556 bp, Oryza sativa
aaattttatgcagcagaaggaatttggactactcgcagcctgaagaaagctgccatctcatcagcatgttgcaggagaaggccaaaaataaccagttgatggaccttatcgatccatgtttctttgatatggaattacatatggatgatgttttatgaatgatgaatttagcaatgtggtgcttgcaagtcgataacaatagaaggccttccatgtccatggtggtcaaaatcctggaaggtaccatggatgttgaaactgaacttgattttgacctggtaaacatagacccgatggtagtagcacatcgagcagctcaaaggaacagtattactttgcaggtagactctgtcctttcagggccaagatgaaatacaaggagctcaaatatattcttcaaagatatcaagctcaagattgaaaacacgtactcctgttttcctatactatggcatttagataaacaaagatgtagacatgtagtgatgtactatagtgataatgattttttttctgttctccaatgcagcagctttatatacttgtgatgacaaacatttgcagttgcaaactgtatggtatctgttgctaggaactggaagatcccagagttctctctttagataatgttcccagacatatatagtcatagataacttccaatgtctgataatttatattaagtgtgactctggaaccatctctttataccttcttgccttcttggttcactgaggtattcgagctgatctcctcataattgtgaatactgaaaagtaacttgttgcggcgctgcaaggatgctatacagcaaatttcttgagtaactccacctgtaggaatttaccaatatatctatttcttgattgtttgtttaagtcatgaaactcttataatctactggtaaaagccatgagtggactggttgtcgtcttgccaactagtcagcatgcatatgctccagcctccaggagtccaggttgtcacattattgaatgaaatacaagtcattttcagctgattgaataatatatatagtgttaaaatcgagagatccctagaaaatgatcaatagaagtatacgttattatagctctacatgcatttgaaatggctagttcgacctgtctgaaattcctgtgctaccggtgccccctgatataggggatcgctaatgggcgggcgatcgttgtgggcgatcacccccgttccctccctgtcgggtcccagaactaacaacttggatccgacataaattaatatatcaatccctggatcagtaaatatcgatacatacaatataactggttcttcattgcatacgttaaagttttacaatactaagggttttacaataatatgtactcatctaattgatcagctaaaattaatatacagcggaagtttttatacattctgactagggaggtataacctttagggattctctaaattatcggggtcatcgtagtaatagtcataagggtcctcctcttgacctagatctgaaaaaggggttataagagtaaggatgagtattcataatactcagcaagttatcatgaaaatatattatgcattggcatatagtagggttctttgcaaaaagcagaaataaacaatctggaagagttatagcaagaatttataaacgtatagactttatatttctaaccagggtaccatatgagtcccggtactcaattccatgagtacggctattcgaatagtttcaaagatattccactgcagcagatgtacgttttacccgcagttcacgacttgttgataatcatcggctttagtcatggcctagtattaattcattaacaattgtggcacctgttccatgaacttatatcctcatatgccctgaacatattgttaacagcagcaagaggagttctggcgttcccgaggtatttaaggggaaatgatcgtatgacaccacgtcatctcgatcaaggcttataaatataccatatagtttatactcgagtatcacaaaccatttacctgtacatggtaatggttaaggttgcccttcgcggctatagttgcctcctgcgcgaggacttaaaaataagaaccactatacataggtgccatattgctaattaacataataactatgtctgtccccattctagaaactgcggtcaaactcgttcgttcgacataagttcctggtaaaacttatatcgatcgagacactactagccacccggaaatcaaccaaatcttacgtactgtcctaatctaagtataaggtattttaaccatattgtaggcaaagtaagcaatactaaattatctgggtttctatggttgatttatgcatataaaatagaatattgaatagaaggctataaatgaataatttgtaaaatataggcttaaatgaccaaaaggtatatggtaacttgccttgctcgatgtcctgagattgattgatattatctattgagtcagatgaatcctcaagacctagggttagacatataaaattcaatttcaaaaggaattcaaattaaattcaaaaataagaaaaataaagaaaataaaataaaatgtaaaaatagcaaaaaggattcaaaagatagagaatgattttagaagaatattggtccaagtttcactggaattggatttatattttaaaagatatgggcttctaaagtttgaaaatcaattaaatgttaaatgttactgtgtgtgggtcccacctgtcagtctctctctctctcttctcttcttcaacctccggccgatccccaaatgcagccggcggcgctagggtttgggattgtggcggtgctaaagggggaaaggggttgtggccgaggaggggagggagctaggattctccggcgacgacgagcggcggcggaggggttaatttggtatgtggacggcctagcggctagggcggcggtgacatggttaggccgtgaaggcgattgggatgatgtgagttagacatgctaggggaggggttctagagcatctatggagtgcttagatggattccaacagcttgccgacctttggcaaggcgcggagaatacttgctgacgagcgcctccattggcggcggccgtgctcacgtcggtagcccagagggtggcatgctagtgcaaaccgattgcaaaaatggactctaggtagtatgtctatggttgaaacggaagaactcaccgagatcggttgaaacgacggattgcggccggaaaaacttcgcggtggcgaagaacagagcaacgcgggggcggcggtgctcggcttggtgcggcgaggtaaaactcggcggtactagaacatggttgatataaggtgttctaagggatatttagggcggaggatggatggaggggtgtggtgtcgatcgcgcataaggtgttcgatcgacgggagaaagtgattgatgagatggattggtgaagcagagcttcggggttgtggggctatggttgttgatgatcgataatggacaaggaagggattgaggtcctatttatagggctagaaggagtagatgagctcgagcaccgtcatcgccatggatgagctcaaggattggatatggctggggcgacaaaggctgtgagacggcgggcaagatcaatttgagtgatgggaggccacgtttgaatacttaccagcgaaggattggcttgactgcgtgtgaaatcggctagcggcgtgttggcgccaatccgggcgcgacgcgcggtggcggcgagggtgaaaacggccgactcgggggtggatggtttgaattgtgagaggggaaaccaccatctaactttaatctaaccgtgcggcaagaattggcgcgattcaccacgggtagaagcgaaatcgcactcggcggcggcttggacgggagcgcacggcgtcgagcggcgattccttgcggcggaggtcgtcccggctttgttgtcgtcaagattggtgcggtggcggcggtctgagggcgtcggacgggcgacggcgtgccaaggcgatcgggcacgcgcaagcggccccgaggctgacgcgcggcgactcggtgcgcggcgaagtcggacgccagggcggcgcgtgcaaggggaggagaaggccaactaaaccacggtttttgagtgggatgtggtccccaaggatccagcatagactttgcaaaggattggatagggattgggctgagttagtcgagctaggcattctgccgaataccttgagggcaatgaacagtgttttcaggaatttttgaatatgtccctaggaaagaatgaatttaatatatgaatttggaagggttttactagggtttggagtgtagcaaatactcactaatattaaggtaaactaaggaaataatctaaagtttaaaatttgagagaatttgctgaaattcactaaggtttggaataaaaggaataattacggtaaattagtagggttctaaggaagtaatacttgaaccaattaagaatcaaatagatttttaaagcacactaatttaatcaaaagccagcatgatgcagtcaaattttagtttaaaatttgaggatgttacactcccctaaggccctaacacgttcctcttcccttcttctcttcctactacaccataaattaaaaaaaagtaaaaaaaacacaagttagaaaaaaaataaaaatagaaaaaaaaaatctaatactcttatttatgtgcatagactctatacttatgtatagactttgttgtcgagtgacaaccacgtcacgtcgaagaacgtgggattgggtctggtgttttgaacagtaaatggtattgacttaataaaatgtttgggatccccctatcacatggcactaggggctatttatagccctagtacaagctgttactctctagggtttattgtttacaggagattttacatgaataccctcatgacggtgacatctacaggggtaaccaatgtctattgagttatgggcctgctaacagcttcctcggcctgccccaagcaagtggcgaacaaccttctcggaccgatcccgagcgaagctgcatcccgctctaccgaaaggggatgccttcatacttcgccatgagcttcgccatgtactttgtcttcatgcatcgccatgggcttcgccttcatccagacttggcttccggtcattttatagatccctgatggtttcggcgggttcgggcgaaggccctcatgacatgcctccaacaaactttatatcgtaaactttgcacgtataaactttatgtgtgtgtgtgtgtgtgtatatatatatatatatatatatatatatatatatatattatttgaatcgggtatataaacttttgacttataaactttagctgtataaatttactaaaataggaaagtaatgcggtgccaaaaaagtaaaccacgtgaagaggggcctgatcgcgtggggcgaacaatcgcccattaggattttcgcctgatatagggataggcaaaccacaaatttcgaaccttgcactgcacccgaatgctggctgaaaaaggaaagaagatggagaagaaagggaggccgtgtgggcctgagggagaaaaaggaagggaggtggcccgagtgaaacagtgtctctttttattttccatggatttgtttgaggggtatttggaagatttgatatttgaactcacaaagttctcaggatttgaaacagtaacttcataggctagtattttgatggttttgaattggatttgaaaggaatttgagatgggttggggggggaggaaatatgggaaaggacgatgcaaaacggatttgaattaattcacaaggtagggattcataaaatggattttgggttgatgagatagaacccgaatggtagggtgtcgattttgaattcttagaagaagggcttccggggaagaggttgaattccaaaattcaaatttcaagagttgattttgaattgggatttttgaaaaaaaaattataattaaggtttttattaaaatagttttcaacggtccgaaaaattggggcgttgcatgcatggagctagacgcgtttccgattgtttcaaacgaccgcaccggacggtacatgatttggttgggttcgcacattgtagatcatttcagatgacgcactagactttacaatgcagcaccggacttagtgcacgatgtacataatttgaaatcagggtgcacgcgctcactctaatttggacgtaaaaacggcaaacaaatgcacacagtccatgaaaacactaaacactggacaaaatgtctcctctttttatcgtgcttacatgtaggggcaagataactatggctgcgccggtgcatgcatggcctccttgaaggccctggagccgcgaatcctggcgtcctacccactacgggagagaggacgaatggtgagctacacgcctttggcatggtgcccttcttcatcccggaacgtgagcaggagatacatctgtgtttccgtctgcttcgtcctccgtcggctactcaagtatgcacgcatttccaggaggaattagaagcttctacttctactcgcagcaacgatgacgatgacgaggactcgactcagggtgtgtttagttccacgctaaaattgaagtttgaagaaagtgacggaaaagttggaagtttttgtgtgtaggaaagttcgatgtgacagaaaaattgaaagtttgaagaaaaaagttggaatctaaacagtgcctcagatatttgggaggtgttgggtctggggatttgtcacgaccgacctgctgctgatggagaaccagatccctttctttgtcatccagaagctgttcgagtagcttcggatgaatagtgataataaggccattcacagtgtgtcctaaaattttaccagatttcacatgccacatggaccaagaaccatactagctacatactccacaatgcatattacttatagtgggtcttacctatctctctcctctcacttttctcccttcccctctctcctctcacttttcccaccaccaccagtccctcatgggcggaggaagcgaagtggcaccgatggtgagcgtcgcggcggcagcggcgccgggcagggctccacgcctccaactctcctcgtcgcaccgcactcacccccgcccctgcagttccagcagcccgagcagcatcggcggtggtcgccgccacggctgcaacggaggcggcgggagaggagaggtggcggcgctgcccaagtggagacggcgccaggcgggcggaagatacggacgatggcggcgccgagcggaacccgtagacgacggcgccgccacacagagccgcggatgacggcgccgccgatctgcggaactcgggaggctcttctccctctccgtcgccgacagtccgagcggcgacgacgacatcgggcggtcttagcggcaacaacggcggctatggatcgagctcgccggctccgaatcgacgtcggtcgtccccttctcttctcctctgccgcatctcccctcctcctcctccacttgtgcaggagcaagggacagcggggcagctgcgtgaagctgg

SEQ ID NO: 49895 - DNA, 1572 bp, Oryza sativa
ccagcttagtcaatgctttgaattatttttttaaaaaaggaggtagtaagaaataaacctgacaaaagagtttgaacccccactaatactactaagtgatgtggactagggttcacgatcttccgaaagattctgataagcagtcgatttggacggagtcatgacacaactcgatccggcttctgaacgaacacgctcttaagccccgcaatcgcagccccacgtctcctccggttattaaccatgtcgaaacgtgattgacgtcgctgataaggctaatccctgtttgcgatacgaagaacacaaacaagaacaaggaagaatacaaccaaaattacagatgaatgattaagcttacaagttgggatcttacaaaccaatctagcggcgagactgttcttgatagaataatctaagcaaaacctgaaccctaaaggtgacggcgggtactgatatatagagtttagggtcatgcaaacaacccttgacgcaaccctaatgggttccaacacaatatacggtccaaaggcccaaatacggtgacgcaacaccgggacaaattctaaacatcaatttgtttggttgattcctattgacttgaaaagaatttggacgtgggactagaaccattggaaatgttatcttcttagctttccatccatataaagaacaccctaatccgagcatgtatgcgatctgggcgtccgttttagtgcagactagtcttggactccgaataatactcgaagtcgacttggttgagcctccatattgatttgggtgcccttgatgatttccacgcctctaagtctttctctaagcgtcgctttgtcctctccatgattcttaatcataatataatcattagataggaatctattctcaaaatcatgtaaaaaaacgtaggaacaagctcacctctaaattcaattatcgtgcgcgagctcttgtaattggttttttaatgaccggtggaggattgttgtgtatatccaatggagtgatgtcctcatcactaaagaaacttcttttataagcaacagagagacgaaataaacaagactggtatcaaagattgttatgaacttttgtaaacaattgttttctcccaagtgttgcaacggttctttccgaaatttatccgttgcatccatggtagtcgctctctcttcttgacccggtaaacacaaataaacatattcactcactccgtcactcggagaagaacaaattaattaataaacaatggagaatttgaggtaaatcagattcagatagatatatagatagatggatggatacagatgtagtgagattgggcgaggatggagcgttgctgacgacgacaaggacgtcgatggcgagagaggagagaagagcgcgcgcgcgtccggtgagacgtcgccgtcaccgcgcgctcccaccaaccactactaaaacccccccacgtatctcctcctctcgacacggtctctcgtgctctccattcgagctcacgtagtggctaagtgtttgtgtgtacagttgtttgatcagctcgccattgccaatgccaatgccggaatacgagct

SEQ ID NO: 49896 - DNA, 5633 bp, Oryza sativa
tacaggaggaagtacttgatgttgttcgtcgggataggcgacgacatgaaatttctaggacttctcgcagtttctctcgggtggttccggtcgtcaatcaacctgtgcgacaacctgggggagctggtgtgtaaaatctgaggactcaaaggctgtccctgttgatgacaagtttgctactcttcgagcgtatcgtcgagctaagggtctctgccatacttgtggtgagcggtggagtcgcgagcatcgttgtggacccaccgttcaacttcatgttgtggaggaattgctgcaacttttttctgtagatgaacctgtgtctgatgaacctgctgctgaatctttgcaaactgaacctgaagaaattggtgagcaggagggtgctctgttgactatttctcgtgaagctgttctgggcacagagtcacccaagtcagtacggttgcagagtttgattcagcaccatgaagtactcatgcttgttgactcgagtagcacacacaactttatcagtgttcaatggctgatcggttagctggttgtcgtcgttctgttaagccactgacggtacgtattgctgatgggggtctgttgcaatgtggggaagaaatgcttgattgtcaatagtggactcaaggggagtctttctgtgcaaatcttaagattcttcctcttggttgttatgaagtaattttggggatggattggttggaacgtcacagtcctatgcatattgattggaagaggaaacaattgcaatttgagctaaataatcgcactgtgcgattgcaaggggtgttaccagatgtgacttcttgtcctcctgtgtatgttaatcagctgaagggacttattcatcgtcatgctattgttcactcagttgaattgtgtgttgttgaatcccagggagtagagcaagctatgccagctgcagttgctaacttattgtaggaatttgcatctgtgtttgatgagccgaccggattgcctccttctcgagtgtttgatcatagtatccctttgttgtcaggagctcagctagtgaatcttcgtccttatcgctataatccggcacagaaggatgagattgagcgccaagtggttgacatgctttgccaaggtgtgattcagagtagctccagtccattttcttctccagtgctgttggtgcaaaagaaggacggaacttggcgtttttgtatcgattaccgatatttaaacgttattactgttaagaatcgttaccccttgccaatcattgatgaattgttggatgagttggcgggggcctgttggtttacgagcttggatttacgagccggttatcactagatcggttatcaccagatcaggatgaaacccgaggatgagcataagacgacttttaagacacatcaaggacactatgaatttcgagtgatgtcctatggactgactggtgcaccagcaacattccaagggttgatgaacattatatttgctccatttttgcgcaaaggggtgttagtcttcatcgacgacattttggtgtatagtcgcaacttggaggaccatgtgaaactgcttcgggctgttctggaaatgttgacaaagcaccagctaaaggtgaaacgttctaaatgtgcttttgctcagtcctctttgacatatttgggccgaccatgtgattagtgctcatggggtgacaactgatactaagaacattcagtcagtgcgcaattggccagttccccagaatgtgaaagaagttcgtgggtttttgggcttggcggggtactaccgtaaatttgtcaagcactttggtattatgagccggccattgactgatttgctcaaaaaacatgtggtattccattggacttccgagacacaggcagcctttgaggcccttaagacagcccttactactgctcctgttttggcattgccggatttcttgaaatagtttgaaattgaaactgatgcttcggctttcggtgtgggcgctgtcttgatgcaggagaatcatcctcttgccttccttagtaagtccttgggaccacgaaatcgtaggttgtcgacatatgagaaggagtgcttggctattcttcttgcggttgatcattggcgctcttaccttcaaggttctgagttcattatttgcacagaccagcggagtttgattcatttgggtgtccaaaaactcactacaccttggcaacagaaggcacttactaaacttatgggttcgcgttatcgtttggtttataagaaggggactaataatcgtgcaaccgatgctctctcccggcgcgctgctgacaattctgcagagttgtgttcagtctctgtttgtgttccgatgtggcttgaggaagtacaagctggttatgcttctgatgcccatgcctctcatcttattactcagctcacattgaaaaaggatgtagtacctcatttttcctttgatgctggtattttgcgctataaagggcgagtgtggattggcaataactttgccctacagtctcgtattcttcagtccttacatgctagtgcccctggtggtcactcaggagttcaagtgacttactctcgcatcaaaaatctttttgcttggactggtttgcggcgtattgtcaaagagtttgttgatgagtgtgctgtttgtaagcaggccaaggctgaatgggtacgttatcctgggttgcttcaaccgttgcctgtgccagagcatgcttggcaaatggtctctctcgacttcattgaaggattgccgcactcgtcgggatttgattgcattatggtagtggtggacaagttttcaaaatatgcccattttgtggctttggctcatcccttctcggcgtttgatgtggctcaagcttatctcaccaatatctataagctccatggctttcctcaatcactgatttctgatcgtgatcgcatctttacaagcacactctagacttctctgtttaaattggcggacacccagcttcggatgagttcggcttatcacccacagaccgacggccaaaccgagtgggttaatcagtgcttggaaacctttttgaggtgttttgtccatgcctgtcctaagaagtggtatcaatggctggcgcttgcgaagttttggtacaatacttctctttactcagctctggggacaacaccctttgaggtactttatgggcatcctcctcggcactttggtattgtggatattgcagcttgtgctgttccagatttgcaagcatggttctaggaccgtggggtggtccttactctgttgtgtcaacatctgcatcgcgctcaacaacgtatgaaggttcaagcggataagaagcggtccgagcgccaatttgctgtgagcgattgggtgtttttgaaggctcaaccttatgttcaatcattgtgtttttgaagattgggatcgcctgaaggagcgtgtcacgaccggaattgacccaacgggcgttccttacgtgcgtgtattattccttgtcccaggaggcaaggtacaccaaaagttgatacatttcagagtttatcaagcggaagcgtaaatagttaattcattacatgggcagcgaaggcccagcacacacaaagacaaacgagaaacagcggaagactagggcgacgaccacaggcgcttgacagcaggcacgagctagacaccaaagccttcatcttccagggactcctcttctgggtttggaaaaattgagcaagactgagtacaaccaccgtactcaacaagacacacccacaagtgcaggataaatgtaaaggagtacaaggggggttatgatataaagggttagggtttgcagtaacagcattaaaagacacttagttgctcaaagctattttgtaaacacgtttccagagctatacaatattattaatcaaggccgtgaacccacacgagcctgccttaacccaaggcctctgatgattcagaccgaactagcaacccgaccctgggtcccagctcgtcccaagccaacccaggccaaccattccacattttagttgataagcaggttttaagaattaaaacactaacttgggtacattgctcggcttgcccataaccgagggcgcggctattcgaatagattatactctgatcagaggtgtacatctttacccacaagacacatcttcctcacgtgtagccacgtgtcacataccaccacggtatacggacggaagacatgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacaaaggcccgaagaccggtccttatatggccgaggtgctactatcaaaaccatgcaccccgagcccagcctaaaaccattttggagattttgaatagagggtgaggtgtgaatccaattccacaataatcaaaccattccatagtgtccaggtgatatgaatctcccaaagtctagagttgtaaaaccacctaatgttacctaattaattagcgaagcatctacctaaaattatactagtggtaccatgagtagagtgtctactagttggggttttgtttattctagggtgaacaaggaaataataacaataaaaataataaggtcataacaaaggtaaataggcatggctagataaaacagtgataacgcgggaatttaaataaagcgataatgcaataatttaaatcaaaataattttataaactgggatttaatatgttcaaggatgatgtgacttgccttgctcgctttcccaaacgtcggcttcaacttccacgaagagcggatcttccgaagctgcggcgtctacacgaccaacgaaaaaaagaaaaggcttttactctaataaactccatataacaagcaggaacaaagcacaaaaatgggttcttgacttattaaggaaaaattagagacttgaacggtccaattccgagttcaaatggccaagttatggccatttgaagtttatatgctctttaaatgaatatttgcgaatttcttcatttaaattttaattaaaaaaaaggtttattgcgtcagccgaggggaggggcgcgcggaccgggtccacgggagtggggcccacgcggcagccccacggtccacggtggaccgggcgcacccgggctcacaccggccggcgccgttggtcccacgcgtcagccgcacccgagggcgcgggcggctgacagccgggccccacgcggcagccgctcggtgcgcccgaaggcggccacgccggcgcagcgacgggaggcggcgcgcccgcgcccctatggtcgccggcggcggccataggcacggcggagcggcggccgagagaggggagggaaagggggaaacgaagcggcggtccacggctcaccccgggtcgacggcgacgacggaaacggcgaccggagcgg

SEQ ID NO: 49897 - DNA, 3056 bp, Oryza sativa
attcctgcagcccgccattatatggcgccggcgaggttaggggagaggtttccaaacgaatccgagggagagagggagggaaaattggggggaaagggggaggggatcccggggaataattccccccactttgttgcgcgcggggacggcgggaggcggcgggattcgcggcggcggcggcgctagggtgcgggcgaggcggcgggagcggcgggaggaaggggatgacgggtgggccccacccgtcagcgagggtggcgggcgggcccgcccgtcagcggcgcgcgcgcggggagaggccggatgggctgcggggagaggagagggagggggaggtagatgggccgagccggcccaagagggagagggagggaaaagggactttttagagcttttctttttataaaaccattttaactttgtttatttcttaataattattatttgtgctctgaaaattccactaaaatttatttacgcattttaggcttttaggaaatatacaaaaatcctccaagccttatttgacttttaactttgcacattttaattgctggaggctttcacacagattttaattattctaggcataatttagaggatgtattttagagtcgttttgggacgtgacagagcgttttcctgtagtctcggcttggggacaagccagttgcgaagaaggggagaatgttaccaaccctgttaagcttaggcccagtaggagtaagcggtccaatccacgcgtcagtgggccagagtgggtggcgtgagtgttcagcctgtgtatataaaggctatgctgtaatcgtgctggttatcgaattgaaaatagaaaaagctaatccccaacaacctctgcttcttccctctctccctctgttcatctctcttcctccccaagtgctcggtcaaattcttgacagaggttgtgacaaaaaacccctttgttttttaatttgttaagagatgcgctcatagcatagtggcaggggttgctgcatgcaccctatcggtccaggtttgattctcgtcgagtacacacaccaggttcgattctcgtcgactacgcacaccaggaatcgtcgagtacgcacaccagaaatatttacttttctttcttcttaaaaccattgacaccaaatcctttcttggtgtctaacctttttttaattgtttaaatccatcagttgatccaatgaacttggttattatacaacaatcagtagtcggcctcaccaaattggcgatttctcagtttcgatagaacatttttaacaatgaatcagcgagcataacagatgctgtcaacataacagagtagtttgacttgtttctggcatacttcacgtacagataattaagtagaaaaatatctctatactattcaaaatgttggtagctagcagtggtgttcattttcacaccacctctattactagcatttaggcttacaatctatactattacaccacattcaacaattcctctcttttattattggcttcaccatatttcaaaatcacaaatttgttcaataagaaaaattgtagtattacttagaataaatatatatttattacttgatttaataagctagaaactcaatttggttttcgtgacaacacaatcaattagtcctgaacaaacaaaattccaagagtatctacgttttgatgactagctgattggtcatcctacgagagtctcgaaccaaactgtatcgaacgtccttttgtttacgaggattgctatagcacgggatttcattccaacgcgatactttatgaatctaatcctgcacctcccgtttttcccatgttcaagctcccacattacaaagaaacaagtagcgtagctccttgctcccaccggtcacagcaacaacagaggaaggagggagctatcgttgagaggaaaagaaaagagaagatgagacaatgataggtgacttgccggtaagttagacgatgacaacgcgctcttttcccctacgccttgacccggtacttgataccattggtatcagacccgatatctaatacctgataccaggcatgataccccgagatatcagaccttggtatcaaccctctgatacctaaggtatcaactgtgacatacttgtacacacatcagtgagtacaagtgatgggttggcaagaagcagaagaaacccaattccaaggtcgccatctacgtcgagactagtcgcttccacccagcctcttcctatcgacgcctaggacctcatccccctcctccgccgcctccctttccttctggttgcacatgacaacccccaatctcacagccatagttggctcgctccttgactataacccccctgcccatgccaacctctactctttcacattcttcggatccagtgtagctagaaagggagaaaagatgataaggaatgtcgtcggtgttggagacgatggtgaaggagtcgaggagagtgaggaggaggatggccactggggtagaggagtggatggagggaggagaaaaacgaagcgctgctacttggtgggggagaaaaacgagtcagtggggaaacagatcttgaagatatgtaccgttcacacctattttatcacgtgtccttgtgcccccgatgggattccgtgtattagttttttctgtttgtttgtgggagtttagaattttaaggaataattggttggtagctagattctaataatcaagagaagttggatttcctattttttgacttttaattatttttgtagattttacacagcttctcagattttagactttgtattgtttacgagagcttctaattctgaaagaaactacagtcgctagaaacttccaaaacaagccctttgattggatgaaccagccgggattcgtttgtgcacggcccaacgtgtcacggagcccattcagtgacccggcccaggtaaccatgggccattgcccatgaggccacgcttagtcgcctggtcgtcgcagccgttgcatatgccatgcatgcgcgcgagcgaaactgcaacaaccgccacgccagagtccaccgcacgcca

SEQ ID NO: 49898 - DNA, 9845 bp, Oryza sativa
  unsure (1)..(9845): unsure at all n locations
gataattaagtaggtatgtttaaccaaaatgttgcatgcttggtgtgattgatttaaaattcatacatcacaaatccggtttcttttgtgctggtccaaaattcagaaatatcaagtaggagtatatgattgtaacttttgttgttatatttggaaaaaaaattgcagtacaactacaaagtagatctaattaagccagttactcgcaaggtgcatttctattgatattgaaatagtgcaaaattgttctacaaaactgctgtctgtaaaatttcaactacaggttcaattcgtctcaatgactccaaaataaaattcttgcaaacagtaggatcgaagaaaaataaaataaaaacttgctagacacaacaaatcttattctctcccttcttttcacacttgatgtcaaataagttggacgtaaaatcttacagaattatttttctcctcaaactagcttggttcatatttttaaaaaagaacatgatttatagcaccgttcaacataaatatggtatttagttgtattccccccttataccatactaagttcgaattaataatctgaacatgaataaaaacagtagaaatatatactatgttgcatctctgcatatggtatagcacatacaccggcggatccaccgcccagcgacccgatcgagcagtcacccgggcttatcggtggaagatccttttgaaattctatgcaatttaacaaattgaaattgaacattataagcaaatgttagctataattaagtatgtccaaggctttaaaattttactgagcacatatcatatataaattaaattaatgcagggcgggagatcgtaacatacgaaagcccaagccccaccatgggcatccaccgcatcgtgatggtgttgtatcagcagcttgggcgcggcacggtgttcgcgccgcaggtgcgtcagaacttcaacctgcgcagcttcgcgcgccgtttcaacctcggcaagccggtggccgccatgtacttcaactgccagcgcccgacaggcacaggtgggaggaggccaacctgatctgatcaatatcgatcgatcttcgatcttctagctcttgtacatgttgagtgttgaccaatataatggccactcatgcatatatatatatatatatatatatatatatatatatatgcagtgtgtctagccagctgcatgcaactttgtctacgtgcttatataattaaacaaatgcatatatagccggccgtatcataaagttcctagctataaaagctatagaataaatgtcgccccacttggtcagttggtgtacatgacggctcctaagtgtgctatcatgaatatgctaataatagcagtttagtatatcatccccgcaaaaaaaaaaagtttagtatatcaagtgtacgtagagatgtgacattttgtcacacattggaaaataaactatattgtaataatatgcgtggtcgtttaatattcaatattttctgagtagatttcatataaccctagatattatggtgttaaacacaattatagtggtttgcagtggcggaccgagaaattttcaaagactagggttaaggtatgaatcaactaatgaagtgttggttttctacaaaatttacatagtgatttaacacaacttaacaaaatttccttccattccaaattgatctatatatttcataggtacaccaagacaaaaaaaaagctaatagctctctcatactatatttactctagcaacaaactcgatgcatgcaccatccctactatttcctagccaatagcaaatcaagatattacatgcgggttataaatacttgtgtgcatggatgcatgcatcaatgtccattactccaatgcacaaataacgaatagacttaatgaatgaacacaaatatgatgatcatttagaaataacctaaaaaaactatatgatgatcattttggaacggagggagtaagattttagaggcatgtctagggctcaagccctagctgccctagtcctgcctccgcccctggtagtttggcacgtgacacataaccccgagtatttggtatcgatgcaaaactatgatgttaactaattcaacataataatgtagcacaatgaaaaataataaccttatatggctacaacatttagacgatacattaaacgaactcataaatttcaaatataagtttaaaattcataataagtgtactacatcaaagacaaattagttaacggtaaaaactgtagaatcataatatatgtggttctatgcaacacatcaaaaccctcatggttttgtgcaaacatgaaccaaaatatgtagggtttagtgaaatttactcatattttcataacctaattagcttttaacttaagagaactatctgaaatgtgtttagtcattgctattagatacagattaaaatcctaaatacatatataattactctatccgtcccaaaatataatactacttatgtcccataataattgtatttctaggatttgtatttgtcccaaaatagttgtcacaatagagtactaatggtcccattgatcacttctcgttcaaatttcttcatattatagcctcaactactctctcactctttacctatacacccttgaagaagggacatcatagttttccttcacaaaccttaatatatgctaaacactctagaattacaattattttgggccgggtgtagtaacttttagaggtaggcattggtaagaagaaagcttaaataaaataataaatggttgtgattagctgagatgatgtagctgagaaattaaatgggtatagcagtccaattaatactcatcctcactactccattctgtgtttgacccatggagtgaaagaggagatttctctctctgcacgcacgcttcccaaactgttaaacggtgtatatttttgaaaaaaaatctatagaaaagttgtttaaaaaatcatattaatctatttttaaagtttaaaataattaatacttaattaatcatatgctaattactcacctcgttttgcatatttttccaatcttctcatttctctttctctcaaccccaataaccaatgtctgtgacgactactacccaacaaaatttcatggaaaaaatgtgagctgtatatgccagtatgttgaataaattcagctgttcattacaactgattctatacaaaataaatttagaactattacagatataaaaaatatacttgaataattgcttggacaattacattctttggaaacaatattttctctagttattcatggtaaaggcataatgccctgtttccagaaaaaaattacaatctagtattgtttcaattataatattttagtaattggtagttttaataatttattgtacactatatgcactttacttcaactatgttcatgttagtttttcttgcacatgccttcatcatttatgtttgaaggagtgttttttttaaaaaaaaaaaactccgtacccctattctcaaaatcttgtgttcgccactggaaaaaaaataaattccttcaaatatatatgcactttatttgggacacagctttgccacagtggtatatagaaacatactggaataattcatcttcatcagcagctgactttatctagttttgcttgagtacccaactgtctgttatggtctaatatatgcagtgatctggggtgatcactaaacaaatactccccccgtcccagaatataaaaagttttaggttggacacggttattaagaaagcaggtagaagtaagtggtggagggttatgattagatgagcagtggaggtaggtaggaaaagagaatggtagagtgttgtgattagttgagaagagaatgttggcggagaagctgttatattttgggacaaattctgagagctaaaagttgttatattttgggacggatggagtagtacttatgaagacaccttggtctcacagatgtttttaccatttttcatgaaatatctgaaatgcaaaaaaaaagtggtttcattcaaggattatatatatacatgaaatggagaaatattatcattaataaatctaaggctgagtttgaatataaatgtgttgagaacttctttccctgcaaatgcaaaattaagcgaattattagcgcatgattaattaagtattagctaaaaacttaaaaaatagattaatatgatttttttaaaaaaacatatttcctatagatttttttttaaaaaaaaatacaccatttagtagttcaggccacgtgcgtgtgaaaaactaggaactctgtggctaaagagcacttttgacaccaacgggcaccggtggtttgcgacagtactacatgtacaaaagcgtggctttcatcttttgcttgttgagttaccttacacagcttaaatttgaattttgaaataaagttggttttttattgtagtttatttgtctagccttggattttaattaaatgctaataattaatatagatataaaagttttacaatagattaccttttttactttcgtctatattttttttaagtcttatttgctataactacaaatgacaaaagaaactccgtagttagttaacttgttagcaaagtggattggctaatgttggggcaatgaaacatatgtgtctaatcccaatgttgggacaccaatatttacaaacatagtcagcaatccaacaattttggcagaaaccaaacaaccccaaaaaactagggcttctattctagagctagtgtcatattggtaccaaccaatacatgtcagtacgagacatggtacctcatcaataccagactagtggtatcatacccaggcgagggggaagagtagaaaggatggagaaggttactggcgtcggttcttccacctggcaactacgacgatgagctcaggcagcgacagatccggtggcattgggattggcatgtgttgtatccaatgactgggagcttaggcgcttcaaatccaccatggatgggcaatggagaggggcgatgagaaggctacagctacatcggggttgtgtggtgtctcaggtggaggcggagtcaacagcaatgtagctcgccggtcagccaagcatcccagaacaaacaaagaaacctaggagtcgagcccaatccatgagctgaggaatgataccataccatatgttaagggatgtagccggatgcgccgcactcgaagtggatgagaggacaccgccggtgtggaagagaatagaggccatctggccttgttttccgacagtgctaccgccatggcccataccgtcatagagaattgaatgggaagagaggaatcgtaaccgtcggctagggcctcacgttgcggcactcctagagtgcagcgtgggtggtagctctatcgcgactgtcgccaccacccgtgcattcacttggtgaattatttggaatcataccgtactgatgctagggtacggaatcccgtctccgagcattcctattaacaattggtgtagcaagcattatgtataatgggcaagtggggagtggatctcatggaaaacatcatcgctttggtattgcccatgacaccatactccgttataattaccaccagggaaggtgtcgaatggcaagcaaattacgtctgttagacaagttccgcatgattttgcatgcgcagattgttttctatccaggccggtgtgttgttcgttgctgctggttgtgttgttgtgtccaattcaggagctgcccaaaaagcatcattcctttttgtgtggaggcctctttcccttgatgcaatcttctgtttgattattgctgcatcttgggactgtgcggaaaaggaccagtgcttgaagcacaaaactttaagtgcgatttttgtgtcattttccctgaatcgattaaatttattccaaactgatatggcaaaagtagtaagtatcacatttgagatttgctaaccatttgtttgttctaaggcttaaaagtactgtacgatagcatattgtgcgattaattaagtattttattagtactcaagatgatattacactacaattatcagcttgtcagcacttctcgatgaattgatcaccgcaagctctcactctgtcagctcaaactcatgacaaaagtaatgcagcgtactccctctgtcaaaaaaaaaatcaacttataagagggtgtaattcctcttattacaacaatccctttataagatgaggggtcacgtcttcttatagattaagttttttttttatggaaagagtacgtggttaggggccacggcccagactatacaccatgatcggttagtggcgaatgccatatcctaaacgctccgatcgtggcacacaacatgcatgaactggatgtgcgtatatatggtgtgctctagtggcgccgacaggctctcaacagaaagaagcagaaacctaccggaaaaagaaacaaatgtgcaatgcaagtgtttggctgggcagagtttttccgagggattagagtgtttggacggatgaagctatcgagtgttttgtttgattagagaacatggaaattttgatatgacgggatgacgaattgagggaggaacccctactttttaatagctaggtaggagtgagagttggacaggaattctccctctatgttacctaaacaaatctcggccatccatttttacttaagatctaccgtctagctaaactccctatcaattcctaccacattcgccaaacaagagattgaaattaaaaatcaaatttttacactaatattgctactaatttactcgtttaaattcctaatatcctctttccctaagttgctaaacatgccaagtttagcacatcttaggccccgttcgttgctttaaaaaaatttccgcacacgcaaaacgagaaagctcactagaatatgattaattaactattatatatatatatatatatataaagcgtaccatttaacaatttgataagcgtgctaaaggagaatgaggaagttgaagaaaagaactaagcctaaggccatccccaaccctccatgtcatttagtatgtgtttgatttggggacaaagtgggatgggttagactcatccctatttttaggatgagatgatcccatctatctgtttggcataagggatgggatgatcctacttttgaaggaatggcccacatgtcagcgagagaaaaaagtgggttggatttgtccgccggtttttgagggaccatgccaacccggatcttaagggaatattccttgtcagggaccatcctatcccacctatctccaaaccaaacacactataaaaaataggttcaacccaacccgacccatcccaagttcccaaacctttaaccaaatgcatgcagtatccatagcattaaatacattgccacataagaaaaaaaactaatgtgacaggagaattaatgaggagagagataaaaagatgaaggaaccatttctcatgcaagaaaccatctctacataagtaccaagaatgaaaacaagggaatatatgagaatttaatttgaagacatcatcaattgaatatatagtttctatgcatagtgcctatatgacatggcaaatatgaaaactacttgataggtatttaaaattgatgaagatgaagattaagttgacgcacatgattagttaacttttaattattataaacttgagaaatggatatatttgatattttaaagatatagaaagttttcatacgaagatattgtttagtactttgaaaaagagtaaattacattggtggtacacaaacttgtcaggtgggtacaatctagtgcataaacttgtaaaatgtttgtgatggtgtatgaacttgtctggtgcgtgcaaaacaaggccaaaaggacacaacaaggctaatctcatcgatttaagtgctgattaggatgcgatgtaaacatgcaagtgagaagacgccatatagacatatatatatatatgtgtgtgtgtgtgtgtgtgtgttcaataaaaggtaaaataaggcatgattgttgtcaaagaaaaacataaagaacctgagtaatgatgcaagggtggaaacaaaaagaatgttaatgtaagaaccgagtttataaatatagcatatctcatgcccatctcatatgtgcatatcacgtcctaatctacatccaacttggtaaaattagccacgctatgttattttggtattggttcacagccactaggcaagtctgtacaccaaaacaagcattttacaagtttatgcacttgattacactcatctgacaagttcgtgtaccgccaatgcaatttactctttganaaacgtgataacggaaaccgagataaaatatgtatcttaatgagaaaagaacatgggccctgtgctaatagcttagataattctgaaaactcaattccctctcctgatttgtactatgcaattccttgtgttgctgattgattagcaaacaccgagagaatcatgcaaaggttttgaagccccagcaagcaaagttgcgagcttctgaattgaaaggtcagtgtagaagtagcagtctagcactgggttcaatgtttttcctcagaaaacctttggagaatgttgtcattggccttcttttttttggttcatatgagttatgtgtgtgattctgatcttgagcgcgacacgaaacaacacaaatctgatgatgtttacgtctgaagctgcaaattgcccacgaggacatgcacggagaataatgaggtaagaaaaatgttcttcttgaccactgggtagccacaccccatgtcacttcacgtctgtcgaagcgtccatcccagccttctgtgtgtctggattgcgaaactgtaggctctattatcagaaaaaggattcactgcaaacatatcacattttgcctcatttttttctctgaaatttgnttcaaccagttctcttcatgtctncgcttaaattttttcaatgaagtgtttttgtttcattttttccctgtaaattttctttcattttcattaatttccttcagttttttacatttattagagggaagggaggaaatgcaaggcgtaagagagcacgattataatggacaaaaaataagcccatgccaaattcttaatgggctgatgtgagcctaacaaatataagattaaataggctatcaacgaatttttttatttatttatttgtaaatatttaggaatatgctttggttttcaaaaattacagaaatatacccgtaacgtcctttatatgagcgctttttcttgttttggaaaaaaaaaagccctctacgaggactagagggacttaaatgcaaaatttgctttatagcttatattaaaatattatttagtaatttcaaatttttttttggagttggataaaatcaaactttatattaaaattttcaagctcgataagatccttatagttaacaacttatttatttaagatcgtttagaagttcgaatatttgttacatacaaaagttgcataactcaatcactattacaaaaacggacatacatgttggcactatcgggctagaaatgctaaaacttgtacttatagtgcttttccccccaaaacacgcatccacgggacatcatcggctaaaaccgtcacctttatagagagataggtgtcggttctaaattaaaaacccaacacctataatattagtgtcggttcatttagaagaactgacatctataatatattataggtttcggtcttttaagaaccgacaaatatatttatattataggtggttttataaaaaaaaaacggatacttattaagaaaacccgcgggagccaactgaa

SEQ ID NO: 49899 - DNA, 841 bp, Oryza sativa
atgaggctgtaggcccaagctccggctgccgcaccggcgaacggtcccaagatgtacacccacagcgccgtgtacttgctccccaccaacgccggcccaatgctcctcgccgggttcatcgacgcccccgacaccggcctgcgcgcccacgtcatccatgtcaaatagacccccaaagttagtgtgacgacatcatttgcgggtgtgtgagtgtgagtgtgcgtgtgcgatggtgcgagcccatacccagcaaacagcacattgagcatgatggttccacccacagccactccagccatatgacccacctgtaaaaacagagtcagatgaccgataagtcaaaactgataagtattcgtgacgtggatggctgccatttaccgcttggtcatcggtggcgacagccatgatgacgaacatgaggtagaaggtgatgacgaactcgatgacgagcgactgcgcgtgggcgccgcccggcagcgtggccggcacgggcgcgtgccggccgccgaacatgagccgcagcaccacgctcgccgccgtggcggcggccgtctgcgccagcgcgtacgcgggcgcgcgcctccacgggaagcggccggcgacggcgaagccgagggtgacggccgggttgaggtgcgcgccggagacgtggccgacggcgtacaccatcgcatgaccgccgcgccccacgccacggccacccccgggaacgtcaccgcgcccttcttctcctccaccgtgatggcgcccagccccgcgaacatcacgaagaacgtggccaagaactcggcgagcagctgcacgcagcgtcgtcgtcgatcgacgaccaaattaacca

SEQ ID NO: 49900 - DNA, 7800 bp, Oryza sativa
  unsure (1)..(7800): unsure at all n locations
ttatgcggcaaaaccgaagacgctgaacaaatgggtatctagctcacacacgtaaacatattagaagaaagtagtacagttttagttacacaacgcaatagaccagacaggctgttgccggggtacaaggaacaaatgggtatctcgtggatgtcaagaagaagatcgaacatgtggactgaaattatataagagcagatcgtcctcactcctcagagtgtcagccctcagctctgtcttgcccttaatttcattctttcttcggattcaccgagagtggttgatgaaagccaaaccaggtgaattactgaaattaaagattcgagagatacgaactggggattggacaaaattgaaacgacaactcccacgaatatatgttccaataatgacaaggtcggggaaatgtattagaggatggatacaaaattaacctgatgccgtcttttggtgagggggggacacatgtcagcaactctgcatgtacatgttcttgtttcttcagagaacggcagagacagacgacaactagtgcgtcatacatggatggattttttttttcagatggaaaattgggattttacacaaattaaccatttattattggcgcatgcaacacctataactcgattcgttagcaaattgcttagtgggttcggcccaattgatctggtgaaattcagctcagcttgacgatttgcagtttcattacaaagcccaaagctaggctcaccaaatcaggaccagtctgaaacaatagaagaggtatgtgcaaggaccctcggcttcggttcggcttcggcttctttaaaatttgcagtcaacaggatcagatgattaaacttacaacacaaaaatagaacaatagatagacgcaattgtgatatgcctctcatttctcatctgatagctcaaattgatnggatnnagatggatnnaatttgaannaaataaattgtgatagctattcgagggataaacaaattaattaacttctacaaagttgaaaagttgctttatcaaagtattccaagaaaactttatatagaattgtgttcataaaatgcaatgtttaggagcttgggaatcatgcgaacaaaaaatccaaaatctaaaattagaaaagaacagggccttagactatggtgctaagttttaatttcttcgaattcattaagacctctttttgaatgcatgatttgaagaactgcatgaacaggaaaaaaataatgagaaattagggtggcacaccaacttgatcctaagtaatgtcaaaagcacacaaattacttgaatcgcgttgtttggatgcttcacaggaaaatactacatgaatttggagagggaatggcagaaaggaaatgttccatgtggttaaatctaatggtagaattcctctaaatttcctatgtatttggttattctataggaatttcaaagggtcaattccttttgttctaaaggagtacatataggaaaattttccaaaagattcaaccctacaagtgctccattggtcaaaggaaaaaatgaggaattttttagaactgaagtcctttaaaaataaatcctacatggtcatttggaacagaggaatgacctttcgaaattcctgtgaaataaatgtaggtattttgaaggaaatttagcaacatatctaatattttattttcttgtctcttaaaattctatgtgtttctcatagcgttaccaaaccatttttccttcttcttcttcttttttttttgcaaatttatgtgggttcactttctgtatcattcaatgagacgtgataacacatcttatttttgtgtgttttcctattccatgtgggctgagtgcgttgactggtcaaggtgtgtgtctatgttaaaaagagtgcatatacctctaatcttagttatacatgtgctatgatgtatccaactgatgaatatgatgtgtgtgagagtgtggatgtatgagtccagcagcgtgtgctcagaaaaaaaagtacatttaaatttgaattctctgacatcattcgaaatttcacttggaatttacttttgtcccacattgatacctcgaaatttcacggttttcattaacacgtaaaccctgattgcaatgttgtacaatgtgcagttttagttcgttttaactacaattgttgttgttatatgtggttttactttagtttcatctaagttctaaaacattttgcgtgtagttttatattgggtgaatagctaatttagtccctcaagtttcacaaaaggctcaatttagtccttcaggtttcattttgtccacataggtcctctaagtatttgttttggcttaaaatcatccttggcccacttaatatgccatatggatatttctagttaacaattctattagaaaatgtctcttttgcccttaatatgtacacaactatacactagaaaaaaaaacaaaaataaataaacaacattgcatatgtacttcccattatttcaacatgtgcacataaaaaacttgagcctaatggctatcgtatacacttgcaagtacataatttatttttgttttatataaattactatgcattatctataaaaaagaattcatattttttctctaatatatgtgaatgagggggtataagtgtcatttatcaagagaattgtttgttatgtaggttcaaggataagtttgaattaaaatagaaacttgaaggactaatatggacagattgaaacattaaagacaaagttaatccttgcgtgaaactaggaggaccactttgactattcacctttttatatttatgtatgacttataattttgttcttgtattgttgtaaatgtgtgtatgttagaatagtctattattaattcaatcatcacgtagtagatgaaccattggattttcatccaacggaaaaaaaattatagcaacccatagaaaaacaaaactacttgggctgagtaggtttgcttctttttctgtaagataactcagagttccaaaccaacttctaaaaagataaacactcttactaatcaactagcacagtgcccgtgcattgcaacggaacactcaaatttcatgagatgattgtttttgtgatatgagcatttcttcaaaaaatgatgtttctaaacaaaaataataaaaagtcatagttacaactcatccaaaaagaaaccaatccaaatctaaatgccggaactaccttttatgaaagatcagtaaagctaggaaagaaaattactataaccacttcaattgaaagtaggatattcagcatgaattgtttcgtggttgatgccacgccatcagcaaaagccatgaagcaaaatcatcatgctaactcaaacaactcgattagctcaaatcccgagataaatacttgaaagatgaaataaaaaaatataactctattagctcaaatcctgagataaataataaaaatcaaatggaaaaggtagtttcttaatcttggtaacatgaaaattagatagctaagtcggtttattcagtatttttgtaagaaaaaaggggtttattataacgagattgattagctgcagaaaaaaaacaatctatgaaggagtgattgattataagtaaaataatacgggaaaattgtcaagtgaagagctctaacattcgcggacaaagcacaaaacagaccttgaaggttagtgaattgcagggccttgcgaggggtggcaaaaaaataagcgaaaaaaaatgttggtgcgtcggtcattagtttctaattaacctgcggtctgtggtttaggaaattttggtttatatcgtctaggaacgtaaaagactgaaataccagacggtcatgtgcagaaaaagatcaaagtgaaaggaatgaggccgagatagaaagtactgagactgaagaattctgttttaggtattgaaagatcgaattttaagcaattaatttagttagtagccatggttaatcgattgggaaaaaatctctctctttttgcttgctaggagaacattataatttatttgttgaagcgaagtcaacatcgaactattatgagtaggatgtaactaattgtccagcaaattacaaccaccaagcagcagcaggtggcccaaccaaattgcacaaaccagtctaccgaaatctctactattataagaattaaaaatatttatgcctaaaattttcgtatgtcgcatgcatccgatacgaagaagatcagcgtccgtgtttagttcccgtctaatcatccgattggcttgtgcatccgattagtgctgacctgcgcactaattaattatccgtcatcgagcgtgcatcggtttccctaccccgttatatcgttggatcgagcactccaattcagcctaatcaaatattaatttgaggaggtgtggagcgatctggctagaagaaaatcaaaaaggaaaaataaataagatggaagttttgggctggtttgaagttttgggctggtttgattaggtccgttactgatcaagatttgactagatattgcttacagggttgacggatttcttttccgtgacaacacatcctaccgtgcacatcagcacatatgggcgaggtcacagttgatttgaacaaataaatcttaactacttagaaaatttgtaacttttcattcatcacatcaatttttcgtccataagtccaatgaaacgatggcctccattcccacatgcgcgagtaacacatcgcctaaggagaataaagcacaaattcaaaaatagatacaaaatcgaataggacaatctaaagaaagagaaaaagaatagaaaaataataaaagctgcacagatcttatcttaatctttgtcaccaccggatctgcccgtgggaagccgccatcaccatcagatccgcttgttggaagccgtcatcgtcgctggatccgcgccgatgccgccaacactggatccgcccgcaacaagccgccgacattgctgtcgccaccggatccgcccgttgaagccgcgagaggacgttgtcgctcatgatgggggagggccccacctccaccacccgtgctgagtgagggcgctgccaccgttgcacgtggtgggggagtgcaccgccgctcgcgtgggaaagaaggggaatgcatcttgggttaggtttttaacatacaatgttttatctaaatcacaagcgatcctaaccattcgatcgaatccggcgactctcagggcacctacgccgacttgggccatggcctgccatatgggcctaatgcatttaacaagccagccacggtgtgaaagagagatacgggccatccttctaatcatgggcctaattatgttttatttattttcagtggatttaaactattttttcattagtaaacttaatttaagcactactttaagccattaaaaattgctgaaatttgatatagtttttcattcttcatactaaattacttctagctaaatggagtcgacaaaaatgtaattacttatttgtatgatatagaattaggtatagatttaattcattgtttatttacaggagtgtcctatataattcccatgaaactataaaataactataatcattatcataacattagtttttccgttgtaacgcacggacatcttttctagtaaaaaaagagtgaagtacacgggcgatccttaaactcgtacggatgtgacatctatattcctaaactctcaaaataaatttttgggtccccaaacttgttatgagtgtcatataggtccaaacaagctccaacccgctcagtaaaatgatgtggcatgccacggtgacgcttacgtatcagtgggatccacatgtcaatcatatagaagaaaaatttaaaaatagagagagagaggagaaatgatgtttttaattttgaaaaaataaatgaaaaaagagaggagaaaaaatatgttcttaattttttggcaaattttgctacaggacacttcgattttgtggttttagctataggacaccgtccgaactcactcttggggaaaacactccataaacgaggtaatttgccaaacgacactgcgttgattagaataataattttcggttgaagattagagagaaatcacgtgaaatgtcaaaaatgcccttggacccacacatcagttctcctatctctcttctcttctcttctcttctctctctatcttcactccataacgccgccgcgctatgctacccgtcgtcttcgtcatcgtccagccctcccttggcgggagtggagagggcatggaggtggaaggcggggtggttgtggtggcgaagaggcaccgggcggcatcgattgccaaggctcgagctcgtcgcggtggaggagatggcgaggacggcgggagtagcagaggacagcggggaggagagccgcgccttcatcaccaactgcggccactcccgcagcggaggacagcaatgacggcgggagcggccgccgcggtgttcacggcgggggacggcgacgacgtagcagccggagccctcgcgcacgacggcggcggcgaggtcgatcccctcctcgagtgggacgcggtgcgcacgtagcagcctacccaggcggtgacgatggctagcagcttgcggacgtcggcggagggctggacgatgacgaagacgccgacgtaggtcggctcgagcagcgcgtactcgagctcgacgccggtggggtccttggcataggtgaagggtaggcatagacgaggaaaagcgagccggtgcgggcgtggaatcgaggatggggcagagcaatgggaggaggtccttgtggaagtaggccgacgatggcgggtacgacgtggcgagcacaccgaggttgtgtgtggtggtgatgaccacctgcttgtcgagtccgagctgcgcgagtgcttcgtggaggcactacatcgccgggagcagcgaccacgacagcgacgagttgctagcgccgggagccccggctggatgacggaccgaacccacgatgcagcgccgcagggagttgacactgcggcaaggcattcgtcggggacaccgacgacgagctccaccccagtgttggccgggtcggcgtcgtagagccagactcgaccgaccttgagcgacgacagcatcgacgacatggccattcgccgaggcaggttgttgccgacacggtcgtagttgatgcccgagagctgacatggaaggaggaagatagagagagaaaagaagagagatatgagagctgacatgtgggcctaagggtatttttgacatttcacgtgatttttctcttctcttcaaccggaaattattattttaatcggcacggtgtccatgggcaaattaccacgtttatggagtgttttcccccaaaagtgagttcgagcggtgtcccacgactaaaaccacgaagtcgaagtgtcctgtagcaaaatttgcctaattttttctatatgtggctaacatatgggttctattgacatgtacacgccaccatggcatgccacgtcaacacacagagtgggttggaacccgtttggacctttatgatacccgagacaagttgagggatccaaaaattattttgagagtttagaatctaattgacacgtccacccaaatttagagaccgctcgtacgctttactcttagaggaaaaaaaaagaggaaacaggaaatggggaaaaaaaatcccgtagatctcgtcatctacaccacgctattcgtatcgctcgcgtcgctgctcccctctatctaccaccacgccgttcgccgctgcctcatccccacccctaccggtgagctcgggggcgtctaatccggcagc

SEQ ID NO: 49901 - DNA, 4028 bp, Oryza sativa
aagcatgatttgcgtatgcttgggaatgcctaactaataatcaatgcgtggaagctccttgaaatagcagcactgggatatacttcatcaatctctaatagcaacacttggatatatttcatcaatctctctgtttctttcccgaaaaactatttttatattttttgttaattaatgtcgctgtggacttagctgactgcttcttgttataatttatcatgacaaatcagggaacccacacatttgagcaagggccaaaggttcatcttgctgaaaataacgtggtaggcagtgctggtgttggtgatgtctatgaatacagcagggaaatgaccaccatgcaggagttagtagaaaacacttactatgattgtgctcttcgtgatcaaactggcatgtgggtacctccatcggttccaccgatgacaaagcatgaccacgaggagtggcaaaagggctttggtgctaatggtgggtacttcgctgaagaagatttgtgggatatagatgaagaaaacaaggagatgacaatgtgggatgtgcttgctgcgatggtttctgcgggaaaagataaagtattgtctgttgtatcatatgatttcggaaggcaaggcatgtctctgatttcacatttgcttcttgaagaggcttgtaaggataaggctgatacacttgaagatgctagtgttggtctcgaacatgcactccttgaggcagaaccaacagtctggctgcctgacagtgctgctccttcttgcatgctttgtggagctcgttttcatccaataatttgctcccgccatcattgtcgtttctgtggtggactattctgtggtggttgctcaaagggtagaagcttgatgcctccaaaattcagcacttcagaacctcaaagggtttgtgatgtttgtggagtacgtcttgagtgtattcagccttatttgatgaataagatcagccgtgcttgtcagattccaacaaatgatttgacagacctgagcaccttgaggtcgtggttaaacttaccatgggcacgcacgatggaatatgagatatacaaggctgtaaattctatatatggatattttaaggtatggccatcctataattctaatacctgtccgtgttataacttggttgctttgcattcctctaatttttgtctggaactctgtattctcatgtatatcgccccaaaatgtatgttgttatgcttgtttgctttctgacaaatatgtctgcttaactaaaaattgttgactgtctatttttatcaagttcatgactatcaaattggtactaggaaccaactgaacatgcctaaaattccaattcttctgcgcagctgaactttacacaacacaaccgaaatcgcgtttgctataactctagccagctttagtccaccacatacttcatattcaaaaccattgcagcaaggttgataatccaagttcttaatttcctatcaaacctatactcagccaaaccatttttctttcaaagccttttcattagtcattatgttccttttaccattccaggccatggtgagagcttacatgattgttctattctatccacaatgtaaaaaattctggtgtcatgctaacaattattttcacaaaccagcatcacatgaagttttaatttgaacatttattagtgtgagcatttattctggatttcagatgattttgtaggtttaaatcccagcatatcctttgtagttcctgaggaagaaaataagtggtgtggtctgtatagcattttctagaagacccttttgaaattcaaatgaatccattccttttgcctttgacaatgttgagattgcactatggaaatttcaccttctcttttccagctacactaaggctgggttcgtttccaagttttcccaactcacctctctctttttccgtgcgcacgcttttcaaactgataaacggtgtgttttttgcaaaaattctgtacgaaagttgctttaaaaaatcatattactccatttttcaaaaaaaaaagattaatacttaattaatcgtgcgctaatgagttgctccgttttgcgtgcgcgagggattagttcccatccccaagtgccgaacacagccactaaatgctgctatgaagcattgttagctattcagtgttgaccacttcatatattcaattacaacctgttcttaaatttgtgagaccatgataaagttttaagacttttgtccagcttcttgttcgatcagtcattttggaatcagttagaacactaatcgcattttgtgtgcttcaatgcaattttaagttggaagtttgaaaccggagaagtcaatccctgattcgattcttagacaagcaaaaggacttgctataattactgtggtaaatgttggaatgatggtcacatacaaaattggtactggattggttgttgctcgaagggcggatggttcctggtcacctccttctgccatctctacttatggtgttggatatggagttcaggtcattgcaacggctcaagtgttcttgtttcaccaaagacatatgttgaacatatttatttatttatttatttattggccttgcaggctggaggtgagttagccgactacatcattgtcctgaggaatactgatgccatcagaactttcagtggaaatgcacacctgtcagttggggctggcattagtgcttctgctggtcatcttgggcgagtggcagaggctgatttccgtgctggtgatggtggttatgcagcctgttacacatacagttgcagcaaaggtatgattcaaacaactagcagctgaacaaaactgaacttcctttccattttaccattgtccgtgttggcctacagaagtactcttcctttcttcctgatttattcaccagcgcacaaacctgcacatgattaagtttccttgaataccagatagttcagggagtagatgcttggttctttgagtttttaatgaactaaactaatctgggagtgcgacgcattattgattgtgagctccttcacattttactttcttacatgtagttaaaagaaaggtaacttataattgttgataccactaggctggttgcttctgagcagctcttatcttttacctggtgctttttagccaaacagagatgggcagcactgcttggacttgctgtcaagaactagtttttgctacacactataaagtcaaatactgcacacatttgaattttgtgattattgtttagtccttaatttcttcttgccagtcatttttgttcaacataccaacgttgcttaaagacttttaaatatctgtatgatggtttgttgtttagaataacataataaataaaaggagttctggagaactttaaccacgtggccatttccagtagccacttactaattatagcttacaacaaacattcagacaacaagaatctgcatacttgtaattccgtgcagttcaatgaagtgagatcatgatggtttggaattgtagctagccacttcaaagtactacattcagataatttaataaaggataagtccattttacccccctcaactatagcgtttgtctgaaatacaccccttaacttcaaaaccgggtataatacacccctcaattcttaaaaccattgaaatcacacccccccctcctgtcctgaaatatggtggtttcgccaatgtgtggcgctgacgtgtcaatctatgtcagcaaaatatattagaaaataataatgtcccacatgtcagactgattcttcatcttcccttctctctctctcttcccaagccagcagccaccgggttggtcagctcgagcgctgatgccgatgaacgcagcagacagcgcaaagaggagagccacgccgcctggagctccccgacgccgaccttgaagcctcgtcgagctccaccatggaagcagatcgagcgatggcgagctcgccatgcatgcggtgtggttgcgctactgccactggtgctgggtgtagcccgagtccgggtggaagaagaccgt

SEQ ID NO: 49902 - DNA, 1141 bp, Oryza sativa
tgctcttgctggaccttctcgacgcaccagcggcaatggagtttctgtccttgcatggtgtaccggcggcggcggccgcccggagcatcaccgatccatgcaaaccgtccatagtgaaaccgttccaccgtcaagcgtgcatcaccgacggagacaagctgctcgcggcgcgcttcgtcatcttgctgttcgatcaatcaatcaactccagcggtatgcgattgcacagcaaaacgcatcgaaaattaaatgggagcatgcaatttcgatcgatcaattaaatgacgcgatcatcactggcggcaacgagctgctcgccggctacgtgatttgcagatccggagattcccattgattaattgcagaaactaggatagaaaccactcgcggggggggggggggtgtaaactgcgtggtattgaaagttcagggatgtaaaatacccggttttaaactttaagggtgtattttagacgaagtgaagagttgagggggggggggtcaaatggacttatccctttaataaatcaatacatcatactcaggtgcctggggagtaaattattagatataacataaatttaatttgtttatttgaatatttttgtacggagagaagtgagagaaatggctttgcagctttctgactgtgttgcttaataatcaaatctgactaaaagaaatgtaatggttttgaatcaaattaatagcattaaattcatgcgaattcttctgcaaacagtgattgctagaacagctgaggatcatcttcaatgtttcagcatatataaataatataattcagttttattttgaaaatgaaaactggaatgttatgaaatgcatgctgaaattttatatcctgctgggagcttcccccgacggtattctatgtcctagctatagatatgcacatgtatgctcaactcaatttctatctgtaatctctgttccattatttcccttcaccattttctattcttcttctctggcaggggcatttgtgggctgtgcactcaatggaagtgttgtatcaactcgacattcggcgaatgcccaattttatggtggtccaataaaggcatcagaaatccttcttggttcagtgagcaggccagctgctgccgctaccctctacaga

SEQ ID NO: 49903 - DNA, 1083 bp, Oryza sativa
ttgctgtcatagagaccagcattcctctgagaaacttcttcacgctgaacagagcacatgcctggctaatgttttcaagatatctctacagtcttttgttcccatgttggatgaatgcatctcaaaccaactatgctctaattacttgctcttggaagcaaacattggaatgcatgggcctggcatggtatagcagacattctacacaatcatgattcatcctgataataccaaataccagcagatcagatcaactattatagctttctcaacccgtaattgcttgccatggctgatattctgtgcccatatatcgtttccacgcaattacgtccacatagttttcaatccaatctttacagctcaaacgtttcaaacgaacatcggtagcttttagaccaagcgttcatatatacgataaacaacacagtgcgttctccaaaccaccaaatgtgccaacccagctgcacattgaagagaacataaacgccctatctgctcacttgcccacttctcttgaaaagactttgaaaagacaacatagctagcaccctagcaacctgtctatcctcactctttaaccttcttctacctctatccgttctctcagccagacctctctctctctctctccttccatcaagaacacatcctcttttccagcttcacttcctccttcggttcttgcttgtgatctactacattgagcagaagaagaacggctcattgctattgctgctctgatattcatccataccaggtaccacagccaccgcatctcattctccaaactgatttctacacatatattatgctttcctcgcttatcttatcaaataaacataggtacaacaaatcgattagtaaatacaacggcagggaaattagatctgtttatagatagaacagtttccctacatgcacaagccaagcacattcacagccatatttttcttttatttttgcagcaacatggaacacaaccagacagggaggttactaggccaataacacaaccatcgacctatgtgaagaaacggccactagcagcagcaaaattttccaatagaaaggagacgtccc

SEQ ID NO: 49904 - DNA, 5661 bp, Oryza sativa
ataaaacattcatcccattcagaagaacaatactttactaatgtataagatgaataaattcaaaattctttcagtttgatagtacctgatcaaatggatcaggcatcacctgattctcgagaagttcaggggagatgtaattttctcttagagatgaaatgtcaacagatggagcttttccaattctcacacacattgaggtaccgggatatggaggaagatgaagcttatatttgctcacaataggtgggggaacaaatctacccccaagaaaatggtgtggaccggtaaatttttttgcacagagctttggtgcagtcaatgatacctaggcacaccataaatcgcattacaaatgaaatttgcatgttcaaacagcaatatcttatactactatattgattcaaatccagaaagcttctgaaaaggatgctaagttgctaaccagcatatcaggtttaaaccctcctccattgatatctccctcttcaacgtgccaccccgaagggatatcaacagaaacaattgctggtcttttagcagaattatcaatagcactcagtgaaacaagcctgttgataagatcatcaaatggtggtcttggtgttcctgcattgatatttcccaaaagaaaaaaaaaagctaaaataaatgaaagcatcactgagctcaggaacagactcactgaaaacccttttggaacttaaggccttttctcaattcatgtggtacatgaaatgattcttgtgaattaatcctataaattcctgcgttgcaaatgcaatgggggctaactctgggatctgggctcaatccaatccaatttaatccaaatgatagcattggcagcattatcttaatgcacaaatcattcttgctttagtaaaacagtgcagtaaactatgccttagttgttcactcatacaaatctgtcaattgtcccattatcaaaagaaaaaaaaaacttgacatataacaagatcgatacagtatatttaacaaagtctcaaatacaatttgcgacaaaagaactagtaatatattacatgacatcagctgttattcataccacagttgagctacatcaattctcacttgtttcattcctaagttcctgttgataaagagactaccacactacagtctaacagagaatctatggccttactttacaaatcacatcatacagaatattcataaggaataaatatataagtagcaggcactgatcagttccctagtaccagcttcacatcaaaattactatgattatgataagatattggatagcatgcacataccatgaaacgaaaaaccaaacattgcatcaataatgatgtcaaactcctccgataaatttgcaggtaggtcttcaacaggaacgaaagggattgttagtgattcaagctgaaacaaaagagtggctcgaattatattggaaaagaggaagcatttggcacgccaagaaaatggaacaggatatatcagtttacctgagtacaaaggccagaatacagaggcttgggcgtgcgttttggataacatacagaaggcttgtacccaaagtgatgaagatgacgagcagctaccagaccatcaccaccattatttcctggaccacagattactagcacccttgtatgttcacccaacttgtaaacctgtgattttttttggggggtcaatacaataaagtatcactaattaagactcataacagtaacaaacaggtacaagaaggaaatccaaagaaagaaaaatgtgaaccacatgatgacagttccatttttttaggtctgaccagatttcattttctctactcaaagttagtggaattacacaaacccattaaacagttaaatcacttcattgctgtattggctagtccattctttgacagcagacagccaggcacaagatgattagttgcatttctcatcatgttcagcaacaacaggaaacagcatgataatgcggtagtgctgcattccaacctagatgattatatgcatgattttttaaaaaaatcttgaaacaaaactgcagagcacgagtacaccagctacagtaacaaagccaaaaagttgtgcaactcctcgttgctgattagagtcgctaatttacatgcttattaatcaaactaccacgtcttgaagaaacacaatactccagcataatatcaacacattcaggtaaggcagttacgtattgggagcacaaattcctttcgagattcagcgatagtgaatcaattgaacgcgctttgaagatttgttctacttttggaagaccttgcgttatgtcactagatatcgctttctcgtatataaacgtaactaagggggtgtttagatccaccggcaaatttttttgccccgtcacatcgaacgtttgaacacatgtacggagtattaaatattgacaaaaaaaaactaattacacagattgcgtgtaaattgcgagacgaatcttttaagcctaattgtgccatgatctgacaatctggtgctacagtaaacatttgctaatgacggattaattaggcttaataaattcgtctcgcagtttacatgtggattatgtaatttgttttgttattagtctacatttaatacttcaaatgtgtgtctatatatttgatgtggcccagcaatttttttttgccggtggaactaaacacagcctagcctatcccctttgtaaaggttttgtccataatgaccatgaacagttgctcctgtagtggccaaataagtagcaagaaacgattgaaaccgccacagcaaccaaaattgaaaggtactgaaacccatcacacagtaaacatcatcacccaaatcgggggaaacaaagcctctgagcgggtgcctttacctccgcaaccgccgccgcaacgctaagccccgcaagctcctgcacacacacacacaccaaacccaagggatggatgagtcagagaagccgagtggaggccgggggagggagggaggagtaccggaccatgagctggtcgacgctgaagccgagcgggcccatgagctgctcgtcgatctccgccgcctcccgctgcgcgaggtgcgtcacctcctcccccgacgccgacgcggacgccgagacggccagcgacgccatggcccgccgccaccgagggtcctgcgcggcggtgacgagggcggcgcggcggggtggcgggagcgggaggcgagggcgagggctagggctccgggggagagaggaggagtgaggtgggggaggaggggtgggggaggagaggaggaagggcatagcaagggagaagcaggccgcggcggtggattttttgttgttgcggagtgcggagccgccacggtcagcatcgtcgccccagttgcccacccgtctgtctgacactctgactcacctggtcactttgtatgtatggccaggccagctgggtttgcttgcgtggctttagcaaaaccaattgcttgcttggttgttggttgctttcttgctattggattttctttttctttttcaattttttttaaagtacgtacgatctagttgtacaactcatatacaactaaagacatgtaaccatatatcaatcaaaaagagcatattcatatacattgtagttgttgcaactgatgatttgattcactattatgtgagtcaaacggttgggtcgtatgcataataaattcatttttttaatatcattatggtatgactagtgcaatgtttcctttacacgtcatgttatttaaaataataaaatgctaaacaatttttcagaagaaggcaatggtactccaatactaacgtgtgggtctctattatcagtgaattcatgtgtttccgatatttgaacgctcccaactgccttaaccggtttaactctagcgcggttgtctcgctcgtgttcttaccaccactagcgcttcctcgtcttctgcccctacccaagctcttggctcactacgagtctcctctagtctagcacatagtcaaccccctcatcatccatgagctatccctaccctctttgcacgccaccatcaccgctccaactgtacatcattgccaactttctcaaatgcgatgcaatgtcctccaaatcttgtgatgatcctcatgcagctgaatacataggccttgggctacccaagtcatggctcgcggcttgggattcaatctctgctgcaaaagtctattttcccatcatgtaaataatgttcacaacccacgttataataggccatccctggtcgtggcctgatcctaggcccgctccaatcctcatatacctcctatgccccctctccacaccaagtgttgaggtcactctcatgtgttggctgaaactaaggcgaagaatgtagagtcagtggagactactccagctaagacagaggcaacagaggttgagctgatgactataaagacttagactattattgctacccaaagatgaaggtggcttcggtcgatgtggctaatgaaagtgcatgagagtatttatattaacttcacctacctcctttttgaatggttggttgttctctacatgtgaaaccttagggcttgttcggtttagaggaatttcaactcataggaataggaaaagtggatgaatagaaatgtatgcacgcatcaattcataggaatttttccaaaaggtttgagtggataaaattttttctatgtttcctctctacaacttgaatggaaaagaaaaattcctttggtttcctattcctcattcctataagccgaatggcacatgtaggaattaatccttaggatccaaatcctttgtttttccttcaaaccgaataagaccttaattcatgcctttctagacttcttccatgcctagggtttgaaaacagttctaggtccaactcactatacgtacatttctaacactattgcgttttgttcttgcttcatgaaaaaaaaaagtccgaacggtactccctccgttccaggttataagacgttttgactttagtcaaagtcaaagtactataagtttgactaactctatagaaaaaagtagtaatatttataacaccagtatagtttcattaaatctataattgaataaatttttataatatattagtcttgggtgaaaaatattactacttttttctacaaaataaaacaaacatatagcagtttgacttttaccaaagtcaaaacgtcttctaacttgaaacggaaggaatagttaattgctctaggaataagttcatttggtgaccctcaaaagtgattaaaatctaatccgtgaccctaaaccacaaaatcggatatcttgacccccaaactatcaaaaccgatgcaatttgactccctcggcggttttggagggtggtttcgctgacgtgacggtattgacctagtctgtgtgctgacatggcgcttaggtggcatttcaattaaaaagttatacatgggacccgtttgtcattcactcacaattgtggggcccactgacatgtgggtcccacatgccatcttctccctttcttctcccctcccttctctctttctttctctttctcccctacggctgtcggcggggagtgagcggcggtggcggcaggagctagctggagcggcggcggcggcagcccgcgggcggcagcggtgggcggcaacgggagg

SEQ ID NO: 49905 - DNA, 2777 bp, Oryza sativa
cctcacccgcccgccggccctcgtccctcagccgccactcgcaccgccgccggttcccctcggccgcccactgccatgagtcgccgctctcacccgcccgccctcccggcgctgccgccggcccccgcctgccggttacggcgtcgaagacctggtcgacggcggccgagctcgccataccgcgcagcgtgtgcctcccgccgccgccgctgtggtcttctccgtcttcgccgctgtggagctcagcccgggcgccacctccgctcgcaggccaccgcgcctccgccactcgcaggccaccgctcgccgccgtcttcaccgctcgccgccgtctccgcccgccgcgggatagagagagggagcggcggggagagagaaggaactgagggaggggagagagaagggtcacgtgggtcccacaatctatttttggtgtcaatgacaaatggtcccacacatattttttaattctaaatgcttcctaaacgccacgcgtaaaggagacccggtcaataccgccacgtcagcgccacgtcagcgaaaccgccctccaaaaccgccaagggagtcaaattgcaccggttttcatagtttgggggtcaagatatccggttttgtggtttagggtcacggactagatttcaatcacttttgagggtcaccaagtgaacttgttccattgctctaagcagagcaaactctcttaggttgggcgaggtgggccaacttttcctacagtaacaaatgtggccactatacagtgcccggctgctacagtacagtgcagtactaggctgcgttttgcttctgctgttgggctgtgctgctagcttagctttgctcttcttgctgttgggctgggctgagctttgctcttcttgctgttgggctgggctgagctttgctctcttctttttctttttctcaattatttgcggggcgtcgtattctacctatctagctagttctacctctagtgcttcctctttagggattggtgtagagagatttggaagtgagtgcatgagagactaggctagcttttatcttgggcactcaagattggcatcgagctcgtttgtcactgtatttgttactctttgaggttctcctgttcgctagctagtgaggtgtcgctcacgagcgccggtgaagtttgtgaaggattactttgtctctctaaaaggaaaagaggtggcttgagtagataccgagcttgatctttgttgttgctttgtgagattaatttggaattaaagaaacctgactttttggagtccctcaatgaaaacgaaggataatttggaatccgaagttcggtgaaaaatcagttgtcttctcctttatccctcttttcttttgtgcataatcatttgtatcgtgttctaattgttttgtgctagctagctcgctagtttcctgcttctttagttttcatgttgctagttgtagctagtgaattaaagttgtgcttgtgagttgttttcccttcgtgggcttttcctacctaattggaacctccagtgttcttaagcagaacttccagagcctaccggaagttccgactataggaacaaaaaatacagatccctgtcaagtttaggactaccacgagggcatttgggtctctttgcgtgcaaatgtggcttctctctcgttacgatgtcttgtagcaaaatttctcctttttattgcatgaaagaatctagctgggagcactacaggtgagaagattgctgctcatgtaggatttgcctcaatattttattagagaaaaattcatggcagagtttatttacatacagaatatgtggtaatgtggagcaggaagaattgaacaatgcatttaaagaaacttagcctgccaatctgccatgtcattcattggtgaacggtgactttattttatctgaatgatataagctgccatcagagtttactaaaggacatggcagccccatctgttggccttgggtgtggaaggtaaacaacccctgcatcaggattcaacaactcccatctggaagaaataaattgagccattgaaaaaaaaatacagagggtgaattattactgagaataattgtacacatgtactgttaatgaaggtttggaagtttagtgaatacttgtaaccacaagagagatgatggagcatgatggtgagctgcagccttgccagcatgttgccggcgcagatcctctcgccgccaccgaacacctggtacgtgcctggcttcgctgctttctgatcaatcaatgcacttacgattaagttgacaatttatcatcaaaggaagaacatttacttcgatcgagtaataaattatgtacatgaacgaccacatatgtttagttacgttttctttcaaatttaaaaatagttatcgttttgataaagatacggtctccacaaaataagttttcactatttctattgtaatatataaaaagtatcagtaaatatataacattattgaagtacattttaagattaatctatgcatgtgttatatacgtatatcagtaattatttatagtcaaagtttttaagtctagcattgtagcatcaatgttttttttaaaagataattatttgcaacctgaagggagtaaatatatagcagatcggcactcaagtcctcatttataagcaagttttgtgggcttggcccataaaattggtttataagtggggctcctagtttaaataggattactttaaccgatcatctacttgattatagtagtaattaaagaagaatttttaagaaaac

SEQ ID NO: 49906 - DNA, 1093 bp, Oryza sativa
caagtacaccataagtccataactctgcagaccattgctatgtttagttcagcgtaaagtttgaattttggttgaaattagagataatgtgactgaaaagtaaagttgtgtgtgtatgacatgttaatgtgatggaaaaggactgaaagtttggatccaaactttggatctaaacacagcccatgcatctttctgaaagtttatctatcaaaattcaaagcaccagcctgcatggaaacaattcttcccctatctgttttatgaagttctcaacccccaatcagataagtgcctgtatatggtagatgcacacacatagaccattttatttctttgttatatggtagatgcagcacaatccaactatatttttttgggtattttttttttcattttcatgtatagttatgaaccaacttacatcccatctgtcggggttgaagctcaacggatcatcgtaatatttagggtcaacatgtagtgatcggatccacacaattactttccacccctctggtattgtataacctgcttgcatgcatacaattaaacaattttgagtgagaatttacttagtatctcgatcatgggttattctcgataattattcattagtaccattttccctctgctccagaaataattttggtagttttaattttctacagtctacaatacaaaattgtgattattcttgtagtttatataattgctgggtaagagtgcaaacatgctactagtatagattagaaatgatagtgtgaactgtgaagaccacgggtattggcgccacatgtcagtaacacattgatgttattttccactcatgtataattactatttcgattaatttgcccttacatgcaaccaacaaaaaaaaatatcataaaaatgcatattatggaggcgtttgataacacagagatccatttaactttttcttaattatgaccttagttttatgttaatgatgatcaaagtctctaaaaataatcattaaagtataatttattgatatcacctcggtactcgacatctctgagtgccacccggtaaagcatcggagatatgttggccaaccgaattgtttctt

SEQ ID NO: 49907 - DNA, 7015 bp, Oryza sativa
  unsure (1)..(7015): unsure at all n locations
nnnnnnnnnnnnnnnnnnnnnnnnnnnnnnnnnacgcttacgttgcatcagaagtcaagagacaattcaagcctcgaagcccagaaaagaagattcctatagaccccagtgttaggaacttcttcaggggtatgtctgcatctgtcaaggaggccatcaagctatcggactatgagcgaacgctgaagaaagcatcttctagaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaacctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctcttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgtggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgatcatatatatatctatatacatatgatttgcataacatatatatgtataaatacatatatattatgcatgtatatacatataatataatataatatatatatatacatatatatatgtatgcatatatatgtattgaaacatatatatgcatggtttatatatatatataaaccatgcagcaacaggggcatgcaaaaaaaaaaggtcagctcgatttttagtcccggttggtgttaccaaccgggactaaagatcgatctttactcccgtttatttcacccgggactaaagatagcgatctttagtcccggattggtactcccggtttggaaaccgggactaaaggggggttacgaaccgggactacaaagggtttctccaccagtgaatggaccctttaagatacgagagaaaagggaagaactaaaaaatgtctggcagggttttgaatttctaaatatgtgtttttttgccggtgttgacaaaaaaaaccgagaccaccgaaattttggtaatctcggaattttttgaccgattttttttttgttttttaatacattttgactgaatttgaataaattttgatgaaatttacaagtgtttgagaaaaaccaaaaatttcgaggagatttgtgcttgccggtgggggctgaaattttaaaccatggtatgtctggtgggctgaactcgggcgtaaacttagcgagccaaaaacatgggcgaccttcttgagtgacgcgtctgcgccaattagcaatttcgcaattactcacccaaaaccctatatatacacatctagcttctcactactggcaatgcaaccaacacgtacgacacgacgcctacttcacactgatatagcggctatggctgtgcccgtggagatcacacgcagcgagttgctcagaccgtcgccagcgtctgcgtcgggcggcggcgagagggccggccttaccgccttcgaccgcgccgccaccgacggccacatcccggccgtcttcgcgtgaaacgcggcggcggcgccgttcaacgacgatatcacgttaaaattagaagtttggttgaaattgaaacgatgcgctggaaaagttgaaagtttatgtgtgtagaaaagttttgatatgatagaaaagttggtagtttgaaaaaaaaaattggaactaaacactgccatatcgacggccaaatcgattaatttccagacgcgtatgctcatctatacggccggcacgtacgactacgtgtgcacgtgcgtatatactgttcatgctgatccagaccagccacgtacgtatacgtatatacgtagagcgtctcccaaaatcctatactactcaattaaattggcgcgcacgaaggtacataggccaaatctgggctccctgccacccgctggttggtgggccggccgggctcttcctcccgcccaattactcggggggaggctgacaagtcgagcacacgacggccagatgtggcgttcccgcaccgcacgccaacttagtgctaatcatcatgtgtttagtgctaatcacgcttagtaacttttaattggtaaaagtaatcgctacgttgaaagtttcaaactataagttgcaagatttcaaatttagggttgaaagttttaaaatctgatttggaagtagttttatattttgagttgaaagtatcgaaattcgattatatgtattagaagttttaagttttggttttccattaaaaaaatcaagttgaaaggttcaaattttggattttttttttttaaattagaactgaaagatttatctttttagtttgaaagttttaatttgaaagttataactgaaagatttatcttcaaattttaacgctaacaacagcgttggattagggttagggttttttttctttttttgtttcgattttttttctcagtgcgggcggcttaagcacctgcacgggaaaatcggttttcgcgtgcgggtgcgtctcccgcatgcgaaaatcgtgattttcccagacgactgggtgcatgtgggccacccacccgcatgcgaaaatcggctcgcccgcacgggacaatcggtgctgtagtagtgatacagatagaaggttgtgatgtatctagtgagggatattccctccgtttcagattgtaagactttctagcattgctcatattcatttagaagttaatgaatctagacacataaatatgcttagattcattaacatctatataaatgtgggcaatgctagaaagtcttacagtgtgaaacagaggaagtaatttatattgttcactaacacctaatatttttctgggaacgcggtagccaactaaaactcattttagcatcttctcatccatctatccccatgttagatatttttggtgtttgttccgatctatatataaccaccacgaacctaaattattgaggtatataatacgggatcggaatatgtacaacctacagtaaaacataagataatgtgcaaaacaactaatgggatgctttgctacagtgtttaatcagaattataaatttcagtgtcatgatttacgaaacaccttgatacgttgcgagaatctagctgctagcgtcttgattgctccaactctctgtttaaggcagatctgaaaggctgaaacagatgattggtaacataagccatggtggtaagaacaaactgaaaaatatggactatgcaatttcagaatattggtaaaaccataaacaacaaaaagaaatagattttatccaccttcctgacttgtaaaagaaagaactgaagcaagagataagtggacacaaagcatatcattttcagatttgcatcaattgctgatcaaccaaacacaaaccctgattactcatttggagtcatagaaatgccatccaatgaacagtgcaggataagagaatgaaacagggggtgatggccggaccaattaatcgctacaaagcagatcaaactaactcagttacctgatggaaagttttctgcaagcagtgataagataacattctaacaatgtgaaagaaacttcaagtaatcagacgatattaaagaatgcttcataaaagatagaactgattgaccgaagtatcagagccaaagatcatatacaatcagcgcttcatgaattaggggatctagaactgatgaataaatatgggctaccgagcgaagcaaagtgtgcagatatattccatcggttccttgcatcagcgtgttgatgtgacggctcacctggttgcctttatagatgggtgtttttttgttgagtcaaattctattcccatctagtggcaacgattcccagaagaggaagcggaggaggaggaggaggtggtggccgactattcacacaagaggaagcggagagatggaggagaaggcggaacggcgcggggaggagaagcgagcgtggctgagatggcgggcctgcagcgagcacacgcgggatggagaggagaagacggctagagcgcgtgagcgagggatatggggaagcagcgtggcggaggaggggaagtgagcgcatccggggacggcggcgactgtatgcgatgcggaaggtggagaaaccttggaagaggagatttttccctatgcgccattaagaaagatggtgtctgcctctgtgccactaaaaagttcgagccttcttctctaccatcgtcgaactatatcgtgccctccacaccattccgtccgtttttggtcgtaacagtgggtaacggcgctgcgtagtgacttagttgcccttaggcttgagaggccatttgatgaagtttgtttccttctgtgccattcggaagcagccacatgcctgtatttttggcaccaaaggctatactgttggcggcaaaggaagtgttgtttggcacctactgagcccttctcctcctatataaaacacatcagcccttgtacttccaactcctccatcttcatctcattcacctctcttcttctccagccatttcccaagaatctagcagctatggtggtagggtgaagcgggtgctttgccgcaactgccatgtgcttgcaaaccgattcatctcgacaacagaaaagaataacaattgtgcatttcacaagtgcccttatttagcagtttgtgtttcattctctgctcacatattgtctttgggttttttgttattgtttgctcacaatgtgttgatggtttggctttcagattggaggctgtcagtattatcagtggaaggatgaaatgttggacactggagtgcggacacatcttgcccttgctccaattcatgcaggtcacctacaggcagtggcaccacttggtggtttccctactgcagctccacaggctatcatgcaggatcgggctgctggagttgtaggcaatgcacaagtggacattagggtgatgtagcagcttaagtggcttgaaaagatggtctatgtttgcactttcttactttttatgctattttcaagaagtagttgggtgtttgtgtgagtagtcatagataaatggatgtatggaaggatgaatgaatgaatgaaatgaattttcaatgatgaatggtgaaagtgtaaatatccagaatgaatcaacaccaaatgtcagcacataacaacaccaaatgaaacaacataacataactagttgtttcatcacataactagctgtttcatcacatgatagcaccaaatgtcaacaacaaacatgacttagcaaaatacattgctccacataccaacatgccaaagtaagagaccaaaagaagagtgtttcatcacatggcagaagtttttcaccatcacagaataaaagaacagttatgccatagaccaaaagaaccacagatcaaaagaacaagcacattttactgcagcttgagcttctttctcctggtatttctagcagggctgtctaggcttgatgtagtggttacgacttgggctttcttggggtaagcttcctgttgatgcatatcttccttcttggtgaagcctgggacagcacaatctgcagtggctaggtctcttgggtctcctaggtctcctgttgagtggtctcatatagagctaggacttgggccatgctttctcgggccagcccaaggcacgatggcccagcacgagggaaagcatggcccaacatgacacggctatgggccgggctggtacggaccatatttgagctgtgcctgggccgtaagttgtggcacgctaagcggtacggcacggccattgggtcatgcctgggctaacc

SEQ ID NO: 49908 - DNA, 2813 bp, Oryza sativa
cttcattatcttgacaacaatcggtcattaaataagacagtcatagggttcaaactcatgacgtcacacacaggagatgccatggccacgacaatcctagaggtattgagagaattcaatttacaatatagggttgtttccattactcttgacgatgcatcagcaaacacaatggccatgtcgattttggagctggatctacgaagttatgttggaggcttcgttattcatcagagatgcatttgtcacatcatcaatctcatcgttcaaccatgtactaatgtttattaatgatttattgattttagtgtatgcggcatattgcttatttattttaatgtatgcaacctatttgttttgcaggcatgattgttctggagaaattgttaaacaaaatttgccgttatgttcgtatcatagcaggtaacacagtggtcaaagcgaggttccaggactactgtaaagcgaagaagaaacctgcacggatgtttggcattgatgtcaaacataggtggaacacaatgtacctattgttgcgacaattaaaagggtatgaggagttaatttatgttttcatcaattcgatgcatgtcagaatgaaggatatcgatgacgacggtgatggtgagatttttattctcaccgatcaggactgggagatcgctacacatgtgcgtaaatttctgaagcccttttataatgctacagttcaattatcaggaatttactatcctacagcttgtttggtgcttaagtggatttggaagctggcacttgtttttgatgaaaaccagtctgatcgtattctgtcttccattgttaaacccatgaaataaaaatttctcaaatacttcaccggtatacctcacctttattgctttgctttgatacttgatcctcgcaaaaagttggaaatcaccaaggttgccatgaactcaataggtgatacagtggggcttgattattctgaagcttttcaacatgtcaatgatgagctctatagggttttccgtctgtaccgaaccaagcttggtggtactccccgagttcctgagcagacctcacaaaagaaagcaagcaagtcaagtgcagtaaatttgtgaaagcagtatataggcaacgaccaagcctctccatcctcagagaaaaaatcaacatggaacccgatttagagcttaaccactacctcatcacaatcatactgagcatgatccgacgcttgatggcgacggtgtcgatctccttgggtggtggaaagagaaagagcgaactcttccagtgttagcccactttgctcaagatattcttctggttccggcctcctccgtctcttccgagcaagcattcaacgttactggaagaattattgaagaacgaaggtcatgcctgacacctgagacggttgagttaatcttttgacttaaagactagatggaagcagatgaacgaacgcaacactgtctacatgatcaagagcttgccgatgcaatggaagacgcattggcggaaatttgccttaccaaagatgatggtggtgttgatccggagtaattgatgctataatgtaaaatagttgttgtactcttttttccttacgagggaaccatactctagggcgtaaggtttttaacgaggcaacaactgtctatgttcaacagctggaaaaatttgactaactccattcgactgcctgcccacaaatatgtgttgaatgtcaggccatctagggtacctattgcttccttcaatctctccataaactagactcagttctcattggtctctgagttagtcacaacaatagctactggatacatccagttgtgcccatctactgcacaagctatggacaactgccccctaaacctccctattaaaaaagactatctagtgcaagatatggtcaacatcctctaagaaatccatcaacacatgctttcagtgcgaagaatagcctattaaatctaatcttcttgtttatggtgtgatgatcaataacaagaaataatccaggacttgattcttctaactgggccttaagcctatacaggttattgaaactcttgtcccagggcccataaatcttatccatgacaagatatttacctttgtacactcttatagggcaccacaactttatagtgttccttcaacctcctccgcagttctgttgcgtcaatattttcatcttccttcggcccatcaaggacctgactgcacacctagaattgagttacccccacacatattccttgcctcctagtgctcagacatgtatgaggttttggaactcttttcacctagaaaccagtcaagcaattcacaagttagaatccacaaaattgaatgaaaactggtagcaatcaaataaaataatttagtaacacatcacctaaatagtgtgtccatcctttcctgttgaggcatgaagtctccgcaggcagccatcattcttttgtgcgcaattcaccctgtatctccctgtatcattcttctcaatgtcatagttgtactcatgtttaacagcatggctagctaaagcaatcttaaaagaatccatatatgaataaacagttcctactgacataggagggtccttcttatcataaaaagcatcaagcatattttctggctccctgtctttaatttcatcatcaatgtcttctacttcattatcagatgattcataataaaagtcagtctcatggcattcatcatcactagaactgtcacattccctttcttcactcccaccttggttctaaggattagaaggagtaggggtatagttgggctccatatcaatgtacaga

SEQ ID NO: 49909 - DNA, 1312 bp, Oryza sativa
gctattgtctgagtacatcctacagatgaacaaggagcacgtaatcattaaaccctaacacggatcggtagcgctgggcactaaacatcaatatatcaagggaggcaacaaaggtggcctaagactgagaaatcaaaggggacagcagagaactcacccatccagaaaccaatccgggcgctcgccagcgccattccacgccatgcctgctcctcctcgttcctttcgatgcaagatcagatccacgctcccatgctccttcccgttgccgctaaggtttcaccgccgctagagtttcgccgccgcggagagaggggaatcgagggagaacagagagtgacactgagggggatgacgataagcaccggtcaacaggggttccaatatgccagcgactgaaagggcaagagtgacatttttcctgcctaggccgacatgtcagagctgccaaacggataatcccaaacagaatagcgacggaatagtgtggagttcatgataaagttcgacgatggcagagagggaggctcgaacattttagtagcacagatgcagacaccatctttcttaatggcacacagggaaaaacctctaggatatgggctgtgttgggcttagcttcaagcgctagaaataaacgggtgacgtggcttaacctcagcccaggaaaatccttagggtgtgtttgggattgggaaagggaaatggatgaatggctaagtttaaatgaggtgtgaaaaatggatggctaggatacaatattaccctttgaagggtgggatattatttctctatctcatttgccaaacaaaacctaataactacactaagtggggatcacttgtatagtattataggattagtttcctaattatcacggctcaagcgcaagaaagacacgcacctatggccacaactaaaactacaccaccatcagtctacaattttacaattttagtaggaaagtggaactgatatgtgtaaactcaaactcaaacgcatacacatatacatctatcacggcagccatgcatcattagcaaactgataatggtttcttaggatacacatacacatatactccctccgtcctattttaagtgcagccatgcttttccgtgctcaactttgatcgcccgtcttatttgaaattttctttaaaaaaattaaaaacataagtcacgtataaagtattattcacgttttaccatctcataacaacagaaatactaattataaaaaaatttaaataagacggacgatcaaagttgggcacgaaaactcatggttacacttaaaatttgacggaggg

SEQ ID NO: 49910 - DNA, 7383 bp, Oryza sativa
tcctgcagccccctcctgttgttcaccgtcttatgtcgaatttgtgtatttcgggaaatattagaacaaacacacgaaactttaatttttaaaccattgttcaaaataagcgatcagtaaccatggatgtgtagagctcgttgagtagtataaagtagactaggtaatcgaagtccgaatgaagtctcgatgtggaccgttagatctcttttctagtaactacctgcttcactaaacatactagtacataataaaccatacacgttttagtttattagctgattgtagtgggtcaacgtgatgacggagtagatctactaggtatctctagctagacaaaatatatgcaattaataataatgataattaactagcgcgtattcgagtgatgacttgtcgacttaaattatatttatatctcataaaaaaaacttttcatactagaacttcttttatttgttcaaattcgttgggaaaaaaatgaaggaattcctcaagtaaccataaatgatcataaaacactatttgttcaaattaaggttgaaaacggggcgggtatttccagccctcccgcccggccatattatttcgggacaaattcgggtacccgcgacttttcacgaatatcgggttcgaatacgggtcttttttggcggatatgagattgggttcgggaacatggtatccgacggatacgggttgtccggtaaaaaatcagggtattacccggataattatacggatattacccgtattatgtttttgcgaggtactttttggtaccatgtattagttctactatgatgtattgtagcctatttatttcctaaggtcctaatggcctaatataatcgtattatggatatatagaattgttaaatggttattgtctatgtgatatataagattgttgcttcgacatgatatcctaataaatattcgtaaccgatagtgcacgtatctattttggtacgtattcgtttcgtatttttgcccgatattatccaagtttgtatctgtattcggcactatccgtatccgacccgattccgattataaaatatgggttaaggtatgggaagggtgagatccgaccgaacccgacccgttttcacacctagttcaaattcattgggaaaaaaatgaaggaattcctcaagtaaccacaaatgatcgtaaaacacgaagtgagcgtaactcacctgtcaattagattccttgggtgaaaccaacccatccggattcaaattctagatttaatatggatgatcgtatttacggctaattattatttcattggtaggcgatgtactccacgatagcgaggcgtcatggtaacttcgtcaatcacaaaatataaaatgtaccggcacagtcttacgatgtgctcatgttagtaagatgcgcacgtgttgtgatcgcttacgattgactgtgtttctttaaaaaaaatcataaaacaaatgcatgcgcacatatttttgaataaatcggcggggaaggggtgccaaattgatacaacgcgttatttacgcactgattaggtcttcgtgatttgctccggtcagctcgctttgctagttgctcgtgcaaaatagtccacgtgcacgtctcttctttgattttctggaagaaagtgacgcctttgggatttccatgtgtctaaaaagctttcgcgaacgctttgacctatttctcatatggcacagggatgatatgatggtgacatataaatagtgatgtactttcttcatactccctcctccctgaaaaactactttcgggtttatatgcaaacccaaaagtaggttttttttgacggaaaaagtatttatataaatatgtgcactggcatagaaaacattcattcgtaagttatatataagttttatataagttacagtgtaatctctcgaaaaaaattacaatataattatatcacgattatattataattatatctgacaatttttttatgataaatgtatagatatataatccccgtattagtatctaaccgatagaagggtagtttagtaacgatgtcgggttcggaatcctacatgtggcctgccagttcagaatccagcaggaaatgccattcgtgtacttgtgatgatattgttgaattcaatcggtctttgaccgtaacttcgactattgttttatattaaaacatattgataatatgtataaccagattataattagtattgtaaaatttctgatacagaaaaatcttctcatatgtattttattttttcaaagtcaatatctggacaactattaataatcaaaattttaaaaagtttggtcaaataaaatcgatattttcatgtatttaaatacagagaaagtatctcacaccgttaatattccaaaatatgctctcagtaagtagtattacgaagagatttaatttggagggagataattaaactacaaaagtttcttacaattttttccttgtttttaacactactacgttaaaataactatagattttctagctagaaaagaaaatcaacgacgtaattaattaaaaccacgtatcagtatgtactactctatccgtattttatattttaatgtatgacgctattgattttttatcaacgtttgatcgttcgtcttattcaaagtttttatacaaatataaaaatatttatgtcatgtttaagagcatttgatgataaatcaagtcataataaaataaatgataattatataatttttttagtaagacgaataattaaacgtcgataaaagtttacggcgtcatacgttaaagttaaagtatagacaaagtatatcacaattcgaatggaaggtatgaacttaactggaaccacatattttggatgtgcgacgcgatgcatcgaacctgttttacttgttagattttcctcgtagggggttggtgaatggtggtgacgtgtatgtttttttccatagtcaaggtctaaactcttggagcgaaaacgtcacaaaagtcaggcgagtcgagtcgacggcatgcgtacgtgtgttccgccgtccatcatccgtccttgtgacgtcgacgtctgcttgctctttgcatccgattctactgggtccgtattatgctggaagtgccagccatatataatttgtacgaaagtatgtatatgtatgcagtgacggacatgtgataaatagtacttccctccgttttaggttagaagatgtttttgactttgaacaaagttaaactgctttaagtttgaccaagtttatagaaaaaatagtaatatattttatacaagataaatttattataaaaacatatttaagtattaatttaataaaactaatttggtaatgtaaatattactatatttgtctataaacttaatcaaatttaaagaattttaattcttataacctgaaacggagggagtaccaggattattacatactgctccctccgttataacctgaaacggagggagtgccaggattattacatactgctccctccgtttttgaatttatttttatagttatttaattttgagcaaatttatataaaaatataataatattttcaacacataacaaatatattatcaaaatatattcacggttagatttaataaaattaatttgatattttagatgttgctaattttttctattaatttgatcaaatttaaaaaaagtttgactagaaaaaaagttaaatgacttgtaatatgaaacggaggaaatattattaactagaaccctaattattatagcctaatacatgtaaaaattggataagctatctaatgtgtccggtgcaccaggataggtagctaccctatcctagggcggtacatattcccgtatgtacgtgtgtgtatacatgtaatataatcagtgataaagcccggaaaattttgaagtccataaatattttttaaaaaaatgtaaaacagcagatgctctgccgaatacatcaaacaaggagaaaaatccactagaagcgaaagcccagagtttcagatcacaagtgaaaacacctcataaaatggttgtttgaggggctacatgcgaagaaaaaccaaagatgcaagcaaagaaaacactcggctatagcctatagtaggtactccatcaccagataagcgcgattttggtggagattttggaagacttcggcgactcgagcactgctcaatggtgtgacagactgaaatacaaacaccctagattgctgggcaaatattacgccaggtggaccaatcagaaaccgcggcagtgcctaaaggtctcgttcctcccaactccataaaaatctaacagtcacgaaagaagaaagtgtgtaactataatattatactccctccgtattttaatatatgacaccgttgactttttgaccaacgtttgaccattcgttttattcaaaaattttgtgcaaatataaaaatatttatgtcatgtttaaagaacatttgatgacgaatcaagtcataataaaataaatgataattacataaattttttgaataagacgaatggttaaacgttgaacaaaaagtcaacggcgtcataaggtagtacgatttttagaagatcaatatatctattaaatatcaaagggacgcatggtaaattcgttggaaatccacaaaattaagctctcctaatggctcttgcgttcaccacggtgaaaggggtagttgaatgaggactcaaaagtagctagcgagccagagttgacaggacgatatcgtaagaaaatttgtgcataacatcgttcaacatttatgagttggaagcttgcagcccaaactaaattttacaagttgtgcatgactatggacctgtttgggggagctttagattctgagaagcagctgtttggtagccagtttctgagaatctggaaaagctctaaaacccagcttctccagcttctggtttcttatcatttttcagaaactgtaactatagattctcagaagctgtgaattatttggggcagcttctagcagaagcagcttttgcgaaaagctgcagctggataagctcccccaaacaggacctatatggccctggcactcgaggtcctggtgggtctcccttggccccggaatggccctttcatgaccaacatccaaagcagaataattaattatttgctacttttacgagagtggtgataaaggatttaccactagatctacatgccacaaacacataagggttcacatgtcatagatagcgagtggaaaaaaattaatttccacatcttaaaagtggcaaaaagttaaatatccctctaaagcacccctacttaatatatgcaaaattcacgaaattcttaaactcttgtagcacaagtttggatccacaggcaacgaataatgcatctcaacaaatttctaccaactactaagtatcataaagctgcaaaaagttattgtgaagcacttcatctcaccaatattttccgcggcaatgtgtgttaaaattaaggcacaaatcttatagggttaatttgatccgtgccactgtaaatgtgtctattcagataaatgctattataattcatctattcatagccatgccactcaaattttacaaaattagaatcatgctatcgccgtcacgttttccatcctcttcctcaatcacatgtgacccacccgtcagattatcttcttcacatgcggcgccgagccaagagtgcacaatgctggtggctactttggtggacggagtgggttggttgggtagagttatggaggctgagaagtggtggaaagagatgagaaaaaagagaagaggggaggatgggggaagaagatgaatctgatgggtgggtcccacatgtagatggggaagaggatagaaaacgtgacagcgatggcatggttctaattttataaaattcgagtagcacggctacgaatagacgaattgtaatggtatttatttaaatagacacatttgcaatggcatggataaaattaaccatttgaagtaactccggaaacatcttaatatcggttgataataccaactggtactaaaaatatctttagtatgggttggtgttacaaaccggtataaaaaagcatctttagtaccggttggtaacattatccaggactaaagattcaccagcattagtctcgattggtgctatcaactggtactaaagatgcatttttaataccggttgataacaccaatcaagattaaagatgttcctagagacttggaattttagaaccggtactaaagagctttagtaccggttctaaagagctttatcaccggttcttaatctatgcaagatatttgtgtgtttggggtattggataaaagataagttctctagtagtggtatatctctcttatttgtggatggcgcgagaccgggtatttgtggatgacaccagaccgggtgaaaggatacctcctagcgcgtactatgaggcccgtaattattacaaactttacaaatggctttatccgattttttaaaaatattatatgaaagtttttgcaaaaaatacaaaacaaaaaagttcggagttaaagaaaagaatacagcctaaggcccattttttttcttaacttcaaacttcaacttcctcattttccgttaacacgttttttgaactattaaatggtgtattttgacaaaatgtttctatgtagtagttgtttaagaaaatcaaatatgtgctaatcagttttctcgtttagcattgtcttctgtagttcactttgacgtgttggtgtaggatcaatcggttgacgagagcgttgtctaacttcttgagagggatgcttcccacctgcttctacttgcacctttgctttagcaatgatggtatgtgcggcatcaagttgtgccccatcagcagccaactcaattaccgtgttgacacctgcaatcctgacatcaaagatcatcgagtcctgtgatgtggttacctctgtctcctcctgattcaccattggagcagcatctcttgtgctaattgacgaggacaccaagtcctgagttgcatcgactagcaaagttggagcatacgcagccactagcccaccttgtccgactccatctcctgagctgcattgtctatgacaatactccctctgtccttaaatataagggattttagttggatgtgacgtattctagtactacgaatctggacaaggagtatgtctagattcatagtactagaatacgtcccttccacccaaaatcccttatattttgggacggagggagtaggattcagcagtcaaggacaaagttgcagcctctacttgtgttgatgatgctcccatcgaggcctccgagattgatgcacaacttgccggttccatctcgctcacatctgtcaattg

SEQ ID NO: 49911 - DNA, 4784 bp, Oryza sativa
ttcctgcagcccctcctccaagctagatagcagccatgctatccgccaccacagccaaagtcaaagcagccacaacctcttcatttgcagccaaggtcaccatgttctgtctgatagctaggatctccattgagattttttctggagccctgttcatcaccgttttcgagttgaaagccacgcacattgctgtcaagacctccttagtttgctgctctattgcggtatcatcaacaacagtgagcaacccagtgttccctgaaacacaacattaattaagctataagtctgtagctgaacctcctcttaatgacatagaggatgaccccactccatttttcagtcggtttgggtcccgatctcccataatgacatcatcatcattcctcttttgttcactgtaatcacactgattatcttcgagagaaggccaatggaggcaattgtttagtggcttggaaaagagtgtgccgtcctctcatgtatcttgggatcttgaatttggagtatatgaattggtgtcacatcctgatttttgtttcaggatttataaattatttaataaattattattagaatttatattaaatgttcattaatttacaagtgaagttaaatgtgggaaataaaattttctaaatataaagcatggatgtatttaatttttattaaattgtccatggttaattatactctctggaattttctcagatttttcggagctcaattcctaattttaatcatacaaagagcatttcagtaattacccacatattaaattaatcattaaatggtctaattataatttttttaagtactttgagtgtccaattattttcaggatttttcttgaaattatttgagcattggaagtatttttaacaattcaaagatcatttaagtgattattttaattggaaaagtaataataatcctcttcctagtcttgggccctttccggcccatctccctcttttgtgtgcacggccgtgcagccctagtcggcccagccgagtttcccccttctctttctttctttgctttgttttcagccagcccaagacgaaaagtctaatttgcctccctcgacactgtttatcttctacctctagcagccgaactgagaccgatttggctcggtttttctcctccaaatctgacctttccccttgtgtttttctaaaattagttgaggcgaaatattcctcttatcctcctctatctttacccccaaaaaatcggagctaatcgttgagtatctcatccgaatcgaactcgttttcgagtttatctccaaaaccgagtttttgatttccccgatcgatttcttgcgggaggagtccgatctcttcaatccaaggctataaaaaggaccccctagtcctcctctttcgtttgccccctctcccgtgatcttccgtgcctcgtagcgccgccgccacgtgctccaccccgccgtcgtcgccggccgagctccatccgcgtcgcgccgtcgcctccgtcgtcgccgccggtcgccgtcaccgccgtaaggtgcgcgggagggtggagaagcccgccgcctgacccccgaagccgctgatcaccggagccccgtcgccgccgtcgaccgaagccgcgccgccgctagaccccgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggccattgatgaggtcatcatgacgtcatcatcgtttttctttttcctgtttttctaatagattaaatcttcagaaattcataactaaatcatcttagctcggatttagttggttcaagtctctaaatttttctaaaattgagatgtacatgttaaaaatatccacatgtactgttcatgcttgtttatgtgctgttttggtgtttttgctcttttctgtttagattccgacgtttccggagagtccgttttcgcaggagaagaatttgaagagttccaaggccagcaaggcaagtcacacagatcccaaacaaccctttgagcatgttgaacctgtttaaagctattgatttatttcaacttatgcattgttttcgaatgtcattgggtggtgagcctttcccctttaattatggccgaagatgactttattttcctatgggttataatttgactagcatggaccttatatattggattggttcagctagatgttatttatagttgcttagccatgcttagaaacaatagctcactaatgggataaatcatgcttcactatcacttatggatatttaatggaagttcacgacggttgatcgtgattggttaattaattacttgtcaactaaaacctgataatggtgggttgtgagcacatggttttgatggtcgtgctcatgacaattaaggaccggttcatgagtttcggatgtgaaacatttaccgtgccaaccacaagccagcgtgggcaacggctttaccttttgtatagcatggttcattgcggggcacccgactgagaagtggcggagataagcccacgggggtcgctggggagtctatgcctctggtttttgagggggtgattatgatccaggaatggtgcgctgcagtggattgtgttatgcaaggggtaatgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcggattgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattaggctatcctttggtatccttgtgcacttgcatatttgttgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtaccttggctgattcctggacgaggattttatgcacaaataagttcggaaattactagtgaatttccgggcgtgacaattggacacttcgaatcaggtggctttggttccaaaagacagatagcactcgtgcttggcagggaatgcctgtgcaagttcctcgcatggcacctaaactttttaaaatggcaatgttttcccatgggggtatggactctccactctctttgggacaaacagatgtcttgagggaaagtctatcacggaaatagctccaaaccttttttagttgattgctaaaaggtggtaaagaacttggtcaaccaaaaatgggtctcggacatcaaagagcctttgacagttatggttattacggaatatctccatgtttggatagcattgcaaggggtaatcttgtatgaggagctagatcatcgccaatagaagcatattggatctggtgtttacacttctaaatcagcttatgcatctctttttgttgggaccatccggtttgccccatggagaaggaattggaataattgggggctatacaagctttttatgtgacttgcggtttacaatagatgttggacagccgaccgccttgccaagtgaggcttgcctcatccagcggcttgccccctttgtgaccaagatgatgaatccatacaacatatttcggtcaatttgtgttcagtagtcaagtttggacttcgattttggaaaggcttggtttatattccacacttcccgatcataactctagagttttctctagttggtggtcaagagcagcgaaaggccggttgagaaaaaatgggctcaacttgatgattattttggtcgcttgggagatttggaaacatagaaatgattgtgttttcaatggagttgtccctaatgtggaagttgtcctccaagctgtcgctagcgagggcgccctttagtgttcggcaggggcatcaagactagtgagttttccgctatggcaataatgctagctccgtagagaggttgacgtgagcatgtgtttgtgtttttttagttttggtgttgtctattgtaagatcttgtgggggttaaacccgccacttttcttaatttgtctcttaatgaaatgatatacagatctcttgtgtattcggggaaaaaaaacactgatcatcttcatctatcttttcatttccgattcctcctcgggcatttccaattcaaagaaaacctcatagctatggatgactacctcagttctaaagtgtaatgacttttaactatgtaaaaaaataaagatatgttcggatacagaattagaaattgttttattttgagatgggatagtatttagtttattggttataatctagtttcatttctttatcgacttctctttttttaatgtcctctaaatattcaatgctactgctggtgcg

SEQ ID NO: 49912 - DNA, 3643 bp, Oryza sativa
catagtgaagcgcaagaagaatggagacggggatttcaatttgccaactttttcataaaaataaaataaaattatgggatttatgagaaacttgatagggttttaatgtccacagagtgggaacaaaaatttcctctgtcttctgtggtggctcttaatagggatatttctgtcttatgtggtggctcttaatagggatatttctgatcatactcctttactgttgaatacaaattcctcatctctcagtaatactcaatagagttttaagtttgaacttggttggctattacgagatggttttgttcatatggtgaaagaaatttggtcttgtgttgacgaaggcaatactgctatggagcggtggctggcaaaaattcgtcggttgcgacaacatcttaggggttggtcaaaacatactagtggagtttataaaaagaaaagaaagaaattttagataagttagatttgctagataaaaaggctgaaacttctcttttgagtccggaagaattggatattagatggttttacaggaacagattatcatctattttgagagaggaggaaattaaatggtatcagagggctaaatcaaaagacatcttagagggtgattctaacacaaaggattttcatttagttgcgaatggtaaacataggaaaactagaatttttcagttacaggatggtgaccatttgatacatggtgatgcaaatttaaaatcgcatattactacttattataagggtctttttggtctacctaaggaatctcaacttcaattgatgagagtaaagttgctgatattcctcaagtttctcatatagagaatgaggctttaatacaggaatttactgaaacagagattaaggaggctatctttcagatggagcacaataaagccccggatcccgatggttttcctgctgaattttgtcaagttttctggagtgttattaaaaatgatttacttgacttgtttaaagagtttcataatggttctttacctttattctcgcttaactttggtaccatcattcttttacctaagtatgtagaggccatgaaaattcaacaatataggcttatatgcttacttaatgttagtttcaatttttttaccaaagttgccacaaatagaataatgtgtgttgcccaaaaggtcattagtcctactcaaactgcttttattcctgggagaaatatcatggaaggtgtggttattttgcatgagactttacatgagttatcgtaaaaataatagtggtgttatcttaaagattgactttgagaaagcttatgataaggttaaatggccctttgttcaatagactttgcggatgaagggcttctctcctaaatggtgtgagtggatagcctcttatatccaaggaggtcatattggtattaaagtcaatgatcaaattgacgataattttcaaacttataaaggctttggacaaggatgacccgttatctccaattctttttaatatagtagctaatatgttagctttgctaattaaagggctaaagagaatggttctcttaatgggggtaattcctcatcttgtggctgatggtttgtctatcttgcaatatgcatgatactatcattttcttggagcatgacttacaacaagcaaagaacttgaaattgattttatctgtatttgaaaaattatctggcctgaaaataaattttcacaaaagtgagttattttgttttaggcaggcaaaagagtgctttgatcaatattcgtctatatttggttaagctaggctcctttcatgttggatatcttggtattccaatgcattttaggaagttgagtaataatgattggatggttattgaacaaagaatagagagaaaactgagtagttggaaaggtaaacatatgtctgttggaggtagattggttttgatcaattgtgtactttcaagtttagctatgttcatgatttctttctttgagattccaaaaagggttcttcaaaagattgattattatagatcacgtttcttttggcaaggggatgaccataagaaaaaaatatagattaactagatgggatataatttgtcaacccaaagaccagggtggattgggtgttcatataagttaattaatgaggatggtgtttggcaagatttattgaagagaaagtatcttcataacccaagtggataggaaacaaggtggttttcatttttggttagggcttatgaaggtaaaaaacacattcttaaatatgggctcttggattgtgaatgatggtcaacagataagattctgggaggataaatggctaggaaatatggcctttacggataagtatctatctttatatgctattgttaggaggaagagtgcccctattgctagtgttatgggctctgtcccgctaaatgtttcttttaggagagctttagttgggcagaatctaacaatttggcatgatttgtgtgcttctattgctcatatccagttggatgatactggtgattgttttagatggaattatcatcagaatagccagttttcggtaagatcaatgtacttagctttaattagtaatggttacattgatagaaataagttcatttggaagcttaagatgccgcttaagattaagaactttatgtggtactgctcaaaggagtcgtcttaactaaggataatctaacgcgacggaattggaatgggtgtttaagatgttgtttttgcatgaaaaataagacgattcaacacttgtttatggattgccattatgcaaagtttatttggagagctgctcggttttcttttggattacaccctcctagaagcatacctcatatgtttgacggttggcttcagggtgtggataaagaaaagagaaaattgatacttgttggtacatctgccttatgttgagccctgtggtcgtgtagaaatgatagggtttttgacaaaacgccatctgtttctgtaacatcctgaaaatttacaattttctaatcctgcatcatgccacttcttatgtttttaataatttcctaaacctaggaaaatataattagtgggacctcctaaaactaacttgcataaaatccctctatggtatttaacttcttttgtgtttttcatttaaagatatatttggttaaattaaggtgtttcttgatttggttttaaattaaaaccttctttcgacaaaattcctcttattcaaatttagttgaaaacccttttcatttgtatgaattatggtccaagaaaaccctccaaaccaactctttgtaattccgattttaattggaattaattgtcgacccatcctttgattccaaacctatccttagttcccttgacaaatctcaagtatccaaattcctcctttcaatctagccgccaatttaattcccatggcttgattcctcctcggcacaagaagatatatttcatccttccatcccaaatccaaaacctcatttagcccataattaattctagatttcctaccacatattttgggctaaaattttatttattccattccctccattttcctcccacattcccaattatatatctctctcccccatttgagtgcatctatataaattcaactacattccacttccaaaaatat

SEQ ID NO: 49913 - DNA, 2468 bp, Oryza sativa
tggccgagtagacgaccgcctccacaaccgccttcggcaaccgacctccgcggcctataaatagacgatgaggtcgccccttttcccctccacaccatccgagctcttcgagctctgtctttctctctctcttcctcaagaccggctgccgccaccgtcggccgatctctctcaccggagcaccactaaccaaatcctctcaccaccaacattgccttactccggcgaatccatttttccacttttccccttctctttcgtcccatttcaagccccaccggagctctctctctcctgccggttcacggtcttgagctcgtcgttccggccattcccttaaccccctctgccggccactaccttacctaggtgtgctgtacccgggaacaccaccggccgtcggcgtcgccgccttccgattactggagccccgacgcccctctcctcctcctctctgttcgaccggagagaagaagaaggaagagacgggaagaagaagaagaagaagagaaagaaaaagaaaaagaaaagcctgacaggtgggtcccctgtacagtgacttttctcattttctctatttaattcaaatcccaaactttagaagcccatgtctcctaaaccgtagatccgattccagtcaaacttggacctaaagtcatctaaattcaaaatctatattttgataccaaatttgctattttaagattttatttagatttccttaagttatttaaatgtcatttgcttttcaaatatctccttttattttaaaataccctttagccactaaaaagccgccggttggaactttacaccttccatggggacgttcgcgtggtctacggaccccaacgtcgaaccgttggttgtaaagctcggcataaaccaaacccaagattgaagtgctgctcctggcaccctacgcctcactgcgtacaatggtcggagcttgactatttcctcgacctccacagcacgctacacagttcgctctcaagctctgtgtgattctagccgctccaccgccactcacggttgtcggagtaacacttccaccccactaaacctgcacccacctcctatctttctacccgatatgatgtctatcgacaccagctagaaatgataccaaatctagtcgctatactatccaactctagcgatgactagcaaacacccaaacccctaaccgatatttatcctacctcaatattcgcctaaacaactaaactctagctaacaccttgttggttaaaacccaaccgtcatccaaataccccacctaccaatatcgcctatccattatactcagccacctactctcctagaacctatacagagcctaaccgatatgcttccctactccgtagtcggcttaaatataaccaaaccctaggtattatactacccgaacctaccaccaaccaatactagccatattccaactgaaccagttcaattatccaatatacatcctatccttttagcaaccaagcattcacatgaaatataagcaaccttagttgcctgatcccctctccaccttagccttcaaccctttagaaccctatacccctttaacggagatatttataccccaagcctagccattcttgctctttatcactttcttactatttcatgatttttattgaatttggttcttcgtctttcttagtagagtctattttattttggatggcaacctgtggtatttcgaggatcggataatcaggttgcctatctcggatttgtttgcgttggagcaagggaagttattattccctccctttgagcataatgatcctatattcttatatctctattctatgtattagtcatacatgatttcaaatgcataacttgaacatatagcaaactagatatatgctagcttttgcttagctctgcctagttagactgcataaaatataatgaacttagattgggacagtacggtagaaatagttgatttccgggtggctagtactgttccaaccgacataagactgccaagtacatgtgaagaacatatgagtacgaccgcaattctcgtatgggcatggacctagctgattaagttatctagcaaaggtggtacctctgtatagtggttcttcttaagtcctcgcacaggaggcaaatttatgccgcgaagggcaatattgtgatatttaccgaggcgcaggtaaatatttatttgagataaatcatgatcatgaattgtttgtgaaccctaattgcgaagacatggtgtcatacaatcagttctctctaaagatctcgggaatgccagaactcctctcgctgctgataacgctacgttcagagcgcatggggactagagttcatggaacaggtaccactgatgttagtaactgaaaagctttgccatgataaggctaatgtgtttggcacgtcatggattgcaggtaaagcgtacatctactgcagtatgaatattatta

SEQ ID NO: 49914 - DNA, 7613 bp, Oryza sativa
attagatagatggtttaagtctatagcaaaacagcaaagttagtctattccaaagcttttgcgcactagttagccacaatcttgtaaataccctattactttatgtaataatatctccttcaaagctatgtctaaatgtatgtaaagacgatccagattattgaaattgtatcaatctactgatctagggcttgatacaattttaatatgtcggttaccgaatcattagttttgggacccgacagtttcctatatgtaggtaattttcagggcaacatattggcttcgacagtgggttcaactacaaaagtatgaggaagatggagttttcctgaatgttgcatgtcgtaatcttgaaacaatggttatgcaacttttcgccaactatggatggagattcaccaatagactggaatattgttttccttgtcatgttaggtcttctttaaattttggttggttggcttgctttattttggactacgtctttttaagtttgctactttttgtaataattagctgtagctcttcggaataaaggccgggatgttacattccattattaaaaaaaattatgggattaggaacatattgggcatgtgttgatgatgatccaaggacgtgtgttgttccatgcctaaaccaaccacaccaacataaaatgctcaatgcaaaaatactcaagttttatttggtttgttgtcaaagatttgacaatggagtcattgtagtaaggctaaaggcccctttattggtaggaaaaacataaaaaacttaaagttctataggaaatactcataggaagacctttaaataaacgattgagtaatatactttcctttgaaattcttatgaaataggtaattttatagagattttaaagaaaagtaaagaatgaactttaacctcttaaaaattacctttaaggttatctcactcatccgatcgagcagtttttcttactgtctatttataaacgagcatcctgtctaatccgaaatttgacaaaatgaactttgcctaacagaaatcctctgtgtttagttcacgataaaattaaaagtttgattgaaattggaacgatgtaacggaaaagttggaagtttgtgtgtgtaggaaagttttgatgtgatgaaaaagttagatgtttgaagaaaaagtttggaactaaacaagggatgaagctattgcttgaggtgttgtttggatctgacgaaaaagattaagtgatagacacgtaaaacgtgaaagccattaatgcatcattaattaaattttaattattacaaacttgagaaaatggatttatttaatattagaaagcaacttgtatataacgaaatacagtttttagctgtttgaaaaatgtgctaatgaaaaacaaggtaaaatttatatttaattaatcaagtagatcaaggccgtagtactatcttttacggtggtactacctttacaggctttctttggttgaagctgccaactcaatttccttgttttttacgtgcacactttttaaacaattaaatcattaaatgatacgttgtttacgaaaaaaaatatacacaaaagttgtttaaaaatcgtaataatctatttttagaaagaatagccagtacttaattaattatgtactaataagttgctttgttttacgtgcacgatggatgaattcccaacccaaataacaaactcaggcagtagtacagacagtgtttagttccttcaaacctctaaaaattccgtcacatcaaatgtttggacacatgcgtggagtattaaatatggatgaaaaaaaactaattacacagtttgcatgtaaattgcgagacgaatcgtttaagcctaattaagctatgatttgacaatgtgatgctacagtaaacatttgctaatgacggattaattaggcttaataaattcgtctcgcaatttataggcggaatctgtaatctgttttgttattagtctatatttaatactttaaatgtgtgtagttgaagattgaactaaccaacataaaagaaaaaaaatatcggagagagtaactttggcttgcagagcacaattaactctggcttgcagtgtactacacaattccaagaagccccaatccaaaataaaaaaaactagagaggggccaatccacaaaagacacaagactattgttgaccagttgaccgaccccccttcctcggcgacatcgtctatattacgatttgcccccaaaaacccccaactctcccgcttcatcgtttccaccggagaaaaaccctcgaacgccgcgccgcccatggcctccgccaccgccgccggcgacgcctccgccgcggcgttctggacggcgtgcccgcactgctgctacgtccactcctacccgcgccactacgccgggcgccgcctccgctgcccgaccgccgcctgccgccgcgccttctccgccgccgagctccccgccgcgccgcccatcgtcccgggcaccgacatgtacttctgcacctgggccttcttcccgctcggcccccccgccgccgccgccgacgggtgggcccccttcacccccttcaactccgccccgaccccctcccctccccccgccaccgccgccgcccccgcccccgcccccgctcgcgccggtggccccacgtcgaggaagaagatgtgcgtgtccctcaaggggagggcccgcgtggaggcggagcaggaggaggaggaggaggaggccgcggccgccgccaccatcatcgatctcgagccggaggtgcaggagggcgggattggcgagaagggcttcaccggcatcaacctcaacgagtcggtggagctgagcgagctggggttccgcgacgacgagatcgagctcttcaccgccatgtcctgaattcgtgatcgctggggaaggtggtgaaaaaggttgtgcgccttctgatcataatatcatatactcaatgcttagtactactaactgctcaacatggtggatggtttgaaaaaattgggatagtaaccagtaatataatcttcgtatctgtgtagttatcaaggttttagtttcttatgatggaatgtaggcctttagggcttagcaatgcatagtttttggttatcttaatggcacaaggctatggtatgaaggtgatcgcgcatagtggtggaaatggcaaatgtggatccttttggttggacttggaagtgtaaagtgggttttatgtcttttggtgctggaaaatgtccactttatggccccaatatatataaattttagtttttagtttcagcttgttctgtttgtgcacggttttgtcggatggtgatatcaacttgagattatcctctggtttattgttgttgatttaatcactagaatggaacacaaagtttcatgcttgcttgcactcatttgcctttggtgtgtgagtttctgatgccctgaggatttctgatgatcagttcgttcagttcttgtgtcggagccctgcagctgaatgcgaccaaattctttcagtgactgttgtgtcttaaattggatatccaaggtgctatgttatccaactggggataggataacacagcgccacaattttcagtctgtgatctttgacatcttcatcagtagaactgtcaaattttgcaggccaatgttgtgagtttgatatggccaccattcactcaccatttatccttgttttcactatttgtatttcgttgtttcaaaaaaaatatttgtatttcagctagtgagaaatgaatggtataaaagtatagtatggccaaatcagatataatctttccagcataattcacaaaaagtggggggatacaatacacagttctgcttcagattagtatagttggtgcttttttttttccaccacttgtgactatttggctagaagttgtggctttaaacaatgtgcttcaaacattgtgtataggtgctagtggggaaaaaaatggagctatgttacttcaattcctgcctgtgaaaaaatatttgtttcctcaaaatctgatggtttaagctgagccatcatttcactgtctgactcctgagttacagagtggagctagaacttctggtacgcaaaaaccacatggaattcactaacatgtagtaccaatgtacattatgtagtaccatacaactcgcatcgctttcattatggacatatcttctgtgttttcgctgtatccattctgtcaggacaagaatccggccaaattaaaagccatgcaaactgacaagagtatgatctgtcgtaaatgttcaagattttgttttattttctctgctgtgattagagtcattctccattcttgtaatggggtgtacatgaactgcagcctgcaggtatttattttgttcagtgtgacgtataaataatgttggcaattaccgggtcactgtttatgatttttcagtgctgctagatcaagtttgctcttccgggctagtaatatttgacgatttcttcagttgtttgtgtaattctcgtaaaaacctgtacaatttacaggaagcaaacaccgcttcagatcgcatggactgggctttggcccatgcctaatgaataattatacctacagtgggccagatttggcccattgcaaattgttactggcgaaagcataattagacttcggacgtcggcgatggataagttgccgcaaaatttgtaactttgttttttggatttttctacacgtcttaaattttcttcagtaacttggttaaacacaaatacaatataattacattgtaacttacattttactatagtataatttttatatataactttaacatagttttggacagttagatttgctcagattcatgcaaatatggaaagaaaatattaatgtgttcaattgctcatggatgaggactttttgggggaaaaattcggatatataagattccctccgtcccaaaatatagtaatttttaggtggataggacatattctaatactacgaatctagataggggtatatccagattcatagtactagaatatatcacatccaaccaaaagttattatattttaggacggaggcagtagtccctttatttactagtaactccaagagggctcaacaagaaaattataccttcgtctaagttgtgagataatcgggtactactctactataacaaactctgtattttctggaccatagggtactgataatgaccatagggcactctattaaccttaggaggctgtgataattatgtcggccatgcaggagatgagaaccaaaacctaattttttttcataccaacaacatttatttttatacaccctcaacgaaagaaaatcccaatcatcagatttgctgtgattattctcaacatacacgaatattaattttactatcttacagtgaaacgagcgtaacttaactggttagatttcttatggtggaaccagtttatccgagtttaagtcctagacttgatacggagctcagatttatagctaattgtaggtgatatacccgtcaataacgagatgcccatggtgaacttagtcaatcttaaagtatgccggtctagtattataaaggtgctcatacttatgcccgtgatctcaaaatatgaaaaaaaaaaatcagctcagacatccaaaagtactcgtaggggcaagatatgcgtttgtgccttcatgggtgagtccacgcgtattacatgatttttattccctatgtcctaaaatataagggattttggagagatatgacacctaaatatgaataatctgtctagaacaagattatgggcatgtttagtggagcttaagattctgagaagcaactgctaagaagctagctggtgagaatctggagaagctggaaaacccagcttctgtcttctagttcattttccagattctacatctatagattcttagaatcttggtaaaaagatgggttgttagggagagcttttggtagctagagattataggagaagatgcaactgctaaaaactcctttaaataggtccttttagtaatgtgtcacgacctctaaaatcgcttacattttgagacggataggacaagaaaaagcctggaaaatcagaaaaaaaaaaggaagagcgaaaatgacaagattacccctccgccccttccaccttctcgcagccacacctcctcctctttcccctctcctccctctccactccacacgccgtactcgcctccgtcttcccccccgatctgcgggcgcgcgagctcggagcgtccttccccgcgcgcgccgccgccaccgccgagagagtggcctcctcctcctcctcccttccttcccgcgtggcctgggcctgcggttaccccgcgcgcacggccgacgacgactgcgacggcgacgaaggcgagctggtttcggaggggggcgcgacgcggccgacctgctcccccatctggttcgaatcgaaaggtatatcctcgttcttctgtccttggcccttgttccactccaaccttctcgacgccgctggatggatgggcggcttagattcggaatccgtccgatttgggattgggtttcttcccgtcgaattaacgcatccggttctttgtgcatttcgttttattttatgcgtggtagagagtactagtagcatcttgtagcgtgtgtttccgtgaaaacaaaattgatttggttgggggattatgtgatggtgaagccatgaagctcgccgaccactgtcacagtgtgactgcagagagatgggtgagagagggggaggaaagggattgatgagctttccctctgtaggctacttgcgctatcgcaggagatggcttcaaatggatccttgttccattgcaattgttgggttactggagatgactctggagaataagatctgaatgagtaaaatgtggttcgtatcgtgccccttgggtaacccggccatcgattggattgatgttaggttttgcaaaagttgaacttcattttgtagtttaattttgattccctttgtttggcgtgaatgcagtcgtatctctggagaatttttgctgaaacgttaaatgtgttagagcaatcgaatgcttgtcgtggtttactttgtgcgaggatcttttttttgcctcatgctagcatgtgaactgcttatgaaatatgaaccattgctatgttggtgaagaaatctggttataacttttgttgaatgcaatttgtaggtctagtggtaaatgtatgacctgacttgaatagtatcttttcaggtggatgccaatcggttggtcggttaaaaacaactaatttagctgatcctgtggggaagaagtaatggtactgccaggctctaaggagtctcaaaattatgatagcaacaaccagaaggttcatcctcaaccaattgacgaaaacatgaatcagaacatgggctcaatggacaccatgattggaaggatattcaacaatatatcctctttaaagtctgcatacattcagctgcaggaagctcacaccccatatgacccagacaagatccaggctgcagatcagcttgtcatagaggagctcacgaagctctcagagctcaagcatgcttacagagaaaagaatcctaagcctgtagcggcaaca

SEQ ID NO: 49915 - DNA, 2894 bp, Oryza sativa
cttactcaacaaggaatctgaggaatctgatgatgaagacaactacttttccatcgagttgacaccaagtttatttacatctgctgttgataatgcataccaatctatacatgatttttcaaagcctttgatcaacatgatgaaagctgcagggtgggatcttgatgctgctgctaatgcaattgaacctgctgtggtttacacaaggagggctcacaaaaagtatgctttcgagtcatatatttgccaaagaatgtttggtggtttccaagaagagagcttttctgttaaggctgctaacattactgtttccaatgaggctttcttccatcagttccttgcagtacgagccatggatcctttggatgtcttgagccaaaatcctgattcggtttttgggaagttttgcagaagcaagtacctattacttgtgcacccaaaaatggaaggctctttctttggtaacatggatcagagaaactatgtaatgagcggtggccatccgaggacacctttctatcaagcatttctgaagttagcgaagtcgatatggttactgcacaggctggcatactcctttgatccaaaagtcaaggtctttcaagtgaagaaggggagtgacttctccgaaattcacatggaaagtgttgtcaagaacatcatcctagatgaaggtgcagagaggcctaaagttggcctaatggtgatgcctgggttcttgattgggactagtgtcatacaatctcgggtgtatctttcaggtgtcaagtctgctgattgaagctgatgcagttactcgagaagatcaaggctactttgcatcttgcctgatcaaccaatcacattagtacaaggacgattaagggtcttgtgtgtgatgctgctgtcatctctgaaagatgctatagtcagagtgtcggtgaaaaatattgtctttttaaaatttcgagtgccatgctgtttgtatgtttcttcagatagatttcttctgtaatgtaactgtcaaatgtttgtctatatatatgtttatgtgtgttttgactggcatcctaggcgtgtaaacttcctatgatgctcctttgcataatttgtaattcacggctattcaccagaatgtagtatgctctggaaactagtgtgtccatgctttgcacaatcaggctcatataattggggattggttggggtatattgaggatagaacacactgggaagaggatggatgcgcttttgatgtagagatggtgcagtcaaaatttgataccaataatatgaagggtatctaaattgccaggtgtaaatagagccatacaattttcatagatgagtacacagagaccacatgcatctgtacactagctataatgatccacatgcttcttttgagatgaatgtatcagtgctcagcagaggaggtattgtgattatgataaaacgcatagagcatacgtggcctgcatgcacgccataacatcccacacccggttgatggcaccggacacaagcaaagcttggtaatctttgaacggtacactaaccggaaaactgcttaatagcagtcaagttaatctgcatgaggagcctaaagcagcaagagaacgtgtaaattaaacaaggaaccccaaaaaaaaaaagaaaaaacggagaaaaaggggatggttaggggagttactgattgatgatttcggtagaggagatattgtgattgtaggaagacaagacctgattgcatatgctacggtgcaaccagaccagaagcattcacttttaactggggcactcacagcgaaaccaacctcacgccaagccaccattcaagatgggtttgacatgggaaaggtgataacacagatgacagattcatgacttccccaaaaaaaaatcaaatagaaacgaaatgtcgtctaactccacaaacacgagagggtttcatgtacaacatctgccatgcacgcacgctactacagtttatttgacataagctgtaaaagataggaaaatccatcacacttcacaccgaagccatggagatgcagagtatacgtatcaccagacgcttcgaaatgtagtgaaaaagcatgccacggcacagagttagctttccctagtgctgttctttagccactccaggtacttgaggttgcctccttttatgggcagcgcgatgacttcaggaacgctgcattgggaaatcaagtagtgaatctcagatcacgacaagagagaaattttaggtttacgacctgtcagtatatactgacaaacagatgaaaattgatggacagaaaagaacttactcatactcatggttggctttcacgtgttcggtcaacgcatcaagaagagactcccttgtctttatgatgagcagttcttcagcatcagtttgcacctgcaaaaagatatccgctgatcactaaatatctttttacataagggaataggcaaaacgctcattgacctaaaggagtatagtgagagtgcaaagctaaatgaacagctaaagcttgaaatcaacctatcccaaagaaggaatagaaatgtacctttccttcccaccagtaaacagattcaatacctggaaagagggacacagaaaattaaaaactaaataaaatgagtcgatgttaatgtaatgtaagatagaaagtaggccaaaaaatcatgaatcagaataaaactaatagagaggataaatatagatatctcagcttagcaattccattattttgtctctctttagatgaagtcccattatattgcaaagtgcgcgatacacaatagcatgctgccgcatgcatgtaacaacacatcatcgtgtccactccataccacattccagtgcctatgcacaaagaagagctattgccaacagctacagtattttttaataa

SEQ ID NO: 49916 - DNA, 2838 bp, Oryza sativa
  unsure (1)..(2838): unsure at all n locations
aatgcctaactgacctgngataggatccctccttatatagatggagggctacttaatctaatcctaacaaaccttatctaatcctaacaaaccctaattctatctcatgggcctaggactcccggcccaaagcccatgacattactcccctctttttgagcagctcgtcctcgagttgcagcggaccctgctagactcaaacaaaacaccataacctaaactaagactcttaagccttttacatctcggcttttattatgaacaaaaataagaaacaattcatgcgcaggaggacctggtcctacagaaaccctgagcatgcctcccaccgaagcccacttgtccagcccaacagcaaaggaataaatagttgactcggatgcttcatgggccaacgtggaaaccacccagaccagaccagccaacccaattgggagaggacagaaaccctatcctcttgttcttcacgaggccacgccgccagaaacgatgcagccgtgatcgagccgcgagcttcacgaaccaacgtgtggacccggcgcaatctacgccatcgcgacgcacgagtgccacgcccacccgtcgcgctcgcgactcgagccgcatgcacgccgcctggctttgctccaaccgttgccagaatttgcgccaccaactgcggaaaccgcgtcgcatcgcctggaaatcgtgcccgagaaccggacacccaagtcgtgttgtgtcgctgtcttcttctccaccaccattgagggcgccaatggcgacggcgccatcgccagtcccagcggcaaggtcgaggttgcgcagccactcccggacttggcgccgcgcgccctcgcggacgcaaggccaccgcatgccggtataatggttcggcctcctcaaggaaagcagccggctcggttgactgagccgccaaggcccggagttgcgccgccaagttcatcatcttcttcgagatctcggcaagaccttcgctaatgttgggaaccgcagtgatctcggcacccatgggcacagaaccgaagctctgataccaagttgtcacgaacaaggaatacggtcctgaacctaaacggcgcgacgctctccgtcgcactgagaaggcaggccgatgggcactaagataaatattgatctaatgcctaactgacctgggataggatccctccttatatagatggagggctacttaatctaatcctaacaaaccttatctaatcctaacaaaccctaattctatctcatgggcctaggactcccggcccaaagcccatgacattaattagtgtgagtttcatcccgcgatgttctaaattgagcccctttcatcaagtgtaattccaacagtgctgttgttgtggagctcgacatggccaaatgatgcttacaggaagaggcacatgtctgcatcaatgtttcagaattgtcaaatgccacatggtcatacaggtgaacaccttttcccgcattaccatagtcatggcaaggcaactgttagaaattctgattactagacaaatatgagcacttcattgattacgtttctcaagaaatagagaagccagttggttaaagttgtttttgaacattcagttgaccaaagttcaatatgcagaatttccatggaaacagaactgaatatgatggattcgcattgaactccactatataaagtccagccaatttgcttgttcgcttagttcagtgcatctatagatgcagatagagaaaaaagagagaggacgtagttcccaccaggcatagttcagtgcatcgatagctgcggacagaaaaaaaaacacaaaaaaagaagagaggatgtagttctcaccaggcactatgttcacacaagcagcaagcttctcacttataatgctcccagctagcctctttcctgtataaaaaaatgagaaaggcaatcatctaatgctgctaaagaaaaagatcaaacttatcaaaataatatagttatgagtacagctaggaccgctgagtagcataatagaagctattcttgaatggaagctactaaaatagtcaatggggtgaggaaataatctctactttgttcagcacaggtgttgacaacttgtttgctcaagtcgacaagcacgatcgagacacctaaatgccttgcggtgatatggagtcgtcaaacaccttgatctagacaaagctaaaccaagatgggttttgcaagattaaacaggctagcggagccaatttagatgaaacaaggataaacacccgtcttgtgggcgaacagggtttacgggccgaacctacagagggatttcgcactctcacagcgaaggtgggcgatttactgcgcaaatcgacaaagatgaacaaaactaggctagaactaagcaaaaaagtagacatgatattgaaaaagtgattcaattggctaattgtgttcaaagtagattgtgtgttcaattgaaccggccttggtcttgttccttataaaggggttggtcttgcctcctacaatctcctccacatcaaactcagggtagagaccaattagaactttaaaaatacctcaccaagcaaggaaacccaagcaaggaaacccgagacttggtgaaattcaacttggaatcggtctgaccggccacacaccaccggtaagaccgacccataggcagcggtcagatcggctctgtgaaggaaaccaatcatttccaaattttggcgatgttttcctatttcgaatctaggtgccgaatttgggtgttaacaacaggtacaattaaatgacaataaaacacagagtaaatttcacaaaactacatacttcctccatttcacaatgtaagtcattctagc

SEQ ID NO: 49917 - DNA, 1179 bp, Oryza sativa
attcattaacatcactatgaatgtgggaaatgctagaatgacttacattgtgaaacggaggaagtatattttagccaaattatcataaaactatagatttgagatgatgtatcacaaaattacagatttaattttctcacagaactgcagatttaaggtggactatcacaaaactacaaatttagtaacaaagttatcacaaaagtacaggtctagtgtcacatataaacaatgtacctgcttctttattaggaactgtcacatacacaacaatggaaggcacagtggtggaagtagactccattcgagcagaagctgaagagctgagacttctcaccctgtaaagttcccatactggttatttaccagtccagaaaacaaatccaaagtgactacattactttgatgtaactaggctgtaaatataacaccactcccatcctccatcaaggtaaaaagagtgaagcacttcgcatttaagcacaatcggcacaatagttcctatacatcacttctgtgagcaaccaagaactcaaaccgtccccattcatttcgaatcatatgaccaaatctttgaatcccatcgaatcctatgaacaatagttagcaccggtcaaactgcggaatcctcctagattgattggagaggcgcgttaccctgcgaaggcgccgaggctgaggaagaggagagcgccggcgataggggcgcggcgccggagtaggagcggcgagagcccggcagccgcggcggcgcggcgtggggcggcggtggcggcggcggagagagatccgagcggggaggggaggagtggcatcttctgggagcttcggcctacatgcatgggagttgggcccgcttcggcctttggatgtttgggcttttgggctgagttcggttgggaagatgggaacctaccgaatttttttcggttttagattttttttaaaatatttacagaaataatatatcggcaaaaaaaatttacaaaaatagaccctgccgcccacctctggggcggcaagctgacgtggcaaacgggagaggaacgggcggtgacagagggagggttttttgcaggaaaacccttgccgagggcggcaaggggcccgaatgcaaaaaagccagtcggggccggccattttgcaggcggccccttgccgccctctggccgggcggca

SEQ ID NO: 49918 - DNA, 6226 bp, Oryza sativa
atgtgactattgagttaaatagtgtgtattttttaaaaatttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagatatgtcgaataaacaaatattccaagtttaccatggaccaggaaacgtccgttacgggccaactggggtagatctgtcatattttattgtatcagaaaggggaattgatagaccggctgagaggagtgtaccttctataaaaggatggttaatgaggggtttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgggcagatgaacatggatgatggcgagggaccaagtgctaaagtaaatgagacttctgtggaggaggtcaacgcacgagaggacgggggcgtagtagctccatgtcacgaccggaaataacccaacgggcgttccttacgtgcgtgtattattccttgtcccaggaggcaaggtacaccaaaagttgatacaatacagagtttaacaagcggaagcgtaaatagttaatttattacatgggcggcgaaggcccagcacacatgaagacaaacgaaaaacagcggaagactagggcgacgaccacaggcgcttgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggagttataatatagggggttagggtttgcagtaaacagcattaaaaggcacttagttgctcaagctatttggtaaacacgatcctagagctatacaagattattaatcaaggccgtgaacccacacgaacctgccttaacccaaggcctacgatgattcagaccgaactggcaaccaaacccaggtcccagctcgtcccaagccaacccaggccaaccattccatattttagttgttaagcaggttttaagaatttaaaacactaacttgggtacattgctaggcttgcccataaccgagggcgcggctattcgaataggttatactctgatcagaggtgtacatctttactcacaagacatcttcctcacgtgtaaccacgtgccacataccaccacggtatacggacgaaagacgtgacatagttcccaacccatcctagccatagacaagagtaccgacccagccccacctacggccggaacctccgggacaggtaggcaggaccgagcccctagcagcaggacgccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatgtggccgaggtgctactatcaaaaccgtgcaccgcgagcccagcctaaaaccattttgagggttttgaatagagggggaggtgtgaatccaattccacaataatccaaccattccacaatgtccaagtgatatgaatattcccaaagtctagagttataaaaccacctaatgttgcctaattaaacagcgaagcatctacctaaattcctactagtggtaccataaatagagtacccactagttggggttttgtttattctagggtgaacaaggtaataataacaataacaataataataaggtcataacaaaggtaaataggcatggctaaataaaacagtgataacacgggaatttaaataaagcgataatgcaataatttaaatcaaaataattttataaactgggattcaatatgctcaaggatgatgtgacttgccttagtcgctttcccaaacgtcggcttcaacctccacgtagagcggatcttccgaagctgcagcgtctacacgaccaacggaaaggaaaaaggcttttactctaataaactccatataacaagcaggaacaaagcacaaaaatgggttcttgacttcttgaggaaaaattagagacttgaacggtccaattctgagttcaaatggctaagttatggccatttgaagtttatatgttctttaagtgaatatttgcgaatttcttcatttaaattttaatttaaaaaggatttattgcgtcagccgaggggagggggcgcgcggaccgggtccacgggagtggggcccacgcggcagcctcacggtccacggtggactggcgcacccgggctcacaccggccggcgccgtgggccccacgcgtcagccgcacccgagggcgcgggcggctgacggctgggccccacgcggcggccacacggctcgcccggaggcggccaccacggtgcagccggcgggaggcggcgcccgcgcccctatggtcgccggcggcggccataggaacagcggagcggcggccaagaaaggggaagggaagggggaaaagaggcggcggtccacggctcaccccgggtcgacggcgacgacaaaggaggcggccggagcggaggaaggcggcggcgcgactcgggtggatggggacgacggcgctccggcggtcggcgagctcggcgaggtggtggacggggtcggcgacgatgcggcgaagccggagaaggcgacgccgaggcgggagacggtcctggcgagcggagagggccggccggaggtcgtcggcgacggaggagagagagggcgacggcgcgaactcgattccgacggggagacggtgcggcaagtggcggaaacgggcgagggaggcgcagggagggtttaaataggattgggagggagagagggcggccggcggggaaggaaaccagcgcgggaggtccggccgtcatcaatggcaccggcgagatttgcgggagcaaatccggccgtttgaatgcgagagggagagggaaaaatggggggaaagggggaggggatcacggggaataattccccccacttaattgcacacgggggcggcgggatgcggcggattcggcggcggcagcggcgcttggcgcgggcggggcggcggaagcagcaggaggacagggatgacgggtgggccccacccgtctgagggtggcgggcgggcccgcctgtcagcggcgtgcgcgcggggagaggccgaatgggccgcgggggagaggagagagggaggaagggagatgggccggattcggcccatccgaggggagagagatttttagggtttttctttttataaaaccttttcaactttgtttatttcttcttaattattatttgtgctctgaaaattccactaaaatttatttacacattttaggattttaggaattatacaaaaatcctccaagccttatttgacttttaactttgaacattttaatttttggaggctttcacaaggattttaattattctaggcagaattttgaaggatatattttagggtcgttttgggacgtgacactccagtgggcattcaaccaggtggagtggccgacgagggggagactgtcggtgccattgtggatgaaatggagagggaggattctgacaacgagcgtgtagaggaaggtgattcgtcagatgatgagacggatattaatcctgcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaatcggtcgcaatatgaagttcggtgtgttaaggaaaaagatggttgtccctggagagtgcacgcgtataaggggaaatggaaggattattggacagtgtcagtcgttaccaagcatacatgttttctacctggtgttcagaaataccacaggaacattacatgtgcatttgttgcatctgagatgtatgcgcatgtcatcgataatctcacatatgaaccaaggtcaataatccgacacatcaaagagacatacaagtatactattagctatgccaaggcctggagggccaaacagaaaataatagagatgagatttagaacttacgaagcctcgtatgacaatttgccacgcctgtttggtgttatcgaggaaagaaaccctgggagctcttacgaagtgaagaaattcccctcaattgaacatcctggcaagagtgtgctgcaaagggcgttcttagctctacatgcatgcaagatggcattcgtgaattgtcgtcctgttctctgcattgatgggacattcttgacaggaaagtatcggggccagatactaacagcaataggggtagataggaacaatcaggtattgcccttggcatttgcttttgttgagagtgagaataccgacagctggtactggttcctgaaattggttaaaacaaaagttgttggtatgaggccaaatgtgtgcctgatacatgataggcacgctggcattctgcgagtgatagaagagttgcagtttgggagtatggaacgaggataccctggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagtgtgcagcggctccatcgaccgccgttgctgaccctcctcaagctcttggacctctcccaacggatagtccaacattggttagaagaactggattggagattcggaaattttctaagtggattctgcatgaaccaaaagagaaatgggccaaggcgtatgacacgggtggtgctagatatggaataatgacaacaaatttggcagaagtttacaactgggtgatgcgcggtgtccgtggactgccactagttggcatagtggagttcattttacatgggacatgcgggtattttagggatcggttccaggcagttcttccctctatgccgaacaacagcattttgtttggaactttcatgcaaaaaaagctagaggagttgcgtaaaaaggccatgaaacatcgagctctagtgcaaggtacccaacagcacaggtttgagatactatgtcaagataaggtaggcaggggtatctaccgcaagagagtgaagcaggagtgtgttctcaaagccgacggcacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctggggagttcacagagactaacaatgaagtactcaatattcctgacccatcgaagctccgaggcaaggctggaaggaggaggactcgtcgcatccgcaacgatatggacgagtcggaggctggcagggtgaagcattgcagcaaatgcgatgaacatgggcacacctacaagcattgtcctaaagacaaggagaaaccaggtgcggcggaggcaggactatcaggatcagcagcagatggagctcgccctacgggtgaaggcactacctccactcgaccacgtcctaggcgtcgtcgtgccacgtctggctacgtggtgtagttcttatattctatgttggcatgtggctttgcttgtaattcgtttcgaacttatctatgtgtttatgtttcgtcgtgtaataccctagtccagttagtgtaaattggatctg

SEQ ID NO: 49919 - DNA, 2385 bp, Oryza sativa
aattaaaaaaaaacgaaaaaacgatgttgttgttgccgctcgccacgaccgccggacgcggctgccgccgcccgccggccaccgccggccgcggccttgacacccaccggcccgccggatgagaaggaaagagggggaggaggtggaggagaggggatgaggaagagagttagagaggagagatctgtggagagggggagaaattcgatccgctaagttgtaattgtggaggagaggataagggatagggattatatactacgtgttcaattttaatcacggttagtattaccaaccgggactaaagatctatctagaagatctttagtccttggtgatctttagtcccggttattgacaccaaccgggactaaagattctcggccccctgacatgcatctgataggggatgaactgggactaaagatcatctttagtcccgtactaaggatcaaaatttttataaccgggactaaaaataatctttagtcccggttctttttggaactgggactattgtggattttgccagaccgaccaaagatggttcctccaccagtgttacatactaattacatattaagtggtgtgtaagtgggatgtaactactgtgtaaatttgtaaatatataaataactacccgctgcatacacatacatgcaagtgtgaactcagaaaagcagcgggcagcatatccaattgccataaaactgactgctatggagccaaaaaactggcgacaaaaatatagtaaaaccgtaatttattagtcccacaaactcactctacttgcacaaaatgatacttatcacacatcgtacccaatattctcaagtgcaacaagacaagctttgtacgatagcagcagcagagatctgtgattggcagctgctagctcccaagatcctgttgcagcgacagagagatccacaaactcactctacttgcaccacatgatacttatcacaattcacacatcgtaccaaacattctcaagtgcaccaagacaagctttgtacaatagcagcagcagcagcagagatcagtgattaggctttaaatcactgatcaagatgagtggcgcaacggcggactgggcatggtggctcggcctcgtcgccggcgccgtcccgctgctcgccctcgccgtctggcactgcaccgacgccttccacagcgccgccttcgcgttccgccgccgcgggacacgcgcgaggctccccccgggccacatgggcctgccgttcgtcggcgagaccctcgccctgatctggtacttcaacctcgcccgccgccccgacgccttcatcgaggccaagaggcggcgctactgctacggcgacggcgacgacgacggcggcatctaccggacgcacctgttcggctcgcccgcggtgctcgtctgctcgccggcgtccaacgggttcgtgttccggtcggcgccgcccggcagcttcggcgtcgggtggccggtgccggagctcgtcggcgcctcgtccctggtgaacgtgcacggcggccggcacgccaggctgcgcaggttcgtcctcggcgccatcaacaggccgggctcactccggaccatcgcgcgggtggcgcagccgcgcgtggcggcggcgctgcggtcgtgggcggccaagggcaccatcaccgccgccaccgagatgaagaatgtaaggcgccgtcttaatttgtcaactgagaattcactgggtttgtgtaggtgtagcacctactagtatttaaagaaaagattttacaactacatgcaaattatcatgatttttttaaaaaatatggatatctatcgcactacaaaatttcaatttaaaatatagctcctgtaaagagaaacgaagaataaaaatcccaacaagtagtaaaatgaggcctgttagtagtttagggattaagttctccggtcaaatagttataaaaactacaattaacaatttccaggataaaaaaatcttagagctccactacagtgctctctactagtagtagaaaacaatctaaaccattgatcttattttatcgaatggtttaaatctatttataccgccatcctagtaacggcagtaaaaatgtggagagacattattgaaaaaaataggtgctggaggggtataatatcatttagctttgactaaactcttttttctttctttttttggcttttttgatggaatatgagcgatatcaacccaatgtaggaccacataacaatttacctgaaaaaataaataacaaagttacccctaatcactgtattaataaattattgatttacccttaaatagtactactagtattatactaccattagagagcaccagatcattgctcaaaatcataaatacatctcgttcatctcctatgaac

SEQ ID NO: 49920 - DNA, 867 bp, Oryza sativa
aggtgaagatggtgaccggagaaggaggcgacgacgacgacgacggtgacctgatgagcgggctgatgcacgtggaggatgagcaaggtagacgactcgacgacgatgaggtcgtggataacatagtctcccttgtcatcgcgggctatgagtcaactgctagtgccatcatgtgggcgacctaccatctcgcaaaatcgcccagtgcccttgccaagctaagagtaagccaataatttactatagtatatttctctaaaagtgctttcaagtctcaaatggctctcacacatgaacagatcgatcccatatctggcatgttgctgtccgatgagcattcctacatatgaatggatcacttgatcacctgtgccatggccagaggcctaggattggcagcccattagtatggagaatttttaaccatataatcaccatgtaaatcccaactctctatgggccgacccaagccttgggccaatcctggtctgcccttagatcgatcccataactggtatgcttgctctccaatgagccctctcatcagtggcagattcaaaaaatttcttgaacctggacaagtctaacgagataaaagcatatacaaaatctatttaactatatataaattttgtagactaaaaccaacctgagaggttagatggattaatgtatcctgggctagacaagtatatttaactatacaaaaattttgtccttaataattgccatgtgttagcctagcaggatttgtactagtgtagcaggcggagcctgagcacctgcccatgatgatcgaccaggcttcatccctgcctctcatcatgcaaacaaacaaattatgtgagttgacatggagttggaatg

SEQ ID NO: 49921 - DNA, 1283 bp, Oryza sativa
agtgttagcttagctcctcttatcctctcctgcaatattaatattaccatttgcaagttaggaggggataaattaaaatttctaactcagttccttcttgctcacatcgcacatagctccatccaaaaacacacctgcagccctgacattatatgttgtaggagactttggtgcacaccgacaagtgtgtccttgtagtacgtttacatggatatttgttaaggcccatttgagtctatgaagataaaagatcaagtatgggtacgtaaaatgaaaatgctattaacacataattaattgagttttttaaaacataaaattttgatttatttatatgatatttcaaagcaacttctatatagagaattttcgtacaaaatgtaccgtttaacagtttgaaaagtgtgctaacggaaataaaagtaaaatctataacttaaatcaaaaaataagggtagggcccgaaacactatgtagcaacagtactcaagtccatcgtagcgctttatcgtaggtacattccatctaggacatcaaaagcaattcaagctgtggatttgtagcctaacctgcgggtatgcttttccctgatggctggccggaagcagagaggagctgatcactcaaacagattttctagactagttttcaatgtggattttagttttaacaatcattttggatggtgaaagaaattgaataaaccgttcccatatcccatttttctctccaattgttctaatatttcttcttcctattatacgtcctcctcatacattttgtcgatgaggctgatcgatccctatccatctctccttttaagtgcatgcatctattgataactttttttttgttcatgccgtcaaacacgatcgaaaacacctaattcttttcagtaataaggagtcgcctaccacctcaatctaaacaaatccaaaccaagatgggttttgaagatcaaagctggctaatggagctgatttagacagaagagagataaacacccatctcgtgagcagaatggaaggtttacaagacaaacctaaaaagggattcgcacttgaaacgaaggcagatgatttacggagcaaatcgataaagatagacgaaactaggctagaaccaggtaaaaagtaaatacgatattgaaaaagatattcaattggctaattgtgttaagtagattgtcatagataatgtgctcaactgaaccagccatagcctttataaagggttggccttacctcctataatgcattctccatgtcttactcgagatagca

SEQ ID NO: 49922 - DNA, 730 bp, Oryza sativa
  unsure (1)..(730): unsure at all n locations
tcctgcagccccagaatattgcactccaaaggtttccctgatcagtggtgcgactgggttatgaaggtagttagaggtggaaaagtggccattaaagtaaatgatgaggtgggtccatattttaacactcataagggattgaggcaaggggatccactttctcccctgctgttaatttagcagcagaagcactcactctattggtgcagagggctgagaacaattccttggtagaaggcctccccattaatgagaataacaaagtgacaattctccaatatgctgatgatacaatttttatgatcaaggatgaccctgaacaagccagaaatttgaaattcattttatgtctctttgaacaactttctgggctgaaaatcaactttaacaaaagtgaagtgttttgtattgcaaggctgttgaaagacaatcaatgtatagtgagattttcacttgtaaaataggtactttgcctatgaaatatttaggtgttccaattcacaaaaaaagattgctcaacaaagactggactccaactgaaaacaagatggagcataaattgngatgttagcaagccagattttagtccattggggggagattgattcttatcaatgccagcctcagcaatgtgcccttatacatgttatctttctacaagctccctcaaggagtcagagaaaaaatagactactatagaagaagatttctgtggcaggaggatcaaggc

SEQ ID NO: 49923 - DNA, 3280 bp, Oryza sativa
agatcgtggagaaatgaacactgtcgcatgaaaatcaccgtggtcaacgatgtactcctacctgcatctacttctgcacggtcattacacacggaggaggagtagaaaaacgaggagccgtaaatgccaaggctcggtaagtccaagcgtgcgtcggcgcacgcggcacgtgggctccacaccaggggcaattcggccactccacccaggtaagaaaataaaaagaccagactgtgtgctagtagcagtagtactgctatttttgtgtaatatgtggctatgtgctagtattgaaacgataagaaacaatggggctttatactttatctagcaaatcaaagatcgacgtgatcactattatttcttttgttacaattcaggctagttctaaaattgagtaggttttagtatatacttcctccgtttcacaatgtaaatcattctagtattttccacattcatattgatattaatgaatctagacatatagaatgacttacattgtgaaacggagggagggagtaacttttttgttgttgtaaatctacacaagatttatctaaattcaatagataattaactctattacattaacgtaaacattgcttgctacctgatgtagatacatcatacatggtgctttggacaaccaaattaataacaggaggtacttaattaatgacaaaaagtaaagacattgaaataattatatcttcaactcaccgtaatggacaaaacatttaaaatagcccgtttaaattaagactagaattattttgatatagatgtatttagcgtaccattttacatgcttcttagccatttattagaatttaagttagttgaaaattatagagaatcaagggacctatttagtagagatccggcttcaattctcaccttaggccaaacaatttcagctccatctggaaaaagagggtgaagcgggctctcataaaataaactaagacatgaagtcgggtttagactgtttcataactccattccagatctaattcttgaagttaaacttataatttagagctctatcaaacatatcctacatgtattcattcatagcatgacgtattagcgtttattatagtgcaatatagtcctctctccgtcccacaatagttatcattctagattatttaggatggattaaggtttaattaaaaaatttataataccccgtattaaataatatctaatgagaagtgaaaaggttattgagggtaaaatatgaaaatttttgaatataaaatgatttatgggacaaccagtactctatattaacaagtactatttgagaacaaaacttaaatagtattataggacggtatataagtattataggacggagatagcgtttttttctattcgaaatatttcaaaacggggagctatgctccgttccgactgcaaaaccgcagtcggcggaagacaacagaacaaaaccggcgttgagaaggggggaggggcaatcccgtcattccacgcgagcccgagttgcacggcaccaccaccgccttcttccttcactcgacccgaccgccgtctcgtccgtctcccccgcttcctccgcctccaaaacccccccatcccaacccgacctcctcctcgccctcccctcgcgcttcgcttcgctccgatccgaccgccgccgccgccgccgccacagcgagaagagagagagggagatggcgggcggggagaaggtggactacgtgttcaaggtggtgctgatcggggactccgccgtcggcaagtcccagatcctcgcccgcttcgcccgcaacgagttctccatcgactccaaggccaccatcggcgtcgagttccagacccgcaccctcctcatcgaccacaagtccgtcaaggcccagatctgggacaccgccggccaggagaggcaagcctctccccccccccccccccgccaaatctcgcaacaattccgctctccagatttcgatcctgctgtttcgcgtcatttcgttactgttcgttcatcatatcatttttctcccaattttttccggcgttcagatcgctggattagtgagctcctccgtgatacgcgcgccaattgattcaatgctagctggtgggcttacgtcacacttccatttagatcgtaggtagcagtagtagcgtacagcaacgcagcgagtggttggtagaggtggtacgacactacactagtcctagatctctgctccccgttggctgcaacggtcggggttagcttgcagtgcacactgctacctacctggtgattgggcagtgtgatgtgcgactcacctactctggagtctggatctgccctgaattatgctggtggggggtgtggtttactacatgcaaccacatttagttgcgtatgctgtcgaatttaggtgctcttgtatggtggtgggtggctgggtgggcaattgggcggatactaggagtactaaatatggagagtgcgtgtgcatttcggaagtatgtcgattatggttcatgtggttggttgtaatttgttggcacgtgaatctgacatagcgcccgatgaatgggggttattttgaattcgaagatgtccattgctgaactctgcacacttggtgtcctgtcctgctgtatataccaaaggtccatgggatgtttatatatgctttgacatgacccttaaatgtgattgtagttagtacttttactccctccgttttaggttataagactttctagcattgcccacattcatatatatgttaatgaatctaggcacacatatatgtctagattcattaacatatatatgaatgtggccaatgctagaaattcttataatatgaaacggaggaagtacgtactttgatgaaaagaatttgttgtgcccgtgtgctctgtgttgtactcttttgataagcttaaccaatgcatggactgaggccagtgtcatgctccaacttaagctgtgtatttccttcaccaacaataactctcgtgttttagttatggctgattcattcctttcatgaagccacatcatctcaactgtttcggatctttggatgatcgatctaaggcgcaaaagcgcctagctgcacagcaaatcaacattgcacctcttgttagcattttatcatgttattttttcaagcaatttgaagggtttccatcacgtttcataagtattctagtccctagcaagtgtgcagcaatgtattcttttttgttctgatgacaccactatatccatcttagcagtcaggtacaatcttgtggacga

SEQ ID NO: 49924 - DNA, 2550 bp, Oryza sativa
cagggatcaatatataagttaaaaactatttttctctgagctagttttttagctagttacttgtctcaactagacaggaacttgcctgcgaaattaaaacattgacaggtactaaccaagtccacttatcaattactactaaatctttgaacgcttggttgctcaaacagacatatggtcattcaagctggtcagattcatgaatagcttttccaaggcattttcactgaatgtcaccactggatatgtaaatgcactggctctttttttttttaccggaaccactgcaggggaggcccccgcagttaatatattatattaaaaagatcataagtacagaccaaaaactaaaattgcaatgcatggctcatttgccaacatgatcttcacggggaatggttggtcgcaatgcttgttccataatcttttgtttgaggaatgaactaaaactttggtgccacttttgttcagtgcacagtactttctttgagctatacacattccccttggtgtgtaactgcaaccagttcactctagtttagatgtctagctgatattaccataatatagttgttttttttttaattctggttgacataagagcaaggataatagtgagctataagcaagctatatgcttatgtggaagagagagataaacaaaagtggggagtgttggctcttatgcaagagctaactacacacaagctccaagaaatatgcattaaattcatagtgagaaagagagaggatgaaaaaaataaagataaccttatagctaacctattatacatgttagctttaacattgactaatactccctccgtcccaaaaaaagtgaatctaggactgaatgtgacatattctagtacaacgaatctagacatacaggatgtgtgacatccagtattacgttggttttttatgagatggagggagtagtaagtagtgagctctactattaaacttgctctaagccttgttgtttttactcagtaacatacatattgaaatattgaatttcacattcatatgccctagaagtgaaccaaggtttggagaacttgagtggagccagcctaaagtgcttttttttttctcttgaaatttgtctggaggtttattagttatctcctaaggaagaactatttagttccaaagtttgatggttgttctcattcttatctaaaatatcttctatatcaaccaaactagagaattatctggttccctctctgtactgaccactttttgtgattttaaggtccatgacatcatcccaacttcattgctactgggtttttgagttgcccatatgtatttatgtacaattacctgcaaaatatctgtatggtggttcaatattttaatagagaatgagttatgatttgcaacagttttttttttcttctgaaatgttcccctaagccttcctacttttgatattctctataatcttgtcattgtattatttctgactactcaaatgtgtatccatggtaaccatagccttaaaattcttttatgctgcttcgtttgctttgttttccctgtcatttgaactgcattctgttctgcatttgagcacatgacacacaataggtgtgcgtgctgtattatccatgaaatcttagtcctgcactttagagaacttctctatttttactgtcatcatgtgaagaaacagtactccaagatcacagtgagacaaaatatatacgtattttctgtatatatgttgtagcactcaaaatgtgtgatgaattttgtggcagtattggcattcatctgttttgtctttctcatgtagcttacaaacttgtttctttcatgaacacaacttactaacctgtcatgcctatttacttcaactactgcaggtatagagctgtcacgagtgcatactacagaggagcattgggagctctcctagtctacgatatcaccaagcgccagagctttgatcacatccctcgctggctggaggagctccgtggccatgcggacaagaacatagtcatcatgctggttggcaacaagagcgatcttgaagacgagcgggccgtgagcaccgaggatgccaaggagtttgctgagaaggagaacctcttcttcctggagacctccgctctgcaggccaccaacgtcgagaacgccttccagaccgtcctgtcagagatattcaaaattcacagcaagaagaacatggcagcggacccaaaagcaaacggcgctgccccatcgctagcagggaagaaggtcgtcgtcccgggcccagcgcaggagatccccaagagcaagtgctgcagttccatgtgatcttactctactcagattcagctgtatttgtgtgcctctttttgagaattttcacgcgatctttctggatgtacatccctgctcaaatagctctaggctgcgagtattgttggactattggttgtttcggtgatcaggtggacgggatagcttagaatttgtgacattttgtcacttctctcagctggagtagggtgcgagcagaggagctctatttttcataggagtggg

SEQ ID NO: 49925 - DNA, 4226 bp, Oryza sativa
atctaaccgtagttagtctccttaatttcgttcttagagcctgttcatattatagccaaaataaatcctaacaaatttagtaatattgctaaaattttgacaggatttttttatgtattactaaagtttggcaagaaactaaatagatgcacatatatatttgataactctaaaaagatagtataatttaaaatgacataaatatgaacgagcccttaatttccgtggatgcatttcgtagcttactagtgccaactaatcaatggcatcgttcatatatatatggacggctgcgatgatccgatcaaaccccgggaagcagcacgggaggtcgacacgtgtccccccaatccgccgcgcgcgccgctgcagcttagctgcaacccacccacccccatgtgcgcccgccgctcccgtccaagaagacggcgacgacgacggcggcggcgacccaccgcggcggcggtgaacgcgtcagcgggaagctcgccgccggccgccgtgcacggcggcggtgggcccgactaggtagctactgacctatagctagatatatagcttagctagccgagtaaagctaattagcatgcagctgtagcgtttgcatgcccatgtgttgtgtaggcaaactgtgtgcctttactcggctacagtgtcattggctttatctgagaagatgggagatttttttttctttaaaagaaaaattagctagcagcacacatataaagtctactccaactgtgttttactccctccgtcccaaaataagggtttgtttgaggagaagaagattagggagattgggaaaatacgcaaaacgagatgagccattagcgcatgattaattgagtattaactattttaaatttcaaaaatggattaatatgattttttaaagcaacttttctatagaaaatttttgcaaaaaacgcaccatttaatagtttgggaagcgtgcgcgtggaaaacgatgtgctttctcaccctatatcacacaaacgaacgcagcctaagtgtagttttagcactgttcatgtccaacgtttgaccattcgtcttatataaaaaaagattatgattagtatttttatttttattagatataaaacatgaatagtaatttatgtgtgactaatttttttaatatttctcataaaattttcaaataagatggatggtcaaaacgcttagcacgtatatgtatatgtatggacggaggtagtacatgcgagcgaattcgttggctgcacaggagcagatgaattgaatgaagttcagccagcgaggttaacaatgacgtacgtacggcttaattaactatgtgttcttgggatgttgtctcaattttaaagagcttctttatcttatgggataatttccaaaaaaaaatataatacaagtatggttgtgtacttcacatatgggataattttagtataataatctttttcaaagttgggataattatcgaggtcttttttgtaaaaaaataataaataattagtgattttcatctgtagtgtcaaacaatgtataccatttattcagtattataattaactaggtacctccaaacacatcgggatacaaagtgatgatgtaaaaatatagattaaaatgctgatgcatgtagtatctatcatctagtataatatgaatattgtaaagagtaatatcaaacctaacattttctttgttttcttgatctagaaatgatttcatagatatttaatactctaaaattctaagatctatgcagtcaagatatatggttagcggatgtgtcttacatttagtttctaggcacaattaggtccaatgtaatcgcctcctatcaatatcgaacgattgcgatcgatataaatattagtgattggccaattataagggttgacactacacaatgcattcctcttaattaataaaaaaaattaaggaaccgtaacgtaggctatttttatagatatgccattatattagactacacttccatcacttcttccttctctagtcaagttatatattgtactcgtgcaaccatttcttctagtccactgtgcttattagtgaaggcgaccaacactcttggacttgacaaataatgcagatatgcaaccaaagctatatacatcaattttttttacaacagcattttacttttacaatttctagcatgtaatttctcaatttttatatattaatcctatgtttccgcctaaagacataatactccaccaagaacataaagaacataacagattatataaactaataccaatattggtgaaagccagacaacttacttaatttgttttttcaaatggtacacacaattgcgatcgactgctatattaaagacttactagtgaatatcttctgcttatgcatgcaccagggcatcacatatttaaaaagacattgcaaactttatacagcacaatacaaaacaattgatgtcaaaatgtacatgatgaaaattgtgagctgattgtgcctatccctttccaagatggatgcatctagaagggccccaactgattggtatcttattatatagggtgtatttagttcccttcaaactttcaatttttccatcacatcaaatgtttggacaaatacatgtagcattaaatatggataaaaaaccaattgcacattttacatgtaaattgcgagacgaatcttttgagcctaattacgccatgatttgacaatgtggtgctacagtaaacatttgctaatgatggattaattaggcttaatagattcgtctcgcagttcacatgtcgaatctgtaatttgttttgttattagtttatgtttaatacttcaaatgcgtattcatatgcttaaaaaaattaaaatggaactaaatacggccataaccttgtagacatactagtatacatagcatttgccggtcttcaccgctgcattacaataataatatattgcatgccctgccacatcaaaatgagctcattctcctcctctccctagcttctcaccaatcaaccatagacctttactctcttttattttgatttaattttttgctgcggttaaacaactcaatcaactcgtcaccgtcatgcatgcgtcactagctagctcctgcttttgcatggtgccatttttttgttgcccaaaggagcacattctatgatcaaaccctaggtactaatacggcatgcatgtatgataaattttacttcaattaagagtttaaaggttgctatactatagcatagtcactttcatctcggccttataatttttttcacctggggttatctctataatgagcaaatgatcttacaccaaatctagctttttttgttctgtttttactttgacgacctagctagaagtacttaagtagaactgtcacaactgggcctttttttacaattaccccccttaaacattcccttaaattaatatatcactcctcttcctcaattcaaccccactatctatatatcctctcccattcccaagttcccatgcatgttcctacctatatgctcatctcactgacaagtatggcccacatttatttttgtcaataggaacaaaaagttgtagggtaaaaccgtaaaagaaaaccataaaaaaaaattaatcactgtctccttcctccaagtatatgtctctgctagcttgtgccctagccagtagtagtaaaaactatagaaattgactttagttataattacccccatgcatgcatgtacaacttaacaatgccgtaatttacaacaatggcgtcaccaaccagccacaaagcaagcaatcaagccagctaattaagcttagctgagctcactctctcgctagctagctaagctctagcttctaccaaccctcggcgccgtaccaggagaggccgccggcgtgctcgtcgccggcgaagaatccggcgcctccgaggtcggcgtcggccactgcgccggcgccgccgccgccgacgaggagttcttggtggccatcgaaatgcgatgacgcgtggaacatggaagggaaggagagggacgaggtgagcgtggtggatggcgcgaagaaggaggtgaaccccgccgtgtcgtagctcgccggagtttggtggtggtggtggtcgatggccgcgccggagtacggcgacgcctctcgttgaacaccgcgctcgagtcgctgtccgtcgagccgtccaccaccttgctgttatacgccagtggcggcgg

SEQ ID NO: 49926 - DNA, 3303 bp, Oryza sativa
ccgccgccgccgccgtcgtcgtcctcaacctcctcctcctcctcctcgtacgccgccgcgccgccgccgtccatgtacgacctcatgttgtcctctgcaacacaacacacatgatgttctacgtgttaattaccattgcaaaacaaaaaaaaagtctctaaattcacgcataattcagcaactagctacaaaatgcgtacaaaaactaaatgaattgtacatgtttttggtgcatgtatgatcatgcatgtaaagttggcttggaagaaatagaattatggtgtaccttgttgatcagaggtgtcatggatgatggccatggaggagcctctgcagctgggcctcttcatgagcccaattcttgagagaatcaacaatgaagagagaagatatacaaaatggatctgagaggaagaaactagggaacagtgagaagaagaagaagaagaacactagctagctgcaagaggaagaagaagaaagcttggatctacaagagcagctagctggcaatggagagagagagagaaggaaggaagagagaaacaaactggtgcaagaggccaaggagggtgtataaataaaagcatttggttgggttggggcatgtgggtggtaccaagatggcatgtggcagagatatttggtgcctggtttgttagcatttttttgacaggtaatgcccaacttgtttaatgtgctgtcatcctaattcctcttagctagctagttaattcagggttaattaattaattaattgtggtttgcggtgctgtagttttagttttgggaatgcacacagcatgtactactctgacaaaaaaaaacccaatcctagctatgaatctggacaggatgtgtcttttttggatggagaggttatgtttctgccttcaagaaatttaaaagagagaatccatggatgttttattttctctaattagtctacaatttatacatttttgtgtatatatatgtatgcacacaactctgaagtagctatatgtaatactaacatcatggaccatgcaatacatgcctaaaatgtctattttttgccattttaactccctcgcctgaattagcgaatcatgctgttgatatcttggcaaaggcttcgcagtaacctagcttaataaccccatccaatatgtataggaatggcatgtgttactgatttaataagaactttaattactcccaaccaaaaagtttgctccattcaaccgatgaaaaaaaacaaacgatcgagtatatcgttgtgcaatttacgaatgttttaaattcttttgttttggagtttttcttgtcttctaaacttattcggatttcttcaacatagtgagtctaatcatgctggtaaattagttagatgtaactctttcgtttttatagcaataaacgatacaataaatatttggtagtcttataattcacaggcatatatatatgcatgcctatggaatccacaaagtatcctgatgggttaataatctaaccacggttaagcatgactccagtttagctaacatgcaaatggaactgtaacgaatataatatttctcctaactttgttttgagttttttaaatgtaggaatgaagactatcaagtgtagacaattaccaatattttttgtccttctacattgcccttacatgcaagtaatgtcacaaatactaccaagtcaattataacagctaggactcattacacagaagtcatgacttaattaatcaaatgtgaacacacagaattagtgtagcaccacctttaaacaagtctttcttttattaaccacagttaatttgacagatatttcgagtttctatacacaaacctaggttatttttttaacaccatagatgaaatcatatttagttttctttcacttaattttatgatttgtttagatgtgctcggtgcttgcttgggttgattgtcatttgtcacatgcatatagttttataaattaaagtgtgcgtgatccatgtacattggtccggcgtatgcatttctttcatcaaattaataaagcgcagctgcgcgcagggcatgcttttttttttctttgcctttttttaccatcttctaagaaaagctagtacgtatatacttcaacttaaccgattaaattgagagtccccttgtgttatcacacaattgcacggtaatttgcaggtacttgtagaaaacgtaagtttcttacctacactgtccacatctatgctcgttggtacataggagtataatccctccgtactcgtaaaggaagttgttttgaacagcgacacgatctccaaaacacaactttgacttcttgtttctataaaaatatttattaaaaagtgatatatgtatacttttatgaaagtatttttcaagacaaatctattcatataatttttatattttcaaactcaacaacttaagagttattcatgatttatattcgtaaggtttgacttaaacattgtcttaaacgattttcctttacgagtacggaggaagtatacatatggtcggatcagatcctgatctcctccttgaatttctctctaataatacttattcccccttaagctcattaattcgaaccatttaaacggctacctgagggcaattaacatgaaaactatatattattcgaccaatctattcataaacattaactagttccactatgcttagataattaattgcaaacagtattatgattgcaaaatgcaagatatatatatacatatatatatatattaattatatcctcatttttgcttgtacactctttggtactccatcagattccatattttcggtcgacgttgaatcgttttttggtcagatctatggaaatttctgttgaaatattaataagcatcttagacgagtttacctctataattaatgttgccgtggtttccaacgtgagagaaatacctagtttaaattaaggcatttaatatgaacataacgataaatagacattctaattaattactttttggttgatgaaattatatccaaaacgatgcacaacaagcagtgatgtcactgacacgtgggtctcattttactatagcctactatatttgttcgaaatataacaattttgagctttgtattctaaatatgtagtcaaaatttactatatatacagttccattaatttcaaaattgagtagcaattttgtgttagctataaatacggtgtccgtacgtagtcgatggacggtcgagatgcgaagggatcggtcggctcacgtggtgtcgaaacgtggcgtcgactgtgcggccactgagc

SEQ ID NO: 49927 - DNA, 1540 bp, Oryza sativa
tttagtacgtgtttgaccattcgtcttattcaaaaaaatttaagtaattatttattcttttcgtatcatttgattcattgttaaatatactttcatgtatacatatagttttacatattttacaaatttttttttgaataagacgaacggtcaaacatgtgctaaaaagtcaacggtgtcaaacattttgaaatggagggagtatattactaagataagcaaaaaagaaactagcatattagttcgggagacctataaattaccacataagttagacaaaaacataaagattaatttatattgtttgatcagggtgggccagttcatgtaaattgatcaatatagttgtacacaaatataattgtatttatgaaaacataagtcaagaattatatatctatccaattcttaaaaaaactcttaaaattggtgaacacaaagcacgttaagagtagttgtacaatacgacaaatccaattcttttaaaatatagccccgcaaaaaaaaaggtctgcatttctaaaataaaaaagatctaaaaaaatagctccatacaaaattgcgcatgaaaatttggaagtatatatatgtacaatggatggatttttgcggcatgtccatgtaactatctggatttgaaattgccaaaatactatcaaattaattcttcacctagataaggacaaatcatcttttttttttcagctgatgatcgatccaattagtaagttgtaccatgcctattatcatcagccactgaaagtgattgttcatatgcatatgagagaagagagaattgaagagagagagagagagagagacatatatatatatatatatatatatatatatatatatatatatatatatatatatatatatatgcctgctaccctcccagatttaagacatgaatgatcatcaatatccattaatcagattattggctgaagctgcgacgcccatagatctcagactataattaatcaagagctatagctaagctagctataattaggtatatatagtacggtgatctcagcgagttatataattaattgggttcttagccaagaaattaagagacagacagggccaactgatgtgatcggtcgtacctgcatgcatggaggcgaattagggtgacgacaaaatgcagcagatatttcactgtttgtgatttatttgatctgggtctatcgacagcagcatatgcaggcaaacatataaacaagcagcagttcgttcgatcaatcgatcgactggcaggagtagcagctactaccctctccatgttttgatagatcagctagctagttattagctagttgctgctgtgtctacactatagagcttaatttgcttaattggggatttctttttgttataacaagaagctagccaggagttactccttaacacacactcagacatagcgctatactcctattataacaagaagcagctctatgttatttacacacactcagacataggctaaagattaattcataaatcgtgtggaatttatttaaataag

SEQ ID NO: 49928 - DNA, 6074 bp, Oryza sativa
tccgttcgctcataaaagtaatatatttaacttttatgataagatttggttaaactatcaaatgcttagtttaaaataacaatatcataaacttatatagtactttataaatttattttcatacaaaatagactgttaaagtttcaaaattttactaaatccgattctaaacatcaaatatttttgaccgagaaaatataaatattattatgcgccatgctttagtgacggtgccagagttagaaaagagttcaatattgctgtaaaagaaaaaaaaagttcctcccggggagggggagctggaatacttcgtgaaaatttaagtccaaattctgctaagttcgataaattgaacccttttcgaccaaaagtatatctacagtgcaccctccttgtggacgacgatgtagttcaattcaatagcctcaacgagtgcctggagccatgtatatatagccaaaacccatagcatcaactgctcttatatatatgggaatatatcctgtgcacactcctttcatataaactagcaaatgtcacagaaaattctaaaaaaaattacacacatacttccaatagtattacacgtacgtgtgaaatcttatcttcaaattcattatattttagccataaaaaagacaaaattctgacagatttttaccctttaatctgtcatatttttcaacttttttctacggttaaaatataatgaatttaaaaacaagactttcagatatgtatagtacaattaggagtagatgtttaattgtttctagaatttttcatgatatttgctagttagtgtgtacggagtgtgcatgtgaaatttatgcgcataggatatgtacttatatatacattaattttctataaaagggaacaccctaacagtatacattaaatactctcccgtaactaattaattaccagttgcaagcctttctatgcatataatataatcgaaaaaaaaacaaaaacccacttgcaagagtctgccccattcacacagctatagccaattaatccatcaggaaacgcacgtacgagtacgtcacaaatgtcagcaattaattaattaactgtccatacgtgtgctctacgacgtttgcaaactatatactcctgggtttgtcagcaaatttgttcgatctctctcgatcgtctcaagaattaatgtcagcatctgatggacgatgatgatatgatgaacggtgaaagagatcgagatcgagagagagagagagatagagagatagagagatagctctatatatgtccatgcctgcctgctgtaatgggcactcaaatctaaatgacgatatatatgacgcatggcaccaaacagagatgcaaacatgatgacacagctgataggtatgcttgtactacatatatatctatctctcacaagaaacacaccaagtggctgagagagagatttgcaattgcaattgcatgcactgtctcactttttgcaagttgcagacttgcaaactgtgcagacaaagttttttggatatggagaggcagatggatgagcttgctgtaggtaagattgaactgaatgtggatagctagacaccaacagcgcagcactgcacaggtgcttattttgatattttgacctcagctcggcattgaggtgcttaatattgttcaaaaacttgtatatacagtgttctttttggtgtgtatatttatatctaactgcaagctataaagatatgcatttaacatttagcattttagtatgattaggaattagctgggtgggtgtgctttttttttctataaatttgatcaaatctaaagaattttgactaagaaaaaaattcaaacgaattataatatgaaatggatggagcatataagaatggatataatgtataattaatacaaatacaaaatgactaaatgagccatgcgtgtctcggatggcgatagccacttgaaattaataaatgtacgcgtgccaatgacaaataaaacaaatgataaatatattatttgatcttcatcttatatatccatcatattatattcgtacagttacatactggcaacgatttttttgttagctggattcacaacacagtcgcaaaaataaaatcaaaagatgaaaatggccaagataagaccatgggctgccaaaggaagtttatagttgggcccatacagcggccaagttgggcctacgaaaacatgggccttttggttgatggacgacatgaataaacttgggaaaagtacaccgaaggttcctcaacttgtcatcgagatacaaaattgtctcccaaccacaaaaccagataccggaggtctctcaactaacagttttgtctgacgtgacgggtgagtcagcgtggaccccacgtgggccccgcctgtcagtacgccagctcatctctctccccctcttctctccttcctcatctctctccgcttcccccctctctgcaaggcagctagcgggtggggaggaggtccagtgaggacgacacaggagaaggaggcggcagcggctgcgactgcgacttgagaagggagaggcggctggcggcaaagcggggtcggtgcgggcggcggatggcggggaagcagctggctagctgggcgcgagcggtgggcataagcggcggtgggaggagctgcgcgggcggttcctcgcactctctgccaccagagccgctagctctcatgtgtggacgctgacgttgcccgccgccgtcatcaccacggcagctggacaccgacaccaatgtggaagcggtcccctccggcgattgcacctacttcagcttcgattccaactagcgaaagagccgcgagtcgtgcctccgcgatggcgctagctcgtagggaggtcgaggcaagccgccaccaccgccagactccccaagctcctgggagttcaccaacaacggcgaccgcccctcttgcacattccttggcgagaaaatggggatggccggtcgagctcggtgacgacgccgcccgcggccgcgcgcaccagcctgctggccctcctccccacagcgtcgcccgtcgccgtcgtgagaaaacagatagagagagagaaagggataagaggagaaacgctcacacactcccactggccacacagttgagggcgctggcgcgagatctgcggccatggacgacgacggcggcagtgtcctcgctctccccgtcggcgccatcttcctctcccacaacgtgcctgcccactgcccgtctgctctgtcggctggccgctccccgcgctgtcgcccggtcctccggcaggcctgtgcagcaggtgcatctgccgccgctccgcccgccgccggccgcgcgccgccgcctgcccgcagctcctccccccgccgccgcctcgtgggccttttgggtggcggccagcgggggagtccgcacgccgctcctcccccagtggcccctcccccgctgcccgcccgcagctcctccccccaccgccgccgcgttgcctgtcgtcgctgtcaccacagttgcgtcgcccgcgtctccatcgaattggagagaagcgagagagagatgaggaaggagagaagaaggggagagagatgagctagcgtactgacaggtggggtccacgtggggcccacgctgactcatcccgccacgtcagacaaaaccgggctcaaaaccgccagaggatctcaagcgaacggttttgttagttgagggacctccggtatctggttttgcggttggaggacgattttgtaactcgatgacaagttgagggaccttcggtgtacttttcccaataaacttctacagaatataagtccacttactatccctcatctttacatagagtttaaatgacatccctaaaccgcaataatagaaatctgcaccctccatcttcataaaaccattcaagttaggttctatggcagtttggatgaacggtttcgctgaagtgacatcctattcagtaaaaaaaattaaaaaatatatgggacccatctgtaagtgtcatacattttcttcctcactcatttcacttccgcaatcgctcagacgtggcttgcgctcgatgccgttctcgtcggtcccctcgaggaaccaaagagccgaacaaggaatatgatttagacacagtttaactgttgatctgaccacatcgtgcatatattcagacgatcatggcgacgcaatatttcgacacctctgaacattgcagtacagtaccttgagattcagaagagcaacctcgatacccatcgcagtttgaaccactacacatggagcaaaaacgaacaaaatgttcttgtatgtgattacaacaacaaaccgcatcgctgatcaatgtctcattgcactacagaattgggtgattaaatttgtgattgctgaaaatcatctgcatggttataaatttaaaaagaagaagaagaagaagaaaatttggcctgatcctgtgtttcagaagccagttttcagacgagaaggtgaggaggatggatggccaccgccgctaccccggcatggccttctccatcgtccgccgcatggccaccgacggcaccacgccccacctccggccctcttttcctactgcgacgctagagacgccaacggggccaccgaggtcgaggctcaatgccaccaccagtggctgcggctgcagcacccacccaggccccagcgcttagttttgaggcaggagattatgtctatcttcgtggcactccactcaggggagttcatcattttcagaccaaaggcaaattggcaccacgctttgtaagaccacacagaatcttggaacgaagaagagaagttgcttaccaggagcttccacccaacatgactagcatccatgatgtttttcacatgtcataactgaagaagtgtttaaaagtacctgagggggcgagtcccgataatatcgaaatccaagaggacttgacgtatgtggagaagccaactcgccccaaaaccagtgagagaagaactagaaacaaggtaatcagattctgccgagtttattggagtcatcacttggaggacgaagcaacttgggaaacagaagatgagttaaaagccgcccatccgcaactcttcgacagctcttccgaatctcagggtcgagattctgtttaggggtaggtttgtcacacccgaaagtttcccatttttccttggtccctaattcattaataaattacctagagaaaacatttatgttaatctggattgtgaattagctgaatcagcatggtagaattttcttcgaaattccttatgtttaaatgcattaacaagatttttagaggaatttttagagcagaggtggtaacatttataaaccaaagaaatcatcaggagtcaattaaacaaaattccttcctctccctcctttacccgtgagccgtttccggttcacacctttcctatacccatcttcgaactcgcgccgccgctgcatcggccaccgcgtcccccattttcttatcatacccggcctcacactgttcacgctggtcgtatccctatccaattctacctaccgttgtttttatcctctccaaaagacagcgccgccaccctaactagccgccacccttcctctgccgcgcacactgccctagccgccatcgggcccactaaaccaccaccgcctataaaagccaccccacacatcccctatttatgtttccttttttctcgccgtgtgccgccctagccgtcacccccttcctctcccgtgcgtgcctgccctagccgccgccctccctctgccgcgcccttgccacctctaccgctgccatgcatgccactgccgtcgccggtgagccctcccctcaccctcatctctcgccagcatgttttgctatcaagatcatcccctccatctaactaatctatcatgtgttttgccctattcgtcgtcgtcgtcgtccgcggatcaccgccgcagccgctcctccaccggttgctgtcattccccgatgaggcccccttccgctccttccctactcagtgtgcgcctgccgccaccgacgtcttgccgcgccgctgccgcctttgctgtgagcttgccg

SEQ ID NO: 49929 - DNA, 5638 bp, Oryza sativa
tagtaaaaacacagtaaagcttccaaaattcctttctaaatcattcaagctccattttaattcattcaagtctcaataaattcataaaaatgtctagaatccattaaaatagttttgtttcttgtttagtatatttatagcatgttttgagtgcgtgctttgtttgtcgtatagaattccgcagttccgaagctcccgtttattatgaagtggtcactaaagttcctccagctcaggagcaaggcaagtcatacatacgcattgatcatattgtacctattttgtaaattcctcgcttttttcttaaaatcgcattgttttataatgtcacgagggatggatacgtaatgtaactcagcctttgttattctatatcattgatagcttgggatataaaatgattagatgattggtttaggtgatgcttagccatgcttagatcaattagtacactatgggttccacacgaattcttagtccttaatttaatgatggaataccaccatgatattaattaaactaaaacatgacaaatggttggttgtgggtccatggttttgatagtagcaccccatggcaattaaggacctgttcttgggaaacactggaggaattacccgtacttaccacaagtcaacgtgggcaatgattggatttggagtgtagcttctttctaaccgagtaccaacgatagggtgggcgtgatgaagtaggatgggtcctgcgacgacctctgctacttccaaatccacctaggcacgagtgggggttgtccactgctggtttatgggtgggggcaaaacctgatgtgggtgcgatttgttaggaagggttatatgaagggtcctgtcagaacctctttccaaggtagcatggtggtattgaggcgcatggtaccatgtcgtgggctgtcttgtgggtaaagttgtatacctctgatcagagtaaagctattcgaatagtcgtgcccgtggctatgggcggtcaaccagattcactgtgattagtctcaccttaataatttgatatattgaactggtttagtgttgggcatgtttcaatgtgatttagcgttgagcagtgatgtttaatattgattaatttatatctactattttactatattcaaattgtgatatgaaaatgttgcttatgcaaataacccatagctctcctttggtattattctgcatcgtgccttctattggttgttgttatggcttgttaaatacagtgggtagtactcggtcttattttatttttcccccaacacttagaagcaaagtattattcggatgaagattattgggaagagtaggcttgttgcggtcttgcggacgtcaaggatgcctgtggatttggagacgctatgttttcccaagagatggatgattagctaattcgattatttatttccgctgcatatgtaagacttatttatatttttgtaagacatggatctgtgtattaatattgtcgtttgtgtatcttggctagtctggacagagatttcaatacacattctgcttaaaattcggatcagcgaatttttggacgtgacaggctactagctgggagtctgggacccctgagctctagctcctgcccgcccgtcgcccatcatggcatggtcgtaggacacaaccggcggccttttcttggcttccggtatgtatctatgctgatctagctcatttgtgattagtgaatccataaatattccactgccaatttgtgattttattggcaatgaagtctatccaatgggtgagagtcggttgaatctctctccaaacgcgatgacgagctactcccgacttggtggtgtttgttctgaagatgaagataaagataaagattaagtttttcacgtaaaacgatgtggtaatagcatgtaattaattgagttttaattattacaaacttgaaaaatgaattaatcttatattttagaacaactttcatatagaaaattttcgcaccaaacacaccgtttagcagtttaaaaagcgtgccacgagtttccaaaaatttatccaacctttattagagaaaagaacaggacggtgctagatgcttcttgtattgaagcatgtcataaagattgacaaaacagccgctataacataacagactttgagttgagtcgtgacttctactacctccgtctcaaaataagtgcagccgtggatatccgtatccaacctttgaccatccgtcttatttaaaaaatttatgaaaaaattaaaaaaaattagtaacacataaagtactattcatgttttatcatctaatagcaataaaaatactaatcataaaaaaatttctaataagatgaatggtcaaacgttgaacatgaatagtacaaaactgcatttattttgggacggagggagtacttgttttgcatttgtatcaaattttaactaattttatacttgtacacatgttttatctgtgttcgaaaattttattatgtgatataaacctgtgaagtaggactatccaacgaaaacttactagctacgccattacttgtcgcacatttttttttaaatgtgctaggcatgatgtttaccactctctaagctggactgggattactggtattcaatgaagaccagatcagtatgtcgtgccacccatcattctgcttcgtttgcttgcttgcttacacaaacccacagcttggtgtttacagctgtactaacggctttttcaatagagtacgatcagtttattcaccgaaagataaagtatatatatatatataaaaaaaaagaagccgaccagcttaacggctagtcccgtaacaggcggaggagagagagactttccgaccagcccgttacccatccatccccaccgtccatcccggatcgggctcatcctgatcctgccacgtgtccacgtgccctgaactagccgttacgtcctttcgtccccgcctggtccccgccgtgagacgcacacacgttcgctgccaggtgggtcccacctagccgggcccgcgtgtcagcgtcgtggtggcgtgtccccaggtggtgtgccccacgttggtggaagggaatctgatctaacggctagttttctccgccgccgcctataaataccacgtctcctacccgcctcgccaaccaccacacatccagcgtccatctctcccactagcgcgaatctcaagcacttctgcctcgtcttgtccggcgaagagaccaccacgaccaccgcatcaatggcccgcctcgccgtcgccgccgccgccgccgcgctcgtcgccatcctctccgccgtggcggtgacagcgcagagcccgagcgctgccccgaagatggccccgctgccgccgccgctgaagatggggcccctgccgcctcccccggcggccaaggcccccaccgcctcggcgccgtcgccggtgacggcggcctcgccgccggccccgccgatgtccccggcctcgtcgccatccgacgcggcggctgcggcgccgggccccgccgacgccggcgccgcgacggccccgtccagcggcgtgtccgcgcccgcactcgcgcccgccgcggccgggaagagcgccgccggcgccgtctccgcctccttccgcctcgtcgctgtcgccggtgcgttggccgccgccgccgtcgtgttctagatttagaatttttagatagccgcggcttcgccgccgctgctgttgatacttgtactctaccgccactctgttctcgtttttttccccattctttatttgtttgattaattcgagaccgagagggagattgattgaaaatgagatattattcgggttttttttcaagcggaaatgattatcattacatgcttcatagaagataagtgaagtaatttcgtagaacattatctgaaaaagtttgataaattcttctcccatttgttgctctgcttaacaggggaatattaacaattgaattaaccgattcgacgaatattggctaaagacctaagaggttttgcacaaacaatctgaacatttgtacagagctgaagttgagttctctgaaaatttagtgcttcttaatggtgcctcttgtgccatgcttgtgattatctataatcggctcgatcatcgtcttcacgtcctcttcgatttcgtcaacctgtagaaacagtcaattcgattgataatttctggtgggactcgcatattaaaaaaaaaaatccggtttttccggaaaccatgcccccaccatttgtctcattttaccgacaagttcaaattcaaaaattgaaatcatagctatctgcctacccgccagaaaaattcaaattgaaatttgaatccatagcctacgctgtttttggtaccagaagacgctatcttcattgtagtagtctttatatgattcaaaattattctaaaatacttatcttattgtagtagtctttatagtagtccaaaaatactttcggcagatgagatagttccaaatattgaagcaatattctcttttggaaccatcgtatcttatctaatctctgaaccaaacacataaggggatgtttagatggggctaaaactttttagctcatgtcacaacccctaaaaatagaatgatcccatcccaggacatctcttcaaccaaacacatgcctaaagtattagttatctcatgcatcatctttcatttaaatttcttcctatgatatactctcgaatatcactccactatccacatcatttaataagtgccaatatagccttttttttccataaaaagtcttaatgtatgttaaattatctatatcattgtagtagtatgtattttgggacggagacattagtagaatagagtagaagcaacataaaggtcagggtttcagtgttgcttaaagccatggagtaccatcgttttcagtaatccagtgttgggcaaaatagcagatttcttactcctctgttatggaagctgcaaaactgtgatcagataaggattaattaatggttagtactaaccttgtggatgatgtcgtgggcgagatgagcctcctcggcgacctccctggacgcgcgctccaccagcgccgccgcccgccgcagcgccccgtgctccggcagctgctccgcctccgccacctccgccgacgccttctccaccgccgcggccacctcctccaccacctccgccgccgtctccgccgcgtccttcaccatctccacctcgcctgcaattaacggccatccaacgaatctcagatcgtgttcctgtccgatatgaattaatcgcaagaaccaattcgtgtgtgttttatgtgtgtctgtgttgtttttttactttggattcggagaagcgtcgcccacttggactgcaagaacggcgccatggcggcgaggacgacgaccaatcttgccctggcaacagaattaggacaagacggaataaaatttcgtggtaaaattggaaagcgcaactgattgggtggtttaaatctaggtgtccacgaatattatgcacatacaaataagttttcataatgagtttagttttcataacgaatattatgcccagaaatattatgcacatatattcgtgaagatgcgagtgcggtgttccgtgtgcagtggcgttgtgctcctctgccgtttaatcgaagaaaa

SEQ ID NO: 49930 - DNA, 3083 bp, Oryza sativa
aaaaaaattcgtggcaaaatgcgtgcaagatcgatcaatattacagcgcgcgacgggctggctagctgtgtaccaggtgaagagaggggctgttccttctttgccatgccggcgcggtgatcctcccgtgtccgccgcgccgccgccgccgccgccggtggtggcctctctgcacatgacaccacgacggcaaactcagcggccggcaacctgacgacagagagaccacacggcgacagagacagcaggtggagcagagtaacgtacatgcgatccaccctggacaagaacggcctccgttgatccagcgccggtgctcgcgccgccggtgtccccgcggtggcgccgccgccgaggcggacggttcgccggagcccctggcagtagagcgacgccacggacctgacaagggccgacatttttcacaacgatcgaccgcgatatatcggagtaaatgtctatttgatcaccggcctatatatacacgtccacatatatatatagttcaggtgacgcgaggatgagaggctggcttgcaaggcatctgaagtggagtaaattctgaactgatctgataaggatatctgaatatatgtgataggatgctgtgctgagctgggtgaatggacctgtgggcagtgtgcactgcattacacgtcaatgcaaagccactacacacaacattgcttgcaagcagcgtggtgctatgtgcgacaaaaagatacacatttttgtagagatggaaaatcaaccaaaaaaaaaaacaaattgagctaggcttgcaagcaacaggcaggggctaattcatccacttgagttttcttttcttcttttttttttgttctgttctgtgttggcacacaacgatactccctcgttctataacaaaccatgcaacacatcctattacaacaaatttgaatagaatgtaccacatccagttttatatttgttgttttttttgaaacagagggagtagatgtgaagatgagtaatacacccaaatccacatgagaagcctctttttctggagtgcgctttccatttgtaatgatcaaaccattttttctattggtatcagctataacgaagtgacacatggcaccattttcccgaagacgctattagttccatgcttttccaccgtttctttttctcccctacaatatactccgtatgtgcttacttaggattacgcatccgtaaaatgtactctgctcacaggtcatgaactcacaatatatcgaacgcttgaaatatggtcttaaacgtaccacaaaagctcataagcgtacagattaacacacttttgtccaatcatggaatctaatctcaccacgatggactgattacagggacaaagaatctcgaaaacgaaaaagagctggtccatgatgattgggtacggcccagcccataatggtctattcgatattatcaacctatgaagcccataagttatatttagtgggagaatttaggcatggttatttccagcaacttaattggattgttgtcacgaattagtcgttccctacctctctaaaactatattttctacaaagaaacttccttatacatttagatccactcattctaagttattcattcattaagtttatttatcaatatatttaatttgtatatataatcgtatggataatcttctacaataatctggttcaacatgggaccttttccattggtaccaaaacttttgcaccggaaaaaaaaaatcaaactccggtcgctacagctctgtgaaatctcttcgagttgccacttccattgtgaccggctgtaaattgtttttaatcttaacaattgtgctagaggagaggctagatgcagctcaatagaggtagggtgagttcaacgttttctcgcgaacgcacagaaaaattgcacgccaatatattagaaaaaaagaatttttttacacaacgcaatcagccagaccggtctaaactttttttttccttggattgcgttttgtaacaaaaactctttttctccctttccctggtttaattagaccggtcatctttttacttcacccgcagaccggtccaaaccaaaccaggggaagagagaaaaagcaaaacaaaagctgcagcaaggaaaaggagaaaaaaaaactacaacgatggctaagcgcaactctgatcagctggtgagttcaaagtgaaaagatgaaatacagagtgtccaaactaaaacttgaataataaaagatggtccaaattgcaatttactcaatttatttccccgtatcattttaagtgtagttgtgggtttcaatgtccaacgtttcaccgtcttatttaatttgtttataattagtattttttattgttattagatgataaaatgtgaatagtacttcatgcgtgacttatttttttataatttttttaaataaaacagatgttgaaacgttagacatatgaacccacaactgcacttagagcaaatataatagagggctgtaagaagatcaaatactgatgtggataagagaggagatgagagagatgagaaacgggctataagcttgcagccagcttaagcacaggaaccaagaaaatctgtgagacagatagatgggccatatatttatagtgagtaagtagctggttgtattattagcttctcttgaaatgagatactagctataattacagaggaatacaccgtttaatttctctagcatttccatcaaatctgctcggtgcaatgccattcacgagatggaattaggtgtagcactgtagctagcagtgccttttgggacacgtgggggccatggctgcactgctcacctctggggatttgcttccacgtcagagacacacaacatgctagcttcatgtgccagcaaagcttacgtgtacggccctgattcctcccatcacatattccaagtgctccttttttacttttcttttctttttctttttacaaaagccacatatattgcacgtgttttgtctgcactctcgattggctactttgcacaagaatgcgcaccacattcagaattgtaacatgctttgtgatctggactttctgtaggttttaaa

SEQ ID NO: 49931 - DNA, 4163 bp, Oryza sativa
attaaattcattccatcttcaaaccaaacaacgtgtaaagtgcattgtatatcatgacgtctctcattttttagtttcctttcagtaccaagtaattgatccaaacatatagttaattaaacctctccctgcttcttaatatatgccaaaaccaccatatctcaaatattatattttctagctagctaatactagttcgcaataaacatttgatgcctgcactgccaagtgccattacatacaagagaatccccagctggagcacatctgggaaagtaggcagctgcaggcagtacaattcacaagctagttttggcatcagcaaaagcctgctcctcctgcatcctctccagaatctcatgcactgcagttgcaatctcctccacagacccaagcttacatccatcctccacctacagttatacatccaaatcacaaatcattattcttcgcatcataaatcataaatatctattttgttcacataaaatatatattaatacattttccttaagaacaaaaaaaacaaatttgccacctctaaattacttttaacatttgtcaaataaacaaggtagatgctaggatttgaagtcgggtgggttggttggatcatgaaacagatcaatataaaatataagaaaaagaaaaatcgaacaccattggtggttgagactgaccttgaggctgaaggagtacatggccatggcggcgacggtggtgacgttgagatgcaaggtggtgagccctagctggtggagcccggcgacgagcttgagcagctgcctcggccgccgccgcgcctgcaccttgacgctggcgtggccctccaccatgctcgcctcgatgtcggcgatcgccgcgccggcgccgccaccggcggccgtagtcgtcgtctctgcaggcttgacgacgatcctgctgtgtgcatcgccgccgccgccatggccggaggtggcggtggagtactgtgggaaggcgaagaagccggcgaagggggagggagactcgccggcgccgccgtcgatgtggtccttgatggtccttctcgcctccagtgtttggagcagctgctctagttccctcacgtagttgattgctcccccaactatggatgcttggtcaccctagaaaagaaaaagaaaacaaaatctatcaattcgttttccatgaaggtgtaaaagtaaaacgatgttgaacagatgtaaattttgaaatgtgggtttgatctgatttatcttctgatggtgcattgattttgaaattcgataaatttagaattgatatgaaaacaaataaaaagattaccctttgggcgtaggaaggtggcatgagggagcggagcacggcgaggtactcgttcatctggcggcggcggtttcgctcgacggcaatgtgggtcatccgctggctctcgatctcctcccggttcttcgccgccttcgcccgccgcctctttctcttccccgccgccgccgccgccttcacaggcggccgcgccgccaccttagaagaagaagaagcatgctgatcctgatccacctcccactcatccacgccctggatcacatcaagagacgcctctgccgcgaacaggccgggatcgtcccagctcccgccgccaccggcggctgcgaagacatcccacggcgccgccggggcgccgcccatcagcccgccgccgtacccgccgaaatggccgccgtgggagtaaaccaccgcctccagcgccatcaccttccaatgccagcaatggcgtgcggtggctggccggtaagtgtgaacgaacaccagcccgcaccggccggcggcgggggaggaagacgacgacgagcgaggtgaagaatatgggaggagaagacaatggtggtgggtggccaatggagatggaggaagctaagctaagctagggaggggttttatagagtggaaattggagcaagcaaagagccaaggttagggtagctatagccaagaaattgaaatgaaggacgacatgaaggtcccacaaaggagaaagattgggggtggctggattttgtgcttgggggaatgagacccaatgattaagtatttgcaagtagctaattagggggttgtagtgttcaattaatctttggttttctatgcaattgggcagggcaagaggggtgcatgtagagagatttgatagagaggtttgtgggaggaaaacattccttcttgccttgaatgtttatgtggctttttctccttaattgtttattgatgattgtggactagtgtctagtggttgtatttttgtggtttaggaggatgtgtaagcttgctagcttgttgaacttgatttgctatgcttgtgttaggaacctaggatcaaataatggtgagtttttctccagataaggataaccaacgatagaactagcatgtagaaattttgtagagcctgactagataacactagcatcccacatactttggtgtggcagctcgagcaactatatattgacgcagctgattccaccaccgggttatagtaaaaaagttggtaactaaaccacattttgccatcactttttggtgtagtacacgcatgtgggtacggtggaaccaaccaaccaaccgatcttatatgatgttttcagtatattttctgcgtacatatgagaagtgtgtgtgtgtgtgtgtgtgtgtgtgtgtgtgtgtgtgtgtgtgtgtgtgtgtgtgtgtgtgtgtgtgtgtgtgtatatatatatatatatatatatatatatgtgtgtgtgtgtgtgtgtgtgtgtgtgtgtgtgtgtgtgtgtaacactatgatactagactaccgtctaatatattcttttctagtgttttacgctaacaaaaatggtccactttttaacatgatcatatcccttataggttgtgcacatctcgatcacgaaatgccaaaaatctgaacagtgacaatagatcatgtctactgcacaaacctaagtgatgaccaaaagaagttttcttgagtgacgaaacccatcatatgtggctggcatccaacgtactacgacattgtagcgtgacatacccaacgcccatttgccgcgcaccggttattaagctgatcagacacctgcctagtgtcaatattattaattgtttcttggtccgtgactagaatagtagtaaaaattgctggcaaaccaattccatcttattgtgatagaaattaagagaaataaataagcttaatttagttaatatataacaaaagttatttgtaaaattccaaccattctatttatttggaaaatatccaaaagattaaacgagaatagaaaatttccacctcgcctaagtagagatattttacaaataaagaggaaactaataaatttagttagaaaataagataaaataaaatatttttgataccaaaatatttggttttttgataacctgctacacttttgctaccattttttcggggcaataatgcattgtggatacacacaccaacctaaccaaccaacctcaaatggtttgatcttgtagtgagcatttttcatatgcacaaaaagtaaattttggcgcaatactactacaatacaactagataccaggtaattatatatactacaatattttgatttttgaaccactacagaaacacacaaaggatacgacactataggtcctgaaacagttaaaaccggcacctatagtgcttttcccaccacaaacgcatacccacagagcaccatcggttagaatcgacacctttgggaagaaataggggccggttctagagaaaaactagcaccaatactatatgtgctagtttttttaaaaaactgacacctataatatattataggtgttagttaataaaaaaccgatacctataatatattataggttttggtttttttaaagaaaccaacacacgtaataaccaagctgagctgagccgagccggccactcacgagtggatatggagagggaagggccgagtgggcgtccttatccactccactcacctcccagccacgagggcgctgcagtcggcatcgatctgctcggaggcggtgcgagccaccaaggccatggcgtgcaaggtgctgctgcgggtggcacccgcggaagagaatcggtagctgggacgatcggtggagcagtgccggtgcctggg

SEQ ID NO: 49932 - DNA, 8964 bp, Oryza sativa
  unsure (1)..(8964): unsure at all n locations
aattcctgcagcccgtgtcattgttgcatgtcctatatcatctttagttttggaaaaatgacaactcgaatgacaatattattagcctcaatatttacgagcatctgaatgtgttgtggatcactatatcatgactccaccacgtacacagcttcaagtagttctagattagaacttacaggaccgtctataatagagtcctacatactatataaaccagtaatatgtgatcgagttacgtacgctggaagtagataattaatcacgaaagagaaaaatgaactcatatgccagtgagctgaccacactattgcgacttgtaagcttgacgatagagaggggttggagccttggaggtggtggattcagcagccggcacggtcaaggtcatcagagatgttagatccaaatgccaagtactccagaagagttagggaggttggctggaggcatcggggactacctcaactaaaaaaaccattttttgcagacgttggttttttttcttaggcgggtatcgccctagaagataaatggccgcctacgaaaatgacatctgtgggggtgagattattgcccgcctgcgaaaatagattttcgcaggcggaccttaagaagtccgcctccgaagatacctttatttttgcaggtggacctcttaagagctccgtctgtgaaaatatatttttgcagtcggagcttttaagaggtctgcctacaaaaaaggtggacgatattaaaaatgccgctgcccaccaccaaaatcactaagtcccacaccaaacacctctccctctccgcctctctctctctctccctcgctcctgtcttcccctctctcccacctctcctctcccgggagatatggcggcggcggctactggtggcggtggtggctgacggcgcgaaggtggcggctaccagcgggaggcggagggtacatgggtgggcgacgtctcccctcaatcctcccagatccggtggaggcgacggcggaaggcggcggcggtgcagaggtggcggctaccagcgggaggcagagggtgcatgggcggaggtgtctcccctccctcctcccagacccagtggaggcagcacagtgggtggcggcggccctctctaccgaatctggcacggcatcccctccggatctggctggcgacgagcgacctcccctccagatctggttggcggcggtggtcctcccttcggcgatgactgtgatgcatttgttttgattgtgaacgatgttgcttctatgttaatttgtgatgtttctgtgaatttggattaactgggataggaaatgggaactagattgggaacgagaagctgtagcccaccgaaacgacggtggctgcccattttttttttaacgtaggaaactcttttcgcaggtggaccagttacccgcctgcgaaaatcaactatttttacaggcggttgagttgcaagcggaccagttgcccgcctgcgaaaacttgtttagcccgtctggaaaaacatttttttgtgtactacctattccttggctttctcaacaacgaggaggggcttgtgcagcgcttccttcccttctcctacatcggcattgaggcaaatgcccacaggaaataatatgatcgtggagataatagtacaaattttaataaatgaatttattactccctccgtctcattttaagtgcagttgtgggttttccgtgtccaacgtttgaccgttcgtcttatttgaaaaatttatgaaaaatatatttttttaaaaaataagtcactcataagtactatattcatgttttatattgtaataaaaataaaaatactaatcataaaaaatcaaataagacgaacgatcaaatgttggacacagaatcccacaactgcactgaaaatggaatggaggagtaattgctacatcctccgttaaaaaaaaaagaagactttattaattaatatatggctatatgcaggcagtttgacacagaggtagtagtagaatccagtgttgtcttatattatacataatcaggaggatgactacacttccaactctaccacaccctccatgtgacagtgggcaggcaactatagcttagcaagcttaggtcatgcatgtgaatatcttgtacactttgtacagtgattttaccctggcccagctactattatgtccatgtatgtacgttcttgttgcatccggcgccgctgcagcagcaatgcaatgcatcatctctctatatgtaaagactacactggagctcatgtgatgtttcactgcaggcaggttgtgtgcctttcacaggcccctagtatatatgggtgccctaactatagcttgcttgatgtgatgatgtttcttctgccaatttaacagttttatctgtttcagcaaaaatgtttttagctttccaaatttttggaaactttctagaggttgagccatcgtttgactggtcaacttaagtaattaataacctctataggttgaacctattggttgatactacaatacaagttttgaagaacacgtacggccggtgcattattttgcaatctaaattaacaagttgcggaacaaaaactaaaaactagtagaaattatacttcaatgatcacctatatgtactgaaaacttggcgtgcgtgcataaacattactatgcaatgataaattcatacatatacatgatgcttcacgtttgccggcttcagctatgagccaagaggcccctgttgcaatttggaatgaaatgaatagcataaaattaataaagatatatatcacaatatcgcggagaagttcatttggtttattggggatcaaatatataacaagatcttgcttgatgttacaggcatgatttacattgttgtttgtagcttcagcaaaaaaatagccgtgtcgtcagcatcaaacaaagaagctaggggccggaaagcgaaagatgcatgcacacacccattttttttcacctgaactgatctactttccgaaccttaatttgtcatctagatcgatttgcatttcattatacaagccattttttcaaggggtcaattgaatccatgccattacaaataaaccgatttacataaatactactatatttcatctatctgtatcaatgccattatattcaaattcacacaaaatttcaaccgtgccactactaccatcctgtttttcatcacatccttttctctcatcctccttcctcttttttttctctcctctccgtcccatcgagggtcgaagccggccgccggcgagtgctcatggcggtgtactctcctcctcttcaaccagtgttgtaccatacagctgcacagctggagacaaacccctcccgcagcagcaatggcggccgaccaagttcggtgatcagccaccgcagccctccctagggtggagccccaacctcaaccttccctacccgctcccgcccacgcagccgaccgtggtgtcgctgccggccccgcgctcgggaggacccgcgcttccactactaccgcaccatcaccacgttagatctaaggtggccttccgcttcccgaatgaccagggcttcgagggcggcacgaacggtggtgtattcgtagaacaggctcaccaccctagtgctagcgcggtactcggggcgctcgagaggcacacgacactgttgctctactccaatcggctcgttggctcgctcccgccatcgctgggcgggctggctgctctccggatgctccacatcagcgacacctcggtaatgtcgagccctagccttgtcgtgcttagcaggctcgcaaacctcaccgtgttcgagctcgcgtcctgcaacctcaacaacacgatcctgaggagcctcgggaggctcaccaaggaaaggggagggcgtggggattggaaggacgaccgccgccaccgccgtgaccaatggcttcgccaacaatgtcctagagacgcaccctcctcgccaactgctgcatttgaaatgaggtggagagagatggggaagaaaataagaggggatgatggaggaagaagatggaactgacatgtgggtcccatatctaagggtattttggtctatatgatgacgaaaaacgtgacggtgataacgtggttctaattttgcgcgatttcggatggtatggatacaaatagacgaattgtaatgttatttatctgaatcactatatttttggaatgctatggattaaccctttgttatacataataacttggtaggtaccctccaccttaaaataaatatatatatttaacataaatatagacgtagagcgcttatatcaatacttgcgtataaaagttaatttattttgggagggagagtagcatatatttgtgcatatatacgtatgcccattaaatacgaagagatgtgcattttgtttttcatgcatagattgcataaatagtcggtcatttgttgcatttgaaaaaacaccacaagataaggctggagacaggaattacacgtctgacaacacgcgattctctaaccacagtgccaatcgatatgcgtctgcatctgtaagttgaagaataataacaaatttaatgtcccctggtgctagctaggagtatttgtttatatcatttacaaacaaacaaataactaattaacgccaattaattaattttctagaaaacaaaattatcaggagtacacttcacttggacaggtcactgaaaccagtgactggttatgtgcccttaactaggggcggcagaacaccggattggcttgcggctgatagttttttgatggccatggtattggatctggacaaaataaatcccaaaatgattctctcttccctgtctctgtctctgtctctctctttttttttcctctctttttttgctgctctcacacgcctggaatctaatgtggattgattaaatccttcttttccgatggcatcactttctgatgcacacagcacaaagagatactcccttccgtcccataatataagggattttaagtttttacttgcaacgtttgactactcgtcttatttaattttttttgaaattattatttattttatttgtgacttactttattatctatggtactttaagcacaacttttcgttttttatatttgcaaaaaaaattcgaataagacgagtggtcaaacattgcaatcaaaaactcaaaatcccttatattgtgggatagagggagtagtatatagtactgatcatttcttgctcatataacatggggttgtttttattcagtataaaaaattaagttggctagaagatacaagttttccctcttttttttttggtttttctttgggagtatatgttcaggggatcaagaagtgctgtgtacgaccaattatataaaaagaaatgcagaggcagaagacgagtacaaattaatgtcaaattacatagtatatatcaactgtatacatggtacactacttgacatgagaaaataatcatattaatagaaatgttctaatgtacggacctttccatattaaataaatattgtaaggatcataacgagattaatttggtccacctcaattagattcaaaataaattttatattttttaaatggtcattttcaaagaataaggagaagaggtttttcataggccgatttcttaaaaaccactcttaaaatgattcgcggttccaataaaaaaaattgattcgcggttccaataaaaaaaattgattcgcggttccaataaaaaaaattgattcgcggttctcataagaaaagaaggtctgtaaaagttggtttttgtggacaattctcttatggaaagtgccctggaaataaagaaatattatttcaaggaaaaaaaatcgcaactctttgctatgagatcaaatgatgacaaattaaattatatatatgaaattgtagctcaagttgaaattgtttcctatttacatggtttaaggggttcgttgagattttggatgtgctagctctatttcaacatatagatggacataatccaaatccaaaaggttgtttctttttgtgaaactacagcatttgtaagtacttgctcaactaagactgctactatcatgatgttctctacttataaaagctctatttgattttttttgtttgcctcagatcgattactaactgacatacgatgttatatttgttctcatcaaagatttaaggcgctttcaaccttgcaagctgccctttatatgtatcaagctcactatattgttctaattctttcctgaacaatttaatttggacgtactacatgaaaacagtaccataagaacaatcacacagaattaaagcggtataaactaaagtatgtagtacatgttataggtattatattctccttgttttttgtaggataagaaaccttccaaaaaggaaaatttaaggtatgttgttggtatagtactatatatatatatatatactattcttatgttttctaagaacattttgtttcttcaaggacaattaattatgtggaccaattgttttgatcagcctatgatataataataaatacatttgctttccataatacataaggtggtcaatatatatgttgcgaacagctagctagtcatcaaaaaaagttgtagggactagggccggtgacattgtaacaaaatttggtactaacagaaaaggaaatcttgctgttttgtgtagatgtattattagcttcaatttggtcatttaatgtattttgttttgtttgtttcatgatgtcttcaattaatatacatgacatactttcactatgaaatctcgctgatttctcgtgatatttcgctatctcggtgcctctagagatattattaccctggtaaaaaaatttgagttcagtcaatttctttttatttattgattaaattattcaaaccacttctaattcaaataaaatatgataaaaaacaatttctctcagcgagattttcatcaagattttgacatttcacgagatttcgctgtgtcaggccctcccaagattttagtctttaatttcgttttattccagtagttagtacatacaatgacaagaacagaatgtgctctttaagtatttaaggaaaaagtatatgtttattctgctaaagaaaatctctaactaaggaacttctctcaaaaattttcatcccactttcctgtcgcttcgctccctaatggtatctgttttttttttcttttttctatttgtgcaagtctatgcatgccaagtctttttttatgttgtagttttgtggagcaatagaggaaaatatagggtacaaaacaaaatactttagaagttatgcaagaccactttcatgcattttcatatcttgaggatttaaacatgccttcactgtaccaatctatgatagttcaggaaagtgaggcaaataaaaaatcttttaactgtttaaattttcagcgaaataattcaggtaaataaagcttagcactttcctataaaaaataaagctgtttaaatgtgtgtatccagccttcaatgttatacatccttcattaatttacatggggtataaccctaaaaagaattacatgggtatatgaaataatattaattagtaccaattaattcttaactagtgctatgtgtgaaaacaagattgttaattaatctatgcgaatcttggggtgatggtgtgtggggtgtaatagaaagatttcattatatctctcatgcatatgcatgcatggtttattgcggcgtgagattacaaagtttggaggcatgctgttcatatctctgccgtctgtgtattggtcagcaacctatcagcactaccctatctgcttaattaaacaatttatacaaacaaagctgctagcttaagaaagaaacattttacaaagattaattgatgttgtcctaaagtaattcaaggtggtttcattatggggaaaagtctgaattaccccctgatacaattatggttgtcagaattacccttgaacacaactaccatatatttagcatcccacctttttaaccggatgaattagcccataacttaatctagagagatttttttctgacgtgatgtacatgtggcaatccagtcagtaaaaaaaatattaaaaaattctataggctccacatgtcaatgcatcctccatgttcctctcctccccgacttgaccccagtagacaacgacggcgaggtgacatggacatggactctgatgaggcgtggccttagccactgccacacctcttcctaggctcgacctgggcaggcggcgacccgtggagcagatagttgcaatggaggagcccatcgtgcccccaatagcaagagaaattatggggaaggggccaaggtaacgatggtgccagtggccaaagcgaaggaggtgacaacgatgacactgatcggaggtgatggagtggcatggcaagcagctcgaaaggaggggacgatggcagggagactctcggaggaagaggtgatgggacagatgtggcgcggcatggtggcctgcccactcgtccatgaaggtggcggttggaggtggaggaagaagccgagctcgagctcccctcatggaggctggtggaggttgcggccagtgaccgagctcgagctcactcatgaagggaagtagaggtagatctcgagctctcttcgggcaggtggtgaagactcgagacatgtgaccgatggacccggagctcgatcgggatggtgcaaccagcggtcatgtggaactcgcggctggtagtggtggatctggtcacaatggagggagatgggcatattcctcaccggcaccacagtcctctaacttcacgatccccatcatcgtggcaaggcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49933 - DNA, 3509 bp, Oryza sativa
ttgattagcatgtgatgtgcatgtgtatagtgagtatgcataaaacatgctatgtattcataaatttaatctctactttatcctttatcattgaaatgatcaatatcatatatttctaacccttgtatcgttgctcaactttcatatctttctctacaatcactatgtcccattctataaatttttactgaacatatgtctgtctaaatagcattctcacatatgtgtgtgtgtgtgtgtttacgtagtatgctaattaacacatgaatcgacaagattaatcaggcactcctccactcttttcctaacaaaaagatatctttcatcttttcctctctctagtcactggaaacacccattgcaagtcttgcacaagtcaccttatccattttcccctccaatctcccaccacaagtcttgtaagtgcagttcgatcatgtttctgccaattgccttcgatacatagtgcttccctcaccatcaccatgttggcactagcaagacccaccagtcatcccctcccaactacctccctctcctcttcatcttacatacatgatgttatcatctcccatcttcatcaactcggcactagtatcctcacactcccctctttgaaaggttgatcagtggagatcttttactgctatatcctaactcccgcttgcgaaccacatagaatctctcacacttgccattaaccccactcaccaccctcttcttcgtcctcgcggctccagcaataatatcacttgcacctgatcacctacccgtctctgccacccaagctttccctctaaacctgatcttatagtgccccctaccaagggaaataatccggcctagggctatactaataactttgtttatttaaatttgtcgacgggggataaccgcagactgtatattgagggttggggtacgttggtacgaggatctacacgatacgacatcaagcacatagaagacaaagattatactggttcagaccccttgtaaggtaatagccttaatccagttcatatgggattatgagaaaaaaccacagaatacaataaagaacaacagaacttcgagattactgatgagatccttgtcgagagcgtcttgacgagatttatcggtgagtaggcttcaagttcgtccagatcgcttaagttatggcgggtatcttgtgctaagattcgatgttcggtacccctcaaggggtctctatttatactgcagatcaccttagtctccgagtaggactcggagacaatggaccccgtacaataagataatatcgtcatcttctccaaatacaactctgacaccttctattcgtagagattgtttcctcaagaacttaacaatttcctttaactcaaaaggatacttcccgtatacttgaggatatatcgtatccacatatctcatgactcctaggataaagggtatgttttatccgtaaccctgacaaaattttcatgttttttttgtaggatctaaaatggattaaactttaaagagactacaattgggctcaacccttaagtacccttgtcttgtctcctcgctgcccctacctccatcccatcataaagccctaaaacttaatctagaggagctcgccggagttaataagtttgagtcgctatcattggagtgccataggagaagacgctgccgtcggtgagttcttccgtccgtggctttcataacgtctaagaagccgacggctaatttcaatctacttacagtagcataaacaattgctggacatagatggagtaagtatttgtccaaaactccaaatacatagctaaaaggttactactatatagagagtaataattcattagtcacacaattaaactcactcacaccaaatgaatgatacttatcacatggaacccaaatattctcaagtgcaacaagacaagctttgtacagtagcagcagcagggatcagtgattagcagctgctagctgccaaagctcccgtgagattaggcttaatttatactccctccgtctcataatataaggattttgagtttttgtttgcactgtttaaccactcggcttatttaaagaattttggaattattatttattttttttacttactttattatccaaagtactttaagcagaatttttcgtttttatatttgcacaaatattttgaatgagacgaatggtcaaatagtgtaaccaaaaactcaaaacttgtataatacggagtgagtatatcacccacccactgtactattccgccgtacgtgcaacctcaattcactccaagatgatgagtggcatgcagacgccagtagtggccgtgggcgccacggactgggcgtggcggctcggcgccctcgtcgctggcgccgtcccgctgctcgcgctcgccgtctggcactgcaccgacgccttccaccgtgccgccttcgcgttccgccgccgcgggacacgacgcgcgagacggctcccgccgggccacatgggcctgccgttcgtcggcgagaccctcgccctgctctggtacttcaacctcgcccgccgccccgacgccttcatccaggccaagaggcggcgctactgctacggcgacggcgacgacgacgccggcatctaccggacgcacctgttcggctcgcccgcggtgctcgtctgctcgccggcgtccaacgggttcgtgttccggtcggcgccgcccggcagcttcggcgtcggttggccggacccggagctcgtcggcgtctcgtcgatcgtgaacgtgcacggcggccggcacgccaggctgcgcaggttcgtcctcggcgccatcaacagcccaaactccctccggtccttcgcggaggtcgtccagccgcgcgtggcggcggcgctgcggtcgtgggcggccaagggcaccatcaccgccgccaccgagatcaagaaagtaaactaaccatactcctacttgcttctcatggatgcaacgaattatatgttgcttttcaccgatcgatcgatggatccatcgagatcaggtgacgttcgagaacatatgcaggatgttcgtgagcatggagccgtcgccggcgactgccaagatcgacgagtggttcgccggattggttgccgggttcagggcgctacagttggacatcccaggaaccgcgttccaccacgctcgaaaggtgacaccctgtaaattaatttttctctgcttggatcggatttaacaacagtgaagctagagatggtagaacgtactactgtacacatgaatttgtgcatgcagtgccgtaggaagctgaactcggtgttcagggaggaggtcaagaggaggaagttgaaggcgaagttagaggagcacgatgatgttatgagcgggctgatgcggatggaggatgagcagggtcggcggctgggcgacgacgaggtggtggataacatagtctcccttgtcttgggaggctacaagtccacctccagcgccatcatgtgggcaacctactacctcgcaaaattgtccgctg

SEQ ID NO: 49934 - DNA, 1864 bp, Oryza sativa
tctcaagtttccattgcttaattgcgttttttaaccttatcaagttttctcagacatagaccatttttaatattctcaactcttctttaaaggtaagacatcttagaattttcttccatgtttaattttcccgtattaaacaagtactatcccctatcacaaataaataaaatttcatttccaatccagtataaaggaagttgaggcgttttcttaattcttgggcataaatccaaaacaacttggaaccaaatggagtatatgtgtgtcaatagactattttctaaaggaaaaaagattttataccttaatgagataaccccctcattattttctgaaaaaaaaacaagcaaaataatgatgaaaatatttttaaaaaatttggagacattattaaagactattttggtgacaatggcaaatatatgtatatatccactatcctagaaaattccaactgtaaattcggcccatacattggggaggaggggggactccaaactatgaatagtacctgagctaattatcactttatttgtctcttttctcgttttggagaccatgttcaacttaaagtctttttggagtggtagatgtcaataaataatatattatcatttttttagaatttccataactgtgagtatatttgaggaagtaagtaaagagatatggggcacatcctttggaggtatacatatccatcttcttagcttattacgtctcctttggaaccaagaaaaaatagaagatttttataggattgaaatcatgtgctgctttagaatatttgagattcctacaaaatttatttggaatggcttaattcattggaattttggagcctttccaacctgaggttgaacctcataagaaatttttcttttgtctatctctctcctcaaatcctaagcttttcctatgaaaaatccaaacaataagcttcaacaattcatatgtttagaattcccaaggacatataccacttccattccttcgttttttctgtcacgtgttttttattcatgtttttttttgagactagggctgagccccccttccattaccggaacggataaaaagatcttttcttacaaactgaaagcaaacaggagaagaaagagagaaaacccccacccctatagcaagactaagcttcccatacaagtgcccaaaaagagtcacaatttggatgagggtggatcgtttatagggagatttccagacagaaactaggagaaacgacacaccaattgccacctaaaggaagcaggacagcagtcaaactcagcaaaagccaacagactcaacaacactccagtcttcttgtgcacggcttccatccaaatcttgagttgtatacatcatctgctacctgctttaccagcctggctcccagctccagtcttcttcgatttgcctccagtttctgcagaagagcccaagattcaattagattacagactaaataaaccacctcagtgggagttttgggcaggacattatcaaaacaaactctattccttgttttccaaatagcccacactactgctgatatgcccaccattagcagatttttcatatttttgtcatagccagatagccaggtaccaatcacctgggttctattcagagtgggtttaaaattgaaagcacaaatgataatgttccaaatcatctttgcaagagggcaatcaaaaaacaaatgttgaagggtctcctccctacagcaaaactgacacaacttatccccttttttccagccttttttatacaagttatctttagttaagattttatttttcagaaaaagccaaaaaaagatttctaatcttaagggggactttgatgttccagatttttt

SEQ ID NO: 49935 - DNA, 704 bp, Oryza sativa
taattgtcatatatcaatctcacgattgctatagtggtgttgagtcgtaggtacatggtttaaatcctggtgtccatgactatggttgtgtgtatttttagttggtgagagagttatacgtacttccattgtgcaataaaaataaataaatcgatatccatgctttgagttattccaaaactatagcttacattcataagtcacaagcaattgaagtaagtccaaaactatagcttactttcactctaaatgttgatcaaacatctaggatcatactcctatataattgaagtaagtcgttttaatacaatccgatcacctggtcgatctgatatatatctttgtatgcaaaaaaaagaaagttaaattccctttgaaaaattgcaagagacgagggtacccccaacgaatcgaagtcacaagcactatactgaagtcatatacatgacacgaaaagccttcaactacgcacactaaattgcatcacacctcttattaattaaccgatatagtgggtttcgtccggactctagaaaattttagatctcccaataaattaattaaaccggacccaatatatatatatatatatatatatatatatatatatatatatatatatatataagcacatgtatatcaactaggagcagtagtgtagttcctagctagggttgataatggatcagtacttgtgtagcgta

SEQ ID NO: 49936 - DNA, 5938 bp, Oryza sativa
tgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgatgcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggttagggtcgtccatcagaaatttcactcagtggaatgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcaatacaagaaaattggtccgtccatggccgatgacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaaggtaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattctatggtgtaacaatgctttcgatttaggaaataaaatgctgttgtgatgtatgagtgttcggactaaatacttctatcgtgtaatttcaattcaatgttgttgtaatgagtacctccgactattgttgtactagtagtattgcgaattattcggtgttgtatcataatgttatcgtgatgagtgttcggactaaacacttttgtttgtttgtactcttgtttaatatgtgttagtaattcgcttagttcaacatttattacttatgttgaactaattatttatatgtttctgatcaacctatttgatgcaggtatggcgtacgacacaccggcgctgttgaaccgtgggattgacaggaaccaccgctcgttcctgtcggcagtcgagggtgcacagctcggcaccttccgtccacgcacgtcgcgcgagtggttgcgtgtcgacccccgtcacgttccttggtacgcgtatgttcacatttcaactcaactttgatttgtgttgtacttatgtttgaagtttgctctatacaggttgcgtgcggcaggccttctaccactttgtaggcttgttgaggcggcggcggacgaccgtgacccagcgaagcggtgggatgcagatcggtcactccttgccgctcttgtagaccgctggagacctgagacgcacacgttccaccttccctgtggggagatggctccgacactgcaggacgtgtcgtacctgctcgggctaccgctggcgggagcagcagttggtcccgtggacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccgaatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggtcgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggatttaggcaggtgtttccgggcaacgtgcagccgaccgtcctccctgccgaccactcgtgagttcggattgttcatttctaaatttttatgataattacttcatcgagccatataatttacctctcttaacaggttgactcgacggggacagctagcaggcgcactttgggctccacgtgtacagcagtacgttgacgactgggtgttagctacagaggaggtgatcaacgagctcttcccacacacggaggagaactaccgtgactacctttgttggtaccttcctcgcactcgtgcgcgtgtgaccttcactccagacgccccagagccgcacgttgccgctgtcacggacgcgtatcccacgcaccgtgaccgagactacttcgtggcggtacatccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgtgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctgtttttgtacgaaaacatcaccccgtcataacttgatgatccatcctcgcaggacctcgtttgccttcgagcgcccctagcttcggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagctgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtctacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacgtaatctagatttaagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaaatatagagcacagtacaaaatcgcccttgcggagggcggcaagggggccgcctgcaaaattccatgccccctcgccgcccatttgcaggcggccccccgcacagtacaaaatcgccctcgcggagggcagcaagggggccgcctgcaaaattccatgccccccctcgccgcccatttgcaggcgg

SEQ ID NO: 49937 - DNA, 3323 bp, Oryza sativa
ccccgccgcgctcgcctacaggtgatgtgtctgaaaccccctcccctgatctgctcgcgtagagggttgtcgggaatgggcgtgcgtgcgtgcgtgcgtgcgtggatcgtgctgcggcggtttgggcgccgttggcgtttgggtgatctgatgcgagtttccggtcgacccgctcgttgcggcgctcgctttttccaccgttttttttgggagcgatccggcatcgtggttttggttgcgggcaataaatatgttcgattcttcgtttgggtgattgattggcaggtggatgcacacgccgccattcgcgacggtgtctcctcaggaaatttcaggttcgagcccggcggaagtgcagaattttggtaagagagctcccatttggggttctgctattgtttttgtacacattgaatctggagggatattattagttagtgcttgtgatgttgcaaaaccaattcataggaatgctgtggcagtgcacaaactagttcatatggttatggtgggaagtaattttacttgagaagagtttgacattgtgtcttatttgaacgataaaatgccatgcctattatattttgaagaggaaatacgtgtttggtaattctcatactttccacaggttatgttatgactgcttatgcagttttgccgcacattactgttgatttttcaaagcaatgacatgtgcttgatctctttgcttcataaacattcagttctaacttctactgagctaataagagttaaggtgtagtttatttccgaatggttgttccagtcaaacatgtcactgtcatgtagcctttcacctatatggaagaaagaagttattttggcatggacgtagagatgcttgataaataaagttctgatcagactgctgatagggttaagttcagtgcagggcagttggacaacatctggtaactggaattggctagttgatcctttaaatggtgaaaaatttatcaaagttgctgaggttcaggaagcagaaataaaggtacgttagttactttcagatgtttcttttattatttccgtgttgcggtgatattaattgttattaaccttcctcagcttactccactaaaaaaacccacagattgatccgttaaagaaacaaactctcttacattaaaatgactgactacggttatatttagacttagttgatattactgtgaatctgttatctgctctgaagcgtatcctcaggcaacgtgcattttttttttccggtgcagccatttgtagagagtttatctaattgcccaaagcatggacttcacaacccacttaaagctccagagaggtcagtgtagttttcttgtactactaatgcattgcatggttttccaatgtttgacttttttcttttggctgtctgttgtgtttgaaccccaactttggatgcattacaaaaggcatctaacacaacagagtttattttacctgatagctaatccacttactggctcttctttctcattgataaatttttgcagctttatcaaactcctggtcactgaagtatttgtgctatgctacatgaatagttagctacagtatccttgttcttgcacagttgactccaactcccccgaaaagccaagctatacacataggggatttggtatcaaatggatgatttacccccctgtgtgtctatcacatgtgatcctagggtcacatggagttggaaaatgatgtaccactctaaggagtgacaaattatcaattttcccaaaaatatattgctgataacaacatgctttacacacagtaaacaaactttgtggagtaggaaaaattcaatacgataaaaaactgtgtactatatttaaacttgtactgtataactgacactgacagtggcagttaacaacaatgctcatgtatgctttgacgaacttcggtatctttaatatgcaggtatctcatgtatggagatatatctgccaaagctgcaaacatgcttggtcaacctgtggtatgttatcttaaaattaaatggtttgacttcctattactttcagtgagattttagatgactctagctgtgcatccattggcctgcattatgacactcctataaatgccaaattaggtcatgttgagaaggagagaataaaggatatgcttttctatctattgcttttagtttctgattgtgtcattggtgattgacaggtttcagatttctttgctaaacttatccagagggtatctccaaagagctatcagcaagctcttgcagaagttcaagtctctcaaaaattcttggagaacttttgtggagatcaggtataaaaaaagagaggaccatttcatagtatcagtgtaatctacatatcagatcagttccttcattgacatgttcacaagtactatgatataattgatactttcattagcgctgcagtttgtagtggtagacttgtaatttgttgaaagagcacatcatttccaaggaacttgcaaaatgctgcattctgcagattgaaaaaacttctccgatatattctcatcattcacatcaactatttctctggtatggtaggtacgctttctggctcgatcatttgctgtacctggcaaccatcttggacaaagcagtaatggttaccgttggccatatggtccggtgagtactctaacaatgtagttgaatgtttagccatttatttaggcaataccaggttttttttgggtatcatgttagctctaatgttatatatataattctgaacaggttgcaattatcacaccgttcaatttcccattggagattccattactgcaactaatgggagcactgtatatgggaaataaacctgtcctcaaagttgacagcaaagttagcattgtgatggaccagatgcttaggttgcttcacgcatgtgggatgccagcagaggatgtggacttcataaattctgatggtatcacgatgaacaagctgctgttagaggtttgaatagctaccctctcactcactgtaaagtaaagagattacatgctgtatcagatagcataacaaattagcacacattatcactaacaccaccttttagaagatgagagttttacagtttccccttgataattgcttttgaataatgcatttgaccatgtcaatactttgtaattactggattgaaatacctacatttctcaatatctgatcaactgagttccatattgtaacattatatgctgctcatcatgttaatataggaccaccggaccagtgtgctgcaattcatctgatctttcctttgttggggtgatacatcatttccaatggattg

SEQ ID NO: 49938 - DNA, 5169 bp, Oryza sativa
catgctagctttcaatagaattgataacaacctacaagtttcaattgtcattgtgatatagtactaacctattccaagttcatatgcgcaggtggttacagagtattctgatgatgagcttgaattagtattagaagcctgtgaaaggatgaacgctcatctgacggctgcagttgtttcaaacgaccctttattcctgcaggtaagttggttttcatctctgttggtgttgcacccatgcccattcacttggttgaataattctaccacggtaccaccaagctagttaggctaacatttgtcaagccatcttgtagcaatactcacgcagcttttgccaccaacaattgaacacttgaatccaatcggctcagtgacttatccaacacacactcatcggttttcaggaagtacttgggcgatcagttaacgggacaacatatgccggcatccgagcaaggacaactggtgctccacagaaccactggtgagctaagactagaaactggaacctgccatcttccttttttaaccaaaataggttaacatgtcattttattatttgtaattcaggtttgggcctgctggtgatccaagaggtgcagggatcggaactccagaagccattaaactcgtttggtcttgccacagggagatcatatatgacattggccccttgcctaagaaccgggcactaccttccgctacataaatactatgtcaaggctagattagcttgtagcatgttattctgaataatttgccccgtctgggcaatcatgtgtttcattaaccccgagagcataataaaaaggcaggaaatggttgtgaaatgtgttctgaataatggttgcctgtttgctagtgtccaaactttgctcgcgcttttttttgtccatccactaggcagtacttcgttaacatcaatgacttgtttggaacgtggagattatacatgaaatcagttgcatttgaacaaaaaaaatttaatcgagttcagactagctcgtaaacatctgagatcagatgaatgtgacgaacccagttgtcacaggagcattccctcatcactcaatatttggggtgagagaggctcgaactctcgacctcaggattactcacgtttagctatgagacctacgcgctagccaactgcgccaccaccccgtttttgttgcacgttctttattttcatatatttccggtgcttcttccgccttctgggcgaacactgtagctagtagaaattttaaggcaaattttgctcccagacactctaatttggtagcgatccaaacttcaatggctctaattggatcggcattcctgtccatgacacgaactctggtgagcccagacataatgagaactctgtccatggcgcgctcagactgcagatgagaccgtgagctgcaaaagacgctaacacagatacaaacaaggcggaaaaaaagcacagttttctcagctatttgctgctgttttgtctcgccacaagaaggcgccaagatttgagcttggactcgtgtgagaataatactttggcttcttgttgcagcctgtatgacaccgcaaaatatgctgacaataaacaggtaaaaaaaattgtactcgattctgcacatctcacagccgccttgagacaaaaaacatttgcggttaaaatcgatgtttccaaacaggaatatggacaagaactcatcatagtaatcagggacgcagtgaagctcatttagccatggaatcatcaacacattgtcttgtctctactaggtgacaaactctgtcgccagccaatgcaaccagtacataaacacacctgcaggtaatggtgtctctcctggatcaaatccgcttcttttcttcagtgttgctactgttcattcagtcattcagatagctacatgctacattggaggccaagaaccaagttagtaagcagtaacaactaacaaccatggatcatagcatcatgatggtgaagaatgagattgaaaactactcaggatcatctccagcaatgatcatcaatgcgctggaaggcggcgccgaggcgggcccggttgtcaggaggagaaggagggagccgtctttgctcgcaccgatcaatggtgatggtgacaccaatggtggtggcattggcaagtcgtccttgtcaggcatcactgtcaagaggagctctaggtttcgtggagttagcaggtaaaagaagtaaaccatatatacactgaaaaattcttgtgccttgtgacagattcagagcttgtagagatgacaagaagatgttgtcatgtaggcatcggtggacaggtcgtttcgaagcacatttgtgggacaagaactcgtggaatcctacacagaggaagaagggcaagcagggtaaagtgatcttgttcttcttccttctgcttgtgtttgcaatagcatagctatgctatagatcagtttgagtaattatgcacatgttgttttgatttgcatcagtctatcttggagcatatgatgaggaggaggcagcagcaagggcttatgaccttgctgctctcaagtactggggaccaactacctatacaaattttccggtataagaatatctacttagcaagctggcccatactagaaacacagttgtgaatcataatatatgaggttcatttgatatatttcaggtaatggactatgaaaaggagttgaagataatggagaatcttactaaggaagagtatcttgcatctctaaggaggtaccatcaaagtctttagcatgttcaatctcctattctttttttacttttttttagagagaggttcagtctcctattctgttatcacctattcaactttgacaagcatctaaactgatgccaggaagagcagtggcttctcaagaggtgtgtccaagtacagaggggttgcgaggtatatttggacagaaaaatgtattgtactctatcaacagttctgaagataggtttgtcactgaatgtctactgcatactttcaggcatcatcaaaatggaagatgggaagcaagaattgggcgtgttttcggaaacaagtacctctacctaggaacctacagtgagtacaagaacagtgcttatactctattctacattgtgaattggtattccaatgcatccaaaacttcacatcttaacatcggcccatctgccattcttcctaaatctttttctccaggcactcaagaagaggctgcccgtgcctacgacatcgccgcgatcgagtacaaaggcgtaaacgccgtcacgaacttcgacctcagatcatacatcacatggctgaagccaacccctgctcatgttgccatgaaccctgcagaagctcttgcaatgcagatccctgtagatcacttcctcccaatggaaacccagatgatgatgctccctcagagcaatcctttcacctcatatcacaatgcacaatcactgggtggtggtgacggtggcagtagcagtactaataatcaagaagcctccatgataatctctcccagtggctcatctagaaagagatcatcatccactgctcttagccttcttctgaaatcgtcgatgttcaggcagctggttgagaagaattcagatgcaggtgaagaaaatggaggtgagatgagagagccgggtgcccatccaggagaaggatatgaataccacaacttcttccagggagatgctgctccggacatggacatgtgtgatctgctttcatcagaaatgtgcatgctgcaagtggtagtgctggatttgaagaggacatcgcatgttatagtggttttggaagcatgcagtcgctgcagcaatagcatgttggtggctcaggatttgtatcttgtgtaaattgctaacactttgtgttcagctacaaatcaaccttccctttttcactgattacttttccatttgacatgtttacagacttgtgccgaacaacaaagcagaaagcttattttgctcactaacactttccaggcattgcattgaacaaaaaggagatagtgattatagtgatataatgataaacaaataacagaatagtgattatagtgatataatgataaacaaataacagaatggcatgtcgtgtgcttcaatgattactacgggctcagacctgtctaataacgaattagccaaataaatgcatcctgtgcacttataagcagcagatatatgccatcttatgatgaacaagatgaattcaaagtagcctagttagagaagaaatatggttttgaatcaaacagaagtatctgcagctggattcagagggtgaactttgaagtacgtgaccaatttcacccaagagttttgacactcagattccgggacatgttttcccatcaatatgcccgcaaatgaccaaaaagaaaccgagacagattgactggtaacagaaaccctcatgtagtctagaacaggctagaggcaaccaaagttaagccgattacaagttttgttcaatgagctgctgatatcaaaagctagcatcctaaaccaaaccagaaaaagcaggcgaccttcaaggcttgaggaccagggacagcccaaccttggagctcttgtcgatggccttggtatcaacctcagtggagatggtgacgagcgacttgggcctgaactcgtgctggatgagcgcactggccatgccaaagttgttgaagcgcgccttcacagtagtgagttcatccagggcatgctgtgtcccgaaggtgagagtgttctcgttgctcgagaagctgtgagccagctctgctccaacagcacttgttttgctcaccttgtggtagtaggaagcagcaaggctgtctcccttgttgttcctgaaatttgcaaatcactctgttactaccaaaatcaaagcatgctagaataacacatctattgcagtaacttgttgcaccaattccaaactagcatatagatgacacatgcaaagcaaactgcccaagaagtccccagaaactgctgccaaaatctaagcatgttagaaaaacacatcaactgcggtaacttgttgcactaatactagtccaaactagcatacagatgacacagaggatgctgagcaagctgccctaagaagtccccagaaaatactgccaattgattgggacttggaggagttaaacaacaggtaaagggccaaa

SEQ ID NO: 49939 - DNA, 805 bp, Oryza sativa
gaacgtgcttttgagtctgaagttgctttcacatccacggacacattgttgttcttcacctggctctggatttcagagaagatggactcatttttcttcgtgccagcaacagtgattgcctagaaaaagcagggaaaaaacatacctcattataatcttgggaaagtttcatatgcaatgctacagatactaagtttagccaaaggagattgacaacaaaacgtcataacagagatacaggtaaagattatatagacattatgctacgcagttgcagcatgacagagcaattgaaaacactattttcagcatcaccagtacatgataaaggtaagcaccatactaaacctcagtgatctgtcatcgaaagtaccaagtccataaggtcaccaacacatgaccatgagaacagactgaatatacactatacaggagggaaataatgtactaacatgatatatgtaaacaaatgtaaacaacatattaacatgatatatggcacatataggcacctccatactgaggtcacagatgagatacattctgaaaaaacatctaacaacttcatcaacagttccatagtcaagaaagagaaatttaaacacatcctaaattgtcctaaactgcgactgcatattactagcctacatgtagctcaaattcatggcaatagtaaccaataagggaacaaacactgagtccatatgagtagacacagaggactagaaacaaatactccatggatgtagtaattctgtagcaacggtgaaagataagtgactttaaacaaaactaagccatataa

SEQ ID NO: 49940 - DNA, 4844 bp, Oryza sativa
agcgtcaaatcccaaaatattccgttaagaaccccattgataggtcatgccaaacatcatctatccaatgttgtttcaaaaatgcatgaataatgattgccctgttgtttttaaactgcacgaaaagtgtagcattatatgcagttgtaacaatgttgagtgtttctaaaaacatggtttaccagtgattcggaattggcaaagtcctgacatgtaaacaaaatacaaaggacacgaaattaccagtgatttcacccattattaaattccttatgttaaatatactatctttttataagcaaatatgcatgttgaaatcactaaaatgcagatccagaccccaaattatactataatgttgacaggcaacaccacagcgaaataataaagcttcaattagaaatcaacaaatcaagaaaaaagagtcaatatggatcaaagatatagtaggagcagtacagtaccttgtcctggcacatgcatatggagcgttagatccccctatgccaatgatgtgtgtaaactacgggaaatggaatagatggcatagcatactacgcaccagatgacattcaccataatgatggcaatggtaagtttccttttataaggcactgctcaggccaacttaagcagttgtacctggatcatcattgtcttcagcaatgttattacaactaaaaaagaaagggtgtcagaaatcgaagtcattttatagataacccaggatgctaattaatgtagtctaatacagggttcaatatttctttttcggggtttatattggagggtgccgatataccgacattttggaaactttgaacaagatattaccaaattcacaaaaaaatgaaaataaattaaaatttcggccgaaataatatcatagggggggtccgataggaccaaaacttctgaaattttggaaatttcgttcccgaattttgaaccctggtctaatattggttatcttaacaaagttacttcagcattgcagaaagttaacacacatatatatatatcaataatgaagtaatcattccaagaccgaatcatcggtgccattgttcaaatatagagatggcgtacatagagtttatacagtacaaagtgattgccagatgatcaaaatccataaaacctggttgaaaatttatattagtatgtaggtgagtactcttggcagattgtttttttatcaaacatctattgatctaattaatcaaaaatatgaaatcccaagaacacttatccttcaatgccacgtataacctatagacataaaaaaaaattctcaaggcaccagtcaccactgctaataacataaaagcaatgtaatggaatgttcttaccagcaaatcattacattatagatgcatggcctgcagaaatgagcattaataacattgttacgggaaaaagaaatagcagcacaatcttgtataatcagtaacataccaaagtaatgagagagagaaaagaaaaaatatcgacataaaggagagacttacctgatttttctatattattgacgacaagatctgtagacaaatggtaactttagtttgtatgcttgtggaaatcagatactaaactgcaaaaagaagatttttttttggtagacaaacttaccttgcctgtattcatcagtgcattctagcgcttgcatcgtccgcaattgctggtgcagaggggttcggctgaccagggcggcatagtgggagatcccgacgatggcagggagagccggctgtgggctcggaggggatcgacaaccggcggctgggctgcggagggcatgagagcaggcagaggggatgcggcggatgcatcaactgcgggtggcggcggcggcacccatgccctccactgcatcggggtatcaccaagtgagtcccctcgcgatgcggcggcagcggctaccgtggaagtgaatggcgacctgcagcaaagccgacgatggctgggggatgcgcgcagtggttggaggatgcgtcatcgggaggaataggcggcagtgttgttatcgcgagaggatggcgcggcgccggggactgcgtgatgcagcgattgggtggcgccactgtggggtcagcgcgttcgctggtggggattcagcgattcatagctagccctgggcgttctgagccgttggatgagatggacgggtgagatgatatggggtgatttggcctgtagcattggaggggggcaactcctcctttctatattagtatagatatatacaagcaaaagatgcaggtttgtccaatacatgctgtaattacgaaattatgcagtgcaagaaaaatgaaactgtgcatgttatagttctaaacttctagagcatcgaattgggaaatgaaattgtaggccacaatattaggtgaatattcagttatgatctacaggttgggtactaaaagttttactgaggtttagttatggattgacaaaatagcccacaagatttagttatggaattcatgctctttcttctttttgaccactgctcatcgattcacaattaactaatatctccaagatgagtagataaatgctagcaagggtactacaaacctctaaccgaagctaccctttcaaagtattgaccgtctgcaattatgcctgtgagaaggaaatctgccattctctacaacgaattcagataggaaaatatatgcataacaatattggttacctccaattcttccatgtccatctgttccttacctcacatatttggaaaagctaatacaacaatttgttagtcatatacacaaaaatacccctatataggaaaatgttgtgtaatcaaaagttgttttgtgattcgagatgacgaacctttgattggccaagagcatttcgtgactgagcactcgcatcttgtatcccaaaactgaaaggattatgctgttgatgcgcctacttcttccagcttgcagcgccaaacccaaatctgttgggctttgcctgctgttgttgctgttcttggtgagggctccgtaattgcaactgcacggtaaattagaaacaggcatagcaaataaaaaactaacagcgaattcctctgtagcaatcggaattaaaaactggtggccaaacgatggcaaaccaaagctttgaatgaatttcatcataaatagtcattaaaacacatctatgtatttgaagtgaatacattttcagcaataaaagttgatttgtagagaaatacaaatttacagcaagaatcaatgctgtcaggcatggaagagaattgagttagatcacagtatcttattgacggaactaaattgaaggcaattttctgtcaaccactaatcacctgcgcaactgagttatttatatattacaatacaaaattatcaagtgccaacctgcagaaagacacgttaatgcgtcacacacctatgtctaactgcatatccatgaaaatcaaggaagtccagtagaaagctacttttacacactcacagagtgtgagtaaaaccaaaggcaaaggttattagtagaatacctcaagaaccactgatctgctcattttgaaagaaccactgatctgctcattttgaaagaaccacagactattaacttgaagcacatgaatcacagtaaggaagaactattgaccgagaggtcagttgcgttcacaggggaaaaaaatatgaaatcaacctataggagcataacctcatatatgtcacctggaaaaatggaatgttcaagccaatcaatcaagctagatccagaaaatgaaataactgaaaatatgcaccaggagcttaggagccttctttgctatttggttcctcctaattactgaagcctacatatgtcactgcattcacattggcatctgctaagatacgctacattctttgagtgtaagaaggatggctggcgatggcggcgcgcggcttggacgaccggccgtgatgacagctgggcagcgaagggcaggggtcggcggcggctacccgaccgaggaggtgcaggcagctagtggaaggccggtgggagagaagatcacgtggctgtggtgggagcggaggcgagatccagaggcatttgcggcggggcgacagcgagtctcgatctgtggcggcgcgacggcgaccgcacgaccccgccgaaactcctgctcccggacggcacgggggcgggggcccagccggcggtagagggaggcactgactgcgtcggcgaagacgggagcggcggaagcagcgacaggagccgatgcggtagcagcggagggaggcacaacgcgaagtgggaatgaggcggcgatgatggtggcggcggcggcggatggggcctccctcggcgctggccgcggcagatggtaggatccggcggcggcagaaggggacctcggctccggcgaggatgcggcggcgcggcggcagtaatccggagcgagcgagcgagcgaggaggaggagcgccggccgcgacggatggtaggatccggcagcggcggaaggggacctcggctccggcggcggacggagaagaaggcggcttcggcgaggatgcagcggcgtggcggcagtacagaggagcgagcgaggacgccgaggaggaggaggagcgaagtctccgcgcgtgaatggagagtagtcttcgcggcagtactcaatcgtgcggtggagacctcttgcgcgcggatggacggtacagattaatccggatgattttacctataagattagagaggagcaactcctcctttttatattagtatagattagtattagtattagtatagatattaggaataagcaaggtaataattgatcacataatctggcatatttggttaattgatcgcaaact

SEQ ID NO: 49941 - DNA, 1870 bp, Oryza sativa
atagcgcggcccagccgccgccgtgacctgacgatggcttacctcgccgtcgaatcgcccatcagacggcgagcggccacacgccggtgtcgcgggacctggggacggacggtggtgaccgacatgtcttatgcgggactcgatttcgccttgaatccttggcctccttttgaacacaatgccggaattttctagagattttgtagaattttactcctatctcaaaatgtagtaacaatctaaaatcgaattaaagttatacaaatctgaacaaatatcccatgcaattcttgtgcaaattcatgaaactaagatgtgtctaatccaattctagattgttactatattttggcccttttgaacacaaggccggaattttgccgagatttcttagaattctacttcctccatcttaaaaatatagcaatctaaaattgaattaaacatttcatatagttatactaatctgaacaaaattcttgtacagattcatagtactagaatatgtctaatctgatcctagattgttatattttgagacgaaggtagtacataattttcacaggattcaggaacatgacatccatctcacattcacagtgcaggcaaaacaactggagcgctcgacatgaaaaggaggccaagaaaagcagtaaacaaacagggtgtcatggaatggcacaactcgctagtcagttataagaagaaaacgcagaagagatgtccaaatgggataagattgttcaatccaacaagttctctctaacatcagcagctctcttgctcaacaaaagcagggtgtctcggggaggcagggaaatcaaaagcaaaccggaaacgcttcagctatacatgaacatggcagaggaaaggacgcaaaaaccctatagaaataagtcaaatcgcaccagatacaaaccacaacaaagcagctggttcactgtcacggatggggagaacatcttttttacatcggaagcaaaacaattggatcaaactgcagacgccatcatcgtcgtcatccacccgaatgttgcgcaacccaacaggaggatttggtgctcgatcgatgaactcttcagcgtttccattcagctttggcaggtctttctgtagttttttaaaaaataagtggcctgagaaattgtgacaatggctatgcaatgctactacttggtatgtgaaaagaacatctcaaacatacatcgcataaatgtgataaacaaaacaggcaggttttcttgagcccacaagtatgaaatttaaaaatgtttaagaacatgggaaacatcaagctttccaatcagcaaaacaaactaagaattgaggtcactaaattcaacaggaatattgttaagtcacaaggacagctattattgtgaagtcatatatctgttcctttacattctaaacatttggatctcaggtgacattgactgaaggctcactatatctacagatttcggtgaatattttaggactgatatgctcttaacaatcaagctaagctcatgtacatcacaacaaatctagataacaaaagggatagatggtgtcccagcgcccacctatgtgaaataatgaagaaatggatgtttcattttcattatgtaaagcaaaatgagggtgataggaagatattatgcataaaacaggaaattggtttattctatcaactttcttctagattattcaaattcctcttaatatccaaatgcattctgcgtatactggaaggtaaagttaaatgcataataatgttaggcacaatacagatactaatgcaaacaatgaatattcagatatattgtttacaacttaccacttgcgtctcttgatgatagcatagacttgtcagccttcactccct

SEQ ID NO: 49942 - DNA, 2651 bp, Oryza sativa
gatctctgttccatatcattactaaagcattttcttcattgtggatatcttgcagcggcatagtttctaccgtagggtcagcaacagtcagttcagcaactttttcttcagtttcaacttgataagaaggaacctccggttcaggttgaagatcaggtaccaggatatccgtcttagcattttccaacagattaccattctgaggttcttggatctcaggataatttggaacttcttctgcagttcgctgtggtttctcacattggacctcttggcgttcagggatctcagttgcaggagtagatacctttgaagcctcagccatagaattagttaccttcctaaggttacgtttgaccttctcaagttcagttaactgactttcgggcactgaatcagcagtagagctagtgaatttccttgggtttcgccttgatttttcagtttccatggctatgttcgtctgagaggactcaactggtgcagcagaacttctccgagaattgcgcttcaacttccctgactctgtttccattgcataactggccttccttgtgtgtggcttggcatcagtaacagcagctctctttggatgtgaaatgggcctccagacacgacctatggtccatctctccaaccagttgaaggctgaatttggatccctctcatcatattgaaaatggagagcctctaccagaattggtgaagctaaaagctacagcatttatagaaaaaaacaattagcacaaaagaagaaaacatatacatacaggaaacaaaagagtgatatatgcctgtgagtaatgagtataacaggctaatgcatagattcaagattctcatatttgtatcaagccattagaagactaaatttagtataccttacgagcaaatgcatttgaagacaatttctccttccatgcatcccgcttaccactctgcaaaaggggaaagaatcatataactagcatatcttgctaggcgaatctgtcagttttaacaaagcttcccaaacaaactaaaagcgatgaatgcaagcatgcaaaaatatgtgtagcaatgttctatttagcatgattgtagtgctattacttgcttatgttgaaccaggagcattttgatgatagacttgcaatgttttaaaaagtggtaagcggtttcgtgcggtgaccccaccttgtagctcttatacagcataattggctgcttatgtggcttaagtgctaaaaggttggggcacatgttccttgtatgcggccttgtaggcctttttttatataacagtgaaacagattaaaaggaaaggggcatcattatgatgaatacatcaggtactgaatgaaacaggatcagcaagaaatttacccccgactgttgttgaacaagcttccagttgacttgaatggtattagtagaaagtctgacattcctaccacggactagagcttgaaacttcacaatcaaccatgttgcacgaagagttgcaacggcttgcctccttacgagatgcccacgaatcagggcttggagtcttatgattcctttcaacgcacggaatgcccgacgtgcctggaccaataccatgctaaatttaggatgcataattctaaagaagaactttacaaggtattgtcgggttctttagtggattgcagaactacacgacgcaaggaaattttataaaaggcatgcaggatcaaacaggaatcagaaaaaagaaacattaccagatagcctcggaaggcagcttgtgccttgacggccgcttgttcctctctcaacctctcggggtcgttggacgcatcggaaacgacagtattctgcttctccaggtcttgactgacatcgcgcaccaccacttcaccttgtaagctggaattctcacccctcccaacctcctggacagcctcattgttatgaggtgtaacgagcaccggctccgatatcaccggggagctctcaaacccagcatccttcccagcagcagcataccctttgttgttcgagcccttctgcgtatggaaagtaataaatttggttacaacaacagatcccttctatctaactacaattccataactggactccataatcatcaagaaatcggttgcaacaacagtatttgccgcgcaaacaaagaggtgtaaaacataccgataaatctttcgccttggtagagccggacctcgatgacttcttcccgaagagcacggatttgatccacttcgccggagacttccccattggagcctacactgccgcacgcccaagggttcggagcctgcaataccaccgcacatcagctcacagatctacacccaatacccatttttcaaaaattctatctacgaaaaggcccacaagaaacgcaagaagaagcgaaggccagtgttttttttcccagcggaatcaagcctcgtagcaaagcaatcaaaccccgcaagaacaaaactgacggttaaatatctcgcacagaaaactaactccccccgaaatgcagctccaacaaactcaaatccacgcaaccccagctcaaatccgcgcaagaaaaacccaagaaccacgcctacaccgcccagcagacgcagatctagacggcggcggcagactcaccggatctgagaacgagagagtgcagactcaccggaggg

SEQ ID NO: 49943 - DNA, 17420 bp, Oryza sativa
  unsure (1)..(17420): unsure at all n locations
aaaaaaaaaaggcgagtagtgtgacgaactgatgacgtgagccagcgtgcgggccccaccgcccaacggaaccaccaccacctcgcgtccgtcccagtacgggtaccccgcctgaccaggtgaggctgacccaccttcactgacatgtgggtcccactccccgctcctgagagtgtgacgtgtggggccttgtttgttttttttaatgagtgggtgcggctcgtcggtggggggcgaggtgaacgtggcttgggaaaaaaaatgatggggggaggagtggggccgaagcgaggtggggtccacttgtcagtgggccatgtcgaactttttgtacagctggtgtggtactggagcctttttttttttactgagaaaagcgggaagcctcgtcttttttaaccggctagctgtcaacccgagtccccacccacagtatttgcagggtgggaccacatgtcagcgggcgccgtgcatgcgcctccaatgtcaccgagagattaaagggtatgtgtggtgattaacggcttgaaccgccttttatggcctgattaggaaacggtttgacgctctgctcgttttgaaatggagtcttgtctatgcgattagggtggactgagctcgttgcaagatttatagggttttctgtcaacatatagacagctcctaattaaaaagtcggatcagcttcgtcttgttaattttacaagcaaaatgtttaatttgactcgactcatcactcgtgtactggctcataaataagttccgtcttattcctatcattttattatacataaacgtaataatggtaaagcactaaacctatagctaaaaaattaagcactactctctatcccaaaataagtttatttttcactcatcccacacatacaaatacatagccaaaattactagaatacatctatttttataattccaatgtaattagtatccactttatctattcccaatataattattctttattttaacaaaccgtgacgtaatgattactctaaaaatattttttaaaaaacacaaatgataagagctaaaaatgagcatgttatgatagggaaggagtaattagaaagtgcatatgaaaatgatctcacgagttaaaaacctagtttagctcgtctcattacgtcggatgtttctttgatgctcctgtgtgaaaattgtgcaaatctgttattttctttgaaaaaaataaattcttccgaatatcatatggaatccacttatatttcaagttggaattaatgtttcagcaacgcaaaatgcaccaatctgctttaatttctaagcaagttactccaaactccgggcgacacaaggaccgactacagaactaccggcccatcgctctgcaatctgcatgcatgcatgcagctggccttgactttgccgccctgttagttgcagtagtaatctccgagtccgatactaattgtctagttgatctgaccaccagcgaagcaattatcaatcgcgagaggtaacgtggtgctgaggcgaccgatcttcgttgacagaacggttcttcgttgtatggtgccgtgtgtttttcttgatttgatagagattatatgacttattagccctagcttaaacaaatacattttttttctagcctaccacaaaggcggagctacactataaaaggagatgcccagtaaccaggtattttttttcttttcagttatagttcatttattttcactacatgcatctctcaatgcaaacttacacgtattagcttcaactcgattcaaagtaaaataaaacgaatgagtggtactacctccgttttaggttataagactttctagcattgtccgcattctataagaagtctcttgtaacttgaaacggaggaaatactttttttttttttaagctccgcccctaaccttccaaccgagaaggttcaggtgtgcatgcttgcctccaactccccgccgatcgcgcaacggtggcggccgcgctttaacgccgccgcgcgccgcggtttctcgtacgagagagccgcaagcgcggagttacggtcgaacggcggtggagggggcaaccggcgcgcgcggcacgaccgcacgagcgacgtataaaaatcgcattcactttcaccaccgtcccctgcagcgaaaaacacgcactccattgagcagtgtggttctgtgttgtgcagtcgtagtagtactggactactggtccaccgaacgcaccgccatcaaacgcctcatgtgcttgtttttacatggacagaatggcagccgctagcaacaaaccgaccactactactggcagctaatgggaggtgaattttcttccatgcatggaggaaacattctctcgtttttcatacgttaactacttttaatttacagaaatcgaatttggtatggtatgtttctggtgtaatatgttttatactaatttatcttgtattttttattttttttaatattaaatagatggtatgcaagaaatgagaagatatccattcaggaatgaaaacacttctttacggcaaatggcgatcccatggtagatcaggtagtactttaccagtgtggattgtctgcagtactactgatacagtagcagacattgacgtgtggctccggacccacacgtcaatcaccgctactagtactgccgaggatttgtttccgtaccctgctgctccaatgatccaatcatatgccaacctaactgtgccctcctgtagtagtaaatcgggtacttgaagctgccattgccggccttcaatttcctgccagtacgactactatactcagtatccctgaagatactgctaccgagtactgaagcgggatacttacaaaggccaaagacaaatcaaacgacagcgaaacagggaacttctttggcttcttctgatcgatccacacataaaacataatccactgtccgctgtgatgattcggtgacattcaacggcagaaataatgggatttggtatcggatcgagttctgtctccttcagaaaaccaacgctagatattgctatatatacaatacaagaaggttaggtagctagagcctagagaagactgaaacacatccctgtcattgaactgaagcttcttctacttgaggaatctcatggtagtattataacacgaacctacaaaaaaacatagtgttagtgcttcgctttcgtctcttacataaaaagtgccattagctacacataaaagaccaacacgtaggttaattaattaacaaggtagacaacgcacagcagaaacttgttgctcaatgctcttcctaagaggctaagagttgaaccgtcagtgtcatccagaaacgaataaagtgcgccattgatcgatgctaatatactactactactactatccctttgtttctttaaactttattaatgcgatgtagtatgactttgggtggttgcactggcagattcatccgagcaaaggagctgtcgatccactatcataaacgataaaaatatgacaagaccggcaagattgatgaggaagacggattgagaagaggacgaatcgaagggatatatggcagggagaaagatgagcagcgaacagcagtgtttgcttttgacaaaggaattaatggatgaagtggacgacgaattgacgatgccgtcgtcctgaatcctgatcccttttcactccccaagttttctgagcttcgtcgtcgtcgccggctgttcatcgatctcagtcggatgaagccttgaacatgatggaatcaacgtgcgatgcatgcgtcgcgtccatctcgatcgtccagaaacagaaacgtgagggcggcaggattggtgtttacgtattcttgtgatggaggcggtttttgttagaaaaaggcgtcggcaacagctaccggttaaccacggcgaggccacacgaacacatatatgcgtgacagcgtggagtaaaaaacaaatgcgtggtgatccgatcgaatccattcgtgaaagcatatctcgacggccatggaaacaatggaatggcataattaaaggccggtaacaatcacatttcttccaataaatcacgcacatttgcagttaactatggacttgagaaacaaaagaaattgaggttccctctgtattacaaattacaaacccgattcagcacgagggttaaagtttgttttgtcagatttgctgaatcttaaccacttccagttcgcataagacactgcctcgtcgtcaaagggagcaacctcgtcgaacgaggagtctaactcagctggttgatgcttctctgaaatttggtcccggtatctttgcgccatctcttcagcctcggagaacaccttctgcaaccatacaaaaatgaaaaaatgtgacaagcctgaacattggcaagcctacattgttgacatcggtatactctccgtcccactgaataagacacacatattttaagattcaatgtttgaccaataattatttttattataaatttaattttatttgatgaaaataatatcattagattaatatttaaaatttactttcatatgattatgtttttgttgctataaacactatagaatatgagaaatttaaagtcaaaaaaatagttttgaagaccgtgctaagtttaattgcgccttatttagtgggacatatggagtagtatgtttacgatggtccagaatggagaaagaaatttagagttttctgacctccttgttagagagaaacagtccaggttcgctctcaggtccttggtactgcagaatgaaacatcaacagtttcaaaggacaatcatagacgctgtgaacagcagatggcctatcaaacaacaaaagcaattatccggttacatgtttgggcagtgtacctgagagcaattctgcccgggctgttgatttaatcacaagctttcacttcctcacccacttttagcacatcaccaacggatgttagctgcccccgtgttatatttgagacatgtagcaatccactgcaaaacgcaaagcattatgagttacgttgcatttggcgtgtggatttatccacttgcagacctttacaagcgtgccattagaatatggactagatatgcattctactggactgggcatgagataatgcagaccagttcacaatccaggaaaaaaagcagttcatcaaagggaagtactttttttttttaccaaaacaaagagaagtactatgaatgcacgaatttatatgagtcacgtgtaaaatgtagtagtcatctactgcattatcagtgcaaccaccctgatctaaagcatagcaagtttctgaaatctagccagaagatgcttccgcagagagccctaatcatcagttcgcataatgtgagcatttgtaatgaaacccacaatctgagtcgattggtaaacctcaggtttcactctacttctaacaatcaagactaaggatgcttgcatcacgtaaagccaagactcctagcaatgctgctaaaattaaatacgacattttcttctaactaattgggcagatacaagcagataacaagccacactggaacatatgcttgattttttgggtgatcaatgaaattcagttgaataggaagaaatgacatatatagcaattgacaatcatgttatagatgttaccctctgttagtgtcgccaatcgtaatttgtgcaccgtatggaaacaatttgcggactgtcccttgcaaaagagttccttccctaaggtatgtcattgcctaatacaagtgataaacaaagataagcattgctgtactcatataagtataatttaatgcacagcagaaattgaattgaccaagaaccactactttaaataattagacagttctgataaatgatatgtcagtgaaaatataaaacaaaggggagcactagatgtcaatgcagtcaacttacccatgcttctttttcactaattatcaattcgttagctttttcatcaatccttgtgatgcagacatggatctgttgaccaacctgtgtagaagaaatattattattattattcatgaaagacaaccacttccttaaacagatagctgctaaaacagtcagtcatgctgctatgccataacaggaaagcagcataatgcagattccaagtgcctagggatgtaaagtgatattacatgtcatgctgtacttacagtattctttagatccgtgaagtttcttggtctagtcatcatttcaggtttagggaggaatgcccgaagcccctgaggagtgaaataagttttagtcataaaaatgaaaaaaggaccttgtaatgtagaatagtaaaattatacctcaattcttgtcagcaggcctccggcattccactcaaaaattttaaccttgataggcacatttaactgctttatctggacaatggtgtgtacataaacagtcatataagagcattcagaagaagaaaaggacagccatcactctaaaaaacatttacgcgaaactttctcattcaagtgtgttagagatgcaaattccgtaagacaaccatatccattgtcactcaaataagatatcaagaaagaaaaattttcattgtacatattcatcacacaagcttcctctagattgctcagtattcatgtaacaccttgaatttctgaagtacatgagctctacagtgtaataacttacagccggtgcatagagattgtgccaactcgtagtgcagataggagccataagctcataatcatacgattccatactaataactcctatttaacacacgtgatttcagacacttacgatctggacatcctaggtgcttgttaatctaatagcaagatgaatcactacgctttaacatttcgagctttaagagcaagcagttactttaagggtctagttgctacaaacaaggtggtcatgactcatgagctccagacctaaccgtatcggcctcatcttttcgcttatgcttatgcttatcagctaaaatttgaattttcaaccttaaatttgaagctgattttagggttttttcatcaaagtttatttttcagcctttgcttttaggtcgctaagaacacgtatataaaaattttattcacaaattacttctcgtttgcaaatatgccgaataagccaaacaatggggccgatagaattacttagtactataactgttggtttgaagtatctgggactgggactgggactgggatagcatcatgtcaagactctgtctatagattagtaatgcatcaactatgaaaaagagattgaactaccgaattatcgctaagtgatcagttcatcaaattccaactaatgtagaaaggagagacatagagaacctgcctcactctgtgccacgcgacgcgccggaacagccggcgcgcggacagcagcggccgcccgccaagtgttcgaccgaggacctcggtgacaccaccgtgccgacgcccaaagccggcgaacctctccctctcccctttccgttcctcccgcccgtcgcctctccttgcccctccccgccgctgaccacgactcccaccttcccttccgcggcgaactgggctgcatccttcgacgccacgtcgcatgccaggtactcaaactcctccccggtcataggcaccgcctccttggccagcatcagcgccggctcgccaccggcgccgacgtcgatgtcgagcgtcctcccgtcgccgccgaccacgacgccgaccgcgaggtccccgggcttggggtcgtaatacacgaccccacgcccacccgcaccagctccggcactcccctccccttgtcctcctcgtcttcctccacatagcctccgccgccgccgccgccgcctcccgccgccgcgtcgtcctcgtcgggctcggtgctcttcccctggaagaacttgaggaacggcgcgagcgcctcctccgtggacagtgccggagcggcctcggtcgactcagactcatcctcatcggcgggggatggggaagggaacggcttctcgaggaggtgcagttcatcacctcctccgccttcgccgccaccggaggaggaggaggaggaggcgtggagcggcgacgcagctcgtgctccgcggacggggaggcggctcgcggtggggggtctccgccgcgccgctcggcggcttcgcggggagacggaggcggcggggaggagggagaggagggacgggggcggcatggcgtgcgagcgggtgggggagtggagtggagtggagtgggtgggtaggaaagccgttatctcctcgcggcgcggccaccgtgaacaggagggatatttcctattttgggtcttctcgcggaagcaggcctggatttttatgcgggaaatcgggccagagtaaagctgcagcgacggttcggcccgatactttcagcccgttttaatactttcatccgtccttataagtccagatataacatatcatattacaatgaatctagataggctctctacgcagattcattatactaagatgtgtaacatccaaccaaaaatttagagacaaatggagtactattttatttaatgttactatactggtcttagggatgatgtatatggaaaagagttgaggcataccaagagaaatattcaaggctaatatatgaatatgaatcttattaacaataaaaaccgtgttttttaaagaaaatagatagatatgaactttgatgtggagttttcaacttggtagaagtttgatttttttttctttaaaaaaatccatttgtgtatcacatcaggctagtaaattgcagtttgaaaccataaatacaatgaagtattatatttaagataacattaaatcgcactctatgcctaatcgttttacccttttcaccaaactactatgcaaataattttgcccgtgttttacccctttttttattgcatggaacaaatttcagtagggattatctgcagtactgcacatgcagtagctggctaactgccgctgacatataggatcgggtccacctgtcaaccactacgggcctgttcggcttaactcatgcggctgcggacctgcggtgcagccggccgaaacagtgatttgtgtaagcagctgcagcagcaacactgtgttataacgactactactgtgtaagtacagtactgcaaagtatccttgttaaacaaattttgagttttacttatagcaaaaccactgacatatgggcccgatgcagtcaggcaggacgagccagtcgagcccgagcagcccaagcccaagcccaaggcgccgtcgcggccagcacaacaccaaacaacggggcacgcacgcctttggcagcagggagcggcggcagaggaaggggggaagggagcaagcaaggcaagggattccgcctcgcgagaacgatggggttcatgctgcgggtgaggctggcctccttcttcgccggcgccgccgccgccggggccgccggcggcttcttcctctacaaggactacaagctcgcccacgactccatggccctccaggtctgtgcgccccctcctccctaaaacccaagatcttggatccttgatcgtcggtggtttatctggcagttcaatcgcgtcccccgcacgtcgcctgtggagagggagatttagggatacccgcttttcaagcttgcaactccggatatacgctatgcgtgtctagatcgttacctagatttttatttttatgtgtttaccaatttaatcttcgtgtctatatcatatgattgtgctgcattctcttcagtttgaccgaaaggggatttgacgctgttgttctgtcctgaaattgggctgccaataacatgcatggattaaaaaccaagcctgaacttttcctctgcccaattattttctgataatgtggagtgtctgtggtgataccgtgatagaggctactgttccatggtcctgccactttcaatttaactatcacttgtgttcaattgtataatttaactagcaacgcagttccaaagtttggcttggttgacagttccagtaccacttcatgtggaatctgagcttgccaaattgaaggttcgtgtggcagtttaattatttttagcttgtggtcatcttggtgggctctcgcgtacaatgtacattgtccacagaagcaactagcttttcaaaacgcctaaggatgagaagccacaacctgatattctgaaatactgttgcttgaatatgtttttctagacaatgccataacaccattctttatgagatttctattcactttgaatctgaaaacaatgtgtttgccattccttgcgtgcacagaaaatgctttgtgttcaagaatgtggaaaaagagagtgaattttaggatgccatttaatattaatattatggcgtggttggagttgaattgaacccagtatcctacatattatattatcatagacataggcattcattagtgcaacgtctgtgcatttaagttgcacaggaacgtcatcttgcaacataaaatttgcagctataaatggcttttcttcagagtattttaacttgaaactggtgcattcctgtcatcagcaagaaccttggtgctgttaccaataacttgtttccaatttgaaattttgttggaacttcagtgagaaatgactcttttgtgagaaaggtgaaatgatatgtatatgccaacagtgctatggaagaactttaggatagtccatatgcctgattaacctagagtcctagattagtatgcaatggtgggataacctcatgtaaaagtagaatcacgtcacgtggatgaaagctggaagctgttttgtaagatgcaatatatgtgactctgtagtttgtcagaagaggttccttaaaatgggtggatggtctacttgtgttacctccaatcaatataaccatccaggtccagctatggcatagctaaggaggctattcatatgagaagttaacttttcatatttttcttgggtccttcaaacaggccacttgtttgagctgtaagattgaggtttctatgattctctatatgtggttctaatcctgctccctttgcacaaaatttatgtgcatgttcaattccactgtgcatgatactggttgggtttcaatgtaaaagcatctgacctttcaaatgcatactcaggtcaaaggcctacaagaccatgtggatgcccgttacaaagctcttgacaaacgacttgctacattggaagaccagaaaaccagcgagactgctccagacgtgggcgtgccatctgattagtctgttcattggctggcttgagtatggatgatttacgactgtttactttaacctgtgttatcgtctcttggaggcaaaagccgatgactgactgcaaaataatttagtgaagagttttttttttgtgtgtggcaatgaagcttctgtagtgttatagatgcccatggggatacccaaccttgcaaaaccatttcacttttgatggcactgaaccttggcagtcaagctcgatcatttaccaatgtacctgtgtgaaagtttctttacctgtttgctgccaggaacttggatgttttaagatgcctgctgttattctttttcaaaactttccgtgatgcatgtgcattttatggccaggcaaaatggtagatcttggaatgaatctgatactgacaaattggccatctattgtggaaaacaatcacttaaatacataaatggataaagtatcacagatgaacattgcaaagagacttgccgtccttgttctggcaggaaagtatcaccgatgctagcttctttgcggccatggagaaccatgctgcacaatggctagctgatgactcatcgtcgtcaccagttcgtcatcactggcatagtggcatgggaattcaggattgttgcgtgtgctactgtattctctatatatgctcgtcctacttctactgaattatactgatttctgaacaattaactgtccctttctgtctactaacttcttttgagttctgggttgagacgctaattggtgctgctagagctggttgttttcttgacagatgattcgtgcaaggaatccccttcaagcagattcttccttgcccagtactgagaattaatggtagatgaaaattcttctagtgatccggtgaacttcagggtactgtactagtactgtaacttcatcatattcataggtgccaacaaatctccagcattttcaatctgttctgttcttgcaaatctgccaaacaacagacggaaactaattacggcatcaaagctccaaccatttcagtatccccaaccgtgttctttccgataatgcggttctcatattcaacctgttaagctgcaagtgcatgcacgattacctgaaaaatgcccatagagttatcagaatgagacggtggtaatgcgactgcttcaaaacaattggcaatgaaataatgattgggggaatatgctgcttgcaactgcttgcgagtctgatcagatatgatggatttggtaggtgtgaggagagaaatgagcatatagttcagatttgtgatcaacacaataaacaaagttgtttacaggaaagctgctttcatcaagatctcagcatgttctataaacatctagttaaacattttaatatattatgtaaaaaaaatctaatatccttattggttgtcagcaatctgtagagaccaaaaacattattattaattgacagcccattgtggcaacatttccaccacaattttatgtagaaaaaaataattcatgccagtagtcaaacaccagatattaaacacatgataatgactgggactcctaaccatacaaattgaaatatggtcaatttattttagagaaagtagtggagtcatcagattagcaaattgtaagaagcaaactctttcatggtgtccactgaccactatggctgtgtttgatacttggggttgggaacccaactccaccgcacggaaaacggagcggtccattagcgtgtgattaattaagtattagttaattttttttcaaaaatggattaatttgtttttttaaagcaactttcgtatagaaactttttgcaaaaaaacacaccatttagcagtttgaaaagcgtgcacgcggaaaacgagggaaaggggttgggaaacttgtggaaagaacgcagatatccaaagatagatagaacttgagagattaattttaatgcctctgagatccatgacactggagaaaacaatccatgtgctctcctttgatgcaaatgatggacgttacgcagacaccagcaaacaacaccactgaccatatgcatgctaatgtgcaagcaaattccacaaacagtaagacacaatattagcactcgtcaataattgaaccggaaaaggataaaaataaaccagaactaattaagctcactttgacttcagcaaaaggatcggagccatcagaaaaatttctttgcctgcagtctacaaaacctttctaacattgcaggatcagatgaatacaaatgcatcttcagatccctgggtaacaatttactagtacggttttgtgcatgttagatgcaacccatcattaaacagtattaatacgatcaaataagtgagctatcacccaaacaatttctatggcaatgaaaaggacagtacagtaacacaatccaaattgtacctttctgctaatccactaggcaacaaacattgtttgtactcaacattttccaggaccatattaacctcgctgaagtaacaggtgaaggatccaagtccacataaatatcagcccaaatattcagacgctgacaggaacaggaacactcacaaaacataaaactttgatctcgctgcaaggagatgatatgccaacaacacattataagaaaagacactgaagtgactgtctgattcattgattccactgaataatacggagtacacgataagtatttacaggaatgatacgaggtagcgtatcaatgcacattaatcccgatcaattggtctcatctgctgtggttttcttgtccagcgatgctcatctcggagcagctagcgaaaatgctccattgtttggatcgtttagaaatccttccaaagcagacatcgatcaaggagacccaaacagcagtacggcacctttcagcagggcatccggcaggacatctctgggagcgacagatgatgacgacgagtcgacgatgcgcttgcaagccaaacagaaaatatggtcacatatttgattggcaattgcaaaggaactcccatagatcataaaagaatacatatcttaggcacgttcttttgaaggaatgaagaattgnataatacaacacgcttctcaagttgctaaatgatatgattataaaataaatcttaaatgactatttaaatcgattctgtcaattgtataataattaatctattcatttctactctcgaacagtgattacaatatcattctactatttgggaaaaaaatgcatgtgcgcaatcaaagtacttcatctatttcaggtgataaagtgatttaattttagttaaagttaaactactttaagtttgactaattctgtagaaaaaagtagagtagtaacaaatcatatgaatacattatactagacactttattgtttaaaatatatgttttaggtatatgaaaataatatagtcaagtctatcttaatgaacattacataatagtacaattgtaaagtcttttgacatttataaaagagaatttgttggtgttatgttgacttttttttgggaacattactcccgcaaaataatatttagaaaaatgtacttcgtgcagtttttaggggacttagtaattaattaaaatatttagtactaataaccttcaattatatagcacattgcatttaggcggcggcccagtcagttgcccacccgctcaagaagccagcgaaaatggcgtcctcttcctcctccgcctcgtcgccgctcctacctcgccgaggccaccagctccaggagccagccatggccgcgtcccagatgcggtgcgggggcaggagggagaaccaggtaccagttcttggccggggtggagttgggttcccttgcatttttgctcgcgttcttggatcaaatcggttattattgctgttcttgttgttgctgctgtctgattctgaaaattctctcgtctgctccgggtggtggtggagaaggggcttgtgcagaggtgcgccgagacgatgatgctgtgctgcggcgtggattgctggtgcggcgcgctgcggctgtggcgcagggtggtgcttcgcaagtggctcaacgtcggctccgggtcgggcgactccgacttcagcgccgacgagtgcgacgccagcgacggcgagctcgacggcgaaggttaacctgcctcaccgagtcaccgtcccctctcctcttccttcctagctgctctgatttgatccagtttactcaagctttgctcttgtctggaggaaaaatggggggagaatttggtgtgcgaatttgtgttgttttgattgctaggcaatgaggggaatgctgaccagcatactgcaatggaagctctttcttgtacgcctttgtgatttgactctccttttttttttcagaagattaaaaaataatcccattcaaagaattggttagttttttttctttagaactaggagatgtcatgtttaattttgtgtgtaagttgatgatcttgcaattgcaagtgccggcaatttggtatggtcattaatatctctgagaaagacttccattgtgatgtgtagctaggctagtactctctgcataccagcggctttcttttggtatattcaacctttttaaggaaaggaatgttaggtcagggagttcaaggatttggcgaaagcatgataccttttcgattcttttctaagcttgcttgagcaaaatgggtagcaaaaagtgaggataaagcaggcaacttttgcttaactcatagcctcgtttttttcttattgcttcaatgaatggtaatgtgaccatcttatctagttgactttactatctaatgacagctgctccctttgataaaagtcctgtaggtgttgtttttagttaacaacatgtccttatcaattgctcttcttgcacttaacttgcatatgttattgaatcatgcatattctgattgttctctttattatgccatttgtgcagacagggataatgaatcatatggtgaagggacgagtttagatggacttggtgcaggaacaattggtaatttcattattagctcctcatttttttttggagaggtctgctgaagatctgcacattcggttttttgataagtctatttctttctacatgttctatcttttagatgagttgtccctagttgattttcatacaagggaatggtcttgcatattggtgctaaaatactaatctgagcagtaaaggctagtttggttttgtagacagaacatatgagtccattgaccaaagaggaaagaccttatgtttggtaatcatttacatacgagagactgtagcctcgaatttcagtttccctggggtgatgatgcctctagatcggtttatcttaaactgttctacaaaatagtacatcatgcttttcttgtttttattaataaacatttgatgttatcacaatggatgaaacagaattgaatataattagcaagcattcagctttcaatattttttcaagttactctgaagtccatgtttagtacattaagtgcctatttgaaaaggcagggctgattggttgccttatgtgcagcacaagcacttgtttgataaaactgacatggcaggtttgccttatatgctaatgcaatcaactacacaatgtaggggatgaaattaaatctatgccttacaggcttagaagacgcaaatcagagacccttcgcgctcagtatattgacatcagagaactcaggtatagccgtatagaattttctccatctttgcatttttttttcctggtcctagttatgttcttccagttacagtgagtattgttcctatcatcttatgtcactatgtaattaattaatgtgatgtcagccactcatttcaccgtattcctatcacacaaatcatttcaggttaatgctacaattgaacccacttgttaccggctgaaataaataaaatatgatacttttgtatatgtttcaaactgttttctatatgcaggatttgtgtagggacatggaatcttgcaggcaagtttccacccagtgatctggacattcaagactggttggataaggaggagcaggctgatatttatgttcttgggtaaatcactattcacaatttttttccccctattttgtaaggtaaaagatttgtgccgcagattcgcatgaagcactccacttcttatctttgaaaactaaaaaaatgtttctggatcatgatttgaaattatttt

SEQ ID NO: 49944 - DNA, 1402 bp, Oryza sativa
cctgcaccccggcagcggaaataatacaagaagtcaggcaaaatgcttcttgggaacaacaaagattaccttttgccggtaagtacatgaacccttccgaaacacagctggttcattgttgtaattcaaatgaaattgctggaaaagcaactcgttcttgtcctttgataatgttccctgcagagagcagtaagagagttatggctacagataaccaaagcatcaaacaagatcaagaggggggaaatatttaaaccgaaatgatgaaagaagacctttaatatctcacgagcttcgttttcacttttgccagatttcactagcatccaaaagcatgtgctgtattggttggtggtgtggcctgcgaaatagtacgtagcacgtgagttcactgaagatgaacaaacgaatacatactgaagttcactgaagagaatcatttaacagtgtcagaatatatgccttttaggaggaataacttacattctgcttgtctcgatgacaaataatcacaaagtatcttttgttttgggtaacatagaagttctgcctcaaagtgcggtggctccactaagtccttgttggggaaaaaatctttccacttcatcatgtaaaacaaggtgaaacgtgaggtacatgatgaaaggattaagctgcaaaagaaggtgcaatcattttgtcaatggcacctcttgaaaggacaggcataatagaaatgcataaaatcagtaattacctttcctgacgctggtatagttcagtcttatcctggaacacaaaactgcgacaacaagaagaaaataagaaagaacatttgcaaaagatgaattttctgtccatcaaatataaaaatatttgtctaagatgaaacctttgctatacaatttaatgtatggattattagtcataatatttttatcttgcgaagactaaattaaaacaaaatcaattcagttcatgacatccaggacttttttttctgtacaagcaaaggtttttctttctttcaattgtctttgctctaagacagtggataaggtcataaggagggatatcttacctgtactcattgctaaaaccatagccaaagacaatgtcagggaatgactccatcatcaaagaagcagaagcattcatcaaccttagagctgcctcatcatttggcttgtcaaatgaatggatcaacgagaatctaacaaagaaaatttgagttctcaacaagacacaaaagagattgcatcatgctttcaaataaagaagaaacaagagggtcctaactgctcaaatttacaaatgtcgatgcgaacgacagtccaattacaaggtggaagcctatggttgatgtcaaacttcttaacattctcatacctacatttttctttaaccaaagactccagttaga

SEQ ID NO: 49945 - DNA, 2012 bp, Oryza sativa
ctgcagccctagccggttcatcatcataattgatttggaactgttgtgaaagtaactcattcttgtcctttgaaaatgtcccctagaaagaagaggaaacaaaaagaaaacaatcatttattaaaatgcaattggaagcatatataaactctctaaaacattttgattaccttcaatgcttgttgagcttctttttcagttttcccagacttcactaacgaccagaagcaggtgttatattgattgtttatatgacctaaaaaacacaacaaaggaatttgttctgagtcgatctgtttaatgaagaaataagttgtacaaatctcctaacacatagacaaatatttagtggtgctaagctgattccgtattaggtaaagatgatatacaaaacggtttcattgtacagaacatcattgcacaatgcaaaaatatgaatattgaatctgttttgctatacaagaaaaagttggtggagagaatatcttacaatccacttgtctccaggccaggtaatcacggatagtcttcaagtttggatagcatacaactcgaccatcaaaatatggaggctccttcaactccttattaggaaagaaatctttccacttcatcacgtacacagaagtgaataggaaacacataaagatagaattttactgcatgcaagttattagtagaaaagccaatgtcataaaacattgcacataagcacattcaagatactcagtgaaaatggtgtacatattaaatggtacctttctcgtctttgatagaattcagtttcctctctaaaaacaaaactgcaacacaaacatgagatgcaaataacttataattatactgaagacaatgcattctatgtcaacagggagtatctacagttcacgtctttgatcacctacttaagaggcattttgcacatgtaatataacagcacagctcttacataatgataacattaaccatggcaatcaagtgtagtgtttctcatttacctttggagaaagaacaaactaaggactctggaaaaattcaaactgaaaattccaagagaagatgttgtacctgtactcatcactgacgccatatgcgaagactatgtctgggaacttttcgagcatagaagtggcacaggcgttcatcaatcttaaagcacgctcatcatttggtttctcaaaggtatgtatcttggagaatctaacaaagagaatgctgaaattagtggacaggacaaacacagatcaactattccaaattgtaagcaacagtgatttcccctgtctagtatccacacacactgtggcctgcttctcatataaaccgatcatcacaaagaaaaccaagcagaaggcgttgtgcataatagcaggtttagcttctttttttttatccctaagagtctaagaccaaacagacatgttgcatcaagcaaaaagcaggagatttaaactgaaattgccatgtctgcataaactatcgcacactgcactaccaccagagaatgaactgatacagccaccggatggaaggtgagagcaactgtaccggtggaagtggcagccgtcgatgcgcacaacgatccaattagagggcgggaggaggctgtcgagctcgaactccctcttcacgtactcgtactcgctgttggccatcgccgtcaccccctcacctcaccgccacgacgaccagactacgcctgcaattctgcaaaggtgccagtagcagcagacgcggcattaacaggggcggatccaaacttttgggtgaacaaacaaactgttattatttaagagaggtttaaggctatcaaattaaggaggaggagaagatctagaagagaagcgcaagcaaattccagtcccggtggggtgggagagagagagatgaatcagaaagaggacgcaccaggatcccctcccctcccctccgctgcgatggagatagcctgcccggccctcccctgttcagccgcgactcgtcttggcggcggcgcaaggagcggagacaac

SEQ ID NO: 49946 - DNA, 1631 bp, Oryza sativa
atatgtctttttctcctcccctatcgtgatgcgcactattgttatggttgctattaaggtcggagatgtcgagcttgcaaggactttggaaggcaggagctgacccgacgaagagcgaaggcgctatatctaggctctttcttgctagatccatcggttatccaactgtcggatggaaaaagaaaatggagagagagagagagagttaatgtgcgaaatgattactgagtcactggacttggagatggatagaatatggtagtccaaataaaaatgtaaagttagctattgtgtaaatgaaaatggttaaagtataatattatatgaaaacttttaagaatttttaagaatacatagtatggattgtaatttactccctttgtcccataaaaaacgaatgtagaactggtgtggcacattctagtacaacaaatatgaacatatgcatgtctagattcgttttactaggatgtgtcacatccagtcctaggttggttttttatgggacgaagggagtactttttttttctctagcacaactaaagataattgtccataacccgatagtctcgtgatatgctaagtatgattatgccggtgtacctagctataactaataatctcatgatatgttgatgcatgacgatacagacttctactaacacgggctgattaactatggttagatagattccgctaaaagatgataaaaataataccatcacttttgctcaataataaagcattcggttatggtctttttttctcattgtattatatatgatgactacgttagtacgtatttccgtaattctttcatattattttttattttctacatatatgttaatttggactaatatatttctcataattaaatagataatacatcatttttctatatttctcctataaaatgagaatagggcattttatatttgaaaaattatattataagtgtatgtaatttaatgtgtaagatttggacttatagtataagatttaactttttctaaaaatgccgcatcatagtagataggtagttaactgaacaaccataaaaaacagagacaatccattgtgtgtcactaattttatccctgctctacaatatgtcattgggtttgtcaagttctaatatggcatcgcattttgcttaacttctataatataccatcgtctagttagcctccgttagcattgtacaattttatcatacagattgtaaaacttaaagagtttgagatgggcaacttctctgcctagtttataatatgatatttcggaattttcggccaaattttagaaatttttgtcctagggatatttcaatcattaggacaaaattatacagtactaacggaatctaaatggacgacgatggtatattatagaatttaagcaaaatacaatgacatactgtagaacttaacaaactcagtgtcatattacggtgaaatacggtgaagatacacgttgaaacatgtcgctatcacatatgaaacaacaaatgttaactgattgaaacatatgtttttctttcatcaaaatataatcatgcgatatcttgttgtaaatatttaattacaatgaatacaacggtgtgatatagtcatagattggataagtag

SEQ ID NO: 49947 - DNA, 717 bp, Oryza sativa
tttcagttgcataaattttgtaggctgcaagagatacagaagctctcaaggtagagaaagggaaacttgaggagcatatagaagaattatcaagccgtttgtgtttggaaaagaaactgagggtaaatactgctccttgaattatgacttatttagagaagaagatttacttcatccatcccaaattaagttaatctactacgggatatgacatatccttgtactatgaatctggacaagtgtctatctagattcgtagtacaaggatatgtgacatcccatattagattaacttaatatgggacggaggaagtagtaggtcatattgttgggtgacattatgacacatatctttttcagagtgacttagagaatagcaaagcaacggaaatttccaaattacagaccactcttcatgagatggagcgtagagtagaagaagccagagcaacacaagaaagagaatcagccaaaaaggttgtggaagaagctctagttctagaaagagagaagatagctttattgactaaagaagttgaggagctgaaggtactttttcctcaatctgagcttattgaatatcctttccatatgtttcttaagaaataaatctctgatatagaagtaacttattcagataaggcatgatatttgatggttatagataaatgtgacttcgacaggtactactgctaaaagaacaagaagaaaaaaatg

SEQ ID NO: 49948 - DNA, 7889 bp, Oryza sativa
ggaatagagaagggagaatgagatgttaatgacaaacttcatgcttacctgaagagctcaggtagctctgcacaaattgcttctgctcatcagtatctgttgcagataagcaagaacgaacagagaaaatatagggtgaccaaaatggataaaagggagaacaataatgtacaaattaataactttgacagctaatatgaaatacctggatatttagtgtagtccagtatgtgaggcttttctgaatggtagtctgcagccatctcgcagaaatggtttgcaatgtcataagcaactggaccaaaacttgcatactcatagtcctgtgtaggcatgatgaggaaccagtaagatcaagacgatatgtttgttaatttcgcctggctacatataaaacttcaggttcataaacagacatgacatacatgaaggctaataaggaaaatatgcataatctttcataaagtatgtcgtttcagaagtgaaatctttattcctggagatagtaacatacaactcaatgtatgataaggttatacggagtaccaagacgcatcaatgtgtgtgatgtgaaataacaaagcagatggtttaactctcctttttccttgtggtcggtctgatgtctctagacgaaattgagctttcttcttaatataaagatgtccaagtctcttgctcgttcccccaaaaaatagtaatggaacagatgaatcaaacatacacaatggagcaagaacttacaatgatggtcagcaatttggtctcttcatcaatcatgatgtttccatactggagatcgttgtggcaaaatcctacgcactggtaatcctctgaaagctcattttccaacgcagtgatctcgttctccatgctatccaagcagaactctttggcttcgtcagaggggcacaaattcttggcagttttgagccagttcctgatgaagatgtgcataggcattgtcagttagtaacttagtgttttacttcgatgatgtgtttcattttacaagtatgcaatgctaaaaaacagtgtaaacacaaattaagtaataccttagtctgtcccaaatgagtacagattttggaccaggcatatcaaggttgtggaattccctcagctttgaggctataatggctgaaatctctggatcacgcagatcaacagctgagagtgtctgaaaggaatatttgcatcagtccttttgttcttttgaacattaatggacccaccatcctatataaacatatttatagtcatcatatcgtaatgctttgtgtttttgaatcgtccttcttcggttcttcccagcaacacaaacagaacatgatgctttcttttgaaagtgaagaaacaaattgagaaaaaagattaacattcccatcctactttgttttgtccatgccatattttccccctatatattatattaataaagtaatcgggctgatgccttattctgaagctcagacgccgtgttctgtgacctttagcaactcggtcatcagtcttactaatcaaaagatttcttgcatgattaaaccagtgctcattgaggtgttcagacaccaaattgattccttatggctgtgctcaccaaaattaactatgtcttctcttttttttattcacggctgtgttcagcgaggtagattcgtttcagtaagcaggtagaacggtagatacgttatacaatacacacacttgttctttcatgtggatatttggatcgttgaactataagcaattaaatatgataaaccataaaacaatttcatagacaaccatcattaaacatagtagctgaactgtatgacatcttcagcaagcataattgctaactaacgacagcattctgccaggctcagaagctatcactaaagccgtcaagaagttatgaaggaaaaagaaaatgattcatgttgtacaatttattcagcaagagaacagtttcatatgtcctaacaaaacaaaatagtacagctattagtcatctccaagaagcagaaatgtctttcttttcagggcccaagaaacagaaatgtcaactaatgacaacaccctcccatgcttacaagttactaggacaagtaatttatatgctttctgccaaaagtaatactcatcaggctctctggtctgattcgtaatactataatgtgtccaatccattcaaaatcatttatattttgagacggatagagtatctcagtctctcggaagctattaagaaaagttttttgttttaatttttagatataatattaggcaggcacagtgtagtcaacaagagaacaaaaacaatggctgccacaattaaaattgggtgatgacttcattgagtacggatttgaatgaacatcccggataagtttctgaaggtcaatgttgaaatttcgacagtacaactgcagagtacatctactacatcatcaagaggaaattttcaaagaaaggcaactgattaatattcatatgacgctacctactacacgattcccacgatgcaggctgaaaacgattgcaaacagtgaaacaactctgaatttctcgccgaaaaataaaaaagctctgaattcgcaaacaaaatttatgcgtcagattccccagtcacccatccaaagttccaaactcaatacgaataactgaagaacactaccttccaagtacgaaatcaagagcagcaagaaattttgtcgcaagcagacaagaaagaagaagaagaaaaaaaaacagagaaggccaaaaaaaaatgctcaccctggcgtggatgaactcctcgacgcggccgttggggaagcgaccgaggaggcgcgggccgtggccgtgccgcgacatggactcgaacgtgcgcacctcggcctcccggtcgaagaacaactccacgccctcgccgtacaccctcaccagcaccctcctccccgccgcctccgcctccgccgccggcggccaccgcgcctggtagacctcgttggtcatggcccccctgagcggcaccacctccagcgcccggcagtccgccacgtcgccccaccccgccgccagctcgtgcagcagctgccgcgccccctccgggatgctgctccccgccgccgccgccttctggttcgtctcgctcgccaccatcccttccgctccgccgcctcggaatcttccttccttttccggaaatgggagggggatctgggcgtgggagcgcgacccagaaatggtttgtttcttcttcggggatccaagagttcggtttatggcggtttatatttgcttggggcgctttttgtagattcacccttgaagttgggattattcggtaggaggtactttactactccctgtttatcataggataagttgtttgacttttttttaagtcaaacttaagttttatcaagtttataaaaaaattttagcaacatctaaaatattaaattagttttattaaatataatattgaatatattttgataatatgtttgttttgtattgaaaatactacttcctctgtcccacaaagcatgacgctttaaggtttcaaaagcaaattagcggaagggaaaatgaccaagttgccctcacttaataataatcggatgccatttcattgagtgcaaggcattcaataggaatacttaggccatcaccaatgcgtgtctccagcccgtagcctcgcaaacaacaaccaacttccttcgccgggtcgtctccggtagatggagtaaatatggggaagagagagggagtatgggagaagagaggattgtacagtaaaataactacgtaggctttttgggttagggatactcattgggtcaccagggtattctccattgtaagaggtgtttcccacacagtgtcttcagttagtgaaggcgcccatgtagtatccttgattgtagatgcccttatatatctctgcacactgaagctatggccacaaaaaatacacgtggcaaagcaatcatgagcatattcaaaaattcaaaacagatggccattaaattgctcaaacgacatgttttgtgggacactggtataacctttaaacgtcaggttttatgggacgaaggtagtactatatttttttataaacttgatcaaacttaaaagaaaatttgaacaatataaaagtcaaatgacttatagttttaagggagggagtatccttttaaagtagatttaaaaaaccccacctgtttgttttagtttcataaaaacacaataactttgtcacgtgacacataatcctagatattatggtttcaacgttttacaaaaccacattactaatcattttgcgctatcacaattttgaattcaacaatcacgagcattttatccatcatacaaatgttacattcactttctctattttgatataggagtatgtcaaaatggttaatggtgtggttttgtgaaattttaaaaccataatacatgttatgtggcacatgtcaaaacatgtagttttatgcaaattggatcataataggtggggtttaatgaaatttactcttttttaagcatattatagctcatataaatgcgcgcacggcgcgcaatcacatctatatacgcggacacacacacctacccctacaaacacctccaaagacgaatagtggatatttaaaataaaagaatctcctgcctcgatcaatggaattgaagagaggatagaggatgttaaattcagttgtaaatccagttacccatgacaagcaagccaactgcggaacttgtaaatctggacaaatgaaagaatggttttgataatagtataattgaaccagcccatgtaatgacaatcacagaacaatgacacttgtgacaacttaagaaacaaagcacaatacccatgaaaaataatacaaaactcaaaacaacgggtagattcagtagctcaagaaaaagccacacctaagcaacagctcacgattaaatattggacaatccgtatcactcaacacttgaatttgtatggcaccagctgcagggttttagaacatccagcttcactgtagaggggactttcccgacgatgtatctctcgatagccaagagcgcgtttttggcttccatgaccatagggctatgtatgcggccacaacgaccaacttcgtgaacagatagcctatctgcaggattattatttccatcaaatattgtgtctagtgtaagaccttcaagtgatgttgcattctcaagaatatgacaagttagctcgaccatgatcttcacattcttgatggtgtcatgatggtgtcctggcatctgccttagatgtgatgaatcttcagaaatcacgtcatgctccatgcgagtctgtgatacctgcatatgaaccagcagagaatatttcaacaaatagttccactatatatgatagatatatatttccgcatattaaaatttacttacacgtgaaaactttacttaccttcaaagtgaaagtctccaaggcaggagatgcatcaagaaaataagctaaagaaagataatcatatgttggggaaacgaccctagggactgtgtgaagaaaaacagtaaggtgcttgaggtggagaaatcttaaaggtgcgatcggcgtattgataatctgcataaattgtcgagattaatcacatttcaaggtatgactattgctatatgcataatgctggaatctaatgatataatcttaagttgcgtaatgtacctcgctaactgaaaatacagtgagagtttcaatagtgggcacaatggatggaagatttgcacaggcataataaatagcattatgccaacgaatggaagctatggttaggttcttcacatacggtagacctccatctgatagtcgtgctagattaccctcataatggaagtttaaaagatttggagctttaatttccatcacttgtgatgcttcccatccatacattgccagcttgctgagccgttgaagcaggcaaggtatcttgaggtaactaagctctttgcaatctgtgagttccaactgctctaacacaaaggaattggaaaaaaggcaccctaattcgtgcccagtaatgcgcacctcatacagaaacagacttcgcaagcaattaagtccaccagtaggacggaagacacaatagctgagataaagatgcttaatcgagcttccacctctattgaataaaagtgagaatgggaagtcgtagtagtttgccttgtcctctggaaacagcaaaaggatgagttcttcaattgccggtgtaacagctatctggagccaacaatcaagataacaggcgtcgaccaaattataggatctaagcccaaaagtcttcaagccaacaccggagtggttttcataatgtggtcaacttttccattgagttctcctattactttattcctttccaaccaattgtcattcaatcccaatgttttcgcactgaagatgagattgggacggcatctccaagaacgtagaaatatctgagacacgcatgcggtacgtgcagcatcttgtagtggcaataaggagtgtatatgataccagatgtcctaaaaacaccatagtgggagagaagttcaacattgtgcttgtaaaggtaagtgaaccaggatgtatcggaattttatacctcaggaaggaaggcccatggatttctcattgttttgacaccttggtaatcatcgccttgttgacagggtgagccatttcgtttagccagtgaagcaaccgactcatctgcaacacatcatggtgacaataggtaccgatgataatggagtataaaacatgcatacatctaatttgtttctgttatgcaacttttgggcacgaacgcatattcttctgttaaagactgcaaattgaaatactcaatcagaaaaagaaagcaacagtcttatatctactatccaagcttttttttcttccagagaaccaaagaaagattttaagctatttaacctaaacgaatcaaacttagccactaacagtagtaaagaacctccagttcagtcccaaagcagcagtataatacaccctcctctttttgtctcggtgcagcagtataatactccgtttcattaaaactaaaattttaatatattttcataatatgtttattttgtgttggaaacattgctgtatttttctaaaatttagtcgaaacgacctaaacctataatatgaaccgaatggagtatactctaaaaaagaatagcggtatactaaacaagctatggacgccagggcattaacacagaaacactaaacacgatgcaatgcgacgaagaggccgatggggcgatggatcaaagagacgagctcactacaggattggaccagccgacgtggccgcgtctgctcctgctgcatcgacatgagccgccgccgccgcttcacctcccctcttcttccccgccgccctctctgctcctcttcgattccgaaaccagcagggcggcgcgcgcgcgcggggagaccagatcaccccgatacgccgcgctctctctcgatcttgctccggtgtcagcggcaaggcgcggcgtggcgcggctgcgcgaggagaggaggggaggggagtggaatccgcagaggtgacggccaaaaatacggcagaaaattaggaaacgaaaacctgctggtccatgctgtgggccgatatttgaagcccaccaaacgaggccttaatgggcttttgtaggtatgtttgggatgtacctaggggtagtaatgggcccaattttttaggtttaaaatagagtgggttgaatttttaaacatttttaacctataaatatttgacaactacttcctccgtttcacaatgtaagactttctagcattgcctatatccatatggatgttaatgaatctagacacatgtaaatatttagattcattcaca

SEQ ID NO: 49949 - DNA, 3243 bp, Oryza sativa
taaaattgtcatgttcttcgactccattgagccatactatgttatttttttccccaaaaaaaaattgacttactgtcttcaaccaagacatgatcaggtacatgaaaaatcaaaccaatatctaactttttttggatgaaagatcattatattgcataatgaccttgtttttaaagaaagcaagacaagacaagccacagcttcagctggacaatttaagaatggtattggttatagtatactccaactgagaacatgacacaacactgacaacttcagagacaaatctccatcccaggttaaacaagatttaaaacaagccaacacctcacttaaggaacattggaacattaattcactataaagttcacttaaggaacattaaatcactataaagtcgaacagtaatggtcttttaacacctgcagcatggcatcacctgcagggcaaggaaggccttcactggtgtgcttgggctgaaggataatttgtacggattatgttgtttgaaatgcttcttgattgtggtagtttaggtgacaaataattcggaaaagcagacaattttgttgcccaaacacgtgcgtcagaatgaatgattgcttctcttcttgttcaactctggtgagcattagctattatcttttccagggaaattgtctcgtggacttccactaggacactgatgatcaaatatgaaaatgccaaaccaaaatataagcaaaacataatagcgttgatctctagagagagaagcagtttcaaaataatacactttgtgcgagtgtaagatacaatgcatttcgtccaaaaaaaagttgcaatgcattcataacccatcatgaaaaataggtcatacccattgatagctaaatattctattagtggtaaatgacacgcccgtcgataatgaggtagacttcgtgaatctcaatatatattagtccagtcttcagagatgcttatgggtttgtatgcaggtgtttatacgagcgtttgtactgtgtttgcagtaaactattaaacatgatatactttttgcaggaagtaatattaggatattattgggctgtcatgtaacagaaatatcaatgaaattacaagagcgaacagaacatgtacatgtcgcatgaatacaatcgtagatcatatgtagcatcccagcttcaggtggatttcaattgataaagcagagatagccagaagaaagaatgcttcttgattataatataactgaacatgtaacatgacattagaacactgacaaagcacaacccatgcaataataccacaggacctaaaacagcaggtacatcctatagctaaagaaacaagccacacctagcttaagcaacaccacataattcaacatcgccacaatttaacacctaaacttcaaaggcatggcaccagctgcagggcttcagaacatctaacctgactgtagaggggactttccccacaatgtatctttcgatagccaagagcgcgtttttggcctccatgatcatttgcctacatatggggctgcactcaccaatttcgtgaacagatagcctatcaggattttcataatcatcacatattgtgtctagagtaagggattctagtgatgttgcattctcaataatatggcaagtcagctctaccatgctctttgcagagcaaaacccaatgatcttcacattcttgaggttgacatggcggtgtcctggcatctgcctcagatatgaggaatcttcagaaatcacgtgatgcttcatacgagtctgtgatacctgcataggaacaagcaaacaatacttacaaatgattccattatagacaacggattaataggtattttttgccacatcaaaatttaattgtatcaaacaggagaaaaaacatgaaaaaagaaatgcttacggtcaaagtgaaaatctccaagacaggagacgcatcaagaaaataagctagagaaagataatcatttgatggggaaaagcccccacggtatatgctaagagaaatcgtcaagcacttgagatgaaggaatctgaatggtgaaatttgtgtattgaacctctgcaataatattcagaattccatattaatcagaactcttgctatgtgcacggcccagccaaaaaaaaaaaaaactcttgctatgtgcataatgctggtatctaatgatataatcttaagtttcataacatacctcgctttctgaaaatatggtgagagtttcgatagtcggcgcaacagatggaagcttggcacatgtgtattgaatagtatgatgctgataaaaggaagataagtgtaggttcttcactggcagcaaacctccatctgatagtcctgctaaattaccatcataatcaaaggttgaaaggtttggagctttaatttcaatcacttgcaatgttgtgcatccaaacactgtcagcttgctgagcctctgtagcacgcaaggtatcttgaggtaattgagctctttacaatgtgtgagtttcaactgctctaaagcaaaagagttggaaagaaggcaccccaattcatccccagtaatacgcacttcaaacagatgcagtctttgcaagaaattaagactagtggtaggacggaaggcacagtagctgaggcgaagatgcttaatcgagtttccacccctatcaaataaaagtgagaatgggaagtcgtagtactttgccttgatctctggaaaaaacataaggatgagttcttctattgctggtgtaacagcaatctggagccaacggtcaagataagaggcatcgaccaaattataatattcgagcccgaatgtcctcaagccaatgcctgagtggtttttcataatgaggtcaactttttcgttgagttccttggttacttcatcactttccgacaagccactcagccccagttttgcatcactaaagacaaggttggggcggtatctccatgaacgtagaaatgtgtgagacacgcatgcagtacgagcggcatcttttagtggcaataaggagtgtatatgataccagatgtcctgaaaacacaagagtcagagaacagttcaacatcgcatttgtaaaggtaagtgaacaatgatgcatgcaaaatttatacctctggaaggaaggtccatggatttgtcatagttttggcaccttcataatcatcttcctgttggcagggtgagcccgttcgtttagccaatgaagcaaccgacccatctgcaatacatcatgtgatcat

SEQ ID NO: 49950 - DNA, 6078 bp, Oryza sativa
agagtgcaaattgaagtgcgcaatcagaaaaaagaaagcaacattcgttccgaggtactcagattttaagctagctaatctaatcgaatcacttagctactactgtctcagtcaggaaaaaccaaactttttcttctgtctcagtctctcggaacaataggaataatgcagtatacttcatctcaaaagaataaaagatatcttcctcaaaaaaaaagaaaaaaaaagaggatagcagtatcctgattactgatttaactgaacaagctatatgtcaggacaatgtacacaatacagtgcaacgaagagggccatggaagcacggagcaaagaagcggcttaccacgggcttggacctgccgccgaggcatggacgtgatccgctccaccgaccccatggccagcttcttctctgctcctctccgatctcccggctccgccctgccctgcccgctcgttccaaaaccaacagggcgcgcgcgcggcggcgcagggagagcaccacctgatccgccgcgctcgctcgattttgctccggagtcagcagcaacgcgcgacggcgcgaggggaggaggaggcgagcttgaggaggggaaccgagcggactccggagtccgtggaggtgccgaccaaccaaaaaatatggcggaaaattagggacaaaacagtcttgtccacgccgtgggccgagaatgaggcccatctgagaaggccttgtaggcttaataggtgtgcttaggctgtatgacccacaattgaaatgctactcttagggcggtttagattgatgccaaaatgaaccttaccaaaatttagcaatgttaaaattttggtaaaattagtaacattgctaaaattttggtaggattggtttaataatgttgccaaaattctatacgcattgctaatatttggtaacaaactaaagtagccacatacttgtcaattttaccaaatatggtatggttgaaaatgtcatcaatctgaacaagcccttaattgtagattagtgatgaaggaatagtctaacatagaaggctgagtgctttccacgcacacttctttctttacttaaaatacatacaggaaaaactacaaaaagcaccccaaacatcacccggaatttgatattacccatataagacctttttttttcaattacatccctcctaatttattttgttttgatactttcccaactgccgttactcaatcattctcgtgaacgcaaaccccacaatatgacactactgcgaaaatatggtcgtcactcatatcggacaggcacgataaaaatgattatggaatcctcactcacagtatcatgttgttggactttggtagtcacgagtctcgttcttagatattggggtggctagaaaatgagttgttacgtttatcttacagagtttaattaacagtggctttattttggttgattcaagatgagaaaaataatatcggcatgacactatatagttgagaaaaaaatatgtatattcacgctaaatcttgtaacggaaagaaaaaatacataaaaataaacttattttgagatgaaggacataaggagcaagtaacatgcttatgactgagttcgggggtgagggttataaatcttcattcctagtacgaaaaacggaataatagttagttcatgattaattaagtaataattaaaataaaattttaaaatggattaatataattttttttaaagcaactttgttatagaaatttttgaaaaaaaaccacactatttagaagttagggaagcgtgtgcacgaaaaataagtggatagaagttagaaaaggagagtttaaggagtatttgagagaaggagaaataagaagattaagaagataggccgtgtttagttatttggctaatttttttttaagtatacggacacacatttgaagtattaaatgtagactaataataaaacaaactatatattccgcctgtaaactgcgaggtaaatttattaagcctaataaatccgtcgctagcaaatgtttacttagcatcacattgtcaaatcataacgcaattaggctcaaagaattcgtctcgcaatttacatgtaaactgtgtaaatcgggttttcttatccatatttaatgctttatgcatgtgtccaaatatttgatacaacattttttatctaaacactatatataacgagagaaatcttcactcttttctctttatcatccatgaaactcagcagcttacatctgggtccacctgtcagccagccagattgcgtacagacagagcttctccctcctctcctccctcgtttctcctgacacgctctcatcctacaaggctccaaccccaaggcaagcatgccaaacgcgcttcttccataaacccccgcaatcccaacaccctctccaaaccctctccgaccgatcgatcccccaccacctcctccgcctcccatggcggccgccgcggcggcggtcggcgtcgtcgccttgctgttgttgctgccgctcgccgcgtcggcgtacggcgacgggctgggccgagcggccgtgggggtcaactggggcacgatgacgtcccaccccatactcccgtgcgaggtggtgcggatgctggcggccaacggcgtcgcccgggtgaagatgttcgacgccgacccctggacggccgcgccgctcgcccacaccggcatccaggtcatgctcgccgtccccaacgaccagctcgcgcgcctcgccggcgacccgcgccgcgcctaccgctgggccgagcagaacgtctccgcctacctcgaggccggcgtcgacgtcaggtacgtacgcgcccccactgctgctctcgctcgctctacgggtggtgtgctatggtttgcctcggccgccggcgcggtgtcgcgtgtgcttctagtttgcggctgcatgccaagtgttcggtgttgcgtgcggcgagacgacgcggctcttactctgagcgcgggcgtgcgagctaggtgagggtatggaatgtctgttcgggcgcgtcgaaagtgttcgacggaatgccaccgttggacatgcagtttcgtgtaaccgtgatgtccgtgatcgattgatcgtgtagtgcctgtctgtctgatcgggtggtgctgtgagtgtgagatgcacatgcatgcttgcatttgtggttcatgcagaatggatagttttctgttgttgcagtgcttccttggtggctgggttaaggttcccctgtcgcctgaaagacatgagtgttaattagacatcacttacaatcgtgtcacttagataaatacagtaatgtatcctgcatcatgcaattagtttcatacttcatgcatatattgcatatgggtgtgtagcagtagccgtactgatcaggggatgtttggttgatgcctaaccttgccataactaagtttaggctagttgtggcatggtggcataaatgtggcttagaaatagttggccacaagtgtggcatgcttagctctaaatttgagagcatgacatgtgggtcccaaagttaagaaagtgtggcataacacaattgcggcagcgaaccaaacacatgcctaaaaaactgtggcatggctaaagtgtggcgtggcaaagtgtggcaaccaaccaaacagcccctcaaatctgttttgtgtatgatacctcagggtcgagagttaacgttgtaaatgttggagaaacatgctttgattggtttatggaatacagtgtgtttagatcatgttccctctgttgatggtgtttatatgcttccatggatgttgactgaactagttcattgaggaaacctattcaaaatgtggagcaagtaaacgcaggaatgagccgacaattggattaccatttctaggcttctaattgtagatgccaacggaagccagaatgaacttgtatttatgatatttagagcattttaatccttaattgtgctgaatttactgtggaaatttaggtgtgtttttattggtgaagaacagtaggaattcagtggatttcattgacttaattcctactggatttcagtgactccactttctagcaattccttttgtaattactgtgctacttaagtttatcatgcatgatgtgccaaactgagcatatctctatgaatccgatgggcgatggtgtgttgcatataaaatgtatgtacttgcctagttacttatttctgaatattcacattgtctttggtgatactctcctgttatattcactggttatgttaattgctcaggtatgtggctgttggcaatgagccttttctaaagagctacaatggcagcctaatcaatgtaacctttcctgcgctcaagaacatgcaaagagctctagacaaacttggtttaggtgatcatgtaaaggcagttgtcccactcaatgctgatgtctacaactcccctgagaataaaccagtgccatcagctgggagcttccgcaaggatatcaatgccctcatggttgacattgtcaatttcctcaatatgaataatgcaccctttgttgttaacatctacccatttctcagcctataccagaatccaaacttcccactcaatttttccttctttgatggtggtagcaagccagtttatgacaaaggtgtggtctacaccaatgtgtttgatgccaactttgacacccttgtttggtcactaaggaaggctggtgtgcctgacatgaaaatcattgttggtgaggttggttggccaactgatggtgataaacacgcaaatgtgagatatgcacagaagttctatgatggttttctgaagaagatggtcagaaacattgggacacctctcagacctggttggatggaagtttacctatttgcactgattgatgagaaccagaagagtgtactgcctgggcgctttgaacgtcactggggactactcacatatgatggaaaaccaaagttctctatggatctcagtggagatggcctagacaatctggttggagttgaagtggaatatttgccagcacagtggtgtgttttcaacaaggatgcaaaggataagttcaaagacttgccagccgctgtaaactacgcatgctcaaatgcagattgtacaccactgggctatggatcctcctgcaataatcttagccatgacggcaacatatcatatgcattcaacatctatttccaaacaatggaccaggatgttagggcatgctcttttgaaggcctcgcaaagatcacaacgataaacgcatcgcagggaggatgtttatttccagtgcagattctaagtgcttcagaaagggttgtgccactgagatttttgcctacatccttcttgattctcctaatggttgtgtccattcttacatagagtcagagacaatggaggaccggtaagtgctgataccttggggttgttggagcatgacacagtaaagaacataggaactgataccttgggttgttgaagagttgaagctgcagtaacataggtttgtaaagcatttttcccctcgtattttgataggcaaaacaaggtggaaacagagctgtatgccttcaccaccgtgccagcggtaatttgcatggatgagaaatatgagacaggatagactagcccttctttatacctctgttttcagcttgcgatcttgcagttcatttttttttattttctaaacgaccttgcagttcaattgtcaagctgaatgctggtattttacagcagcatgccttccaaatactgatgctacctacctgtaactgtaaggctgtaaaccaatgtattggcggtacagagtcatatgtgaatgaacgctctgcaattttagctgctcttgaattgcaaattttgtttcgtccctggatgttaatttttctttctctgttgaaagcaccatggataatggttgtctatttgagtttctctgcttaaaattagttggcagaaatttcctttcgatgcaaatcctaagctactggagaaccaaggtagagggctagaggccaccattggcaattcggcattgagaatcactggaagcagtatttagttactggaactgtcagatttacttcatgtatatgga

SEQ ID NO: 49951 - DNA, 1988 bp, Oryza sativa
aaactatgccaaatctaattcgtcccctcaaccagaaaaccaggtaaaacgactcccctaactattaaagttggtttaattgaactccctcagcagttttataagatggttttgctgatgtgacgttttgacgcggtttgaccagctgactcagcatgtgggacccacacgtcaatgtcacgttttcctcaaatctctttcatttctcttccccccccccccccccctcccctttttttttctccaggacggtaggagtgggcggtggctagccagcggccgtcttcggcttcgacgtcttctctgcgcccgtgtcgcggccattggcggagtacgccgggctccgccacacgggacggcgtgtccgtgaacatcgcaccgccaacgccgcctgcacgaccgttgataccagccacaacgcgtccacgccgaccagctgcgccacgctcgacgcctgcccgagcgcaccccacaggccggaggccgctcctcgccgggaagcagcgcatccgctctccgccgccgatccggcccccgctccccgcgtacgggccggagctccagcccccactccaccccgagaccacgccaccgtcccgtcgctccgcctcatggccaggtcgccgccgctccgctggaggccggtccgccgccgcgcgtcgcggggtcgcccagccgcggctccgcctgggcagtccccgcggctgcgcagaaccccgtgactgcgacgcttgggtggagggcgcacaccagcacgaacaaggactcatcctccatcatccactccaatccaactaatgcctgcaactacatcacctcatcttctccaatttcttcttcttgttgtttgttgcaatttactgactgatgaagaacgaagatgcttgcttggatactgctagtctgcgttcgttgcagagaaagcaagcaagcaaaataacaagtgaggaaaggaggaaagcagagtagcagacaaaagaaacagatcgatcaatgcgatgctatctctctctatttgaatttgaatagtagcagacaaaagtttatatatccgattcaaatttgaatttgaattcaaatattttttatatatagtatttctatacatctaaagtttatacacctaaagtttatatatccgattcaaatttgaatttgaattcaaatatttttcatatatagtatttctatacatttaaagtttatacacctaaagtttatagacctaaagtttatatacccgatttaaatttgaattttaattatatccgattcaaatttgaattcaaataattcaaatattttctatatatagtatttctatacatctaaagtttatagatccaaagtttataagtcaaaagtttatatacccgattcaaatttgaatttgaattcaaattttttatacataaatttttctaactttttgtttttttaaatttttttgtggtgtactgtaatagggaaagaaggggaggaggaagggggagaagggagccagggggggcgggaccgatcgcccattagcccccccccctgaacggcggcggtttgtggtggcgttcggaggcagaggggaaattttcggccttggagaaaaagaggggaaaaaaagagaaaagaaagtgagaaagaaaatgtgacatgacatgtaggtcccacgtgctgagtcagccagttggaccgagtcaaagcgccatgtcagtgaaaccatctctaaaacctctgagggagtcaaattgtaccggttttaatagttggaggagtcatcctacccagttttctggttaaggggtatgaattagattcgacgtaattttaagggagtcaatgtggactttttcccaacgagaaatggatccgatccaaggatctggctgggccaaaatgcgcttatagttttaagcctactaatgggccgtcttggcatgacaagccgagagcccgtgagatcgcaaaggacatagtagtttattttggagtaa

SEQ ID NO: 49952 - DNA, 2088 bp, Oryza sativa
aaagcaacatatgatgcaaccgttctcgcatgaaaaagctcaattcaggaaaggtgatcacaattatgttaattttactggtcatctcagccacttagctttttccaagttcaattattgtacaagggatacttcttgccagggctgaaaactgaagctgacgggatagaatggaggtaggtagatatttatccctagatggaagatacatctagcatatacatgtacaatttcttgaagcccagcaaaaaaaacagtgggtcaagtcccgtgaggaagaccgactagttgtatgaaactctttgacacacatcatggtcagctactcaagatgaacccaggccctgttatgaaatgttcttgagtttctttcgcggtttcaagtcgacaacaatgacagtgatgttatcctcgctgcctttcttcagagcgagtctcatcagataatcggcagctgcttgggcagcagggtcggtggatccttcaccctcatcagacaatggtgatgcagcgccattgttcttgtgccacagaaggatctgtcggcgtgcgactttgcatgcctcttcatttgacacaacatcccacagcccatcgcttgctagaataagacagtcatcatccttcgcccgtggaacgaccataacttccggttttggaatgacaaatggtttcagatagcgatcacctgcaacatcaggaacacggataaaattagcacaaggggcactaaatttggacatgcaatccaatgcacagggaagtcagctgaactgtcattggttcaaccaaatttcaggtgaaatggagcaacaatgttgtccaagtgtataacacaatagagttagtttatttgaatggcgcaagagatgtgaacaggtccaactaagacccatttagtcatggtccaagctgcaagtgccacttgcatgaacatgacataaggtacctttgttgcttcgataaacgatggcttttctactttggcaggtaacttcttttcctaatcaaatctgcatactcaattctataacagagatatgtttaacctcatcgcaagttcatcaacaagattagtgccaaactggcaatatccagatagtcacatgattgcagaatcttcacatatgtatgtctcgcatagaaacaagattttagggcccaaactgctgttacttgtaggtaaatatattcctaatgaataatacaacaccatggaaatatctcacagcacgtaatatattcatcactaaaaataagatctagcgtaatagttctttgggcaatacggtaacaggacattttgcctagccaatctgaaataatccactattgatatacttttcttagtgccgaaaactacaagcaatggcaaaggacttggggacttgcactaacatagtgttaacatcatcatataatatatggcaacaattaattctacagcactatgatgcagaagatctcaaaacaaggtggcaataggccaaaatcaatgtaagatcatgtaattttttacatcatgtcgcatagtttcatgtgctttgttcttgccatggccacaatttccaggcccaaagcacagtccttactatggcagtgtcacacaactcatttacagggaaaagagacagacaagtgcttcagcctagatctagcacagggatcaatatgcataccgattgatcgggacatagcaagtataccggacacccggtaaccattccattggatgaccttgcctccctgggcttcaatccttgcccgctcatccttcctgtcaggctgaaaacaaaggcataatcggattcagattaattatccccaaaaatggaccatgacctttacaggcataacaaagcttccccagtttaccttgtgatcaattgacaaggctacgggctccttcccgcggcagagcacgatgcgcgaatctccacagttggcaaccaccacatgagatgagcagacaagcgcaacgaccgccgtcgagccgacgttctctgcggtcaccggtctgaccggacctcaccgccaccattgacaaccctggtcactctccctgaaacctcatcgtccactctctgg

SEQ ID NO: 49953 - DNA, 1919 bp, Oryza sativa
ccaacaacaccagcaacttctcctcctcctcctcctcctgctggtcctccaacaacaacaacaaaactacttcccaagaagccaacgaagccgaccacctgacctcgcaagcacaaggtggggtgggtgaagagaaccaaagagaggagcagagaggaagaagaggaggtgtgtgcttgcccaaagacgcgcgcgtgtcgagggggaggggaaaggggaggaggaggaggagaggaaggagggagaaggcgaggggaggtggtgagacgggattggacgggtgggggtgagcgggacgcgccgtatcggacaggtctccccgtctgctgctgctgctgctggagggggtccgcgtggcgttaatattcatttgttgctccgcgaacgggggtgtttgctgctaccttcacgccacttcggtacacttgttgcgctcccactcggcgccacatttattttcgccatcccttgcgctgattttgtttcgagatttggagggagagaactttttttaagaaagaaataatgaacctattgaggattggagactggacctgaagttgaaactatacatctcttgccactgtactatagatacatatcttttctgtctctagagaggagttgaaaggataaaataatcaataatacttgttttactaggtgagttgttactccatgattaattgagtattaatatatttttactccatgattaattgagtattaatatattttttacttttttatagaaaattttgtaaaaaaatatatttgtctagcagttcaagaaatgtgtatgtgtaaatacactttctatccgaaacaaatgtcgccttaaacgcctatgttgtatgcttattggtttatcagccacaaccaaactttaagcttttgaaacttaaatttaaagatgatactaagatttttttttaatatagtttcttttcaatattgattttgaaattattaagaacacatatataaaattttatttatacattataattttttttacttcgttcattctttcacgacttatgagccatggggcaaacaatgagaggcttaatttgaggtgaaaaaatattttaaattgtaaatatctcggtgtttgaattagtattactcctaccttatatgtgatgctttgacaagggtgtttagatttgattgggaattcatgattcaaaaagggtggtaactggataggataaaatatctgatagattggttaggccagatgttgatcttattaaaatatgtacaacttatatacaaatgtataagtttagacttccacttatttagggtagctttatactcatgttgcctattgttttttacttaatattgtgctacgtggccaaacttcttgtaaagtttgttgctgaaagtcgagatccccaagcaaacataatatattctaccaactaatatctggggtgcgtctatctgttctatactttactttgctcgcttatggaagcaatggtttttctagaaaataaatttgcattgttcacaattaaatcgcaacacaaaaatagtacatttcgatgtactcttttgaattaagctgttcttcctcatcccttatgcgcttctctgcttgtaaaattaaagctattttgtgatcaatgaagttcatgccgatcaacggtgatgacattcctgtggctcctttaaataattaagcaaaataataatatattttttattgctacacaaatatactgtacgtaggaagatagaagatctaacaaaatcttgccatgcccattactggaccttttagaatgggtgacctgtagtatctgcctagcaaaatgccaaagcaaaatggaagaaaacaaaatagccggagatgactggtacacatgtggtgcccccttacattttctctctccattggtttc

SEQ ID NO: 49954 - DNA, 1295 bp, Oryza sativa
  unsure (1)..(1295): unsure at all n locations
tgtgctgaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctcttttgttttttttggatttttagtgaatataatgaaatttcacagaggagggactgggctttatagggggagaggcaaaaatcgccctcccccagggcggcaagggggccgcctgcaaaattccatgccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccttcccagagggcggtaggcgactacttccgtcaatttttaaaatggaaaattatttttgtaaaacttttaataaaaaaattaaaaataaaaaaaattccgggattcacttcccctcctcctcgccgatcacatcatcggatcatcatcatatcagcccacctcttctcgcctccataaatcgaggacacccacgctgccgctgccactgcacacgcacgcagcgagtcgcgacacgagaccgtaccgtggaaagaagagagcgaggcgaggacaccactccgctccgctccaccgccgggtcgccgcgccgcgcgcggcccgagctcgccgatcgagagccatgagcctcatcctttcccggcggcgcctcgccgccgccgtccggcggtcaggccccgccgcgctcgcctccaggtgatctgtctgaaaccccctcccctgatctgctcgcgtggagggttgtcgggaatgggcgtgcgtgcgtgcgtgcgtgcgtggatcgtgctgcggcggtttgggcgccgttggcgtttgggtgatctgatgcgagtttccggtcgagccgctcgttgcggcgctcgctttttccaccgttttttttgggagcgatccggcatcgtggttttggttgcgggcnnnnnnnnnnnnnnnnnnnnnnnntgggtgattgattggcaggtggatgcacacgccgccattcgcgacggtgtctcctcaggaaatttcaggttcgagcccggcggaagtgcagaattttggtaagagagctcccatttggggttctgcttattgtttttgtacacattgaatctggagggatattattagttagtgcttg

SEQ ID NO: 49955 - DNA, 2575 bp, Oryza sativa
atgtggttaagcgctatactaagcactgatgctaaaaataagcacgctatctatgaagcaaacaaaagcagttacatattgctaagcacatctgtaaacactagctgatgtgcgcatcgtcgcatcgacggctgggcggctggccgggtgccacttctacagttccaccgctacagttctttcccttcacaaatcacagtgcagtcggaaaatttactgttcccatctatttttcttcccccttcccccttaatgctgttattttcttgctgctgattgattgctctggttgtagttcactcaatgttaacacaatgtatatttcttagtctttactggtggttaactaactccatttatcattgaccatgtcaaactgtcagttaagcctcctttaatttgcctgatgcagcatgtctatgcggtatatatgtatggtctttaatgcaaatgcatagtaccaagctatttgtcttgccccgaccttttttgtttctttacatcttactctagtacttctgaaatctgaatgatatcttctgcttgaatttctttgtcatggtcaacaaatgagaaatataaggtctcaaatgttaatacatgaccactattctgcaatagtttgtgttgtcatgcacaccagatttagcattcgctttgttagattctctaaaatgtgcagcttgaaaactgtccctagacatgaaagttccagaatagattggtttttggtgtccagttaggaaaaactgaacatgcaggtcaacaagtatcgaaggtcgatgtaagttttgtattaagtctggtatgctttttgttgcatctgtgtatatgatggtattgattctatcgaacttgcttgtttctagggaataatttgaaaaagaacgagttaattttgaaatagctacaaataaattatggtgatgaatcggatttgttccaaaaggagcatgtgtttatctcatagatatccttttgctcattctcagtgagtatgctgtatttacataatctccattaatgatcatgattattgcttttcctgttgggctcttaagactttatataggagaacctctcactgcataggaaagtattgcttaaataacagtcttgccgtttgcaatgctgccctataatttctggtaacttttaggctaaccctagttagttaattagtttcagtttctagaagaccttttgagctgtgaaaaagggaggttccaagaatgtattgcaatgttggtggaggtaactttgtactcttcattctaacctagtataattggcggtaatgtcagtgccagtgtgccagaaagaggagcttttattgctaactatttaagagttcaaaactagttagaatgaatgaattagcttgattgtgtgctttaactctagttagaatttaatattccgtgtttcacttaaatcactaactgaaagatggttcacttaaatcacaccacaataaattgatttttcctgggtgctcacctgtgtttggtgttatgtagtgacagaatagtgtttttgggccagagtttttaactgtttttcagtggcacctgcacataattactgaatagctctactttttgtgagtttctgatggaggtggttccaggcttccaggcggtaagatttaggagtactccccaagttgatccggctaaccagttagcggcgcctataaatatctatcggcctctccaagccgggcaccgtgcgccccttctctcccacgaggaaacgcagagtgagctctctctctctctctctctctctctctctctctctctctcatcgttctcttctctcctctctataaagattgaattgcttctctggttcgattcctccccatgttcttctctgtatctgattcttccctcgctgtatcagcgtgcgtgactcctttgatcagaggaagcaggcggcgggaggcaggcggcgtgatcaactagtggttagcttcctctctctctctctctctctgtctctctctctctcgcagatttcgttggttttctcctgtttaattttctctctcgctttctccttgctggtgttcggcgctgaatgggttgattcatggtgttttcttcatgaatgggtgtttaaaactatatatctggttattgttgattaatggtgtttccttcctgaatgggtgtttaaaactctctggttattgttgatttcatgggttgattcacggtgtttcctccctaaatgggtgtttctgttgattcatggtgttttggcggtttcaacgcagtagcaggtcacgattctgggttgggttcatctgttgctggatctcttcttcgtgttttaatccactcgctctgctgattctctttgttttcgtgcttgcagccatggaacgattaaaagtgatgagaaatctatgtgaagttttgggtatcgatttttgggagaagatggaagagctcgacattgatcctaaagtggaagagctcgacaacgattgcgctgcttggtttacggggtgtcatgtaatggtgggtttgggtagttgtgatttgtgaagaatgcaatctagaca

SEQ ID NO: 49956 - DNA, 2477 bp, Oryza sativa
attatcagtagcaatgccatttaaacggtgttctgaaatgtagataaaatgcgaggtttcccaactcgaacaactcagcgcaaatcgcttgaaagaaaagaatctgaggataaagacgaagataagagaacttctcaagtgtactcatttgacagggaatgaagtagaaattgatcttgagaaggaaggtatgtatttgaacttgtatttgtttccactctgtttggtgcttctgttattctgtaagataataagatcagagcaagtttttttacccatgatgaattggtatctcgagcctgtagatcctttgtgagccaatctgttactgtaacatccttgtggtgtaaaatagatgagtttgggatgccctgtttagttatttcacaaatatttcaaaatcttagtactccctccggtaaaaaaagaagtcgttttagacttttcaaagtcaatgtcatacaactttaactaccttctagttaacataagttaaaaacagttacataagaataatattatgaaagcccttttatgacacaaacttgaacataccattttcatataacaaaaacatgttaactacaagcattccaaacaatttgtttttagaccagagggagtaagttttttaggagttaagctgttagtaaccacaacatctggactaatttcagtccagaaacttgttcttgaaacatactccctcctaaaataaatttatttttttatttgttgcaaatactgtagcaagtctgtttttcggggctgttgtacatccgacactttcttctcttacaatcttaataaacttcggctgccttttcaagccggcccggcgaaaaaataagtttatttctagcctaacatatgtccaataataagttcatttccatccacctatctaccttttctccataaaatgaggagttttacccctttaatacccttactgtgatctactcactaattctgctttcctcttaatgcgctctcagttctggaagaattaaagatgcaaaaggagatgttaaaagttgaagtagagaggagatcggatattgttatcagggctgaaatatggagaaaatcagttgatcaacttgaggccctacaaaaaggtagcaaaaatacaaacaaaatggagctgatgaggtgtgagttactagcaaagaggactgaaggtaaaactagaatctaagtttattttcaagcaaaatatatgtatgtttaataaaactctgtatgttttggctattaggtatcaaaaatatcctggtagaaatggtgcaaacttgggaggaaaaatatgactctccattttcttatgacggggtatatttcctctttaaactacaatatttttgtttaatcattttttttacagtaatatccattctctgtatgtttacaggaccatctcctcacaatattaaatgctgatgctaaacctagttcaagtgaagctgaaggtatgcaaaaacaaaaggctgaaggtatgattcatcaacatctaattgcgtattgttgtattaaacccctcactcttaaaccgttcaaattatctcttgatcagaaacagtcttgagtttagggaagatgcacacagagctgatatatgagtctcctacgatttgtttttgttaacttgtattgtcaagtagtaagcgttaagcgaaaaccactccagttttgtttgaatgggtaaagtaaaaatggttttaataattgaggggattgaatatccggtagttttaagttgagatgtgtcttttaagcacatcgcttttatataacttctctgtttatttgaatagaaaggaatgaaaaatttagcattcatacttcaatgtttgatcgggctcttgatcggtagttctagatataatttactcgtaaactgaaatttctttttcaggccaagtaccagcacaggatctcaagtcactgcttacgcctcacccaaagctccgtcgcacgccaagggtgcctgtgccacttgaagaacatgtccctcttcagctacatgtagttgcgcctctgcttctagtaccacccgctggtgcaccacctccaatggcccaagcagcccaagcagttcaggagctgcctgctccactacctcttccagatgtaccagtgcaggctggttcgccaccgaccatgatcagccagttcaacaggagccggcaaagtctgctgacttctacaatgctgaaggctctccaggtgatgaagagaccggctctatcaacgtttcaagtgacaatgatgatagcgatgacagtgactacctaccttgagtgacgacagtgatcagtaccttccttaaacagactcgatccagtatacatgtagaactaaaggttctggtgtactttgttgcctttgacgccagaaccaagaaattcgcaagtctgttttttgggcttaagtgctgattagcaaccgatatcggaaccttgcttatacataag

SEQ ID NO: 49957 - DNA, 33494 bp, Oryza sativa
agtacgcactacgtaaactagatgatgcgtagtaaaaacgataatgccaatcgcaccactcaaaaaccacgtgcaattttagagtaccaatattatttggatgaaattagttatagaggaataatcgtatttgtatttatagaaaatttcaaagatattagcagtacactcaaataaccctatttaatgttgtttgtaatgatagaaattcactcttaatccatcacttcatgcacaaatttaatgtggatgatttgctatttcatagtatattcaataaacatcatgtatggaataaaaggaaggttgaatcatatggcgatggtaagatgggagggtagaattggatgagcccactttattataaaacaatccttttttataagatttgaatgatagaaataaaattattttgggacagaggtattagttaaaatcaaggggaaaaaactttcacatatttacccaattctccgtttgatttgtaggaattacatggcacttttggaagattccaaacctataagaaaattttctatgaagacatgtgaaataaaagatttaatcttatctctcaattttttatggaatgaacaatcctatggagattttagatgaaagttagcaagagctccaacctcttcaaaatttcctttacaaatctatctcccatctgattcatgtgtttttcatgcggtccaatcaaaccatcttttcttgtattgcattcccctatcaaaattatgtgtttgtttctaaatgatcatccatgtattacaatcctctatttttcacttatatttctattaaaattttatgtttttctattcctatgttcaatcctatgtattcctatttgtatttgtcctatagtggcggcaacggcaccaagggtcttaggaggcgctggcagtgatggtggtggtaacggtggtgtcaggtggccagctcggtgatggcattggctggtcagctcgatggtgcactaggagcgacgccgggtacagcagccacgccaacgacagttgtggaggtcgacatggtggcggtggctcttgagtgagataagctataacggcttggtggaggtcacgatttgcgcaatgacaacttggtggcaatggtctttcggggagataacctttggcagctcgacggaggtgggcatttgcggcaacaacgacggtgggacaacagcagcctggtttgcgttgcaggaagatggccggccgttgtgctttgtagcgatgaaaatgtagcagcgatgacttttggcgatataagctacggcagctcaacagagacagtgctctatgacgttgacgctatgatgccatggttcgggcaacgtaagaccaatgtttagcgatgataggcggatgaaaggattagttccgtcccttcctccacttatgattgagagcataagctttcggggtggctgcaacgacaatgacagagtgaggcggtgaaagtgcgggctctagtttcgcattgctctgaagtttgaagtgttggggaaaagctgaaagctcagccttctagtattttctttttagttgtttgttttttttttatatctcagttatgagatttggagtgtatacgcttgtataactttgattttgtatatctgctagtggatatagatactggatttctatacattataaggttttttattgtccttgaggttgtgcagtatcaaatcctgatcgttgatctggcatcatccaacggtcagaaatcgtccgcacctcatggtaccgcacctcctcattgaagtggtaccatgggtgggagggtatttctgtcctttcctgtttcacgagaggaaaaaaatcgtcgggtaagcatcggcgcctggaccggcgctcgagggggacggcggcgggcggacggacgtgcggcggcggcgactggacgcgcgctcgagggggacggcggtgggcggacagacgcatggcggtggcgacggctggggggggctggacgcgacaggctcgagggggctggcggcgggcggacggacgcgtggcggcggcggcggctggacgtgcggcggctgaagggggctagatgcggcgggctcgagggggacggcggcaggcagactgacgcgcggcggcggcggccggctacgtcagcctcgattggcgacgatgacggcggcggccggctggatgggcgacggtggcggccggctggatgcacgacggcggcggcggcggcctcgattggcgacgagctggatgcgcgggctcgatgcgtgacgtccctgccggcacgaacgacgaagagaggacacatgttttttttgtctgatcataccctgctaaatcaacggctagattagattgatacctcatggtacctcctcaaggatggaaaagatgctcatacattatataaaaaaaattcaatcctgcatttcattggagctagatggatgagacttagggatgacaattttacccatgggtccgggtattcgtggatacccgacccgatgggcacgggtgtgggtgtgactttttacccatgggcacgcctgccgagacccgaagacgttaggggcaataggcgggttttattttttacccgtgggtaacccatgcccgacccgatacatatgtattagctaattttgactcatttcttaattcttataccatttctctcggttcatttgtgatgctaattgatactaagttgtgatgtcattcaaattattgttgataaccaataatttggtaaattattgattttatttctctttgttaaattatatatttttcaagttattattcatgtgagatccattgggtacccgccgggcatgggtacggacatggagttttgcccgctaactctagtgggtagggtttgggcgggcaatgtcgggcatcgggtcgggcatggttttgctctacccatgcccaacctgacccattgccatccctagatgagatgtaagggccgttttaattgactaccctactaaaatttgccatatcgaaactttgatggaccatattaaatcaaaccaattttagcctcacaggatctaaagattgaggatgttttgttactgaaccaatttcacgcacgtaaaacgcaacggctaattagtatataattgactaagtaataactaagaaaacttgaaaaacagattaatatgatttttaaagcatattcctatatagtttcttttttcaaaaaacacactatttagtcgtttgggaagtgtgcgcacaaaagatgagttagtggaagttggcaaaaggagagtatagaactcagcctaaactttgcaataacgcattagcgctagtctgctggatggcaaaaacatatgatatctgcaaactcataagcattttaagtgggttaattggatccatgtcattgcaaatacgttgattcagataaatgctattacaatttatctgttggtatccatgctcttcgaatttgcacaaaattaaaaccataccatcattgtcatgcttttcattatcgtatagatcaaaatacacctaaacatagtgtcagttctatcttcttgctccatcctcccctcttctctctgcctacgaggtctgtatcttcgagttgaccctcgtcgcgtgttgttgcgtgctgccgccatgtcgtccccctgcctatccttccctcgttcgccgaaaccttctcccccatcctcctcacccctgcggccacgccgccgcgccggtgtcagtggcagtaggtcagtccgtacgactccgacggcggtggctccctgatggtggtcatcttgcgcatagggcagctctagcatcgaggcaatggagatggccagctagtagaaggggaaggagagaaagagaggaggaggagaagaaattgggaaagaagctggaaaacattatggttttaattttgctcgttgacattatgcatacaaatagacgaatagcagtgacacttatttggtatcttatggtacatcctcaacactgtaaaattactcatatatgatcacttctttctatccaaccttgcttacttgctccaacagtccaacttcaacaaatactgaagagctgaaacaaattttgcagagcaacctgagctcttcagttagcatgatatcaccacaaacgtaaagttctcacaaaaaaaatactgttcactcacacacatgtataccctccgttacaaaagaaatgcagccaggaatgcacatatagatatagttgttcagcaattagtaagacaaatttcaaattattacacattacagaaaacaaataagaaccgagttcacacttcacacactgctgaacacgaggttcagcaaatacattattcgagtaaaagagattacaaattaaatttttcaccgggccacttactctaaataaaattaagtgaacatgataaattattgctgccatcggttggcctaatggctaatgctgattataactactacatgggtgaatcaacctagaactatttggagatgatccgttgagcaagagaccgcatccatgatctgcttctccatggtttctttctccttgtcattccacgaattctcctgcaacctcggcatctcccagtcccaatttcccttgtacttcagatcccctcccttgaaaatggagacatggcgcagcgcggtgcacgctccgacgacgagcttcacaaagtatacctgactcactgtccctccaaagccagccatggcgaactcctccaagcgatagttgtgcagaggaacggtgggatgatgccatgagaactcgccgccggtgggcttcttcgcgtcgcgcggggcgatgtgaatgtgaagggtcttgagcgaaggcgccgcgtcgaggaggatgcgaggccacgacgcgtcccaggaggaaggcacgtcggcgaccagcagccgcctcaagctgcgcagcaacggcggcgacggcgagcaagacgacggcacgatccatctctccggtccggtgaaccggacgatcaggtcggtgatgtccagggtgtagtggaagaatctgtcgagcgtcaggtcgggttcgagccaacggctgaacttgcgggccaagccgtaaaggcaggcgaggtgccattgccggaggcaggggaaggaggaggaggaggtgcggcggtcgaacagcacctgggtgcccatggaggctaggttctggagtctcggaagagaccgcagcttcaccgaaatgatatcgcaggcatcgacgacgagctccctgatctccgatatgggagcgtccaccaccaaggacttcctccggtcgaggaagcatgattcgaggtgcagcacttgcagctgcgggcacgaggtgaagacgccctcgtaggcttccgccggcgtcgaggccgccatgccgtgcaagacgagcttggtgacgccgccgtactcgtgcagcggcgggagcacgcagccgccgagcgtgagggttcgcaggcgtgacgcgcggggatccttgcagaggccatggctagggaattcgtgggtgggaggttggcgccagtacattggcttcccgacggcctcgagctcctcgacgccccaatcgtctatggccttggagatcaaccggttgatgccagcggtgttgtgcgtgccgaagaactcgagcctcagcctactgaccttccgccggctaggtcggccgtcgtcggcgtcgatgaagctctcgacggagcggaccaaggcgcgcgcggctcgccgctcgtgcctccggatggcgggcatcaggctattggggatgcgtgccggtacgctatccagttcatcacgccgcggtggcggaggatgcaccggtggtagcgcggcgggagtatgtcgctgaccctgaaatcgagggcgtcgagctcgtggggcagattcgtccagcgcctggagagcatgccggtggcgagcgccgcgcgggtgtcgaggcggcggaggacgaggaggagcaggtcgtcggggagtgcgctgaggcggtcgtcgccgcaggcctcccgcggccgccggcctctcggtctcaagctcatcctggccatggtagatctacctcctattgctggggggatcaagcaaccagtagagatggccttgcggctgcggtggcgattaaatagaggcgtccgctcgacctcctcgggttcggattcacgatgcccgccgccggaggaattcgagtcggattggcagaggaattaaaaggctagggaaatttgtgaatcaggaaacttcaatcctatcgccggcgagcataggattggggaattgggggttgggttttcaggcggtataattaaaagggataaacttttgacgcgattaaaagggataactgaattcatgccgttgtaaatatgggcatgtttagtttcacataaaagttttacgctctatcatatcgaacgtttgaacaatgcataaagtaataaatataggttaaattagttttttattagtgcccaaacaccctatgtaacaccatacataatacccaatatgatacgccaaaactttacacccctagatataaacactctctgtatcgatttagacaagaaacacacaagttttacatacacgccaactaataaatatttttaaaaaattagacatgtactttattacacatattcgtgaaattttatggtcaaattcattatattttagttgtaaaaagacaaaaattctgacgtacttttcactcttaaaacttagaattttctttttttttgttacagctagaatataatggatttgaattaagatttgtagatatatgtaatactattcagagtactaaaattttatatgatatttgttagtaccccgtgattcaagataagaaggagatcgactgaatagagatatcaccgcgtccatcgattggtcgatcggttgttgctggccatggcgtcgtcgcggatggaggaggacgctgctaaaggtcatcgtcctcggtgacagtgggtcagcgcacgctacgctagtcctggtttatcttagcctgattctcatagctctagctctacttcatggtgcttgtttaatttcgcccttagcgattcctgaattggattggtcgtttggttttggtgtttgcagggtggggaagagctgatgaactagtatcctcttcatcttttttttcacaaacacgcaaaaaaaaatacatgtcaatatattagaagaaaagagagtttatttacacactgcaatcagacagatcggcttatgccaaggaaaaaagacaaatcagaaaaaccaaagaaaaggaagagagaaacgactgctagacgcaactccaattagcaggagggggcaaggccacactacccttctaaaaaaaccccaaaaaaaagtgacaccagctaacgaccagagatggccctcagaaaatatggactctaagaccacagagaccgaagagagaacaaagtcgaaaaccctagtatcctattcacatccatagcatcaacctttgtgtcagactgatagtttgttgcgtagagatctttagatatcctagtgcaatctttcagcatataaggtctatttgttttggagaaatttcaaaggatttggatggatttggattcctaagaattaattcttatgaatgccaaatgtagatatagaaaaaccaaagagaattttccttttctacaagttgtagagagaaagcacaggaaattttccatccactcaaaaccttatggaaaaattcctatggattgagttgtgcatgcattctcattcctccatttttcctatttccatgtgttaaaattcctccaaaaacaaatagactcttatcttcctttttttttacaattagaaacttgcattcacttaagtaaccataatttctttcagaaaaaagagaaaatttttaagcagaaacaatcttcaggacaccaaaaagaaagatcattgcttggattttcttccactcttgattagatagtgaacacgaagtttagccagcagtacaaggcaacgatttcgtcggcaaggcttgtgagcttgtcaccttgcaggtcaggctcgaaacggaaatcttctgagaaaacaaacaccggccgtgtttggttgttttggcaaaaaaaaaataacgtatactaacacatatttaaagtattaaacgtagactaataacaaaacaaattataaatttcgccggtaaactgcgagacgaatctcttaagcctaattaattcgtcattagcaaatgtttactgtagcaccagtacaccacattgtcaaatcatgacataattaggcttaaaagatttgtctcgcaatttatatgtaaattgcgtaatttgtttttttttcgttcatatttagtgcttcatacgtatgtctaaatatttgatatgataaaaagattagaagtttggagggaaataaacacacagccactgccgcaattcgcaaatgaccaacgatctgcgattcgatcgctcaaacgatgagtagaccaaagcgaccgcgctcatgacatctacagccccagcccgtgcagctttaagcagtatcaactcaaatcgatcgcatggcacatctgcacgcctctagaaaataaatcagctataaatatattttaagaagataaaagaaagataagagcagcggactataaatttagccagctacagcatagacttcaaaatacatgtgtgtacgacaggtgggatcaaacattaattaattatatagtacatgtttataggtaattattatatgaattagctattaaattgactatagataatttagagcaataattagttgtacttttaaacttgctctatgacatcacgatcagagaaaccacgaacttgatcgctcctgcagatcgaacggtgaaaacgtgaacgctgaacgatgagatcattaaaaacggcaacggagagatatgagtgcttgacacaattggcccgtttattctgttctatccacgactctctttttcttttaaaaaaaatcgtttttatgggttcggacttcggagttctcttcttcgagcaacgccgaggccgacgctaatagatgggccgggccggtaagatttgacagaatgggcccgtttcttttctatctttttgttttttcaattttctggttgagtaggggttcggaattttcttccacgaacccccgttttccgcagctactatgcttttccctcgctccccgtgcgccccgtgattcaagataaggaggagatcgactaaatagagagatcaccgcgtccatcggattgatcgatcggttgttgctggccatggcgtcgtcgcggaggcggacgctgctcaaggtcatcgtcctcggcgacagcgggtcagcacgctacgctagctcatccttggctacagacccggccatttcttcctagcttgatttcgaatcgctctagccctgcttctgtcagcttgatttcatggtgcttgtttgattttttccctgactcctgacttggatcggttatttggttttggttttggtgcagggtggggaagacgtccctgatgaaccagtatccttctcctccatagctgcatatcatcgagctttttagtagtatcaattttgctcagttagctgtagattatagtgaaatcctcagaagataaatctcaatattttctactactacctttcattcatttaaccggaattacattcagaaaaaaagaagagatatttttaactagaaacaatcttcagcacaccacaaatatcggtgcttggattttcttgaactcttgattagatacgtgaacaagaagtttagccagcagtacaaggcgacgatcggcgccgatttcgtcaccaaggaggttctcattgaagacaggcttgtcaccttgcaggtcagcctcatacacccattcaatttggatgctttctattctcaaaaaaatttggatgctttcacatgaaagttgccatctggctgtcatcagtattgagttttcttggatgtagatctgggacacggcaggacaggagaggtttcagagtctcggtgtggcgttctacagaggtgcagattgctgtatgctagtctacgatgtcaatgctaaaagatctttcaatgcactcaacacctggcatgatgagttcctcacccaagtaagtcatttttatcaggatattttccttaaaagtttttagcatctgcaattacctcttccattgtggccatgcctgatgcctgtactagttcagagaagcaatgtctgcatcatctgttagtcatatgcaaactgaaggcatacagcaaaatgccaaaatggctgctgcaggctgaaaatttaatgttgcttggttaatatcaatcaatttgaactagttatgaagaacctgacaagtccattttacatttcagaggaaaaagaaaagtagtacagcatttttgtcctattttaacagtactggaagactgcaactgaaaaatttcggctccttttttaggctagcccatcagatcccaaacattttcccttcatattactcggcaacaagattgacatagatgccggaaacagacgtgccgtaagttacttgaacattcaaacttctgtacaacagtccagtacacttcctttttttttctttttctgaacgaaatccagtgcacagacattgacaatttgacatttctgtactgtcttcccggccacagatccctgagaagaaagcaaaagagtggtgcgtctccaaaggcaacattccgtatttcgaaacctctgcgaaagacgactacaatgttgacagtgcttttctgtgcattgccaagcttgctctggagcatgagcatgatcaggacatgtaagtgaaacaccttcagtttcttgtttgcatctgaagtgcttcaagcctaaacaaatctagcattagctgtttactagtcatcttacacctgtttcttctctatccccagctacttcaagactgttgcacaaccagcccctgatactgaacataccagcggatgtgcttgctagcactttggatgcttttgttcattggctgagaatgaaattatacaattataagttgttatggactcacagtgtacaataagctcgcataagaaactgttactcgcttgtgtatccatttttttaacctaggctgtgtttagatccaaagtttggatccaaacttcagtccttttccatcacatcaacctgtcatacatccacaacttttcagtcacattatctccaatttcaaccaaaatctaaactttacgctgaactaaacacagccctactagtagaatactatactagtaataagcagcttctgcttgcatctgcccagcagcccaggtaggaaaagactaactggaatagcagttctgactgttctgtcggtgtcggtattctgtgtagaagtacttgtatagcagttgacctcttcattgtcagctgtaacaaaacatacagttgctttccagtttacagtagtagttatgaattcatctttctccccaaacagtgcgatcgcatgtgctatatagttcatttgatggctcacactgttcagagatgggggtgcccagtgacgctgaccgaaatgttcagacttcaggctcttcaaaagttgtagtactagtacttttctaacgattgcacaaggctgattcagagattcagatttcgaccctgccctgatggcgatcctgaaacttgacgacggcgtgttgggaaaccatgcagcagcagaagcagggagggatctgtcactctgtccgcgccgatgaggacatacaggtagcgagcgtacgctgccggtggtggccgatcgagccgagacgttgctgtccgtccgtccatgcaacgacgctacccccaggtcgtcgggctggataggccaccaaggcgacgacggccggacaaccttgaccccggttccgggaccttgctgacctccttctcggatcctgccgggttgcaggcgagaagcttcagaaaaaaatggcaggaggagatcaaggtcagaggactcgttgaatgcgactctcagccgtcgctctccttccacctgcttttcagtttccggaaaaaggaaataaaagcttctctcagagctagtatctctggtgtgattcttcagctagctcactgaacgatcgcgtgggttcatacttcatactaataaaagtagagtagtagctagtactcctttcgtccttgaatacaagagattgatgtgacatcctagcacagcaaatctagacaagtttactgtctaaattcgttgtactgtaatgtatcatatccaaccaaaaattcttatatttaggaataaagggagtactagtttatgcagcatgccatgtgtatgtgtgtacatgagatgaggtccaattctcgtgttcaatttgtgactgtgtgttgctgattgaataatggatagttggatactagtgatagcagcacacagagttgaacatagcttcgttgtttagaattgttagaatccactaatgaatgcgacatgcgaaaaggggttaattcgtagagtgttttaactaaaacagagtccaaaaacacgcgactgtgcctatgaacaaactcttcattaacattcccgtggcctcgtggacaattggttggcattttatatgtgtccgttgaatttttgtcaaacctatcggttgatggaacggtgtgcaccgcgaactcacacgaacacctatgtttttttttctttcaattttggtatggtttccttttctaataaatttataggccgaatatttatatgtctacttcctatttgtatttgaattctgatttggattcaaatgtttttatatatagtgtttctatattaaacttttctacgtatatttacttatatgtataaatattttggatatttctgatggtggaccaaaacgtattcttcttatgtctaagccaccgtgaacatctacctattacactaacgagcaccagatggtagttgttgaaagaatagtaagattagaccttaccacaccaagtggtgaatccagaaagaaatagtaaagggattaaacaaactagctaaagttagagctcttctcacacgtatgtaaagcaaaaaaaaaaaatagcgagggtccccacgatagatccatcccgaccacgtacaccatatccggattatccacaaggattttggaggaaaaaaatggtattaatatattttaaattagtttcaggctttcagccggcagatattctgcacttagatacatgcatgcatgtccggtttcgttatccgaatgggccgaacaaagtggacgtcaatcgcaatatcttacgctaaaaagagcttcctgggcccttcttaatccccacgtgcttgattacccaaacaacgaatttttttcggttttagattttttttttaatatttatagaaataatctatcggccaaaaaaattacaaaaatagaccctgccgcccacctctggggcggcaagctgacgtggcaaacgggggaggaacgggcggtgacggagggagggtttttttgcaggaaaacccttgccgccctctggtggggcggcaagtggcccgaatgcaaaaaaaagtcagtcggggccggctattttgcaggcggccccttgccgccctctggccgggcggcaggcctcactgcctataaaaggcctgctgcccagcccctagccctcattcttctctcctcaattccagtgaaaaaaaaagaagagaggggaggagaagagaagaaggggcgaagccttgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatttgctagtttggaatcaatacattaccgttgcattggcttacacaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagatgaacatggatgatggcgagggaccaagtgctaaagtaaacgagacttctgtggaggaggtcaacgcacgagaggacggggacgtagtagctccagtgggcattcaactaggtggagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagtttagggttgccaagtcgaaccggtcgcaatatgaagttcggtgtgttaaggaaaaagatggttgtccctggagagtgcacgcgtataaggggaaatggaaggattattggacagtgttagtcgttaccaagcatacatgttttctacctggtaatgttatgttatattattgaactctacatatatgttaaattgcacgtcatcgttatgtaccattagtaatgtttgctatatttaaatagcaacttgttgtacataattaatctcatgattttattactatttcataattttgcaagttatcttttgttttacattactatttttgaattgttctaacacgaaacactatatttttcaaagatggcacgtcaggatacacctcagttgttggacccggcgatagatcactgacaccggtctcaccttactgcggtgcagggggctcagcttgggacgttccgggcacgtacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcagccggcgacgcggacccggccagacgatggactgtggacaggtccctcctagcagctttggtcgatcgatggaggccagagacgcacacttttcacttgccgtgcggtgaggtagcccctaccctacaggacgtatcgtacttgttggggctaccgctcgcgggagacgctgttgggccagtgaccacggctgtggactgggaggacgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaatcgtattacatatttagtccgcagttaaggtgtctaacattttatcgactgcttgcaggttgagcagctacaggcgaaggccgacgagtactcgtacagccgatgtttggaggcgtacttgctctggctttttggctgggtgatgttctgtggcggtcacgggcacgccatcgacaagggactcgtgcactacgccaggagcatcgccgatgctgcagtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcgtctcatattgcagcgccgatgggctcacgtccaggttaggcggtcgtatcctgagtttgctatggagttcgaccgccttctgatgactgacgtcgtgtgggagccctacagtgccgcggctacccaggctcgtgcgccgttgggtctgtccacactctgcaccagggaccaggcgtactagatgactacggttccgatggtcttcgacatctgcgttgagcctcacgcctctttccgcgtgatgcggcagttcggcttccgtcagctctttccagtaccgtttccgaccaccgtcccagctgctgttcaccagtaagatcttgcactacgctttccgttgttgcattaaaatctgcttgttcacaataatttgtaacatctgtcgtttcacactaatattacacattaattcgcaggtactcgcgcaagggtcagcagtcagctggcgactggcccgccaagttggcgacttttgttcaggactggttgctcgcaaccgaggaggtcgtggaccacgagggagagccacacgctgaggagtcgtaccaggcctacctacgctggtaccagccacgcacccgtactagggtcaccttcgctcccttggagcagcagccccacgttgcgagcactagagacctctacgccaggcaccacgaccaggacttcgctcgtgttgtgagtaccctgcatcgcaccattcctttatgttttcatgtctttctcttcgtcaaattttacgaatatttacgaacaaattaaccatgcaggtcgacgacatcaaccgggtcgtcgttgacggttcaatgacgatccaacgtttaggcgcggggattctggtacccgtagaggagcacctgacgacgtacacgcggatggtggagtcgatgcgctcgattctccgagtgctcacctgtcgtgcagacgacgttgctcgggcagacgcagctgtacagcggccacccgtaccgtctggttcccgtccagctgcgcacgttcctaggccgactccccctccgcacggaggtaagtatttttattactatttctatacatgcctcgcacatataagtgagccgtttcacttgccgattgcttcagggtttcgtgcaccgttcagcaccccgccttcctcggctaggccttctgttgtgccccccacaggtacttaaaaaaacaacattacttccacaatcaatttacatacattttatgtcttagcttacaagggtcccgttgtcgatgtgtaggtttcgcccagttcgctatgacgcaggccgcccacttctcccaggctgcagggtcagcatcacaggcagccggcacgtcgagtcagggtccaccattggaccatgctgggacctcgtcggaccgcttcctgtcttccaccgtgctcttcgacatcactgacttcgacttcgcttcaggctcgacagaggacgtcatcggcccctcacagctgggaggcgcaccgccggtgcagacgcaggaccaggcgcaggccactcctccgcgggacactcgtctacccgtactgtgccaccggatcgtttcacctactcccaggaccatgtgcgagcacaggcccggaggaccaagcgtggtcgcggcgcggggcagggccagttgagcagtcttctctttgtttacttgcttcactttccagtactgtatgcttgtgtaatgactacgttgttgttatatgtgcacgatacctttcggcgcatgcacgactactttctgccgcaccgatgcagcctcctttattcgcgtgtgatacgagtatttgcccgccatttggcgcatacgaccaatgtaacattcggcgccgatcatgcatgtatctttcggcgccaatcaggcgtacccaccataccccaccatgttcacatgtcaggggtatcactcgattttttgcgcctatataagtcgccttaatgagtgaggcctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcacatgcttattcattccgtatgggcaatcgctttattcttcgtaacactactctattcggtagacccgcactacggcttgcgcatacatcgagtgggtcgatacagaaaatcccgttctcgacctaaccaccgtttacaaggtcgctggtatttcgcatccgaaagtattgagcaatacttacatagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcaaaggttctttgtttgtccaaatattcttgacgacgatttcatggtaagaatattttgattacatgaatccttattttctcacaacatttactaactttgcttgctttacatctattctttcctcccaggaaccaccaaggagatgtcaatacagagaatggatagataccagaagggttctaactccacctagccgtgttgtgcagcttgaactactagagcaatacagggttactaaagcgcggtttgaaagaggagagggatcctcacgtaggggttagctattatcggacaacttagcatattgaaatttctactgtcatgcttccttgtcccattactacatcgtcgttgtgttcaactattgcactacctccctcctagttcgaatctaatatcatctatgtaaccgcaatgcaaatagttgtatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctgggtccctggggcggcaagggacccagatgaaaaagtacggccgcaagctctttatgggcggccaaaattgcaattagcccctgggcggcaagggcctaatcgaattttggccgacggcggcagacggcgcggtcgacccaccgtctgccacgtcagcttgccgcccaccatttgggcggcaggagctatttctgcaattttttttgtcgatagattatttctgtaaatattaaaaaaaaactaaaaactaaaaaattccccaaacaacgagacaaaaacagacaggctctagacgaagacaaaagagaggcaccctgcactattagcttggatttgcttggttactttccgaaaagttcaagataaactccctattgtttttgtttatgacaatcactgactgccaactcatcgacctcagacaaagaccttctagaatctatactataaatgactaccaagaatcaataattcaatactactatattaactgtaatcatgggaaagcacgacccgtcttttgtggctagtattgtacagtataatactggtagtagtatgatcgactggttcttcttttacggtcgcaagggcatgcaaccttgctgtttctttggcaactttgggaatttattttgtgtaatttagtacaagttgagtgagtatgtacttgtcctgctttagtaattaaataaaacgtgcagtgtgttatttaattagttttggttgcttaaagttggaagtttgtgtgcctcggaaagttcgatgtgatgaaaaagttgaaagtttgaggaaaaaagttgaaatataacatggccaactacgtattactattgtacagggaaatgtgtttttgttttttttccatttcattaatttctgtgatgcccggtagaattatactggcctcataaaattccttcattctgattaaccggaagctagcgtcgctagcatctgatgacgtactacgacatatcgtgcgaatttaacgtcacctctcgaccgtcgttattgctgattgttttcgacgacgagagcgaagtacacgtaaccaagatgatgagcaccaaagctctcacaaaaaagcacagatcccgccacgtgcccgtccggcgaaaaggctccgcttctgtgccaacagctaactgaaacggcccgacgttcgtggcaggttccgcggcgcccgcgatcgcgacgctgacttgatgcgcctcagagcaagtttaatactatagcccactactaactttaaatcatttatagtcaatataataaccaactcatataatagctgcttactatactattaatatctggtcctacctgtcatacacacattacgtcttgaagcccgtgctgtagctggctacagatctgtagcccactgcttttctctcttttcctttatctctttaaaatatgtttgtagctggcttatagcctactattgtactattgtacctgctctcatatgcatctctcgcgagctaggcgctaattgctcgtggtgtcgcggatcggcgggcgcgcgcggccacttcggccgggaacgccgctatcagatcacgcaagcaaacacacctgcctattcgcgccggctcgtcgctgcagaaagcaacggaattgataggcgtgcgcgagcgcgagggggcaccgaatcagccaaccaggcgctgcgtgccaatccagcgggcgagcggtgtggagccttccaagaagagaggaaatatatatcgggcgggcaagtcacagacgatcggcatcggatcgcgatcacgagggggcacctggctttgatggttttgatggagttgtgtttggttcgggtgcgcgtggaagcttcttaaatcaggaaagggtgaggatggttggtcgtttgggagcacatgtgggatgtggtgtttgtgccagctttttttgttgctagtgctcatgtgggatatggctctcttttagtatctcgactccagagtattttctctgtctcataaaacattatgctttaaggtttaaaaagcaaattagtagcttgaagaaaagatgatcatgttgctctcacttattaataatcagctgtcatttcactgagtgcagtgcattcaacaagagtacctatatgtctatgaacctatggccacaaaaattacacgtagcaaagcaatcatgagcatattcaaaaattcaaaacagatgacaattaaacgacatgttttgtgggacactagtaaatctttaaacgtcaggttttgtgggacggagtaaatagtattgaagtatttgatagtttcagtcgcctgggaatggaaacaagaggcgcataattttgtcctaactatgctatgttcctgtattatgcgcatattttgctatcaagtggctgctagccagtagggatggcaattttatccatgggtccgggtatccgtggatacccaacccaatggacacgggcgtgtgtgtgactttttacccatggacatgcccgcccgagacctgaagacgtcatgggcaatagacgggtttcattttttacctgtgggtaacctatgttcgacccgatacatatgtattagctaatttcaactcatttcttaattcttataccatttctcttggttcatttgtgatactaactgatactaagttgtgatcaacttgtgatgtaattcaaattattgttgataaccgataatttggtaaattattgattttattactctttgataaattacatatctttcaagttgttattcatatgagatccattgggtacccggcccactaggcataggtacgggaatggagttttgtccgctaactctaatgggtagtgttcgggtgggcaatgtcatgcatcgggtcgggcatggttttcctctacccatacccgacccggcccattgccatccctactagccagccaccacggcgcttatccgtacgattattcctagagcattgcctacatttcgaaaagaaaaaaaatgattcctatacgaaaatgctatacacacgactgtgacatacgactcttatccgaccagctcttagctgctaattgccctggtccacatggagagaagctggtctgcgtggagcgaaacgattggcaggtgaggttgggtaagatgggagtcggacgtattgcagtgctgattcctataacatgcctggtcgctagcttttggttctcataatcgatctcatcaatcacaattgtccagacagtggtcccgttgatctcttaaccttaggcgtgccttggtgtcgtagcaaccgtacacattcgcaagaaaaccacaagaaactaaattaggaaaaaggggctgtcgctgccagggcgtacctactaattaaggcctaacatagatccttaaatatcgttaaacctttttacagttataatatactcgctccgtctcataatataagagattttaaatagatatgtgacactttttaaggctacgaatctagacaagtgttatatccctctaagatcatttatattatgagatggtgcgagtatgtatctatgtgggacaccccgaccaaattacactagccacccgagaaaagacgttgcacgagctagatgagcatgaaagatttcagtcattttctttctaggttcgctagcgtcgttaattaactagcgaagaaggaaaagtggtaataaaaaactagaatcaggaagaaaactatacataaataatattaaaataacatcaatatcattatctaactcgttgaggcgctactgggatgggagacataatgacaaatttataattaagaaggtaaatataatatactctcaacaaggatgagaggagaagagcatttctaatgagtgcagtatataatgtactactactactctctcaatgttactgtagccttcgtggtttgatatttttaataggtttgattaaccagcccttattattcccttgattgattcacggagctattgttctaactttaaataaaacaatataataaaagaacaatatttaaaacgcaaatcaactcatgtagattagatcattaaaatagttgacagttaattactccatccatttctaaatatttgacgccgttgacttttctaaatatgtttgactgttcgtcttattaaaaaattaaataattatttattttcctattatttgattcattgttaaatatacttatatgtatatatatagttttatatattttacaaaagtttttaaataagacgaatgatcaaacatgtgctaaaaagttaacggtgtcaaatatttagaaacaagagtagttcattttaaggttccacaaatgggttgtcttttttttccttcttaattgatcggcagggctctttgccttctcgttcaaagaaacaaaaagaagctgaaaatattgtaccaatatcccattttcaatcatgcttgcatcattttcctttttttttcttttctcctcggacgaatcatgtttgcatatatcgttcgattgctccgtgcgttagaaaaccaatccgattgctactcttcatgaggtcacgtgctatctctttctgactttctcccatcgcacggttacacactacaccgtctcgcacccgtcgatcggttgcgtccgccggctcacccttcccccccaaaaaaatgacggatggacgacgcaaaaaagtgacacaacgacgccctatccgattccaaccagcgcccgcgcgcgacgtggacacgctcacaagcacgcacatacgcatccattccccgccacgcgcaccccgataatacgcatgtgttcgccgccacccaccatcgcgcgagccatcagcgtcgcccatcggacaccggattggatgcgtgatacgtactccctacgtctaaaaaaaaggcaaacactgagtttccgtgtccaactttaactgtccgtcttatatgaaatttttttataattcgtatttttattattgttaaatgataaaacatgattaatattttatgcataacttgtctttttattttttttatatttttttaaataagacgaacggtcaaacgttgagcacggaaatcaggtttgtctttttatttttggacagaggaagtagggagtagtacttcgtactattactactactaggtgtggtatgcgtggccggtcaccacgcaaaagccgcgaagcgagcgatcgatcagcggaggtcaaccgtgcccgccgaaccacgtacgcagatggattcggcagcggccggcgacaaggaccgggcgcttcgtcgttacacgaccaataataatcagcttgttcatcctgcagcccgggcaggcaggaagctgcgaggaatgaggaatccgagcccacgggtaacgcttaaatgcttaattcctgcagttctgcacggtgttcggctctaaatttttcgggagtacgaaagcgacagcaaagcgaaaatactaataaagtgaccacagtgctcgatagtgtacgtttgtagtgctacgaacctgttatatgtttttccggagaataccgtcatttttgggaccgtaccagccgagcccccaacgaaaagctcgaatgattgaacttgaacttccgtctcggcgtattgctgatgacgccatcggatggcggctggggttggatggtttgtactgtggggcggtgggggtgatggcgatcggcggtaagagcgtgaccgtggcctggccgtgcccgcctgctggccgaacatgggcgaatagaagtaaatattgattattgacagtgattgttagtatcaaatgaaacagttttggtaggcatagccgcataggcatgaaattttcgttatcatattttttaaattgttgaatggtgcatttgcactaaaactttctacttcctccgtctaaaataaacttaaccttgaagaggatgggaccatcctggataaagaatttggacaacctcctttgtcgagattcccctcttaggttaagttttttttcgacggagtgagtatataatagctgctttaatgtattatataaaatatttttaaagtttatctatagtagtaataattaaaatgtaattaactatgagctaatgacattgttgtttttttccataacttcatctccatcttaagtagaaacgaacactacctaagtgggtagtgtctcatgagaaaaattctttagatgaaattctagcgaagttatatatatatatatatatatatatatatatatatatatatatatatatatatatatatatatatatatgtgagattatgtggaatttgacgaaattcatgagttttgagctaattattcaatgagccatgttccgaccggtgaactttcataaacaacttaggttgtgttaaatccagatgtaaagttttgacgtgtcacatcggatatacgaatacatatttgaagtattaaatatagtctaataacaaaataaattacaggatccacctgtaaaccgcgagatgaatttattaagcctaattaatccatcattagcaaatgtttactgtagcaccacattgtcaaatcatagcgcaattaggtttaaaagattcgtctcgtaatttacatgcaatctatgtaattagttattttttcgtctatatttaatactccatgcatgtgttaaacatttaatgtgatagggtgtgaaattttgctaagggataaaaaggatcttacaggcataaaatacatgactaataatggctgaagcgaaaaaggataaatacaccagatttaactgtggtagctacaatatctctaactttcctgtcaataggtttgattagactcgggcaaagcaggaacacacctgatccaagacccgatacctcttggacaatcggagcacgatagtattagcaggcaaaaatcaacgcccacgtcggtgtcgggtgcgtatttaaaaacatcgataatatatgcatggctagataactaaacagagattatgaatcagcacatatgatttgggagcatcatgtcagacatgtcgaacacatgcccgtgcctatcgaacacagtatccgtgggtaaaatcgctatcgctgctcagtccaaagtagacggagctaaaataaaataaagagagatgccactcatttaatttgttttattttagatcgaatttaaactgatataagcgtctgagtttaaattaagtgagtgcatatttaatgaaaataaataaactatatctaaaaaattttcttaaccggttcttgactatcctatctcctagcttcaccccctcccaaaatttcttggtttagccacaccaaccaactcgcagggaacccaaacaaagaaagcggcttgaaccggatggaccgtgggtgtgtgagaaggcccccacggcaactacgtggcgaagaggcgaagaccgcaccccgtcgaagtctttcccccggagacatttccgccatgctgctaaaataagtgggcacgccgtgcgcgcgtgcgtgcgttcgagcggcggcgcgcgcgcggcaactcccgcacccgctccgaaccttctccctcctcacgaagctcaccgcgaagccggcaaaatcctcccggagagagagacacaaacacaacacaaccagctcccccgcgccccgcgtgcgatcgatcacgatcgatctcatccctctcgatcgcctactactaccagtacaaatccaccccgccaccactacatcatcccctcatatccatgcagatttagcgccaatccttataaatacggagctttcgcgccggcctcgtactcggccatggcggcagtcggcgcgcacgcagcggtctaccaccacccggtctcgggcctctcggcgccggcgggcgacgccgcctactcgatgtcatcgtacttctcccacgggggaagctcgacctccagctccgcgtccagcttctccgccgccctcgccgccgcaacgacgccgccgcttcccgacccgtcggggtcgcagttcgacatctccgagttcttcttcgacgacgcgcctccggccgccgtgttcaatggcgcgcccaccgccgcgctgccggatggcgccgccgcaaacgcaacaaggtgagtggctagtggcgtgtgtcacttgtcaagtagagtactactctcaagtgtgcaatcacctgttcatttggtctgaattgggggcatttgatcgggaaaattcaggagcgcggcggaggcggtgccggcgccggcgccggcggccgtggagaggccgcggacggagcggatcgcgttccggacgaagtcagagatcgagattcttgacgacggctacaagtggcgcaagtacggcaagaagtccgtcaagaacagccccaacccaaggtactaactaaccaactaaaccaaaatcatatccccttcacaaaattcaagatgatcatatcatcatcataaatcatcccgtcgtcgtcgtcgtcgccatcacttcgatcatcaaatacaccgatgatgcaattaatcacgcgaattccatcgtcatatactatatgtgcaagtgcaagtctctttcctggcaatgaatgaatggacatcgctaactaacagcgatcgatcgattgtgcgttgcaggaactactaccggtgctcgacggaagggtgcaacgtgaagaagagggtggagcgggacaaggacgacccgagctacgtggtgacgacgtacgaggggacgcacaaccacgtgagccccagcacggtgtactacgccagccaggacgccgcctccggccgcttcttcgtcgccggcacgcagccgccaggttctctcaattaaccgcgcgcgtacggttaatttgatcgatcgggtcagccatgggacttttccaatgctagctagctaatagtgtaggtgttctgggccggattcttgatcgagatagcagcctcttgattgagatgcccagatgggtcattttggatgtagctggatctttttttccccttttcttctctcgatctctgtcccgtcctttttgcctgtttcgatcattggaaggccgggccggcctggctggtttgcagcgatagtgatcaaatgctgtgctgctgtgtttctgtgctcttgaggatcctcccaactatcccccttgagcctaggtaatatagccatgggaaatgtaacatatatatactgtttaaccgtgcaataaaaatgtacagagcttgaaattttggttgtatgttatgaaggacttttaaatattctactcagacttgaatttgttgttgcattgcatgtttaattgattccctcaataaccaccatctgaaacatttacctacacctggatttctatctgtctttcttctcaagattttctctaatgttatttctctttatgtccaaacataaatcaactagttttttgcgaacacgcagaaggattgcacgtcaatatattaaaagaaaaataattttaggtaacataaatcaactagtggcagggatgaaaacgttattggaaattcccgactgattgaacgttatttccatacaattaagtgataccgttttttatcttagccaatataaaatatgtttttcttaaaagaaatattttagcatcgtattgcttgttgacactaaatagttaaatggttcccgaccgttttcacgtacaattttacatgaagctatattttaaaagtataattggatttaatatacaactcttgctttatgttcctatatactcacacttatattttatatacaaattatatctatcaatttgcaccattctatctagacaaatacaaccacaaatcaaaacgctgcataactttgtttaatcagattaatgtggtgatttatacctttttagaatgaatataatacataaacattgtattatatatcacaaaccattttaattaaagttatgcaaacattgtgtcgtctatggctacgccgttcaccattgttccatattttttcattcagtaatattataaactaatacaacttagataaaaagagtaatcctatatatctataaagctcatccacgctaagtgtagttaataatatttctcttatatctcattaaatcacatcacctcaattgttcctagcacttggatgattgatccatggttcaaattatctccattcatttcttcccctataaagtcatactaccttagatttgtctttggatgattaatctatattaattatctcccttgttttccttctatcattgagacacatcatcttagtttacttttgaatgataaacctatatatgacttaagttgttataaaccaattcatcttaatcgtttacaactttttgatgatcgattaaagatgaaaattatataaaacatataaagttatttatatgttgtcttatatttttttaatactattatacataattcctgctgtaacgcgcggggtttcatttagttagctatagtaaacatcaaaagtctaatactgttgctaaacaagattgcaataatctaacttaatgctagaagaatacactacatgagaggctttagtgatacatataccttttttaattaatttagcattagtgattataaagttttaaacgttaaattaattttctggccgaagggagtatataggtcttgtttgagtgtaaaattttgagaagcagcgggtaagaagctagttgagaatttagaaaagctgacaaacccaacttttggcttctaattcattttctggattctataactgtaacttttcagaatatagatgaaaatataaactgtttggaagttagcttctgaaaattttaggagaagctaccgctacaaagcttcaccaaacatgcccataatctccctgcgtttcccttgtctcgtgtgtggccgtgggccgtggcgtcctctacagtccacaccacacaggacagcagccacgctcgcagacgcacccgtagtccccccgtccaggggaccaggagccaggacacaagttacaagttactacggcacagagccacagaggcagactggtggcagtggcagagcacgccgccccgggctccggctcccctcctcctccctacatgctcgcgcggccgcaccatccggcgccaaaccctcctccctctctctccgcgtcattttgggcttttctggcgaaaatgccacggcggcgctggaccggtggcgccgtcgcggcgagcagcatccctctcttccccatcccaccccccgcagcgccaaaaatagatggcactcgcgcctcgcctctctgtttccgcgccccacctttcgatcgcccctttcttcctcctcctcctccccctccccttccctttcccccacgcgacctcggtgctggcatcgcgcgccaccgcacgcgctggatcgatcgaaggcctggccgcgccttccgcctccccccccccccacggccgccgataccgacgacggaggcgccggcggcccgattctaccccccacccctgcactggtcggcgatcgttgcttcccccctcccgcggtgatcgcgcgcgacacccatggtgagttgtctgtgctggggctactggctgtctggctgctagatgatgagatgaggggtgatgctaatgtttcattgttttttcgttcggtccgatgtcgctacgcgccgtgcggccgcggtgtgttgcgcgggcattggggttgccatgctggtttgttagtttctctgttagcattgggtttggagagaaatgtgaggtttctgtgttcgcgtagttggggggaattttttgtgaatgaccactttggctctagaggaaccgatggacgacgggtgactcgattagtgtgagttgttcattgctcccgatgaacggacatgttttccatttttaatctcgtgtgtgtaggatagctgaagcgtttgatttgtggcgaccaggaagcaaagctgtacgccggaaaggatttttttaaaaattttaaaaaagccagttccgtctactcattttagatatgaatatgagaataagccttttttttttttaagttcaagtgttctctgaatttgctcaatataagtattgcttcactagcccactttgtcaggacacactctttcttctatgtgccaccatattggaatagagattagagaagtgtatgctgcaattagttttcactcatatctagtttggtgatgagtccataacttcctacatttgtcttgaaatcagattctgtataatcgtgaccaaatatgtgatgaactaggtgctcttatttcaattcatggtagtacagcactggtgctaagaatttagtttatctaatatctttgctctagaatttacgccttaaagcatatgtctcatgaatttgttttctgattctatgctttttgggtcggtatgatcatgtatcctttcatggtttgacacggcattcttagatttattaaactatgcatgtccatttcaacagtgatccatgcctcattctgctttgtactccatgttatatatctattgtatcattaaaagtttaaaacagtagttataaattatggaattaatttgatgaaaaaaagaaaaggatcctacaccagcataatattcattttagtgggtcctaaatataacaacgtagataagaaatacaatgcatttcatcaacaagcacatgagttctatggcaaatacaaacataccattgtatgtaagtgtgcaaggtgaggctagttatttatagtatacttctagtagtgtttttacaattccttttggcatcttttggaacacaaactttagatataaatctatgcatccatttacctattaaccttgattttttccctggcatgttggatttttgtgacttgtggcttgtgcaggctgccacattaaaaattgttcttggctcccatatatggctggaagataaagatttagcttggattgatggtgaggtcttccgaattgagggtcaaaaggcccatatccgcactaccaacggaaatatggtatttgtagctgatatcagatactatttgttttcttttgcaccttaacttcttcatcattaattattattaccatcatcattgatgaaaaagtagtgtgtgcatggttatgctcttattgcaaattaaaattggcacagttgtcaataaatccataaagtaacagcctttatattttagtgctgaaatcactggaaactatttcaattaagagtgtaactaattagccataaaaacacctataaactatccattttcaacatcgaataaaatctaatcgtttgagaaataacaattatcagaacagactgaacacgctttcaagttttttctttcttttggtttgaactttgaactgcatcaaggatgcaaagccgttcctgtttatatatagtttaataatatgatccgtactactgttattcacatatatcgcatgatctatattgatatatttcatgtcatgaaacttgctttgttacttcaattctgtgaaaccaggttgttgcgagcatatcagacattcatccaaaggacacagaagtgcattctgatggaattgatgatatgataagactatcatacttgcatgagcctggtgttttaaacaatctatctgttcgatatgcaaaaaatataatttacgtgagtatttgcatactcaaacatatcatcataagtagccaaagaaaaacaagtttgtggctttgtgcaaccctctcctttcttttctgattctacttttttttttttgaattccagacctatactggtaatatattgattgcaatcaatccattccaaaggttgcctcatcttgctgcaccccatactatggagaagtacaaaggtgcaaattt

SEQ ID NO: 49958 - DNA, 2280 bp, Oryza sativa
tttagaagtaagttagggatcattaatatttttcagtccttcacattgttaagaacaatatatctgtccttccaaatggaagtgaaggcttttaaaagtgatgtgttacttttgcctggactaatccttcatacttaattgtgctttgatgtagtctaatccagtccttgaagcttttggcaatgcaaagactgttcggaacaataattcaaggtgtttgttttacactctcagttggaatcttggaagataattaattcacaatttattaagtacagcatattactattcctaagcaagaaacaaagctgcttatcctacgtccccccccccccctctctcacggagaaaaaaaaacctgtggaaccaaaaatccattttgttcttctttttttttgcattaataatatttgctcacacatgtacttactattttttataacatggtcaagccggtttggcaaatttgttgaaatccagtttgacaagagtgggaagatatctggtgctgccattagaacatacttacttgaaagatcacgtgtttgtcaaatcaatagtccagagagaaactaccattgcttttacttcctatgtgcagcaccatcggaggtatatttcctaactcaatgtgattaacaagctgggtctgtgttatttattattgaataaacccaaatggcaggaaattagaaagtataatctgggtgacccttcgtcgtttcactatctcaaccaatctacttgcattaaagttgatgggattagtgacaatgaggagtatcttgcaacaagaagtgctatgaatacagttggcataactgagcaggagcaggtctcaagttccaacacctttcaagccactaaataacaatacaattgttattctatgtgcatatgagtaggcattctcacttatttcaagtaacacactgataatgcaggaggctatattccgagttgttgtgctgtgcttcaccttgggaacatcaattttgtgaaagggagagaggtagattcatctgtaataaaggatgagaaagctaggttccatcttaatgcagctgcagagcttttgatgtacgtctaatgcccacctgttctatagtaatcttcaaaatttctgtttcaaatttcactgtttatactgtattactcctcattgtggagttcttactgcaggtgtgatcatgggaagttagagaatgcactgataaagaggaaaataaatacaccagaaggagtgattaccacaacagttgaccctaattctgccacagttagcagagatggcttagccaaacaaatatattctcgactatttgactggtaatctttataactctgtgatttgttcctccctgaattgtaagtgtatgagactgtaatgtgtgcaggcttgtaagcagactaaacgcatcaataggacaagatgagaactctcaatatttgatcggcgtgcttgatatctatggttttgaaagtttcaagactaataggtaattttttaactaaatgctgattcagtttaccattgaagatcatttatggaagtcatatgtttattcatgactgaaacagctttgaacaattatgcatcaatttcaccaacgaaaaactccagcagcattttaaccaggtacattagtaaaacatgtttggatgttcatgatattagactctttttgctttttagataaagactctcttttcttagtgtttggtaaaatgagagcttctattggcagaatgtcttcaaaatggagcaggaagagtataaccgtgagcagatcgattggagttacatagaatttgttgacaaccaagacgtgttggacttgattgaaaaggtatgtagcatttgttttatataatgtgcttagccttgtacttccccaaccttctggtggtcattgtcatttgtcagcaagacagataaatcattttaagaaaaacacatgaagttacttgttgctaacctgtcagtactctggtactggttcacatataggtatctgttctgttgtttgtgaatataatactggtataaacctgtgcttttctcccagatgtcactttacggatcaaatagagtacaatatactcctcccgtcccaaaatatagcaacttctagtgtttgaaatttgtcccaaaatagagcaacttccccacctacttcctcatctcaaccatccctcatttaatttcatctgtcttcttaatctccgtaaaaactccaaagtgcttatattttgggatggagggagtagtatgctttt

SEQ ID NO: 49959 - DNA, 2713 bp, Oryza sativa
tctaaggaactaatctatagtattatagaaaccaatccaatctttatctcaaaactttctaataaacctcatctctttcctaactagataatctcctacctttatatgacttattcctaatttatcatgcctaaactgctgcatgggccttgcccgtgcccataacaccaacatatttgtgcatactagatatagttgtcttttctctgtttaagttcaatattgttcatatctccttttattttcagaaacctggtgggattgttgcacttcttgatgaagcttggttagtgtttaaacccttcttcgatggactgcatgcaacaggcagctcgtgaaaataattgcttctttgttataatcaacattgctatatctatttctgaattagtagttctgacaatgattcatcattctttcattcttttctctatcctgtgtgcaccagtatgtttcctaaatgtacacatgagtcattttctcagaagctgtacgagaagttcaagaaccacaaaaggtttagcaaaccaaagctttctcgtactgcatttacaatccaacattatgcaggagaagtgagcattctgtcacaacatagcattctttgcttatatgcatttgattaagcatattccttttaatcccttgatatcattgcaggtaacatatcagtctgatcatttcctggacaaaaacagagattatgtagtcgtagaacatccagagttgttaatgcttccacgtgctcctttgtgtcagggttattcccatcagtacaagaggagaactcaaaatcttcaaagtcctcaattgctaatcgttttaaggtatgatcctgctagttcaattttgttctctagactctaaattcaggtaaaagcctcactattatgcagactgtatttaataaggacatacatagtgaaaattattagctgggtactatatgcaaactaacttggccttgagcataaaaatagaatttagccattaattctctcagtgtagcctgcctacgtaataaaaaaggatctacgcggaaagttccgattgaaatataatatttgaacaccagaatcaaattacattcagtgttcaaaactgaaaaattctgacatgatacactggacagaagcgtagaaaagatcgaacactagcagtaacataatcttctcccttttctgtttgtttcttctcaaattatgggattaatgttgaaaatttggtggataattcaacatttcatatatctcatgatcaaattttatccttgacttatttatattgatctgattctagaactgcaaaggtctgcatggttgcacttatattttactttactctagaaatatcttcatatataacagggtgacatgtgcctatgtgtagtcgtatgtacttgaaatatgaacctgaatgatggttgcttttatttatacttttatttggagtgcgtagatacaatggtttctaaacattcatacctttcacaacgtagagcagtagtgccatcaagttcaagaagaaaagattgcatttacttgatagggggcatgtgaagcaattaagattatttttttttcatgtaaattcttctgtacagtgacaatatctgagcatttcatgcaaattatcaggggcaactccatgacctgatggagactttaagttctacagaacctcattatattagatgtattaagcccaataatcttcttaagcctgctacttttgagaacgccaatgttttacatcaacttcgatgttcggtaaggaatacatcattcatcagatagtctccagagaaagccagtactattatataacctaacgggtcatcctttcagggtgttcttgaagctattcgcatcagttgtgctggataccctacaagaaaattatttcgtgattttcttcaacggtttcgcattattgctcctgattttttcaaagaaaggtgagtataatgtttacctataccttctaattctgctacctctgtcctgcatttactgttatgatatttgacagaaatgatgaaaaagtaatctgccaaaagattttggacaaaatgggactccagggttatcaggtgagtcattctttaacagaataaatcctactttatatgtattgtacaaccattttcctctttttctcatcccataaggctaccaagtaaaaagatatgtatgtgttactgaaccattatctaaaagaaatgttcttgaatagttacagcttgtaaggtagaaagtaagttcttgaggatttttcttgttgatttggtgatgcaactgaagttttcaactgttcaaaaaagttgatttcttttactttcactagatattctccctggaaaacaaaagtcacggtggaattaacaagatacactaaatagttttactccacaacttgctttttatgattattttctttgatgagcttcatgcaaatatatagactgtttaatcgtgaaacttctcaaaaatattgcaaataattgctgtctttgacagattggaagaactaaggtgtttctgagagccggtcagatggctgaattggatgctagaagaactgaagtgcagaatagagcagctagagctgttcagagtagatttcgcactcatgttgctcgtgaacaatttcttatgctacacaacacatccatatccttccaatcttttgttagaggtaaggttgagctaga

SEQ ID NO: 49960 - DNA, 4610 bp, Oryza sativa
tccatgtgtcaaacgttctcctgtattcatgctttagacatgctatttggactttaaaacttttctttggttcctcgtgtgacggttcttttttcattcttgagattcaactcggtagtttcaattttatttttccggttacaatgtatctccttttcgattttctctttagacttcaaagcttcaactatgttctgaaatgacaatctcctaaattttgtctgaacgtatgctaaccagtttgtgaaaagaatatatttgcttgtgattaaacctttgcatccttttgtgctctgtagtttttatcctagactaatatctagtttctagagttacgtttccatgtttataaaaaaaatatctttattgtgggctagacgtctacatttggttgcatcttattgattttatgaatatcgtagtttgcttctcctgaacgattttatgaatatcgtagtttgtttgaactttttttttctggtttataaaagaaaaatattattttgcattgaagcccgagcgttttattttctctaacgttcattttgaacttattaattgagttttagagattcgttttcttgtttattgaaaacaaataagtttgttgtaaactgaacccatgcattttgttgcaccttaaagcttttttaaaaattgcgatttccttgtatcgatcgtttttaggtttgtcccttcacgctttaatgttccgtccttttattcaaactaaacgcttttagttggatttctttattttcgaacttttctgttaatgcttttgatgttctccttggactttaaagctttaattcagttttgaaatatcagatttcctaaattttgattgaacttatgcttactagtttgtgaaaagaaaatatttgcttgcatttaaatcttgggcttttttgtgctctaccattttcatttttaatttataactcagttcgagagttacatttccatgtttatcgaaaatatattttggttgctggctagacgtctacatttggttgcatcctattgattttatgaaaaccgtaatttgtttgttccgaacgatttattggtttctccgttgacgcttcttttttcatccataagtttaaattttgtacttttaggtggatttcttgattcagtattgttcttgcatcgattcttcaaataacctttttggagtttccaatattttttcgttgtcacgattcatgttccttaagttattcttttgcattgaagcttaactgatttattttgctcttataattgagttgtagagttggatctccctgtttatcgaaaacaaatatctttgttgtgagctgggcccatgcgttttgttgcacgttgaagcttttatgaaaatcaaggtttcctttctcatgacgattcattttctgtcctttcgtttaaatcttttgcatttagttggatttctttattttcgaacgttctcttgtattaatgcttttgacatgctatttggtctttaaaacttcattttggtttctcgagtgacggttgttttttcatccttgagtttcaattttgtactgttaatttgatttcttcaaatacgaagtttctcttttttttttcatcttctctttggactttaaatatttattttagttctgaaatgtcagtttcctaaattttgtttgaacttatgcttaatagtttttgacaagaacatacttgtgtgaatttaaaccttgcagttttttttgtgctctgacgttttaattttggccttatatttaaattctagagttatgcctccttttttatcgaaaaaatattttggttccgagctggatgtctttattcggtcgcatcttattgattttatgaaaatcgtagtttggttgtaccaaacaatatcttggtttctccgttgaggcttcatttttcattgagaaatttatattttgtacttttaattggattcctttattttgaaacattcttcttcatcaattcttcaaatatcccttttggagtttccaatttttgttgttgtcacggttcatcttaagtttgtttgaactttgttttctagtttataaaaacaaattattcttttgctttatgccctgaccgatttgttttgctctgtcattaatattgatcttttaattgagttgtagagttgagtctcccagtttattgaaaacaactaactttgttatgagttggatccttatagtttgttgcacgttcaatcacagtttccttgtatcaaacgtttctaggtttctcccttgacgctttattttacgcatttcatttaaaattttatgctttttgttggatatctttattttcgaatgttctcttgtattcatacttttgacatgttatttggactttaaaactttactttggtttctattttcgagtgttctctagtctctattttgattttgaaaactcttatcttgctctataggaccgagactttttcaaagcttgtacttctgtgaaaatgagattgaaaacacttattaatcataacaaatcagttccagagtgtcttgcaaagttttgaaatccatttgcaaactacacctatgtactagtacggatttgcaaaatatcaggtcaaaaatagcctctagtatataggatttgaaaatggatggataaaatttaaatcttgaaagatatgataaggtttccatctccttacgttatctctgcaccaaaaaaatgaatttggtagattttgaactcctctcttccgacatttcaaattttaccgacatggtctagaacgggtagtttgtgaaggataaaattgttgtgcttaaacctgtagattgttggcttagattgaccacccaaaattcacatagcctctataccaccctaacctaatgtaaataaaatatgaggaatttaggtaacttaaaacatgaataaagtttctttctgtgtcggttgatcgtgttctggaatttcgagtcagtctgttaattttgccaaggctaaactgtaggcgatagacctgagaatttttatgaggaacatgtacgtcaccccaataggcttcatgaattttattgtgatttttggacctttgcatcatagggtaataactcaattagtgtgcataaccgtgttctgaaatctttagacagcggcattcatgtttttatgtagtccaaaccgtaaaagataatcatgctatcttttaacagtagcttgtagacatacccagtagactccatgaattttggctaaattttttgagtctttgcatcatgttctaaaagttcataaaacactacatagtcccaacctgaaaacagtaggtaacctcgttgtcgaatttgtgtagcccaatctagaagggacaaaatcttggttccttcagggtgctcataaggtagctctgtttttcttttaaaaaaattcttttgaacctttagaaattgacctaaaaattaggtaaagatagtagaccagtaaatgccagcactgcatcacttgttttgaccaatttctccaaaataatctatttgcccaaaaaatcaccattccttctcagattggagaaaactttgttaggatcatgaatataaatttttttctaacttatcacccatctaccatagtcttttgcttcagtttgcgtatcgggactggatagtacatcatatggcacatagacctatttagctcatccattaaaatttcttgataaaccccattgcagaattttattttattttaagggggatagagtgccatgaccttacaaacccagagacaaaacatgtaaccattgcaagcccccacaagcctaaatggaaatatcatactaggaacaagtcgtaagcaaactatgtaatttaagttgagatggctcagggtgcaaattttgtgcccctttacggtcggatgcaatatttgtacatcgcaacaactcacaaacatggtttgggaacttgacttttaagttttgaaaacttctctaagatgatccactagataaggagaattgttctatggcatgtatgcaatacaaaatatcttcataagcattgtatcattttatacatgcatcgcatcatttcatacatgcatcgcatcatttcattcatcatgatatcatagcatacatccttgcctttttgagaaaaagaaaagttattgctatacatgccatctagcatcccgttttctacaacgacccaagtttatggatgcacataatgagaccatcccgatgcatccaatatgactcgacaaatattcctagaacaccttggattagattgcatatgactaattagcacctgcagaacaaatattgccaactttatccttattttcccaactgccttacttgctatcctagaacttaaatttatcgaatgtgagattaacaaggttagatcatgaccgtagaccatgaagacttgaatcttgttacatcctaatggttagagatactaaatctggtattcttgaaaagttttatagacatttaaaatcaataatattgtattgttattagaaaacaacatatccatgacaccttagatcgtattccaccaaccaaacaaggataggttgtcataccaccctcaccaaag

SEQ ID NO: 49961 - DNA, 924 bp, Oryza sativa
aaaggaggagtcctgtagggttttggtgcctaaaatcgacctggacctatggtgcttcctctaagacctgtctcatctttgccttatgtaatagaaaattatctacaaccgttagatggagatggatggccaagattagagctaatgccaccctctgcattagcttctgtaatgcagaggatctggatccgacatactccctttgtccccaaaagacttaaattttagagataaatatagacacatgttaaggtaatatttttttagtgaatcttctgatgaatgagataacttttgttttattatcaacgaggaaatggattttatatcttaaagtgtattcgctgaactcatcaaatctcactcatatctgaaatcagtccggaaaacctaatgcgcgaggcgaacacatttttccttttctgttcaccccgcggcctgcatgctcccacgctgaaaatgggcctatgggcctatgggcaaatatgatatttgttattgggagtacctatacatctttcgaaagatttttatgatcgtatcacacagatttttaatctttagattaaaatccgatagatataataaaaagcaaaaagcaattaagaaacaccataatggacactaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaatttgagtgagaaaatcgagtgagagataagaaaaaatctttcgtgtgagatatagcaaaatcgtttgttatttgggagtacctatacatctttcgaaagatttttataatcgtatcacacagatttttaatctttgtattaaaatccgat

SEQ ID NO: 49962 - DNA, 3885 bp, Oryza sativa
agagctgtgatgtgggaggcatcttatcgagattgctaaggggcgatcgatcgcccctagcgatcagggttcggtccctcctccctccacctggtttcttttttggtaccgcattactttcctattttagtaaatttgtgcaccaaaagtttgtacacctcaagtttacacatctaaagtttagagacccaaagtttataagtcaaaagtttatatatccgattcaaatttgaatttaaattgaaatatttttatatatagtatttctatacatctaaagtttatagacccaaagtttataagtcaaaagtttacatatctgttttaaatttgaatttaaatttaaatattttctatatatagtatttctatacacctaaagtttatagacccaaagtttataagtcaaaagtttacatacccgattcaaatttgaatttgaattcaaatattagtttatagacccaaagttctataagtccaaaagtgctgcataccctagtttcaaatctatgaatttacaattccaatttttgtatatatagtatttctatacataaatttttccaacttttattttttttaaaaaaaaatttatagtgtactgtaataggaagagaagaagggaaggaggaaggagtgtatagccgtataggggggaggggcgggcgccgcccattagctttacctgcatcttatccccttagagcaggtacaataaccggcggtactgcttccacataagattttgtgatgatctggaggagagaggggaagagagagagagagagagagtgagccgacgactaatttgtcgccggactgcacgtgccggtcgaggagttcgtggggctcgcctagatgcttgcgctgcctgccttcgtcgccaactcctgcggccactggaccaccgccctcagcctcgccggcgtcgacgcacggccgccgcggtctcccacatccgtcgcacggtccccgtcacccctcgcctgcacggctgacgccatctccgacgcccaccgctctcttccgcctccgccgcgcggcccggccaccgtcgtctccgacgcccaccgcacggccgccgccctcttccgcctccgccgctcggcccagccgccgccgtctccaacgcccgccgcacggccgccgccatctcctgcgtccgccgccgctattttccaccccgccgccatctctgttgctcaagaaccaaacaaagaagagaagacatgaactgatgggagaaagagagagaaagagaatgggaggtagccggtaggagaaggtggtgggtcccatgaaacaataaaatattcgtgttatagtatttttattatagacattagttatattgtttactatatatgacatggctggtttttaaagccaacaacgggctatattattgaccttgctcttagcagattctatcgaggccatagcgacaaacaaagacaaaaggtagtccgtgtgatggggcaaacttgacgccacagtggaatcaagaaaaaaaatcaagttcgctcatctttgtgtgttcgcaaaaaagacaagtccgctcacccttttgcgcattcggaaaaaaaagcaagtccgctcaccgattcggccaaccgagttggacacgttccagattcttgcccactcatcattgatcagcggggaaggcgagaggatgaaccgatgaacaccgagcaccaggggttgtatcagttgctcggccttgtctccagttccaacaccgctccgccacggcatacttttcggctgagacgaagtattcaaatttgctcgatgtgggcgcgccatgggcagcccatcaactcgtgcaaatagcttctcctgcaaatctgcaatcctatatccgacaactcgtgcccatctcatttcgctcggtgcgccaaacacagccgcagaactcacgtgaatcccgaaaagcgtggctgtgtgtgggccattcaccattcgggtaaaaaaccggagcacgacaccagttctattttatttctccaaacaagcgagagcaatgatacacacataaagtatggagtcgacaagtccagctagcctagcatcacgcttgtttgattactccctgattgtcactttcatcggcaagccaccctccatccgcagcgtaagcgcgaccacgagcccagggtgccccttggcgtcgccggcgtaccggaggctgaactgctcgagcacgcacgccacgatggacttcatctgtatgtaggccatctccttgcctaggcacatcctcggccccgcgtggaacaccgggtacttgaacgtgctctccggccggaacgcgcccgcctcgtccagccaccgctccggcctgaactcctcgcagtccgcgccccagatgtcctccacgcgccccatggcgtatgcgcagtacgtcaccagccaccctttccccgcgaacgtgccgtccggcaggaactcctcctccttgcagctgtgcgtgtcgaagggtaccggcggatacagacgcatggactcggtgatggccgcgtggaggtactgcatgtccctcagctcgtccaagctgaacgtcgcgccacgcgttccctcgctgccggccgacgactgtctcaccgcgcggatctcgcgcacgatcttgtcttccacgtcgggccggccggagagtagccagaagaaccaggtcagcgccgaagacgtcgtgtcgcggccggcgaggatgaagttggtgaccacgtcgcggaggctctcgtcgctgtgctcgccgctcgcggcgaagcgcgacaggaagtcgtcgcggcgctccagccgggcctcccttctctccctgcgctcccggacgatccgctccgcgtagccgtggatcgtggcgagcgcctccctcatccgcctctcgggctccatgttgaagagcttcttgacgcgccacagcgatttggccggcgagttgaaccgggccaagatggcgttctgcgcgtcgttgaacgcgcgcatgaactccgcgctctggggcgcggccatcctctccttggtgaggcacgccgggtcctcaccgaaggccacgaggcagatgttgtcgaacgcgaatcgctcgagcacatctcgcaagtccagagtccgtccatcgagccccgcctgctccagcaacggaagcagcctcttgacgatctcgaaccggacggtgtcgaccacgaagttcctcagcgagcgcttgttgaactcgtagctggcggccttccgctgccatagccactgctcgccgtcggaattgaagatgccgtggccaagaaagtcctcgagcatggacacggtgagcttgcccttggggtagttgtcaaagttagtcttgagaatgtgctcgacgttggccgggttggcggtgatgacgccaccggtgaggccgagcgccttgtacgacatggtgttcgtggggctgcacttcatgatgctggtcgaccacttaaggaaccggtgcttgttcttgatgatgtgcggcagcgtgccgaccacagggtaggacttgagtccatgaatgcgaggcttcttcttgggatcctggtgcatgtagaggaagtagaggaggggtagaaaagcgagcaggatcaggatgagcaagagagaagctgagattggggagagttccatggcaacagtgagatgatttggggcttttgtcttgcgacttgtgagctgtgattggcgcaagtgcttgcgagaagaggtcgatttttttttttttttgtggctggagattgcaagtgatgcatgatgtgtcgttatttataacggaggtgctaactactaatacctccgttttttttaaaaaaaatagataatgttgttaacttttagaataacatttgattattcatttataaaacaatagtgtaa

SEQ ID NO: 49963 - DNA, 1854 bp, Oryza sativa
catgtaaaaatcaacggagtcatatataaaaaaaataaaatagtactatgtaatgcggacaactactatggtatcactctatcacaaatatagttatttctagctttcaattttttttacttcctccatcccaaaatgcatctactttttagttcaaactagaaagtatagctatattttgcaatggagaaagtaaaatgtagctatttctctatctatatctcttttttaacaaatcagaattgtccatcattttatttctataccaactttctcttctcaacgaacataatatttcaccatttaattccactaatttctccttctcaacaaatcctaatatgaacttgtgaattttcaaaatcacacgagttgcacgcacaattatatttaaattaatgcaagtagtagtctttaggaagcttaccacgattagatcttggggaaacgcttcccacgatcatgcgcccattcctcggtctctccgtcaaatgatttgatcaatgacaagtaatgcttcttatcggtatttaataacaaggaaaatcttcaaataaagattttcttatcttttcaactgtttttttttatcaaatatacgatatggttataatgttatattccttttattaagatctcacaacaaaatcttacatttctatattcaaatgaaatctcgtaataataatctcatataattatattctttgaagtgtttacataattacatgtgaattgattttattttttataaaattcctccgacttatattagtgacagtacagatttgaagtactttagtgcccatactgaccacagaacatgaacaccacgttaattaagcagggttcgatattttggttttagaaacttcggtcccgggtatgaaattatttcatccgaaaattttaattttatgaatttagtaaattttatacaaattttatctaaattttaaattaacttgggtagaatatttcaaaatctccacaatttcagatcaatcgcctctcttcctcgattgtttttcctttccaaaatataaaaccatgccattatggttccgttgtgggctacgcctctccatgttgtgggtcgggttgtcgagctgcggatcttttggccaactatattcccccgaatggcgaatgtctgtacctgttggagctcacatgaattgtcgtgcctgagcctcttcctcgccacgacgtgccgatctagcacggcacggcccaatgatcccccgctcccataggccgtagctcgtcaatgggcggcccaaagagatgagagatgcaaaatagatgtattctagatatacaagacacgacccaaagaaatgagggaggcaaaatagacttattgcaaggacgagcacgttagactggttgtgccttcagaccagcatggcacagcctgtgtcatattgggtcgtaggtgcaaccagtgggcgagcacggcctgactgactgatctcagaccatgctttggttgtgctaggccaggccgtgtcgagcgactcatttggccatctatagggaaaacaagaaaaccattcatgctttatttctgggatcaaagcaagagcaactctagcaatgaagtggacgatgattactccctggtggtcacttgcatcggcaggcctccttccattcgcagagtcgaccagagcacgaaccctgggtgtccgtcgccaccggcgtaccggaggctgaactgctcgagcacgcacgccacgatggacttcatctgtatgtatgccatctccttgccgagacacatccttggtccggcgtggaagatggggtacttgaacgggctgtccggccggaacgcgcccgcctcgtcca

SEQ ID NO: 49964 - DNA, 1339 bp, Oryza sativa
cttgcggctaacttaatgtgacagttaaatactaaatgaccggtgttcggaaaagaaaatatttgagcccactgcaagagaaatgtactattcgatcatggcaaatgaagcttgaaggttacgttgctagtgaggaatatttctcgagaagatatcgctgggccgctccaaccacacttacaaactagcggcaggaactctggaggaccacatcaatgtgggtttctagcatcataggggtattgtagtaacttcctgtgcaccatcggggttaagattataactccacatttatgtttggggactatataagccagtcctaatctcatagtaaaataccataccatatattgggctttacaactcgaactcatctcgttcttagaataggcgggaaaaatgatacttttccgcctatcctctgttgatctgttacccaaggtcacgaaataatattttattatcaatgttttgctttgaatagttccttaaccaatatttttgttttggattgggtatttttattttcatggtgttttagaccatccttaattttaattatctacatctaacttgttacatgaaaaagaaataacttgtatatagctgtgagatttaagagtttattgatgagtaggaatcgacgtattctagattgttcaaacaatcgttcatatgtttgagacgagggtcggtagtcaaaagtgaaaaagaaaaaacaagactaccctgtccaaaataagaacgtcgattaaaagatgttttaaagtaaactatcagtaatgaaatatgatccgaaatgagaattactcaaaatgttatattatgatcatgccatcacacatgatcgtatcaatatccatcgacacgtgcacatgtgggcatgcgtgtgtgggcagcgtggcgccggcacacacaaagggagaggggagagcgagaaccacacgcacgcacgcacgcacgcagccacaacaggggagagattgcgagcgcgatggccgcctccacctccgccgccgccgccggggacgagccgtgccgctgccatgtcgtggcggtgccgtttccggggcgcgggcacgtgaacgccatgatgaacctgagccggctcctcgccgcgcggggcgccgccacggtcaccttcgtagtcaccgaggagtggctcggcctcctctcctcctcctccgcgccgcccggcgtgcggctgcgcgccatccccaacgtcatcccctccgagaacggccgcgccgccgaccacgcgggcttcctcgacgccgtcggcgccaggatggaggcgcccttcgagcgactgctcgaccggctccggctcgaggaggag

SEQ ID NO: 49965 - DNA, 1244 bp, Oryza sativa
ttctttccgtacaaatttcccagagcaccgtcaggaaagcagagcgtagtccttttttctgaattttctctgcattgcttgtttggctatgccaccagtcaagcagtgtactgtcctctgatgagtcttggaagcgccgtggcctgatctgacgcccaacctcagtccaaatctgctgcacaaagggacattctttgaagaggtgttgggcggtctcaaggtttctgaagcagagctgacaaggtgcggaaaaaatgtgagatcatcgaaatctatacactatacaaggtgcggaatgaactcgcgcagacacttagctttgtttgttacttatacgcacattccgaagtgttttgagtgctttgggtttaattcgttcaaaaaggtggttgaatataggcagttgtaggtgtgaatatagcgtggtaaatgaaacaccgtcaaataggagaacaatttgttagtgttctttcacataaatccattactgcgagtctggaacaaagctcacgtgattcagctaacaaaatcttttaagtcgtcaaaatggttgtctttctcattttggctctccaatcaacaaatcccctagtcggggtttaatcgcagaacacatcgccacttcaccccaatcttgagaggtatcgcttctttttaatttctctattaagatgaatccactttctgtaccaaacttgagtagtcttagtgtttttttgttttgtactaacatttgagagaggtaagtttctgtgcatctgaatcatctactgctaacagtttacaaaattattcactcttacgatcttatctacttttgatcagcagataaccctgatcagagacttgagcactatatctcaagcttggcttcaagttcaataatgttatctgatctcaagcctttaattcacagtgagagaacagtggagtatatcctagcatgtatctctagcatcagaaaagcacagtgcctcctattcaccaccatatatgagcttgaggccagtgtaatcgactctcttgaatcattagtcacctgcccagtgtacccaattgggccctgcattccgtatatgacccttgaaaacgagcataccaagtccaatggagaagctcctggacggatagattacttcgcgtggctggattgtcaacctgagaactcagtgctatatgtttctcttggcagttttgtctcggtgtcatcctctcagcttgatgagatcgccttgggccttgcc

SEQ ID NO: 49966 - DNA, 1137 bp, Oryza sativa
aagcaacgccgcttctcttgtaaaaatgcctctagtttacttcagataagttacccaagctcaaggctgggaagtactcatcaacaaaatcaccacaaacagatcgtactagcagacctgcagcgatcatcatactttaaatgaatccactatggtcttgagaactttctccgacgactgccactgcttgtcgctggcacttgcgacgaagagcaccaccgtgttccccttggcagtcgccttcgccagattgtgagaaccggtcagtgccaatggagtctctagcacatagctgtagtactgcacctcagaagaattgcccatgcatcagagttcagaaacatttagcactccaaagactgttgattcaaatagctgcacaagtagtgtgcaagttgttagggaagtgatcaagtgaagcttacagtttggccatcgatcttctccacggaggtatcgacgagctcgtcggagtcgaaggtgttcccggtgacaaaaggccccagagaggcgattagcctctcagggctaccgatgtcctcaatcgtggcgttcggcctgttcgtcaggcggatcaacggcgaggccaccacctgcaccttgccctgcttgtcgtcctcgaatttcacctccacccacggctcggcgcacttgggctggcagtagttgccggacagaatgttggccactcgcgtttgcttccaggtgggtggcagaatgaactcgtaaggttgcacattgcctggaattggtgaacaatcatattgagtggattcaacacatctcagtatgtcacacaactaaatcaatttctccaggcagagacgacagctaaccaaatcagaagccagaagccaagcaagcacttaccagctcgaagtgcaggagtgtccttggaagtagcccggaagaacacgaacccggggttggacgccgccggcggcaggaccgcgccgacctcgacctcacgcgcctcggccggcaaaggcgccttcaggaacgccgcgcccaatgccgcccccagcaacagctccctcctgtggctgacaaccgccgcgaggggcgccggccgcggggcagcgccaccagcggcaacgacagcggcggcgctgttgtcgtgggtggcagaagagcgcc

SEQ ID NO: 49967 - DNA, 1616 bp, Oryza sativa
tccatgtttgtgcatcattctgaaataaaaatagttggtaattctgcttatccagatttccagacacgtttatctttggataacccaatatttgaacaaaataaacatctgaatacataaattgctttcacaacaaacatttcggcgtgctccaccactcttacactctaaacttgctaataaaacagtaatgaatagataaactacttgtgcagtagaacaatatcattatttaaatctcatcagaactgcagcgaaaatttttttgttagaaataacgagataaatgcattaacatatgaatttccatgttatacttcaattgctttggtattgtgtcgggcaaagaggaatgtgcagaaaaatccagagggttctgagcaaccgtaggaagtataacatggaaattattcatcactttatctactccaataccagggaaaaagaactgatgtatgttatgtattacgaatttgattgaatgaatctgaatctttagctgacgttgatcctcagcagggagtgatcaaatcccagcatagcatgattcactaataaaaatgcctcttatggttagtacaaggtaaaaacaactgtaggatgcatgtagtactacattaaggttaacgaaatttccttggaaacgatcttgactgaataattctttgtttaaggaaaagaaatagggtacaatacttgcactgttgcctattaagcagcacggagtatatgcacttcacctgaaggttaacaaaatttccttgcaagtggtttgtactgaatcgccatttatgttaaggaagaaaaatatctatacaatacttgtctatagaaacactgagctcatgaagattaacaaaggaaatgcgatctttactgaatcacccttctttaaggaaaagatatatacatagtgctatcaagtaacactgagctacatgtattacaactgaaggttaacaaaatttccttggaagggattttgactgaatcgcctttggtgaaggaaaagatttacacattactagtgctcttgagcagcagtgggttgcatgtgctacattgaacatcaacaaaaaaaaaaatctcctaagcaatgtttgactgaatcatctagtgatgtagagagaaaatatcagataagagtagaagattcccttggatacataccatgttcttcgacaccttaatctcagagagtagatcagacgagcacttcgaccttcttcttccccttgaggaagacctccctgtcaacaagctcacgcatgtatccatcaaactccacaggaactccaccattgagcctcttcatctccagaaaccacttgctatctctcgcccagagttcctcaaacgcatctaggtaatgcacactgctgtactttgccttcagcgcatccaacaagaccacgttgatgccctctcccgcaacatacacctgccttcctcctccattgagtctctcctcaatccttcttctgaggttcccatcattgccaccaacatgaacagagtcaaaatctacttgcatccttgatatgataccatcaacaatgtccatcaagcttggcgccgtgcgtattgctccctgcggtggacggaggacatgctca

SEQ ID NO: 49968 - DNA, 4607 bp, Oryza sativa
gggttggggaactagatggaggagagagttgcctgcaaagagaaagggaggaatgaacttttgtgctgctggtttcggctttaagtactgtacaatggagtgtttatactgtcagataggtagcgtgtacagttaatcagtgcttaatgtcagaagataactaaactaaactagcgattttaatgcaattgatatatttgaaagttctgatggtattctggcaatttcctgagaaatcttaaattcaaactctgccgtacttgttagctgctgtacgcagcttgttataatctgcaatgtctgatcctaaagcccacgcattcttatagttaaccatgtgctagagaattttgcttaagatgtggattccgattaagattaaaaaaaatcacttgtttacacatccagttttttagtgtaagaacgtgtatatatattcataattcagtgattagttctagatggttccatgttaggaaacctacacggctgaaagtttcttttcttcctccatgtactgtgatactgatattgtgatttccagtagtgccagatggactgtagattgtagtacattcttgcgacagaatcatgaaaacatcacaaaaactcaggaaactccactttttggagcgagcgcatgagcttaatttagtaaactcattatgaaatatatcatctaacataattatactacgaactaacgaaatcactgaatcaagaacgtttaactggacaactcaactttttaaacagttcagttacaattaatagccttgccacctaaagcaaaaccaaaatgctcctaaaacaagccaataacgttagattaaaggaactattgcaatgatattatccttttggaaaatgaactgtactttacatactagagtttttttccaaatgatcttagagaacaaaaacacaaactaagggcaatcaaatagccggtttctgtgctgtactgttgtatttagcaaatccatgttcttatgtatcaaaccatatttgttccaacctacaaatgatttcagtatcctaatatgttacatatttcaggttcatctttgggaattgaattcagctacaacagagttacaacaggaagatcccggattctgcagattagggctggaaaggctgctctgtgcatgaccaagagaaatagatctaggaagtcgcttgcccgtacacatggttttcgcagacggatgaggactactgccggaagaaaggtcctgaagcgcagacgcgccaaaggaagaagggttctctgcacaaagacgaactcccccactgggaagaaacgaatgttctgattgaatcgcattctaagtcgctctttgtcacaattgtaagtgtatttttttatcccacgttctcggttatactcaaccataacaatggtgcaaatccttcacccggtgtccggttaatgtgtgaagtacattatcaacacaaattcaagttagcctttttgcttgtgcagtatttagtagttgtttgctgtgggaatatgttctccttgatctgcattgccatggttttcctctgatctatcttgactgcattctgagcatagattttgccaaagggcctaaatgctaacttgagcagttgctcaaataaactcatcaatttttctattctgtagtagaacgtcccttttattttctgatacagtccagtgaattttaatattcagatcatctcatcatagtcactccatgctccactgtgtaacacaatttatccacctcctctgtgccaatctctttggtacacacttatttgtaaaacaacctgattgcccatccaatcctctgtcaccttataattttgctactatcaggcgaaaaaatggataatatccagaactcaacctggaataaatgaaaggcaacaagtagcaaagagaacatttacattctaacaaactgaatccctcctcttcttcactcgcatcggcaagccgccttccatcctcaaggtcaccgagaacacaagccctggccgtccctcgccgccgacgaacctgaagctgaacctctcgaacacgcacgccgcgatggacttcatctgtatgtatgccatctccttgccgaggcacatcctcggcccgccgtggaacaccgggtacttgaacgggctctccggccggaacacgccgtcctcgtcgagccaccgctccggcctgaactcctcgcagtccgcgccccataactcctccaagcgcgccatggcgtacgcgctgtaggtgacctgccatcctttgccgacgaacgtgccgtccggcaagacgtcgtcgttctggcagcagtgcgagtccatggccacgggcgggtacagccgcatcgcctccgtgatggccgcgtgcaggtagtgcatctcgcgcagctcgtcaaagctgaacgccgccgcgtccgtgctcccgctcgacgcgcgcaccgcgcggatctcgcgcgcgatcctgtcctccacgtccggccggccggacaccagccagaagaaccaggtcagcgccgacgacgtcgtgtcgcgcccggcgatgaggaagttggtcaccacgtcacggaggctctcgtcgctgtgctcgccgctcgcggcgaagcgcgacaggaagtcgtcactgcgcgccagcccggcctcccctctctccctgcgctcccggacgatccgctcggcgaagccgtggatcgtggcgagcgcctcccgcatctgcctctcgggctccatgttgaacagcctcttgaagcgccaccgcgacttgaccggcgacatgaaccggtccatcacggcattctgcgcgtcactgaacgcgcgcatgaacttcgcgctctggggcgaggccatgctgtcctcggcgaggcacgccgggtcctcgtcgaaggcgacgcagcagatgttgtcgaacgcgaagcgctcgagcacgtcctgctcgtccagcgtccggccgtcgcgctccgcccgcgtgagcagcggcagcagcctatcgacgacctcggacctgacggtgtcgaccacgaagttcctcagcgagcgcttgttgaactcgtagctggcggccttccgctgccacagccactggtcgccgtcggagttgaagatgccgtggccgaggaagtcctccatgactgacaccacgtactcccccttggagtagttctggaagttggtcttgacgatgtgttcgacgttggccgggttgccggtgatggcgccggcgatgaggccgaagcccttgaagttgaaggacatggtgtgcgtggggcagcgcgccacgacgccggccgaccactcgaggaggcggtgctggttcctgacgaagtgtggcagtatgccgacgatcgggtaggccttgaggccgtcggcgcgaggctgcttcctggtgctgccatggcgcaggcagaggaaacagagcaaaggaaacagcaagaggaggagcaggggaacggatgaagtcaacgagagctctgtgcccatgtcgaattggtgattttggattggacgatggagatgccagcctcgtgaagtccgcagaggcgcagattatggagtgatgttgcttatttgattaagttagtcgatttgttgagtgcgagaattttcagaatatgccatcgaattcgcactactttcagaatatgccatccaattcatgctactttcagaatacgccatcggagcacgaatttcctttgttccgtgccactctgtctcttccgttcgtagcaccgtcgtcttctccgcccggcaccgccgtcgtcagtccgccaccgcccgcgccgacacccgtccgtcgccggcatcgtccatcctcgttggcgtccatcgtcgtcgtccacggcatggcgtgggcgcggagggaggcgagcgcgacgcgagtactagcagcggggcgagcgcggccgcgagtgctagcagcggctgcggcggcgggcgaagctgactgtctgcgtctgcgtctactaccgcccgggactggacctcgtgtgcgcgccttgtgaattttgaggcaccgttcgttccagggtgtttggggagattgagtctcgttttccgcgcgcacgcttttcaaactactaaacggtgcgttttttgcaaaaaatttctataggaaagttgctttaaaaaaccatattaatccatttttgaaatttaaaatagttaatacttaattaatcatgagctaatggctcacctcgttttgcgtatcttctcaatctcctcaatccccttcccctcaaacacaccctgagagtagagggcggccggtaaaaactccttgtatgttgttgctgctgcacgtacttggtccagatgatgagtgtgaattggcaaggacggaagggaacggaatgggtaggtagtagttggatacttggattgttcagaggaggacgtcggacttggcggggagtcgcttgtagaagttgaaggggacggatggtgagcgcggccgcgagtgttagcagcggctgcggcggcgggcgaagcggcggctgcggctgcgggcgaagcggctgcggctgcagaatggggcggcggcggggaaggggtgggggagaagccccttgtggatggtggggcgaggcggaatgcggcag

SEQ ID NO: 49969 - DNA, 820 bp, Oryza sativa
acgagcgccctcggtccgtgctctcgctgacgctgcgtatgaagtggggcttgccgatgaaagtgaccatcaggaagtaaccaacaagagtgctctcgcgcctcggtggcctcgccttcccggacactcgatcaatgcgggcaagaatttgggacgtgtgtccatctcggtaggccgaatcggtgagcgggcttatgaaagaatccttttaagtcccttatgtttgttgctaacttgttttggcgttgatagattctggcactgctaatcttggattgtagcccaagatgagatgcctcccatacatcacagctctcacatggtactattgggaaaaagtttacttcagatccctcatctcattgtcgagtttcagaatcgtctctaaaccagaatatcagatataacgcatcactatttttgcaaaatcgggtcccaaagtagtgttgaggacggttttggataaaacaaaaattaaaataaataaataaaaaccacgaaaatgtaagtgaaacattatattcctccttgtatatcttcccatcctccggtttctctccctaccgccccatcctcaccggccggtcaccgccgctgcggccttcctgcagctgctaccactgaagatcatcgataatgcggcagatgtcgaggtcaagctcccattcacaggccttgatgtcgaggtcaagcgtcaaaagagtctcttgaggctcttgacaagcagagaaggaagtttttgtgggcggggggagaagccttgacgggtggaaaatgcaaaatcaacctggacccgaacctgcctacccactggttccgg

SEQ ID NO: 49970 - DNA, 1217 bp, Oryza sativa
gcccgcgcgctggctgcttactcgctcagccgccggcccccccccatccgcgtgcgattagcacaagctaattacgattgttactgttaaataccataattaaaaaatacatgtataatttaaaattttgagttatcagttttaaaaatttgggttaaaacttttgaattttgatatgaaagttttcaactagatatgaaatttttttaattttgagttggaagttttgaatttcaataccaaagttttaaaatttgagatgaaaatttttaattgagttgaatgtttctgaaatttgaattggatgttttcaaaaattgagttgaaactttcgaattttgacttgaaagtttttgaattttgagttgaaagtttttgaaatgtgagttgaaagttttcaaatttgagttaaaagttttcaaattttgagttgaaagtttttaaatttgacttgaaagtttttaaatctgagttgaaagtttttcaaatttgagatggtaagttgaaagttttcaaaatttgacttaaaaaattcaaattttgagttgaaagttatcaaatttagggtgaaagttttcaaaatttgacttcatgtatagatttcttatcaatctgttataaaaaaacaaatcttatcttaattattatcattatctaaaactaaccgtattagttagcatgtatccaaaaaaaatcccggaaaaaataaacacagaaagctcaccgagtgacaagggcccgccacgtctctaagtcgctagtacgcgcgaattagcaaaaccgcaatattactccatcactcgaactctgatccgaaaccaaaaaatccacctcttttcgcaagcacttgcgccactcgcaagtcgcaagccaaaaatcacctcactgtttccatggaactctcctcaatctcagcttctctcctcctcatcctccctcttctaccgcttctctacttcctctacctgcaccaggaccccaagaagcagcctcgtgcccatggactcaagtcctaccctgtcgttggcactctgccgcacttcatcaagcacaagaatcacatcctcgagtggtcggccggcgtcctaaagcgcagccccatgcacaccatgtcgttcaaggcgcttggcctcaccggcggcgtctttacggccaacccggccaacgtcgaacacatgctcaagactaactttggtaactatgtcaagggtgaggcc

SEQ ID NO: 49971 - DNA, 2085 bp, Oryza sativa
gacgtgatcaccaacctcgtcctcgccgggcgcgagacaacggcgtcggcgctaacctggtttttctggttggtatccggccgtcccgatgttgaggacaatatagtgcgcgagatccgcgcggtacggcgtgcgtcctcgagcaacggggtccaagcggcgcggcgttcagcccccatgagctgcgcgacatgcactacctgcacgcggccatcaccgagtccatgcggctttacccgccggtgtccctcgacacgtacgtctgcaaggaggaagacttccttccggacggcacgttcgtcgggaaaggatggcaggtgacgtactgcgcgtacgccatggcgagggtggaggacatctggggcacggactgcgaggagttcaggccggagcggtggctggacgaggcgggcgtgttccggccggagagctcgttcaagtacccggtgttccacggcgggccgaggatgtgcctcggcaaggagatagcctacatacagatgaagtccatcgtgtcgtgcgtgttcgacaggttcacactccggtacaccggcggcgaggggcatccggggctcgtcacctcgctggcgctgcgcatggagggtggcttgccgatgcaagtactcctaaccaatagggggcaagcagtgtcgtgctaggccagctgttctcgacgacttcattagtcctgcttttgttgcgtcgctctcggctctcgcctgttcttctactgttagtccttttatcttctccgaactacgaattgttcacatttctgggagctagcatgagttgcatactgctgtgcttggctctgccatactaatactagtggattttaaacctcgagggaatattttcttattatttctatgtcacttaagtagttataaaaaaaataaaaagtaacaagatagattaacctgtgatatattactttacaaacatataagctaaaattaaaattttacaagttataataaaaacaaattaaactatatggtgaactaattgtcggtattagttccgagattgagatgttcaccgagtgggccggaaaggcactcagacggccacaccctctatttctccaattacgtgttcaactgtcacatctcatgcccctgtatggctgtattcatcgccggatcgccccgtcacgctcaatagtcaatgttattgtttacgagtgaccagtcacacatacagatttcgcgttaacagaatcaccagctaatgacgttattcgctcggtctcaaaattaattaagcactttgtttgatattgcttgaatttttattacgaactttttataattgtttgtttaagggttttttttttctgaaatgttttttttccaaatccattattgtttaataaacatgttctatttgcacaataaagctcatgccctctaattagttagctttttgttgcatacttattgcagtctaatcatataagaactaaaaaatgatgcaatgcttatgctaatgggtaatacctttatatatcaacatttttacaaatatgaatcaacttttgtgtaaacatcgatctaatactaaaataggttcctgttgtttatttattcatggattgaggggattcaaaactatgttaaatacatatacttgtagagtccaattctagtgtgcagtgtaggagacaacccataagtgtacgaggctagcgagaacacaattattggatggctaaatataactacaaatatatgcggttatgttgagaggaacaaatatatgtggaaacttaagatgccgcttaagattaagatctttatgtggtacttgtttaaggggttgtgttgaccaaggataatttggcgagacggaattagaatggtagcttaaggtgttgcttttgtatgaaaaatgaaactattcaatatctcttcatagattgtcattatgcaaaattcatatggagagcagttcagttttcttttggttttaatcttccaactagtatatttcatatatttgatgggtggcttttgggggttgacaagaaaaagagtaaactgatactggttggagcttcttccatttgttgggctctat

SEQ ID NO: 49972 - DNA, 789 bp, Oryza sativa
ataggttcataagtgttgaagttagatgcagtcgaaagaactttaggaatgtttgctgaaacgtgtctactgccgtgatgccaaaacagagatttttacttgtattaaatgaggtcacaaacacagagcccttccttagcttattatgcacaaccctttctcataaactttatatttctttgtcggtgtgtcctgagtaagtaaagtcctttgctttttcagtgactacaagtacttgttatcaataaaataatggaaaatgagtgatttattccacaatatatttgtatttgattctagtacatgagaagtttcctcttttcccccttttttggatgaaacatatttcagttttcagtcataaaaagatacaagtatggaactaatagtcacaatgcatttttaaaattcttatgctaaagcattcctatcatcatgcatatttgcaattgcatcttttgatacaactttcaacttttctgtcacattattccaatttcaaccaaacttccaagtttggttgaaattggaacgatgtgactgaaaagttgcgtgtgtatgaaaggtttgatccgatggaaagttggaagtttggaaaaaaaaactttgcaactaaacagggcctaacattgcataacttattatatgctctacttcttttctttgcagacctaagccgcaagtccttggagcaatatgtcccaggctgctcatcagtcaggctctctgacgtcaagatcttccggtcttgggaacggtcaatgaagctgacaacggaggcgttcgtca

SEQ ID NO: 49973 - DNA, 1508 bp, Oryza sativa
cggtcggccaccacggcacgcgcgcgcggcttgcaacgggaggcgcggcggatttgagcggcgcggcttgggcacgcacgctggcttgcggggccgggcggctgcgcggctgcagggcggcagggcagcggggccggacggcgcggacggcgcagacggcgcggctctcgcgcatgcgcgcgcgacgcgcgggcagagcggagggaggggcgctgggcgtggctctcgcacacgcgcgcgcggcgcgcgggcagagcggaggggaagggggagagagagagagcgcgccgggagggagggggagagggagatgggccgagcgagattcggcccatcgaaccctggggtggcaaaatagacttttgcggaggaatttgatttggaaggattggattcggaattaaactcgacgatagatcggggatttgagatcttgagatggcacggacactagacgacaagcgaagaaacaaatttcgcaattagggtttttaggagataattttcccgctaggcgccacgacggaacgggcgctacaggttgataggtatgattcggttctttagccaccagtaccccacttacccatgggtaaaaaaaaggtgtgcctaaggtaatagctctaatccagtttatatgagattgatatggaaaaccatatagtacaaagacaacagatgaatccggcgttactgacgagatccttgtcgagatggttagacgagatctcccgacgaatctggcttcgtaaactatggtgggtatgttagcgctataattcgatgatctgaaccccttagggggtgtgtcttttataacgtgagttgccttagtctccaagtagatcttggagagaatgaaccctacacgatatagaatagacccaattctctccgagtaggactctgttaatcaccggcctatgaggatattttctataatatcttatagatttcccttatcacctacggtcgtatgaccgatggtataccatactcgtatattccgtaagtcataggatatgaggtatgccttatccgtaaccagtcgtatatgacataattcttacatgattttttacttgcttttgaatgttaatgttaaaactaaggttgcctaatatgatgttggtgcttgccatcgtcatcatcggattattgtaaaaaatttaagtgctctaaattagtgtagtggtatggatatccattacctgtatgggtatggtttggggagaattttgcacccgcggttagatgtgggtattagagcgcgaacttttaatcataagtttgagtatgaggtaagaaaacttgcagtagaattatagttcatgtggatcaatttatttgtgtactgaagagaagagagttgtaccaaaggtaacctagtaaccagattatttgagcaggcgaccaggcatgaggcatccactgtctagctttagtagtactactattgatcaagtcaatgtaacaatatgtttggtagcatatgatgtattcttgat

SEQ ID NO: 49974 - DNA, 730 bp, Oryza sativa
atgctggtggtgccgctggacaccgtaatggccttgcatcctcatccttgggttcctgctggtaaccaggcagccctcgctcttgctggtggccattcgtcgagcaggagcggccagacgaagcccactggacaccagcggcagttcgcagcagtgcacgctcgatccggcgatgacgctctcataggaggacctagagtgaacgatccgacgcgacagggcctgatccggcgagacgcaaatgagtgggggatggacaggagggaggaggaggcaggggattaggagagactgaggccagggtaggagcttgtggggatgggaagaatggaagatgcggcggaggaggatgaagccgcggcggcagcttttctttttttcttttttttttaacgcgtggatgctgcctattcgcctacctctctcgactctgatcgaagactcctgaaatctcgtcttcaccttttgactaaagctatactgaggcctattcaaaatctaacggcatgggttcaatgtttgttgcatccaacggctaatattattccgatgacatggcgctttgtggtggtgaaaaactttagtattttcactactttagatttccaatcactaacaaacagcgaaacagaggtctgattagagatggcaattggcaacatgtcccataacccgagatcccataggtttttatattattattacgagtcacatttttaattctgatatc

SEQ ID NO: 49975 - DNA, 1527 bp, Oryza sativa
ctcgctccctctcattctccctcgtcatcccggtgtacgccccgtcgcccctcatcgtcgcaaggcgtcccggagaaaccgccgccgcccgccgtccattcgcggccggcgccttcgtcttcctcccgccagcccgcgtaggcgccacgtaggcgccacgtcggcgccagctcggccgagatcgggtcgggccgaccccggtcagcccctcccgtgcgcgcgttccaccgcgagccgtgaggctgcgcgtgggcccgccgcatccattccaccgcgaaccgcgcgcgtgcaccgcgtcccagccccggccgcgcgcgtgcgccgcgtgctcgctccgcacggtgaaccgagtcaccgacaagcgggtcccacccgggaccacgcgtggtgagcccggtccaccggctctctctctcctcccttcccgcgcgcgcgtgcttgggccgccttgggccggccggcccatttagctcggccgagccgccccttttctctcgggccgcgccctagccgccgaggaaaagtctatattccctccctcttttcttttcttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagagctttattttcgccgtttgttgagttgtcccgttttgcgtgtagtttcggagaccgaagacccgcagtgcgaggatttcgaggatcaagctcaagatctcgagcaaggcaagccacctttgaacatcttgagcctatatttgaaattaattatgttgcttgaaaaatattatgcattgataggatcacacttaatctgcttgtcccgtctgcaaggcagattggcggacctacctatttgttgcatttgatccttcctctgttaattgttataccatgtttccttgtaaccacctagtcgcgcctcggaaatcgtgcactctgcactagtatcaacggtcgccttcaaacttaaaatctgagtaacttcttgggtaaaacttgggttttacaaaagacttggaaaacccgacacctgggttggtgcttgtgaactaaatgaatttccaaaaccgcggaccggggaacgtaccaggtgtacggtttcccgctcttgcacttaaggaccgtttccttggaatttcatccgaacataagacaagtacgaccacatgggtggaatgggacacccctggctgagtaactagcttatcaggggagccttgatgccgagagacatgtggattcaccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtg

SEQ ID NO: 49976 - DNA, 1099 bp, Oryza sativa
  unsure (1)..(1099): unsure at all n locations
ccctgctctatataaataatcccccccagttgctgaagaagatgaagcggatcccgctgacgaggagttcttccaggagcaagccggctacgatgagttttagggtttcagcctagttcccaagtcgcgcctgtgatgtttggtccaagtcttggcttccgcttcccttttgtaatgcagttgtaagctcgggatctgtccgcagcccaacatgactgtactcctactctataataaagagacctctgttgctgtgatattctgtcttcctgtgataccagcactgtttcctgggactgttatcgattaacaggttaatttggagcgtcacgggctagttccggtcgggactagttcggggcgtgacaagagatggtatcagagcacaggcttggccctagggcgaaacccgacatttaggacgaccctaaggatactaagttcaaaactacttgcgaaaagctaaggcttcttttggtttctttattttcaatagtttgtttctaaaatggttactgatcttttctccctccttcaaaattgtagatggcagtgaacgccagcttcagttcccacggttttggtgagggtcaccacgtcgctcagcttcgtgacctcgcccgcttccttggcttttcgtgtcccgagtacacggggtactccgtggaccgtgttccccctcgctgtgagctctctgtgtacctttaccctcgtggaggtatacacggagctggccttcgcccacaccacttcactgtggccaggcccactctccagatcgcgtaccaggacctctcctgtcgcgaccgagaaaaatacattttcccgaaagctagtgtattaatccccgtcccaggaaaagccggggtacactacacaaacatgatataaaagacacatctttattatatcgataatatttacattattacaaaggcacttaaggcctgacaatcaaaaataaacagcagcgaaaaagcgggcctacggctccatcttcacaggcgctcaactggggtataagccaggactccacctaagacttcttctccannnnnnnnnnnnnnnnnnnnnnnnnnnnnnnnnnnnnnnnnnnnnn

SEQ ID NO: 49977 - DNA, 1815 bp, Oryza sativa
  unsure (1)..(1815): unsure at all n locations
aatagaaatcacaataaaataaataatcataatattattttttatgaaacaataatcagatgtaaattaataacggcgtatattaaaatcggagggagtactctctatttgaaagcacgagcttccgaatatgatctgtagctctatcctactcctctataaaaaaaaattcaaactggtccagattcatccctacagtttgattttttttacggagagacactactacaggaatgattttccttgacgggggtcattttagattgcaaacggcgtgtaagtagttgcgtctgcgaaaatcgtgctccattttcacgtgcgactctttaagatgactgcacaaaaaaaatcaattatcgcaggcgggccacttaataggtccgcatgcaaaaataggcttgttttcgcgtacggacctgttaagtcaccgcacacgaaaatagcctctcaacttttaatccgccgtcgctgccccacatgcacccactctcatcgctatctccttagatcccatctcacacctgctcctcccatctccctctccgcctcctcctcccatctccctatccgcctcctcctcccactcctccctctccctatccgccccctcctcccactcctcccatctcccagcgacggcggcagcatcggagcggattcgttgccggccgccgcagtgaggatggatccatcgcctgtgaccgcgaggggatccgtcgccggcgacagcggggacgacggcggcgggccttaggcaaggcggcgatgacgacggtggtgacggcgacgatggcggtgacgggtttcttgttttggttctgcgcatgtctctctgtgacgttgtgtgacgcacggctagncaaccaagcggctgcacacagatacgancgcatttatatgcacaagnaccaccttgcgatttccaagcacagcggctggaaagagtgtcgcatgactcgaccgcacagaaaaatcattattgccactagtgggagtatatgttagcagatttgtttcgagcctaatcaacttttattatagttcgtgtgtgcgcctggatcaattatttgtgaacctagagagaagcctgtgagccaaaagccctgaaaaccgctaaaagaagagcnctggaactctcatctctggcacgccgcgagccggtcgcgcacctgtcctagacgctttacctagtactactattgatcgagtcaatgatcgctctactagtactactattgatcgagtcaatgatcgctctactagtactactattgatcgagtcaatgtaacgatctgtttggtggcatatgatgtattcttgatcagcaaaacgtatgcttgagctgcaagccgatgtataatcaaggaaatgaaaaacaatgagttccacttgccatcttgggaccaacaatatcttttgatctctccgaaccagagactaccattaaattagacgagcttcagaatcttctagttcttccggcgaggtgaatggattaactcttttttttaaaaaaaatccagaaacatgaataccaagttcgtaaaacacgagagaatcgatccaccagccgaacgactgccatcttcatcagctataaaagagccgacaaatctaggtgctccgcacagtgatacagatcacttgcgccatcacaagtcgcaagccaaaaccatctcactgactagctcgagctcaccatggaattctcctcgagttcaacgtctctcttcctcctcctctctatcctgcctctcctctactttctttgccagcgccacgaccccaagaagcagcctcacgcccatgggctc

SEQ ID NO: 49978 - DNA, 8267 bp, Oryza sativa
aatgtaagtataaaattactggttgaagatcttttttatcctctatgatttatcgctttatgtgtaattccatttttcttggactaatgacattttgctaatagcatcatcaggaaccatagagcttggtccattcgttaaccttccacgtgattgccaagaacttgccatttcatgcctttattacttctccaacctgcttcccgacacaatggagctgttggcttcttgttgcttaagtatgcatttttgcttctctgttctgcgtttagtgtcgttatattctttcctttaaggattacaggtggtacataatttatggaatgcaggtgatgtgctggaacccaccatattgtttagaattattgaggttctacagtcaacatacaaggctgggaatttacatataacagagcaactcagtttcttgtcattgctaatggcacgattcagagttcatcctggtgagtacttttttttttggaaggcaaacttttcttagtttaagtggcttactttaggtgaaaatttcatactatgtgttttgctctttaagttttatcctctaatggttattttatctgacatttttttctaacagctttccttttgttttgttaaactagggtctttctctacccaggataattcccagaagggctcaaatatgaatacttttaaatcattgaaccgcctaattttaaattctctatctgaaatgggtgatggctccctggttcttgagttaatgtgggataatttatctaaagagattgtgaggattcaaaccatgctatgtttttatgttttcacccaaaatccattgaactcatatatgtttgttttgtgcaggcacagataccatctttacataacatgaatggattgtttagaattattgtcacacttgatgcaggaacttgtaagctcatgaacgaagatgctataaaaattatagctggctacttgattgatgctgctatggtgtgtactcttctgaattctaaagctctggactctggtatttgcagtcagtaatttggtaaatttgtacgctaattcaggagaacgtagtcgaaaatggcagattagtcgaaaatggcagattggcgtattttgatgttagaaaacctattgcctatagatctgatataatcggatctaacattattttatgcatattctttgaaaactatgagagttcactaacagagcatatttacgtggtagcatagggagagtatcgtgagtaataagctcttcacatcacctggtgaagcgcagagtgtcagattgaatgcattacggcataaacgtttttttcagttacactagcttatggatggtaattatgagtttgacacctgcaaagcttttggcaaacaggtgcattaattcattgtcatataaattagaagcgcatctccttgattagttcataagcattgctttatcgctgtacttttttgggttttgatgagaattgatttcacccaattttattgtgtacatgcaggatttgtctaaaaccattgagcttggctttcaatctgataggacaagactatttcaatactttataaagccttgcataatcatattttgccagaacgagaaggttctttgctgcgcattggagatgcttaaatctttcgcaacaggagatgaccacgtgctttcatctgcatccaagttaaactacccaggagagctttcacatcgaatttgtgttgtcacaactatactcatattcttatgcaatgatggaaaactccataaaaacctttctttgggcaaatgtgttattaaaggtatcctgcaacatacaaggcatctcatggtaagtggtgataacataaatgcctttgtttggtagccatattaactgatgagatttcagtttcctacattttagtcatttttcatattaatcttaaattcagggaggtcagaatatcaagggcaaaattgaacatttgtgcatgtgaatcgtatgtagactagtttgttgaatttgttcctactatgagagaatatttgtcctgtgctgtacctagatcactatcactagcttgctctattatgcctaaatgtcgttgttgtgaaactggccttcctaatgagtttgctctattcaatacttgctgcaggattctaatgttcttgatgtaacatatgaggacaagcagaagttaagatttgcatttgagcaactaaagacgaaagcattgcagttgaactgctgggacagaagtgagctggaagggttttcaagcaccacgtaaatagtaccaaatactaatggtatgtgggctccttcgtcattgtttgctaattatgttgatttattgtttttttttaaaaaaacgaatgaacttacttccatcccatatgataggtactgccgtaatgtgaaaccttactctgcacgggatgaaaattttgacgaactgaaggtgaagatggagagtggacatggtgactggtgaggggcagaaggatatgtgccatccgacctgcgtcagactccagtatacacctctgctgttcagctgttaccaacactttacgaaggtctgtactttacccaaagattaatttcacacttcgattctatcttaatcctatgtttcccaaacggtctacgatttgccataaacacacgagtttctcaggagcactaggtagatttgtcatgtttgacaacaacgtgcctgacagtaatatcttgctattgcaggtggccggaaaatgcattgttcacatgttgggaacgaggtggtccactggtccatgtatcattgtggtacagcgcttggttttgatgcaacagaattgcagtttagactgctcaatagaccataggttatttcaccgaaaggtttacatttcaacctacatgtccatgtaagaatcccgatgtaaatgtagaaattttgtttggaagttcatttcgggcctctcatgtcattgtttccacttcctgcatatatacttgtttcaccgagacagcctcaaagccattttcatttccattcgcctggtcaacgttggcaaaggccataaggcagtttccaacgtgcttacactactgcaacttacaaccatatccatcacgctggtgcaaccacatcccctacacacaagctcacaaatcacaatgtttgtctgcggccttattctatcaactcattcatttggttttgggtaatctatcaattcattcatttggttttgggtaatcaatggtgtatgatcgggtcgccattttgggtagcaaatgatgtagcttatcacgaattcacgatagggcatggctgctatagtgccatctactccctggacatatagtactacgaatctggactagtcccatgtccaaattcataatactatatacgcagtatcatctacgacgggcgtacaggctgctgctgcgtgatgcagtgtatgtttccccctgccagcacgatctctcttgcgccttccaccatcaccacctgaaattcacgggttccgtcagaacacccagcacagttttgagttctgacgtcgtagccattgccgagtaacaaccaacagccactgcttgcttgagctgtggtcgctgacagacagaaatcacagcatcgctggataaagtttcgaagtgaaatgggtcagtgaagatcacctcatgatcaggaaatgccttctgaagaacagcacacgcttcttcgtcccacttgtcgccaaaagctggtgctacaattccgccattggctatgtagaagtttacgtacgaggcagccaatctcgtgcctggttccctcggtatagcatgctcctagaaaaaaaaaggactattcattcttagaaagggatgaacacgctcattttcaatggattgaagttagtaatgaatatgacagaaatactgactgtttttacaacaccctctgactcttcctttgtcatgtacagaggccctgggacgtggattttcacaacttctatctgccgtcctttcgcatcaacggacttggagagagttgagagtgcatcaacggacctttggtactgtgggtcgttctcatcatcggtccatgacaagaggaccaccccaggtttaatgaagcagcatagattgtcaacatgaccatttgtatcatcatcacctagagaaaccattgcaggcctatttatcagtagaatggttgaagaagcagggaacagaactattatggttttacacctttatgtgacagaatgtttttggtggttaccataaagcccatgaggtatccagatgacctttgcgactccaagaaaatccttcagctcattctctatctctagtttggtcatgttggggtttctgttaggattcaacaagcattcttctgttgtgatgcatgtacctgttggaatatggcaattcattagcaagataccaacaaatatactgaaactatatgcttgtcagcaaagattcaacacatgaacaaccttctccatctacatgaatgcttccaccttcaagaaccatcgtgtgtggaaatctagggatcctctcaatctcaactatctgaaatcaatgtccaaaacagaactagttctcagaccagatggagactagcaaaagatctttttgaccttgaaagatgtcaaattttctttaagaaggttattctcttcttactttcttggcaacatagctgtcaaggctccaatcaacatagcaaccatcagtggctcctgcaggcattagcagcacaattcactgaatcttcatacggagcaggtgcaaagaaactagcatgtcttgataatgtacgcttttcacactgttaataacagacacaagcacaaagatttaatttgtgaagaaaaatgtttcatcacacaaacaatctaattgaaataaatagcatgagaaagaactgaataaacatattactcaatataagaacaacatacctccccaggcgttaaattcccaatcaattcctgctatatttttttctgtgattcctaaccctggtgcacctttacgaacaataaactaaaaaacagggatactgttagcaacccaaacactggagagcaaatttggaataagaaggcttgaagtagcatacagtgggaccaatatcacggaaccagcaatcattcatgctcatctcgaccaccctgatgtttggttgatgtagcattagctcatggacatagggatactgcatgaaacaaaagtatgaattggtaccactgtgcaatcagacatgatcgtgcaacaattcacaacacagatcataggaggcaatgtggagaaaatctgttacctgcttggcacttgcacatatagtaacagactcaaactttgaaatggcaatagcagttcttgcaaatacttttcgagctggaccagcaagctctcgccaattgtctcgacgctcctgggattcaaagtaaaaagaacaatgctcactgttaaccaaatgctcactgtagtatagaacaaggattggggaagaagatagatgaaatggatacagtctgcttttcatattcaagaccacagtccaaaatgacaattattgatattgtcaagtggatattccacctaaccactccctttcggagttacatatactaaacagcgattagacaagacaaaatagggcatgtacagggtagagtagtccacagatgtcactgcaatgatcaaacgatcattcatgattataaaatacatatatgtagaaaatgtcaatgtgccagtgtttaagcaatgtgccacagcaacgtgaaccaagacaagacaggtaaatatctctagaatcgtacatcagaaaaatcagacagcaaagaaaatgatggtcatgacttatagattgagtcaatcagggatagggaacagtagagctttaatagcgtgatggtcccaaaattacaactttatttatgcgtgaggggaaatgattcattcatttgtactaaaaaaatgaaaaaaaaaatcattcttgaatagttttaagacaaaaatgatactgtcgtttggacaaccaatgtagccgcctacttaaaaagtaatccatgtgcttacaaatcaagagtaataaagttgtggatgttccggtgaggcggtgatagaatccagcctaaaatatgctcgtaagctagtaccgattcagagattccaacttgacgagaaataaacaataccccaaattgctctgtgcactttagatgggatggattgatcccgagaccgcggcgcgcggccatccatcaaatccattcacttgggaggaaaccaaattctacacgacgcggtaggatttacttgtttcttctttctttttttttttggttggcgataaaaatcgcgaggatggatccatcggaattcagaatccaaacggagaagcgaagaacaattaaacagaaaaaaaaaagatgaggaaccagagggagagagatgagggagaagtacgtacaggccagcccatccagcactgctcgtgcggctcccactccgccggcatccggaaccccatcttcgccgggcgcccctccatcgtcgtcgccttcgccatcctccttctcctcttctacctgatgaaccacctctcctcttcctcctccctaaacctaaatatccaaaatacccgcctgattagcgccaattcgtcgaaggttgcgctcagcaaaagcaaaagcgatgggaaaaatgggggcgtcccacgactcccacccgcatcagttgctttatatacgtaggcggcggggctaggcgccacgtggctggaggagagaggggagtggggacccttcccaacagcttcgcgtgaccaagtttggccacacgaacctcagcaacttttgtcagaaaaaaaaaaaagcaactccacgagaaacaagaaagcgagaagccgtcagggagctcgccgtcgctgcgtggggctcgccggagtagggggcgctcggggagcctcccgagatccgccgctcggcgccgccgccgtcctccgggcggagctcccgaagctcgcccccctcgcgcgccggtggcgttggcggggcccgcggccgggcagctccggtgctgcgcctccaccgtcgacgacggcgtcgtcgccgcagccgtcttccgccgcgccgctggacgccgccggatctgccgctcgtcgccgcgtgggcccctccacccggttggaggaggacggagagaccgacgaggaagaaggaaggtcgcgatgcgctgccgcgggggccacatgtcattggtggggcctacctcctcagatgcgctttggtgctgtgcaaatgtaaccactagatatttttttacactttggtctctataaaactttattttgtaaataaactcctacttaaacttaggttatgttcggatacgatggttacttaaaacaggacgagctattagcatatgattaaataagtaattaaaataaaattgaaaaatgggttatatgattttttttaaacaacttactagcactttggtaagcgtgtgtttgaaaaaacgagaaagtataagttaggaattggtatatctgagcacaaccttactaagtgggcatttttctcgatgctaccggggtgaaacatttcatcgttaatgatactagcgcagacaccctcgcttccttagcaaccaagcgttcgagatgtagagccgtagagggatcagtgttagcctctttagcaccgatcctctccatgtcaatgaaatggctaccacggaggataaaggggtgtcggtgccagtgttattagtgacccaataatgttggcactgaggaaaatagtctattttaaaattagtttatccacagatctactctctctatttctatttcatgttataagtcatttcatttttttctagtcaaaattctttagatttgattaaattatataaaaatttagtaacaaccacaacaccaaattatttacattatatataacattgaatatattttgacaatatattattttgtgttaacaatattattatactatcttttataaatctgatcaaattaaataagttgactaaaaaaatcaaaataacctactatttgtaataagttttcaagcagagctaaaatgtaaaaaaaaaacccacacaggaaactggggattggggaaagacggcgttgctggtttgatggtttctgttgcactgacctcccacccttggggtgggggcggagaggttgtcagtatcggtgtgtggggtggttgggggggggggg

SEQ ID NO: 49979 - DNA, 2453 bp, Oryza sativa
gggggcggtgatgggtgtggcgagcgaagatgcagccagccacgaagacatcgatacgtgaggacggaaggaaggaaaatgaattgtgatcgagaccgtgtcgttgagaaaactggatgtgtcgccacgtgacgcggaccaaatcattggcttgaaagaaacagggcgctataattcctccaagtcatctacacaatgtacagcaacatatatacttgcaacgtaatactctctctctctccgtttcaaaatgtttgacaccactttttttaagtacgtgtttgaccatttgtcttatttaaaaaaaactaagtaattatttatttttttatattatttgattcattgttaaatatactttcatgtacacatatagttttatatatttcacaatttttttaataagacgaacggtcaaacatatgctaaaaagtcaacggtgtcaaatattttgaaacggagggagtatgtgtaatggaggagggttgctcttacttaatttactttactttagatcaagtttaagttgatgcgtgtgcgtaagtttgtattgaggggatatacacatggtgaaaatcgatgagttataactaaaaaattttcttgaccgggttcctgggtacccctcccatactctacctccacgctctgctaaggaatgggatatactacatgtatggcattaagcatatctattacggagtagtaatcaaccaatattattattctctctcctctgtctcttactagttatttcatccgttcaacaaagaatcaactagtattggatgtgccacatctagattcattttttatgggagagggagtaccacttcatcattaaaaattccgtgtggcactttttaatagattatgatgttacatcatttttttattgtcagatatatagagagaaaagtataatactatttagtactacgcactccctccgtagaaaatatgcacgggacccattcatcattcacacgaaaataatgtgggacccacatgtctatcctctttccttcttccttctccctttctctcacttctctctctctttctctcctctttctccttgtctgcacgccgaggcagttggctgagggccagagcgacggcagcgagcaggagggcgggcgccgccttgagacggagcggcgacaacgcggcatcgaggcggagctacctctcgtcgtcctcaaggcggagccacaacacgtcttgcccttgagacggtggcgcgaagcgaggagtggtctccagcgacgccttccactgacgaagtggagcgataacgacgagcttcagcgtggagcgttatccccatcttacttgacgcccgacgccttccaccaagccatcatagacgagggggacctgctcatcccgctggtctatgtctggaacaacaccaccttcgatgattccatgtcttctagatcatcttggctgccccaataccccgtcgtcacagctgtccgcaagggcgacaaggagcatctccgtcccaaggttgatgtagccatcggctgcgacatcgatgtcgagattggccacattgaggtggatgtcttgcgcctcacctcctagctccaccaccgcgccctcacccttccatccccaccgctagggtggagctcgccactaacgccgctggggaggaacccgctaccaccgccgttggggaggagaccgccgccaccgctgctgggctaagaaacgaggtgagaggaataaagggagtggtaggtgaaggacctgtggacccacatggcagtggattccatattttttttgtgtgaatgacaaatgggtctcgtacatatttttttaattctaatacacataagcgtcacgtcaacttcacgtggaacggagaccgattcaacattgccacataggcgccacatcagcgaaaccgttacccacaactgctgatggagtcaaattgcgctggttttaatagttgggggttgaaatatcggtattgcggtttagggatacgaagaagattcgttcactagtaaagaaagtcaaagtgaactaatcctcccatccggcatccccaaggccccgaaggagcttgggccaaggccacaagcacaaggctaaaccgagcctgtagccgcaatagggcccagcacagcaccgcagcccatccagtaacatcaggaaggcccccataacctccaactcgtggataaaaatgaaaaacaaaacaaaaaaaatattttcccctctaatcttcctcaccattcgcgcatcacccagcagacgtcgcggtcgctcaagcctcaagtgcgcaatccaatcaccgcagccgctgcaatcctcctctcttctccgtaggtaattccttcgaacacctcgcgcgcgcgcgttctctccgatcgaatggcgtagcggctgggttttcccgaagagagcttgattgattggcatggctgccg

SEQ ID NO: 49980 - DNA, 3791 bp, Oryza sativa
cggctgtcgccgcgggacctccccggggacgccgcggccgcgctgcggcgcgccgctcgacgcgtgccgcccgccgcggccgcgcccatcgtcctcgcggtcctcctcctcgccgcccgcctcgcgctgcccaagaacgcggccaaggaggtggcctactcggacctcctggctggcctccgcgcgggcgccgtcaccgccgtcgcgttcgaggaggactcccgccgcatctacttccgcagggccgcggacgacgggggcggcagcgacgacgccggcgcgggcgcgggcgaggcccgcagaggcgccgcggcggcggcgaggtggccgtgctacgcgaggagggtgccgcacgacgaggggttcttgctggggctgatgcgggacggcggggtggactaccggtcggcgccgcggccggcggggaggctgctggtggacatgctgagcacgctgctcacgctgtgggtgtcgctgctgccgatgatgtggttcatacagcggcagatgtccgccggtggcggcgcagagaagcggcgccggccgaggaagcagcgagtggggttcgacgatgtccagggcgtcgatgaggccaaggaggaactcgtcgaggtgaatctggattctctggctactgatttactcatgattttgatgagtgtgcatagataacaatcagtagacatgatacaatgtgggggatgaatgggaatgcaaattatttatacccaaatgttgggactgcttatctttgcttgacttattgaatggcttgctattgataatgcagatatctaggttgataatcgaggtagctatggtttgctcatgattcattattatacatgctaatgctactgtatctacctcagtagtgccatctgaactagcttctctcttgtggggtggatgggaaatagaaaaatgggtttgggatccatgtcatgttgttctactgatgagaggaagttgtggagtgtaggacataggaatgtgtcaacaaggtgttttgaaagcttaaatgtagattcaagaatcattttgttgattgtgctgcaaattttacattgtttttgttgtaggaaccatatatctgctccattccattatctgaaaatatatctgctccatatttgttttgtggatcctcagttgaaaacaaaaatactgggactgggaggatatctgaaatataaatacatatatatgatagaaagtggaagtataaaacagtaatatacagttggatagataactagtacttccattttttaactctcaactctgaagttcgtgatgattgcgggaatgttaataactaatgcatcagtttcaattaatatccatgttcttaattttcctcgctagaaataattgagtatgtattaaatgtgacagattgcaattttctaacgcaggtagtgagttgcttgcatggttcactgaactacaagaagctcggagctaaattacccaggggtgttctgcttgttgggcctccaggaactgggaaaactcttctggcaagggcagttgcaggagaggctggaattccctttttctctgtttctgctagtgaatttgttgaagttttcgttggaagaggagcagcccgtgtaagggatttattcaaggaggccaaagaagctgccccatctataattttcattgatgaacttgatgctgtgggtggaagtcgaggtagaagttttaatgatgagagggaccaaactttaaaccaggtaggattctagcaccttgattttatctatcctctgattcaaatgatactactgaatgaagaactgcttgctttctctatcaacagctgcttactgagatggatggttttgactcggacatgaaagttattgtcatggctgctactaataggcctaaagcactggaccctgctctgtgtcgccctggtcggttctcaagaaaagttttggttggtgtgcctgatttggaggggcgaaggaatattttggctgttcatttaagggacgttcctttggaagaggatcctgaaataatttgtgatctggttgctagtttaacaccaggattggttggtgcggatctagcaaacattgtgaatgaggctgcgttactagctgctcgaaggggtaggttaaaatttatgttgtacatttgtacttcacttatcaccttaatgcaagtaatattattgctacattgaacagctctttgagttacaaggtttagaaagctagaccatatatgccttctttattcttctcagagactacaactgaaatgttttccctttaggtgccttgacttaattcaccatattttgatattttactggagaaatcataataaacatgctattgacttttatctactttcttgttgttttaaggatggttaattcattctgatggaaaaatctgctattgaatatactgatcttggatttttacaggtggcaatactgtggctcgggaggatattatggatgcaattgagagggagaaatatggggtcaatggtagacaagagaatgctgattctgaaaggcaaggcctcactaaattgtttccatggttacctaaacctggaaatagaccaacaaacccagatgatattggaggagttatgggatatcatacattaagctaactggaggctttgcaaggtatcatttgagatgttcatcaaacttatatttagtaggctttgcttaatcccccatcagttgaatctactccgaattctttaattgaacatgaaatatgtcttgttagtttctttagcaagtccttactccttagtagagaccagcataggtttgcaaacattacatttgatggatcacaaacaggtgtaaagtgcactcatctttagcttgtgaaattagagatagaatagatgggagttgaaaaccttacgttctggtcatttggctactatatagccaatctagtttcaaagtttaagttcaggatttatcttgcacatttgttgcagttgtaaggtccagtaatgaggcttggaggtttccagttgtaactcgttaccactaaccaaggactggccagttcccagtccactctgtagctttcaggaggatattttcaaatatgagcatgccctcactaccctccagcaacttaagattatgcatgggtgagttggtgctcaccatcaaactatctgagtctcccaagtagctgagaaatttaagagcaattaggaagctgctggagaacctcctgtttctttgtagtatgcgtccttaacatactctgctgtgtttcatactttcattaatatgtagatttctgtttatgattgtataatgtggagtattaaatatcaattcatgccattattaatatattctgtggcattgcatagtactatccttttcccttagacaaggtattagcaagtgaaaaattcagcacattaaatgtttgctgtgaaatcttctcagtaagtattaggctacaagctttgaattccttttgacatgctcctccttttgtccctgcaatcttatttaaactgcaacatccttatgtggccttttgtttctgttgggcaggaagaaagaagttaagctgcaatcaaaatggtgtttgaattgccaacgtacatgggaacatgtcggttatagtcgtgtaggagcaaatatgcgtctctactgtacatgtgaaggatactgcactcttctgagttttggggctgcaaatttaggtgcttggaggagaaaactgccaccaaatcagaagaaatcaagcttctgaatgtgaaacacg

SEQ ID NO: 49981 - DNA, 3062 bp, Oryza sativa
ctccttaccatttcaaattgtgcatcgctttgctttacctaagcactagtctcttcacgttgttcatcatttttcttcaactgaactttctccactgctacaattctataaatctgcaggtatcaaagtatgaatagattatacacctttcaactttcaaatttgaacttctctgtagtactcattgtcctgtgttatctatgtgccattttcttctgcatttgcttggtaaactctgatgtgtctgcatgacttcagcattactgctaaacctgatcacaaacaggggattactggtggattgccaagtgggttccatgacagttagtcggagaacgacccggcggcttgacccagaaaaaaggccatctgctgtcagagacacacatcccgtcctgaagacgacatgaccttaataattgggaagccatgcaatggctgcagaatcaggacatatacccttgagacaaagatgaagcttctcccagcaagaaaaaatgttgtgtaaagggcagagctttggcatgtagacctcgacctgtcatacaccggaatgaagggtgtggtttggctttttgtgttctttcttctgggctgcttaaccaaccatgcttatctctgcaggatcaggtcacagggatcaaaggggggaataaaatggaaactgatgggaataaaatggaaactgatttgtagctttcaatgtttcgttctcagctttgctattagctttctcctgatgatttagaggccatggtggtctcagttcatgcatctatgacctgaatgaatgaagcttgtcctgcacttcagatcgatcggagtttctgtgtgcatatctaaactgctgagttttgggcttttggcctgacactgttctgcctaaatttttcagaaatgccttcctagctactagctaggtcatgagctatagccatcagactgttcgagtagtttagttagcaaaaaacaagactacagaatgcctactgacaagttgccacaaaatataatcatctggtatatataatcagcttcatgttaatatttgagaacgcatgcttaattatttagacgatgatgacaacggcgtgtaaactagacagctaccagtttcagaagtacgtatatatacaggaatcacaaatcgatcgatgacatttgtaaaggtgattcatgccctgtccgtcttgcaccatgtacgtttgtattgctcgtgctttggaattaggactaaagggataatacgatgaggacaagacacgcatatgctgagacgagagataagcagactacattttctgcaactttctcaaggaattggaacaatctaggggaagctaccaaattgatgagaagggcccttacctaacatatctcatggatatacagtactgaagatattttgtatgtgtacttcctccatccaagaataatataaacacatctggagtataatggccgaatacccgtgtgcagaaacaaaaaaggaaaagcccaccatatactttgaagcctagataaaaatatgaaaaacacaacgagaattaaaaacagaagcccaccgtacactatacagcctaaaaatttaaataaaattattttcattgtaaaaatcttcagataataatttttataattttttatcttatttgatagcttatggtgccttactatttggaagattcacatgtgaatgatggtggtgatggtagattcacttctcaccataatcattggggtctttaaaagagtatatgttgaggttgaagtgagtgtgaaagtagatgcgaaaattacatagaagttagttggggtaagaaagtaagccgggatgtgtttatattattggataaatttcaggcttcatatgtgctattcttgggcagagggagtaggtgtgttaaggatagaaaattcagggtatatgtaggtgttaaggatagaaaattccagacagcaatttttgcctaaccttacaatatatgcaactgttatcccattgtttctcataacaaaaagatacttgtcaatatcagaaggaagatttatatcagatgctaactgatatcggaattattgatgtacagtgtgcgtataaattcaagtacgtactgaaccatggatgcgcatatgtacggtatcagagatgagattgatgagaacaggagagagaagacaagtgatatatgatgatggagaataatcttgtagtagacaagaagagaaaagcaagaacaaagcagcactgatgagtgactttcagttgctaaagacctagagctctgagccgaatagttcttctaggcttccagttgagttgctttcccaacaaaaagctcattcctctgtagaagccatttcaagtgcagtgcaaagcttttcttcgtcacatcctgttggttgcatgcaattacaagtaagctcatgcatatgtactttacgttttaactgtgtgcttaagcatgaagcatgcatcgcacactgtaaaaaaaaaaaaacgtcctcggtattcggttaattaattactgtggcgttaatatctcctgaccgtcgaaagaacagcgtaatgccagcactactgccgacgtatatatgagaaaaattagctgggtatataatgttctcaactaaacaaaaacagtctagtgcatcgatcatcagccaaattatattactattacttgtttgttgtagtagtggtagaattaatttaaatctaactatagatcgattttcatgagtacaggaatattttattcaaaactttggtaaggtatccttaccaattcatccattttaatgtgccatatatataacatgtgaattgatcacagtgttatatatttgatttttagttttaaccttacaaaatttctactacacatattatcggatatagtataataaaataatattcattgcatctaattaaagaaaatggatgactcacaatcattcgagagtacctaaaaaaacctattgatcaatatgtaatcatacctcatactacggagaaatttaatatcatggtcgtataaattttaaatcttgaaaatgct

SEQ ID NO: 49982 - DNA, 1856 bp, Oryza sativa
attcctgcagcccgtattcttttaaatgtatgatagttgattttttacatcatatttgaacgtttgtcatattaaagttgctatgtacttttattctattgtggttatatcactaaagttattttaagcatgacttatattttttttccatatttacactaaaacttaaatgaaatgaataatcaaattttatgtccgaaattcaactgtgtcatacatttaaaaattgggggggggggtatttgactactcatggttaattttacgttggattaatccagatgcacatctgcttaattaaacatgcatgtgtggttgtatcatgtaatatcagttataattaaggtgtgcctatcaatctagctaatatactactccctccattttaaaatataaatatttctagaattcaaaatttataccataatatatggggcaccggttccaatgcatagaaagctatacattttcatatagttggaaagggaatctaagcaattcaaaatttaaaatttgatatcaccgaagtgactaaaagatgatattttctctctaagttaggttttgctaaagagctagaaatgcttagattttggaataaggaagtagctagcttttgttatggaattttcagaaaataattaaattgaataagtatgtgattatatggagtagctttaaattagcatatatatctttgatgacgataatttcttatggtacaattgtttatactaattatatttatcttaaagccccgtgtgtttttcttgtatatgtatacgttgagataataaaggaggtaactactcaaattatttctttgtaaaatgtagaatgactagttgtgtgagtagacaaacattgacaggctagcatcttgttattgaaacggtgcaaactttattcatgaataggctagttcagaacgtttgagtactgatcagcaaataggcatatcctgtttcagaagctgatcgagatatttgatccttcctgacgtaactcagatattttgaatgttttaataatgttttagagataaacttctgatttgtaatttggtctttctctggcacacatgtgcaaactataagatgtaagggctaaacaaacccggcgtttaataattaacttcaatctgcgtttagtttaattaattgccaccaaataccgtgacatgcatgcatggttacaatctatatgtccatatacatgcatggagatcgagagatcagagaggggtgaccacaactccacaaggccatgcatgcatgggagacatactataaacaatatcatacatatttattcattattattattattattatatatcatcagcagtgctaattaaacaattaaaactatatttgtacattcatacatagcagttccggccctcatctcatgtcatgcatgccctagctagctagccagctgcatatatatatatatatatgtatatatatatatatatatatatatatatatatatatattgcacacacacattacaacatatatactatacatgtaataatatatataataatactacatctagctagctagctgcggtcctgtatcgcgagttagctagctatatcgatggagtagttcagacgacgaggctggtctggtggtggtggaacctggcgatgaagtcggaggccttctggtcgacgtcgcgctcgccgatccaccacccgttgtcctcgtcgctcgaccggaccttccgcagcctcgtcgccgccggccgctcccagtcgctcaccgccgccgcctcgtcgtcggcgtagtaccgcctcgacctcctcgagaagctgaagatgcacaggaacgacctccctccc

SEQ ID NO: 49983 - DNA, 9111 bp, Oryza sativa
tgtcggattttggactgtcaagagtcattgacataggagtatcacacgtaagctccgaagttagaggaacatttggatacgtcgatccagagtatcgccacaatcacaaggtaaatgctgcaggggatgtctacagctttggtatggtgctcctacaactcctgtcaggaaaacgagcaatcaatatcatgaacactgctaaaccaatgtcattggatcgaatggtaagattataaacagtcagccggatattaagtattcgtcttaaatgatcggttgtgctgaatctgatatccataccttcgttcctcaggcttccatgctcatcagagaaggcaacgtgttggagtttgctgatcctaggctgaacggagagtactcgacagaggcatttgatctcagtttgaagcttgccctttcatgcactggacacaagaagcagcgtccgtccatggagcaagttgtgtcacatcttgagaaggccctaaagatctccatgagagatgacgataagcataacagcattagcatcatcgagtcccattcatagtaccctgtgcaatccttcaggagttcaggctgcaacttagtgtttccactaacatgtttaaacatttgcgtgcatttatgtgagcataattcagctgtgtttgagatacacaccaggaaatatactaattaactgatatacttttcatctatgcaagagtaaatagattttgcattaaaaaaagaaagaattaatatatgttagatctagagacagtaaatctagattcacagtttaccacaataattgcagctaagcaaatagtatgacctaataagaagaaatcatgcctcatattaggaaagataatgtccagggtaagctttttcaaatcatatcataactttgaaatgtatattctaaagtggaaaacagaacttgctgggatgttttgaacaccactgccaatagaagtttattgctatcacaactgataatacagtgccagtatcatcctgaactccataatcctaactcctaagtcttcgctagaagtatttttgcactagagaaaacataaatccctggcaattagccaattattattagaaaataaatatgattacaacatggaggagcgagcagacttcaaaaaatgatgttctttgtagattaggataaaagtacaccaccatatggcacattatcgaagttggatcccttccagttcagcataatcattctggttcattgacagggcacacaagccatgggggagaaaaaggtaaatggcaacaaatattatcactccaagatcagcctcttcacctatggctggttgaggtggatttcgcaggtatatctgagtggcacaccacatacagtacaagatagctatcaccacgatgaggaagaaagattggtttgatttttgagtggctgatttttcatgcttcactctgccaaaacatagaacaagatgttgttagcaacatgatcagtatacttactagttggtagaaagagtgatattcaaaattctggtactagtaagaaacttttaatttctaaagcatcagcaaggatccaagttttctagtcaagtgtctagatctcctttacagctatgtacatagcctacttgttggctgtgtgcatccatgatgccgaggccagggatgtttattaataataatgtaaaaacacataggtgcatctatgaagcagagttcacacctgttaatgtacacaaaccccagcacgaggcaaatacaaagaaggcctacaataaccactgcatccgaattgataggagcacggcctacccaccaaccagtgctcagaatccaagtatacatcgtagagtgcccattctcctgcagaggaaaacacgacgaaaaaaattagcctaataagcatgcgacgcctttttggatggataaagtgctactaaatggggcacagagacattggagcacattctcacctcaaacaagtgatccaaaaagaaatgggagagcgagcctgccgtgataaggtagaagcattgtctcctgcttagtgccacctgcatcaacgtcgatatcagtacaaattcaaacatggaagaataacccaaataatcagcagaggcgcctggacactagagctagatctacaatgtgctgcttatatctgtgtccttccatttgcaattgcaggttggtattctagtactgagcaatgttgccggctaattgtttaattaatccaaatgagacaacataaggaatgtactactggcacaggtagcagatatgttccttccatttgcaaaaattgcaggttgggattctactgagcaatgctgccgtgctaattgtttaattgatccaaatgagacaacagaaggtatgtactactggcataggtagcggatgttccagctttagttaattcgaacaaacaatcccaaggctgcttctagatatcaatttggcgaccgaagcgattaaaaaaatggtttaattaaggaaaaggctatacgtactaactttttcttactaaattcttaccaacactgatgtgtcatgctatgagtgcatctaggtaacttccatttacttaaatcaaacggttgagatgattgttagtaaaagtttagtaagaaaaatttaatacgtgtagcattgctctttaattaatactagatatcaatttggcgaccgaagcgattaaaaaaatggtttaattaatactagatatcaatttggcgaccgaagcgattaaaaaaatggtttaattaataggaaagcaaatccaggaggggattaggagaagaggcggtgcccccacccgagagggctcgtcgaggacgccggcgaggagcagccgccgggagagccaggcgtagaggcaggcgagcgggaagccgaggaggagcgggtagtagaacgggtggtggacgacgcccatggcgaggtcccccacggcggcggcggccgaggacgaggaggggaggaacgaggcgagccactcggcgaaggagccgaggtccgggccgaggaaggcgttggcggcgtagacggcgcagtggtgcggcccgaaccgcgccgccccggccagccgcgacagcgccgccccgcccgacagcgcgtacagcaggtgcgcccccggtcccggcatcacgtacgtacgcacgcctcgccaccgccgcggcgcgatggggatttggttcggtgcgagaggagggagacgtacgacgacgagttggattggagtggagcgtgtggtccaacttccggccggctgctcttatggggagttggaccaagaactccggcgacttgctcgctccgtgtccgactcgtatatggtaggtaggttgccgtttgtttgctcctcctcggcgtcgcttgcttttctcgtgcggttttaccgccaaaggtgcaggtggtttcggtttcgactagtacaaaaccaatctggttcgatactccgagtattagtatcaaattctaccaaattttactgattcgcagcgtcgataatcacgacaaaccttcgaagtcattcgaaagtttggaaggatttcgatatatgaaatccgctcaaaagctcgctcgactgatgtcacttgtaagaacagtcagctagtcaagcagcgctctttcgagaaaaagatatgtaagcaagtaagcagaccacctgcctaaacaaaacgaacagtggggatcgtcacccgtgggtgtccaattacctagaggctgagctaaacgctgctacctgctcggtgcatttctgcatttcatattggaaatctggagtgcaaagttccaggttccactatatgctggttgtactactgattgccctgtaaggtctggtttaatttccaactttttcttcaaactactccatccgtttcataatataagggattttaagtttttcttgtaacgtttgacactcgtcttattcaaaaattttgtgcaaatataaaaaacgaaaacttgtgtttaaagtactttggataataaagcaagtcacaaaaaaaataaataataattttaaatttttttgaataagacgagggatcaaagagtgcaaacaaaaactcaaaatcccttatgttatgggacggagggagtaaccttttcatcacattaaaactttcctacacacatgaacttccaactttttcgttacatcgttcactttcaattaaactttcaatttttgtgtgaactaaacacaccctaagtttctttccttcgcagaaaacaagaaatggaagcctccaccttaccggtagatcagcactaagactcttttattaggaagaggaacttttactctacgtaggtgttcatcatcaaactctttcctcttccaagttgcgagccggagctctgctgttcagctcagctaagattagtcgaaccagatttgtacagcgtacaggcacaggcgcacagcaatgaactgtgcagttgaaagttcacttaggacggcgcgtcagagaacctctaatttatttccctctaacttgtcactgacccatggatcccttatccagcaggcccacatgtcagtcactcaaagtcagagaatcctctgccacatcaggcgctgcagtccatctgcaccaccgcggtggagtcatcgtccttctgccgccgccgcctgagctggctcgacgccttgatcgccagcaggttgtcgcaggcgatccacgggaagctccagaaccgcttcccgcggcggcggtctgggtggtacgtcacgcggtaccacgccgacgccatccgcgacgcgtcctcttccttcctggagctcagcagccagcccctcgcctccctgtgcagggcgtcgacggcggcgacgatccggtccttcatctcgaagtacctcttgttgtccctcttcaggtacagcatcttgttccggatgttgcccgtcaggatctcgtcctcgagctccgcacggtagtagttcatcagcgtggtcagtttctcctcgtacagctcgtagtactcctctgcagcttgcaggaattcgtcagagccagggacctcgaggtcaggatagtatgtggggcttggttgtgctgaggatgatgagagagctcctgaatctcctgatttctccatgtgacccatcgctgatcggtagagcttgccaagaacaccattggatatgtacatcggattctcacaccgttctatgaagttggggtactccattggcctcaatgttcgtggcatttcagctggagctccggttttggagaagtaaaatgccatggaatgcagagttgccagatggaggcactcgggaatcggagctttcagtggtgatcggtttgcgtgaatcaagtgggcagttgagatggcaccaagtgagtaatttatcatgtaatcaacaaagtgattatgaatttcctgcagttacagacatttttttaaaaaacatttcactcagtgagtataacaccatggttgagaggagatatgcatttgttcacccatgaggcaactttgaaaagtctatactcataaactcaataagatttgccatttatgttccagaggcctttcttttttcacagaagcaagtatttgctgtttccttttcttttttttggggatgctgttttcttttctgaataaagctctcaaaatttctaaatactattgttaaatgtgtatggtcagtgcatacttgtttgaaattattcaaaacttttcaatgattggtgttcacgtagatatattacttttagatcaatgaccaccagtttttctgttaattgttaaaccatcctgagtgagttgactagttgagttagaaactcactccaagcttgtactttctggtttgcataaccttattagcatcacatgtttcatggaacatatgcacatattgtcctaatgcatttattcatgcccttaaccgcaagcatacatttttaaaaggtgcctcaggcccatatatatgactataatgctacagtccataattggtgacattttgcaactatcaagattgaattagtaaagaacaaaaagaaatccttcagtaaatgagaaacaacagcctagcaaaaaggggaaaaggaacaattagtcaggcattacctcgagtgtaacaacatgatccattatgcgcggccttgttgctgtgtagtccataggtgtatcaactttctctggaataagtttgtcatcccaagtaataaaatagaggtcgccgtccaaatctccccccgagcattcgtttggatgaggcctgatcaacatcaaatacaagcaaatcattggcagcattcattcataaggttgacaataaaaaaggaacctagcaaggaagataatgctggacaacgtggtgattcaattcaatagagaagtgatggactcctttccttccattgaagccatgggcaaagcaatacaaactttaaaaaacattaaggtaagagataaattcagtttcagtatcacaaacctttctcctctttgagggaagacaagacaatcaaccatgcccaccaaatcagggtcatagatggcttcaagtactcggatatcaccaggatggagacacggattttttgtgattgcaacttttccaacaactgtggctgttttcccgtcatcattataaaaatatgattgattactgtccttttgttctttgctgttctttgtaattcgaatgtaaacctgaccatattctaatacacctgtttcatccaaacaaccaataagaacacggccttttggaacatgtattttacatctagttctaatgtcagtaagcctattctcctgatgggccttaagaatcattgacaggtaaggctctgaactaggctcataaccttgcagcaacatcttcactgctgtctttgtttcagaaccaccaagtttccctaggactgacaaagcaacttctttgttggttagcatttcttctgtttcacgcatctcatcttgttgcattgcaacaaaaatttcatcccttatacccaatgttgagagaagagaaataatttcacgattcacatagcatggctgagacttgctccaacttgtaatgttcaacatcctgctctcagactcaaatttcttcatactaggacgcagagaaagatcaatagaggacataggatcaatggcaatgactcctttgtagccaccataccttatttgaaaagctgaaggaaggttagtaggatctaatccaacgtggtgtgcaactcgcttggcaaatctcaaagatatcttcccaataccatcagaaaatatgtatttggagccatcagttgtgatctcaatatctggaatcacttccacatcccatcgtaagacttcaaatgtttgcctggaggagctgaacagctgacccattctagctgcacatttagaaactgaacggatattctcaaagtggcccatccatcttcttatacctccagcattcaaggaagcattagaagcaaacatccaaacagaatttccccgaagttgacttgctgagaaggccaaaaattcaaagttctttggaccaatggaaaatcctttttttagaatggagagaatccgataatatagaccagttttgaaaggcttagaaaagaaaccttgttcaattctagctgagattgcattagaagaaagcttactccaatcttcatcaacaaaagtaactctcacaaagtcagaagcatatgcagaatgatgcttaaccacataatttgtaacctcttcttcaggtccaaagcagaatattttggagggagttatgttaactctataacacttcatcaattttctttcaccttcaccttcaccttcattggagagcaaaacattatggcttctcttcatgctataagcctcctgttggataaattgtaaaggcccgtagcaggtagactctaatttgtgcattttctcaaaaattctccttgagacatcaaccggtagttcttgaagggctttaaacagatcggcattaacatgcttggcgactatcttccccatatgcatgagagagttcagacgaaacagaacttcataaggcactgaatagtccctcggacaatgaacaaggggaaccacattggaggaggcaccaacaccatccattgaattcatagtcaattcccctaaatttcctgagaaaggtaaacttttgagaatatcagacaccaatgcacttttacccagtttaaggacaagagtagagcacctcccaaaagaataattgggtgtaaaatcaagtgccctgacccaggaaaatttagcatcctccttgcatgcatgaaagcggtcatccataaaccttgaattaactgcaggcccagaaattgcagtgtgtattcttggtgcataattgagctgaaacaaaaattagaagtaaacagtatatttgtcagataaaaattgtatacaaaaaggaaagaatggtgcatctgaaatcgtagtccaagaggttatagtacaacaatttagccgctaatggtaatgttgtttggcataggaatgctactctttttttagattgttttactccaccatttgtaaaatctactcaaatatgtcaagtaaataaaagtttcatgattttgtaagcgtaaagaagtaaaaattaactaaatcttatattgtaaaaaagctcttgcgatcatttgggtagctaggtcacatttaataaaacgagtaagatctaaatcaacataatctttgaaaaaagttgagaactactccctccgggttgataatacttgtcgttttggacaagggcacggtctccaaaaaacaattttgaccattattttctattataatatgtataaaagtgttaacaaatatatgatattattaaagtactttttaagactaatttatacatgtagccaccatatttgaaagacaaatattttaaaaataattcataatcaaagattctaaagtttgacctcacccttatccaaaacgacaagtattatcagcccagagggagtaacagctgtagattgaaccatgacttcaagcacatcatatgaactactaatctactattgcggccttactactgagcgcaaaatcaaggtgacacatacgggaaaa

SEQ ID NO: 49984 - DNA, 2029 bp, Oryza sativa
tccggaaccgggggcgcctgcacgtgaaaagcccagaggatcattgatctttgtcgaattttataatatatatatgtcaaactctacaactcgatctcaattttcgttttgagttttgtatctcaagtatgcaaatggtttgaactttcttttgaaaaatctaaattccaaatacgcacgacttgcgagtaaatatttgtgtgtggaaagcatatgatacagtgtagcattagtgtcacgccccgaactagtcccgagcggaactagcccgtgatgctccaaattaacctgttaaccgataccagtcccaggaaacagtgctggtatcacaggaagacggaatatcacaacaacagaggtctctttattatagagtaggagtacagtcatgctgggcagcggacagatcccgagctcacaactgcattacaaaagggaagcggaagccaagacttggaccaaacatcacaggcgcgacttgggaactaggccgaaaccctaaaactcatcgtagccggcttgctcctggaagaactcctcgtcagcgggatccgcttcatcttcttcagcaactggggggaattatttatatagagcaagggtgagtacaggagtactcagcaagccatgggaaacaagtgtttaatgcaggcttcaaagaaaggctgttgtttttacgattgattttatttaaactcttttctgaaacaactaagggagtgcttctcaaacgacacggatgagacagtgcgtctcgtccggtcggagtatgtgcaatgattcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaaactacgataggaatcacctcacatccgcccatgaccgtgggcacggctgttcgaaaagttttaataacctctgcagagggggtacacttttcccacacgacattactaacccggatcatccagcccgtgcagaacggccacgactagagaccttaaggctttcatgacaaggcatttcgaaagccgacacaggttcaccatatgccaacgagagggatcccagaccaacaccagattatgtcccagaccatactgtgccaggaagcccaggggtcctccccgacaccaccccggcgaatccacatgtctcttggcatcatggctcccccgataagctagttactcagccaggggtgtcccattccacccatgtggtcgtacttgtcttatgttcgaatgaaattccaaggaaacggtccttaagtgcaagagcgggaaaccgtacacccggtacgttcctcggtccgcgattttggaaattcatttagttcgcaagcaccgacccaggtgtcgggttttccaagtcttttgtaaaacccaagttttacccaagaagtttctcagattttaagtttgaaggcgaccgtcgatacccgtgcagagtgcacgattaccgaggcgcaactaggtggatacaagggaacatggtgtaacaattacaatggaagggtcaaatgcaacaaaataggtaggtccgccaatctgccttgcagaggggacaagcagattaagtgcgatcctatcaatgcataatatttttcaagcaatataattaagttcaaatataggctcaagatgttcaaaggtggcttgcctcgctcgagatcttgagcttgatcctcgaaatcctcgtactacgggtcttcgggctccgaaactacacgcgaaacgggacaactcagcaaacggcgaaaataaagccttattattgacctctaagcgtgccattagatagatctcgagatttgaggaattttggaagttgaacggagtcaaacggacttacggttggggagatattgaatttctaagattattggatttttggtctaaaggaaaaggatttatttaaatcctttttgaaaaagaaaagaaaagaaa

SEQ ID NO: 49985 - DNA, 7491 bp, Oryza sativa
ccggggaagaggaagaaggcaagcgcccggagtccccttccgcgtccacgaacacaccggctctcccggtgcttggcgatgaacggcggaggcgagacagaggggcggcaatggcgcggtggcagcgagcgaaacgggaggaggaatcgatgggagggcgccttggtttataggacgacgatgtcggtttggaaaccgaccttgggcggtcaaggcgcgagctggcgctcagcgctcgcggccaaaacggcgacagaggcggatgacgccggcggggaggggaaaaggaaaaaggaagggagaaagggggcttgccccttgccactttgggaaaaggaggaggggatgggggcgacgcggcagagggaggaggagctctgcctccgtcccttggaggctagcgcgaggagaggggaaggccgagtcgatgacgacggcgatgacggcggggcggtttggagcggagcgacgacacgggcggcaggcgcgggcaggcgctgacggcggcggcgaccaggcggtcggccaccatggcgcgcgcgcacgcgggaagcaacgggcggcgcggcgagaagcggcagcgagggcggagggcgctcggctcggcgcggctcacgcgcacgcgtgcgcagcgcacgagcagagcgggggagagggagagagagagagagccggggagggagggggagatgggccgagaggagttcggcccatcgaacccgagggaggcaaaatagacttttgcggagggatttgatttgggaaggatttggattcgggattgaactcgacgatagatcgaggatttgagatctgagatggcacggacactagacaacaagcaaagaaacggattttgcaaatagggtttttaagagatagttttcccgctaggcgccacgacggaacgggcgctacaattagagatgtctcgtggatacatttctctatttatgaggctaatggtatcgtctatttaagcgtacgttaggaacataatcgttagacatgtgagtgtggtgtgtatatcttccttgtaagtaaagaaatatgttaatttttttttgttttacgcggtatttttacgtacgtgcatgacatatttatttttttctctattgtgcgccatttctctattgtgcgccatttggaagtaggtttatttatagttagttaggcccaataattcgtaatatataatctacgatgaaaaatgtcgttattaaagtttctttataaataagttttattatagaaagtttttattacagttgaaagtttccttgtggaaacttttccatctttttatcggaataagatgatgtttttttctatagatgaagtccttttgtctttctatatttttttttcatatcacgtagatcaaaatttagcacccaaaatttatgaacattaagtccaaaatttatggacaaacatgaactcataacggaacttccgatttgatattcgagacagagagttgcactcaggattttcgcgttggattaaaaactcctggttttaaattcacactgcgatttctaaaaaaagtttaggtcggttttacatatatttaaggctgaatttaaaggaatttccatacagatacgagaaaaaaactgccctcctatatggctaagacatattgaatacaaccaatcaattgcgaaaactaatctaccaactttttcagaaaaaaatgtttataacaaactatatactatctgtataagttttagtgaatttcttttaaaaaatatctgggaacttccaacagaaagtcacaaccaaagaccaaccctgtgaatcaaaataaggctctgtttagttttcaaaacaaaaattttcacgctgacacatgcatggagtattaaatatagtaaaaaaaaccatttacacatattgcgtgtaaattgtgagacgaatcttttaagcttaattgcgtcatgatttaacaatgtggtgttacaataaacatttgctaatggtggattaattaggcttaataaattcaactcgcatttgctaatggcagtttaattaggcttaataaattcgtctcgcagtttcctgatagaatctgtaatttattttgttattagactatatttaatactttaaatatgtatctgtatatccaatatgacaaccaaatctaaaaattttctcaacctaaacatgtttaggcctaaccaaaggagagtgagagagtcggatagaccgaaaatcaatacaaggaaacagtaaacggagagccggagagacgataaacggtttaacctgaacactttattattcactcatgcaccgatacgtacactaattcgtgggagacagtggctagccggagagctagcaaatgcaacaccccgatactgcgaccgtgtgcgacgacgactgacggcgaggacgctatagtggactctaacacataagccacgcacccgcacggcggcgctcgatctggctgtctggctagttcttgaggaggtagtcgtcgaggtcgtggaaggtcttggcggcggtctccttgatgacgtccgggtcgggcacctcctcgctggccttgtcgaagtccatggtccagctcaccaccgcgccgtcggcggcgggggcggcggcgccgcccttgggggtcacctgcagcgtcaccctgaagttcttgtagaagctgaccagctcgccgtccaccacgctgtacgacaccaccttcttctcgtcgtccgccacctccaccttctccttcgcgaacgtcaccatcggcaccccttcaataaagttcatacatcgatcggaggcatcattcgtaaaaatgagagttggccggagagacgtcactctaaacattttttttaaaaaacaatatgaacgtgttgagaattaaacacgagattttttaagtgcatattaccttcggtgtacttgaggaggcggacggtgccggcggacttgccgtcgccctcgacggtctcgatgctcttgtactgctcggggaagatcttggggaacagctccgtcgagtcgcgcagcgccgtccacagcttgtccgccggcgacttcacctccaccaccagctcaaccttggacgccatgatctctctctctcccttaatctctagctcacactacctaccagctgatgaatgcgaatgttaattgcttcttgagttctttgttgtgtggccatggcgttagagccttattatatagccacggtcagctgctttgattgtggggagctactaccgctgctggccattgatgcactccggcgagatccagctacctatcgcagcacacaatttatggcgtcggtgcagattgatgtggtacaagaataggtaacgatagaccgggaacgtgttggccggtgcagagagccagagacttattactgttaacgggtactcctgtcccaaaataaaacaacgttggttggaatgagggagtacgttaatggtagtgtgagagtgagagtgatactgattgtgctggtgcgatactgggattcttgatctgaaaatgcgggtaataatgcctgttcggtttgccgttggcaacagtgatgcgggtaacagtgatcggaagtactccttctagtaactgtctgaactaaccagctgaactcaattccatgatttgcatttctccatctctcttccgtataccaagtgaattggcataagctttctagcttgcttggctgagggtagtttagttcctaaaacttttttctaaaaaaacatcgtattaaatctctggacacatgtatggagcattaaatataaattaaaaaagctaattgtacacttaaaagagaaatcgcgagacgaatcttttgagcataattccaggcgagttatgaaattaattttttcattcgtgtccaaaaatctcttacaacatttgatcaaacatccggtgtggcacttcgaaattttctttttcacgaactaaacaggacctgaatcaatgatgtaaaatggtgtgctacgcatggcaggaaggttcagaatattcagagttggtatctcggttgcagcttgcaggtggttgaagcgacggagatggcaacgggtgatcagatagagaggttccgttcagaacgttgtgtggagcacagagaaggttcagaagattcagatttcagggttggtatctaagcgacgcacagttggcgtttatccacgtggacccgtttcaaaaaaaaaaggaaagaaaaagaaatcgcttctaatctctacacccacctccgcttccgctccgccgcgccggccatggccgccgcgtccgcggccttcctcctcctcctcccggccgtctccccagccgccccgacccacccgcgcctcctcttctcctgccccccctaccgctcgcggcctcgccaccgggcacgcctcgcggcctctcggtcgtcgtccgatggcgagggcgacggcggcatcgtcacggggccagcggggggagggggaggcggcttcctctcgccgcgcgcgctgtcgcagcgcgacgagctcgccgccttccgctacgcgcactccttcccgcacggccgcctcaccgtgcgggcgctcaccccggcgggcgacgacgacgagtccgacgcgctcgtccgcctcctcgcgtcgtccttcgccgagaacgtcaggtgggcacccgcgcagcggtacgagcagctcctcgcgttcgtcatccgccgctacctcttcgagcgccgcggcctcgccccgcacgccgccgtgctcgtggggtactaccgccccgccgccacgggagacggggatgaggaggagggcgagggcaacgaggacgacgacgactacggggagatggcgtgcacggcggaggtgtcgctggacgcggtgggcgcgcccggtgccccgcccacgcccacgccgccgcttgacttcccgtacatttgcaacatgactgtcaagacgtcgttgaggaggtaatggattacaccatcagggccatttccactttgtctgcaaatcaaaatggagtatgctatgctgatagattttgaggcgagagctgagttgccaattgagcttccttagcatagcagcatatggttgcgttggatcaagcattttcccattttcgctgattattgcatatgcactaaataatttgaggctccaagtagcaaccaaagttgttctgtggacatggtaaatcgagaaccagtgtagaagggtttttactatacaaattgtcatactttgcttatataaaatgcaatggccatgatttaattttacttgaaagagagtatttgtttggagaagattggaagtattgttcattatgaaccagattcctgaaaaaggaaaaatgcatgagagttacccatgtggcctagttctagggccatggctcttgcacgtgacatctaatggttgaactcattctcttttcgatcagagatagatgagtaagttgtgaaacctatggttttatgccatcaggattaattgttaatctatataatgttttgattatgtgctttataaagtttttattgtgccttgtttcttcccattaggagaggaattggaaaacaacttcttaaggcatgcgaggatctgattatcaagatggatgccaaaaggcacgtatatctgcactgtaggataatcgaccaagttccattcaatatgtacaggaaagcaggatataacattgtccagactgacagtattttggtttggctgagcctccaaaaacgcaagcacttgatgagcaaggaattactgcaaacttctgttagcagcaggagtacagccaaagattttgatgataacaaattgacaagctgagcatggtagagaaccatcaggtattcataagattgaattttctgtatagctctatgtttctatttcaccactaatattttcatgtgtatattttttctgttgaatatctttatgataaaactagctaatgctgatcaagtggccatcagcccagcacaaaatggttatggaaaccactaaaatgttgtagcccataggctctcgctaatcagaagtgatttcaaactgcaaaactctgcttgttcaaaaactgaccccagatgggtcctttgcttttgccttcgacatagagaactctaatagttttatgtctaggtcatcacagtgatcatatttcgtatgtcctattgtctgaatctaacaaaagttcctgcaaatgagaaaaataggtgcctggtgttgtcatggtaaaaagtaactcttattgtggatgtgatggattggcaaagggccttgtgtcattgatcttccaagctgttcttatatttgttaagcacagcaagcagtagctcattccacatatcaattggtcctggcagacaccaatgcgaacaatcactgtaacccctcatccactggttattccaatggatacctgggtgtgcatcaggcctcattgacatagctttggttatatctataatctctattttcacccctcccttgccgttgttcttttttgttctatcagcctcttcaacctgtgcatttcttattgcccattcagtttgatcaatcattgcttcctctctcagtggttcagttctattgcaagatcctccagtattccacaaaccattttcaaaatgtgctgatgttgctgttcttaccactgtcaattgcaatctgcactcctggctctctttcaaattttttagcgctgttcgaaataccctctgaatagccatagggacactgaagcttgtgatgttatcctctgagcagtatatgcatccaatgagctcctcaccttcgtaaagatagtttcttctgaagaaccaacgcgaggtggatatgactaaaatattgatctggtgtaagtttgtagctaatcttggatcaagtttatccaagtgtatgtcatgctcttcaactactgtaccattgatttgtctttgagaatcttctactatgaatttggtccaaagaaccatgagtaaagttatgagacctgaagttccaggtgacaaatttatctttggtgtcactactaactctgattggtgcttctacctggaaaagcttgtagagttgtgtcaaggtctttaatcacagctatctgataaaatttctagaaacaaaggtacatgaagtagaattgctgtgataaatcagcagatggaagaacttagtgtaaattttatgccccatttttggcataaaatatgaaagcactctgttataacttataaacattattgattccgggttagcaatgtaaataaaatccaggcctggagctgcttggtccatatttcataattgtgacctacaaatttctttggagaaaattatttcataattgtaacctaaaaaatttctttctagaaaatacatgaatctatgcaaagatctatagggcctcctgcaggtgtgatgcctgtttaaggtattctcttatattacaccagtatatatattttttattattcagtggaaa

SEQ ID NO: 49986 - DNA, 1776 bp, Oryza sativa
  unsure (1)..(1776): unsure at all n locations
ttttggatgctaccaaaatgtgccctaccaattaattggcaacccaatagtacttggctagagttcggattgaagctatttttttgccaaaccaatgtgatactctaccaatttgttggtagtggcaaaacttgcctaaatttttacactaccaacaatttggtagggtaaagaaccaaaatgaacctaaaaagncaagttacttgtaattgtggatcactggtgatataggtttacgcaagttaaaagcaagtcttcctttggttacacatttagaagaactaaaacacaaggtgtttacctgagacagtaaacagagcaatgattccatctggttccgtgcaatcgaatccccagcaaaagccaatgtcttccctctgacaatagtcaagaatagatggggttcgaatttttccatggcacaaccatgcggtttccacatccagtttacataatccatttgctttccgtactttgcacagtttnaccctttggcaaacacagttccttgcctctggtatcgttgggcatgttgtgttagtgtaaatcgggcctccaaaatccctaacccatgttccattgaacagattgcaggcttttgcattgtcatgaggacctaaacaaagacaaaatcacacttgaatttcttggataggcaagcttgctgcttttgattatattagaactgatatgctccccgcaaaaaaaaaaagaaaaaagaactgatatgctatcaatacatatcttatttgtcgacatcggaaatatgccataactctttgggggtggattttgcagagttagaagttatgtttccttttgttcatttattttggtgcttgcatcttttcccaattattaatctgatacacttctgaaatataatatgtagattatctgaaaggtaagaaagaattcgaaactacatagacagctaggcttggtaagcattttaaaccacaagattcacaacactagtactatttaacttcccatagaactgaaatttaagttgatgttgtagagtgaactagtatcttattatgctgccctttcgttcatgttccaaatgtacaggtggaaagtgtaggaaaaaaaatttaatctgacacataaatactccatatgttgatgaacaatagctttccaaagaatcaactgatggtagaaaaatggcacacaaaatgtaactataatggcagttttttaacccccccctccccccccgaaaaaaaatatgaagactgagagagcatactgttgatggccgtctgatgagagttgtgtgctggcattggagggtaaaggaaaatctgctcaggagaatatgctgagagaacaagcacaagtagcactgagagcagcatcattcctagtgtttttcttccgcagggaaatacatcgcttgcatttcgaatgtaatttgggccatggagatttggtggagaattttttcccttagccatgagcatagtagagcttatactgcatcatggtaaaccagtttgcatcatcacctatttgtagaagggaaacgggggcaagaggtgcccaggtatgaaaatttgcaccattgtaaagttgactgatactcctacacttattgggactaccgtgagctacaccatgttcgatggtgtggtagatagaatataagatgaattcaagctttggatcacttaggaatcaatcaaaacggctattttatagtacccacctagatgttttcagtcttggagaccgaatccatgtgaaatttctatcagcgtattgaga

SEQ ID NO: 49987 - DNA, 7032 bp, Oryza sativa
tgttggcatgttagctactggagtagtgaacgctgaacagggtaagatagacagtattgtcgaaaagttagaatttttactaatggagccttaaacagtactgtatttgaaattctgttatatggatctcttttaatcaagttagaggtctctgcaagaaaattcagttcgtcgcaatggtggacgctattgtttttccatttcttttccttgggtggtgctcctttgacctgcaactcttaatgcaagggactggaagctcaagatgataaacttataataaggaaggagaagataacaaacaaaaaatgttgttacagctctagtaccaaaacagagcactccagtcaatgtagcacgaactaacgtgcgttcccattttaatagctactttgtccatcctaaaatacttgttaggtagatataatttagtacataaacttataaaatacttatttcagtgaacaaatttgtctagttcgtgcgagctagaaccaaaatggctttgcaaggttgattttaccaagctgatgttgattggaatgtgatatgtatacgtggaatgagtatgcataagacaatctatatttataaatttatcctctactttatccttcatatatatctaaccacttatcattgcttgggtttatatatgtttttttaactaaatcactatatcacattctatctttttattgaacatatgtatatttaaatagcaacatttctttgatatatgtttacgcagtatcctaattagcacataaatcacatgaataatactttatgcataacttacctttttaaatcctgttataattttttcaaaatgttagacactgaaacccacgaattgattttttttttaagaacggacgggagtatgtagccttgtacgacatggcccaggctccagagccgctctcccagagcagttcagcagtgcagtgcatcgcacgctcgcacatgcaacatgctccccagtccccctggcgccttccctctccctctcgcctctcggtggaatgcagctcagcacctgcacccgctgcgcacggatcgcccagccctctcgccccttctcccctctcgtacgctcaccggcgtgccactcaccaaaccccctacccgtacgctgtgtgtctgtcttccccgcgtgtcgcgttgcacggtgcgcgagccaatgacactcaacgcttgcccgtgctcgtgcctgttttttttttcttgtaacggacggttggatggtggagtgatttgtcctctgctctcttgttcaaaagtcaaaactgaaggatactagctttgcacaggagagtgtggtgcccgtgccctacgataccgggtgttttgtttagatgctacaatttgctaaacttatggctaggcattttcatcaagtaaaactagtgtttgatttgttgtcacatttgtaacatgcatcacaccttttcttacgcaaagtacttaaaaacttttaccataacacatcacacctgtggccaacagacgctataaaaacaaagggttaattagatctatgtcattgcaaatatatcgcactagaaaaataacattactattcatgaatcggttgcatgctactgcaatattttaaagttagaaccgtatcactccctcacgatttctctccatccccatccctcaattgccacctccacttcttcgtctttgatagcacgatgccggtcgactcatcatgctagtcgctagtcgtgtctctaatagcacaacgccggtcaactcatcgtgctagtcgctagtcgtgtctctaacaacaacgaggatgcgtagcgtttcctcctcaaccaagaggaggagcagcagcttagaaggctcttgtccacgagcaatgtcactacaacgatggcggtatcttgatcaagttagactagtgtttggtttatcgccatagttataacatgccatattttcttggcaaaatttgctacagaacacgcaaaaaatatgtaattagctgggagacaccaaaaaacgtgacatggttgatggccactacaaaatttgtgtaattggctatagaacactggtcgaattattttattatttccgagttccatcgttttctccttcgtcaggaatgcgcgtggtggggcgaggtcggcgtgagcggggtgagcgcgagctcaacggcagcagtagggcgggtgaggaagcactggctcgcgctgaggagcggggcgaacctattcatgcactcgctgaagctcgatgagccggaaaagtccgtcgtcaagagctggcggaagggcgccaacccactcccgcctcgctgcaccgtggtcgtcatccggttccgtggcaagtcccgagtcctcggcgagggcaacggtgtggtgactcctctgcatgtccctgcctccggttacccgatgatgagcatggacgagcagaccagcctcagcttcgcgctattcaaagacgtggcgttcaacgccagcatccgccgcggcgtcagggcctccgacgtcgcttgcctgcccatctccttcggctagtagggcccagtggaggaaaactggtgactcatcaagagccagtgcttctcaaccgagggcaccgccaacttctacatgcaccccatcgagggcctcaccgtgctggtcgacatggacacggcggaggtcctccatgtctctgaccatgacgccggcatccccatccccaccaccgcaaacaccgactatcggcacggacactcaacgccttcgccctgctcctcagcggacacttagcgtgagctcgacagccgaagcgggggccttccccttcccctcctccttctccttctcgccctgccacccgctgccgccgtcgagctcctgccccgctcgtgccgagctcaccgacacatcccccgcacgcacggccacggtcggcgacccctcccccaggcgcagccagtgaaacctcctgacctcccttaccgcggctgtggtaaagcggtaccaaaattaggtgtactccattatggagtgggcacgttataaatccgccggcgtggtctgtctcggtggctcagtcggctctatagccaacaaagcataagggaaagaggctcagttggctctataaccgggttttttaataggtgttatttttttaataaaattggcacttctaatataaatataggtgtcggttttaaaaaaatcgacctactactctgtaaaaaaaaacacaatggactttttctttttaaccattttaatgcacgaggagttttgtatgtctcagcaagaagagaacaaatctaccatctaaatagccaatacatataacaacataacaaacgatatgcataatctgcacactaatttgtacatctatcgaaaaagcatttatcgataatccataaatgtttgaggcgattttccattcgtgcatgcatccgtgattctcatcgactaggtgtgaacagagaaaacatgtgcaatcaaaatcgataaatataatggcatttataacattactataacatgaaaaattctaatttatatcaatgaaacagacatccatttaggattaatgaatcagattttcatatgtgggctaaaaaagttttttcaattcttaactaatttcagttgttttttcatttacattattagttttagcactatttgatccactaaaaattattgtaacttatatttagctaacttataacttttctaatattgaattatcgttccggacaaagttatttgtagtttcatattgttatttatacgtttttatttccttcatcatttatgtccaactataatatatagtttaggattttaatttatgtcaatgaatattatttagaacccgttgcaacgcacggacattattgctagtcttataatatgtatgagtaccaaaaacaaaatttataataaatagacaaacaatcctttcagatatcatgtctgctactccctccggattgataaaaaaaaaacaatcttcaaggtgcaacaaaacacctgggtgcatgttggcgactgttaaatgccaattttatgccgccaatacttacgtaaatcggaaaagtatgaaacatccaatatggtggtagggtttaattcaaacaatttccacgagtgttggtatatatttgtataccggtgacaaactaccaaagttgagacgaaatacacataaaactggaggagaatttcacccattgagtttgggcccacaaactcatcgaaataccacaaattaggcccaatcaatacaccaatggcccaaggagtcttttgccaaggcccaagaaaaaagccaccgtcaggggagctggccagaggtctcttagttcctattagcatactggaatattgtgcactagaaataatgtttactttagtgtttgatcgacattaggaatattagagtagtatctaaatagtgtagacttggtttctatatattatttaatacatgtatttgcagcgcatcccacagttcgttagaggtagatgtagaggcggtgaccgccctcgagatcacttaagttctccttatccgaatacggagtagagcacgatctggtagcagcgagcaagccagtgcctgaagtattgcaatatgattaaacataagctttctatagaccctatacctcactagaaattatctctaccttttgcctacatttttatattatgttcttggattaacagtattgcaatatgattaaacttaagctttctatagaccctatactcactagaaattatctctaccctttgtctacatttttatattatgtccttggattaacctggagaagagttacatgttccgcgtggaaatcaataacttgaatatgattttatctgtgatcgtaatatcaacagtgcagctcaaaacaaagttatttgttttctgtaaacagggggacccaactctacaactcaactctaagctgaaaattaatgtcggtgcaaaataaatcagttaggccttaatgcaaaagaatattttgtttttataaatgagaaaacaaagttcaaacaaacttaagaaaaacaaaccgtgacaaaaaaaagatatttgaagaattgatacaagaagaatgtaacgccccaggtaaccacgtacctagagtgccacatcaaaatactctcaaaactactaactcccaaaataattagaaattttggtagagtctctcctataaatatagacatccacgtcaggcagttatagattaaactaataatgacatcgttcccatagtgctacccatccatataatccatggaaagaaaccaatagatatttaatagattattacaagacaaaaccaagatatagtttaaatgtcattatggacctaagcagtatagtttgatagtgtgcaaatagatatgtatataagggtgctactttctgcccatgcatgccaatctcaatgtatacctaaaaaacaaataaacataagagtgagtacagaaatactcagcaagtacagtatgtaactagaaagcacatatacacatcatgggcaatagagcacgaatagaaagcttcctttctttgataagaaacacaatttcaaacaccaagtcaaagaaaatagtagttcccattccgggcagacatgaattgaaatagtaatttctatcccggacaattgtgaatacatcctagcatttgactttaaccttgatggtaacctgacgtaacactctccacaaaggatatttactaaaatcgtaacctagaacatataaacttttaccgatttgtattaaacaacctatagcagttccattactattttatacgtaactcgcaaaccgtttaacggaaactagcaaataatacaacttcagatatctagaaaaaattgtctacaactttcatgttggcaaaaaaatcagattaagccaatgtaggtctcagataagaaaaacaaatttctgtccctattttcagaccggcagcagtactgtttttgctgtttctcctaaaccgtttatcggattcgagcaaaactagcggcgttaaaaaaatatcaacgatgactacaaactttatttaggacaactgacctgaataccgatggtttaacaccagatttgaaaatacggtttcagcctagcgttcgaaattcgaactaccggtaacagatcgtcttatatatataaattagaaacaactagggactaaaacggattacctagcagtactaatttgagagaaaaacaatgaatttggagatatccacctaattccccaaatttccctcttctatctaatttccccttctctcctccttcctgtttttctctgcttccctggtcgttgtagaagcaacagcagcaaaccacccaccagcagcagcagctgcaacaaaagttggagcccaacgcacagcagccaaagaatcagcaggccacgcattagcaggagcagcagcaggaaacgcagcagcagggaaagtagcagcagctcaccaagaacagatcaaattggcagcgaaggacgacgagggctgcggcaaccggcgacggctgcaccggcagcggtggcgcagaggcggctggggcgcaggagtggtggcggctggggcgcaggacccttttttttttttctgttggttatatagagagaggttaaagaaaatcgaacagcccacattaattcgatcaccggaaataccttgggactccgattaccacaaacttagtctattttgcactattcagcgagctctatgcatccacggtccctgatcgcctattcaaacaacggtttaaaagttgaacttttgcgcgtttgttttaatatatcccgaaatacactaattcgaaactcggggtattacaaagaacatttcaaaaatcaaggaatccaacttaatgtacaaaatttaaacttatggaataaaagtgaaacgtcaacggagaaaccaagaaaatgttcgtgacaagcaatcttcgatttccgtaaaatcaataagatgcaaccaaatggagacgtctagcc

SEQ ID NO: 49988 - DNA, 3178 bp, Oryza sativa
ccaatcctccccgtttctcgtccgcgccgttgccgtagccttccgagctctgtctcgcctccgccgttcatcgccaagcgcagggagagccggtgcgttcgtggacgcggaaggggactccgggcgctcgtcttcctcctcttccccggcccgaggccggagagattactcccgcgccgtcggcctctcgtcactgcgccccgcccgcacggtagtgcctccctccgttcttcctcctcgctccatctcccccccttagttttcggtagtagcttgtgtagcctccccgtagctagccggcgccgccccaaccgttgccgccgctcgccatgtgctcgccgccgtcgccgcccgtgctccgtagcacccgctcgtcgccgacctcgctcggcgtagctccgcccaatccgacgctagcaacggattcccgtaaccgcgtagatgctctcaccgccgggaattggcccctcgtgacctcgtcgccgtttcccccttttctctccgccgggtgccgccgccgcaatccgccgccgtcgagcatcccccggcaaatccgagtagttggctcgactcccctcgtcccgcgcaacttcccggtgtgctcgctttcgcctagatcgccgtgtttcgcttcgccgcttgccaccgccgtccgccgtccgttccggccggcgtcttcttcaacctcccgccggcccgcgtggctgccacgtaggcgccacgtcggcgccacctcgaccgtgaccggatcagctgacccggccagccgctccctccgtttcccctccctcgcgcgcgcggtccaccgcgagctgtgaggctgcgcgtgggcccgccgcatccgcgtcctccgcgaaccgcgcgcgtgcaccgcgtccctcccccaaaccctggcgcgcgccgcgtgcgcgttccgcacggtgaaccgtgtcaccgacaagcgggtcccactcgggaccacgcgaggtgagcccagtccaccggctccctctctcctcccctcccgcgcgcgcgctctgggccgccttcttgggccgaccggcccatttagctcggccgagccgccccttttctctcgggccgcgccctagccgcccgagggaagtctacttcccctccctcttccttttctttttccaaaagggtttaaataaatcctttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccggttgttgagttgtcccgttttgcgtgtagtttcggagcccgaagacccgcagtgcgaggatttcgagggtcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcggacctacctaatttattgcatttgatccttcctttgttaattgttatagtcatgtccccttgtaaccatctagttgcgtctcgatattcgtgcaccctgtgcgaatatcgacggacgccttcaaacttaaaatctgaataacaacttgggtaaaacttgggttttacaaaagacttggaaaacccgacacctgggtcggtgcttgcgaactaaataaatttcgaaaaccgcggaccggggaacttaccgggtgtacggtttcccgctctcgcacttaaggaccgtttccttggaatttcatccaaacgtaagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttagaaatgccttgtcatgaaagcttggaggtctcccgacgtggctgatccccacgggctgggtgatccgggttagtaatgtcgtgtgggtaaagtgtacctcctcttcagaggttaacaaactgttcgaacagccgtgcccacggtcatgggcggatgtgaggtgattcctagcacagttttgtttgactactgcttgtgaaattgctgttgtggaaaggggttcgatgtttgaaaaatctgcagctgatgggatcagctaggcccgggtggccgtttgaaagttgttggcccgggtggccgtttgaaaagctgttggccgggtgccaaccttgattcaattctaaagactgatacattgcacaaactccgaccggacgagacgcactgtctcaaccgtgttgtttgagaagcactcacttagttgtttttagaaaagagttcaaataaaatcaattgcaaaaacaacagcctttctttgaagcctgcattaaacacttatttcccatggcttgctgagtactcccgtactcacccttgctctatataaataaccccccccagttgctgaagaagatgaagcggatcctgctgatgagaagttcttccaggagcaagccggctacgatgagttttagggtttcggcctagttcccaagtcgcgcctgtgttgattggtccaagtcctggcttccatttcccttttgtaatgcagttgtgagctcgggatctgtccgcagcccaacatgactgtatctctactctataataaagagacccctgttgctgtgatattctgtctccctgtgataccagcactgtttcctgggactggtatcgattaacaggttaatttggagcgtcacaggctagttccggtcggtactagttcggggcgtgacaacttttaatattcctttttctaatccaaaatttcaatcatttctagattatattctgtatggactcttatacttttatttcaatattcctttttttaatttcatggtatttataaattccggattactgttatttttaaattgtattcctatttggaatctattttttatttttttcctctttttctccaattaatatgagaatttctcgaccgtgagagtgaatgtggaggctc

SEQ ID NO: 49989 - DNA, 736 bp, Oryza sativa
caacctaatttggaagccctgggctcctcgcaaatgcaaaaccttcgcctggctggtcattcagaatagagtctggacctctgatagactatgtactcggggatgatcaaatagatccatatgtcccttatgtcgtcgggtccaggagacggctctacacctcctcgcaggctgctgctacacaaagagaatatgggcaaccctagcggaatggacggcgtgcaacaatattcaccccaaccattgacggcaggcttcgtcggtgttagaatggtgggatcaaaccacaagtgtaaaagaggcacccaaaaaggctctacgctccctaacgctcctagtcgcctggttgatctggaatgaaagaaatcgcagaatattccagcataaggagctcccaccgagtggtcttctgacaaaaatcaaggacgaggccgagtggtcttctgagaaattggcttgttccttagttgactagggccaaaggtcctgagttttttcttttccttttcactgtacagttttctccttctatattcaatgaaattggcggctcgccgattcgttaaaaaaaaaaatcacgggccagtttcttgctcctcgtccagcaccgccctatcgggcaagggtggcagcctgcaggtactacaatagttggagctcggcacagggctatgcattggctgaggtggagtccatgcgggcgtcaaggccgccaccatcgccgctagcacatttt

SEQ ID NO: 49990 - DNA, 7740 bp, Oryza sativa
tgctcactccaaacaggaattgattgaagttatttcgaagtctatgaaggagactagtgagtgtttcttaacctcactgcgattaccttgtggtcgccgcaaacaattggatgatggaggaggacttgaacaccaacaagaagagctggaggtagaaagttctgttcaagaattatgctgttgaggttatttcttggaatgtctacagaaagcccaacaatattattatttcattatagcatagactatatgacatcactgtcagtccgcatgttgtgttttgtaacaactagcaattgtatgcttttcttgtcaggaacctttctctaacaagtattaacgaaacaatgaaccaaaataacacttttgacactcctctcatgaagacgttggtaatacttttaacaagtattactgtgtacttgtactgactatgattattctgttcaaatttgaaatgtgcagaagctaaaagtgtctttcaacgagatgaagcttcaagttgaatcaactcgatctcagtgggaggaagacttgaggaggctaggtgagtaatggattcagaaatgttttagaacattttgtcctttgatcgctaaacatttgcttaatattgcagaaagttattttgaggctcataatcacaatgcttaccacaagttactcgaggaaaatcgtaagctgtacaatcaagttcaagatcttaaaggtaatatgcgaataaattaacttcatttcactaacagtgagatatttgtactgataaattgaaacatcttttaggtagcattcgtgtatattgtagagtgaaacctttcctgaaaatgcaaactgatcaaagatctaccgttgatcatattggggagaatggtgagataatgattgtgaaccctcaaaagcaaggaaaggaagggcggaagatgttctcattcaacaaaatattcgggcctaatgcttcacaatgtacatcatcgacatttctcattttttttcatttctcatttactgcaaattaattgcattccatcttgtagtttctaattgagtgatgacttacaagatagttatgcatttatcccaaaagttaaacagttcattgaaaatatgactatttagttgagtaatgcatgataaaaattgcatacggtttcataagaaaagaatggtgcatattttggagggctggctgatatttattttgagagttatagtttgacttttttttttctttgtaacagctgaggtttttgctgatacacagccattgatcagatctgtgatggatgggtacaatgtatgcatatttgcatacggtcaaacaggatctggaaaaacatataccatggtaattctttgcaagtaaatgtactaaagtttcaataattacttttgtgaaaaattctcaaatcaatgaatccaatactataaaaaaaataaagaaatttactgctaggaacaataataaaaacagatgctcttttgtatgctacttgtctgcattaagcttcaatctatttgtatttttctttctttatgatgttgtaacatatctttgttgcatatattactcagagcggtccagatattacaacagaggaaacctggggcgtgaactaccggtcacttaatgatctatttgctatttcgcaaaatagagcagatactaccacatatgatgtgaaagttcagatgatcgaaatatacaatgagcaagtgagagatctattgatggttgatggtgcaaacaaaagatatccttttggttgcaaaagttattttttctcaagttgccgattgaaaacattgtttcaaataagatgtttcctctatgaagttacttgcaaaaatcttctatatgttttcacatgaaataaattatcttttattgctctcagcatcaaaaaattgtttaacaatatttccttccggggttgttcttaaccatgaacacattagagatacgaaacagttctcatgtaaatggactgaacatcccagatgcaaatttagttccagtgaagtgtgcacaggacgttttggatttgatgagagttggccacaggaacagggcagttgggtctactgctcttaatgaacgaagtagtcgctcacacaggtatcccaaaactaatgcaaaaaacgacttcctctcagaatgtcccttctccctagtataatatctttgcataatatttttctttcatcgtctgagcaacaggcatactcactacatactgtaattttgttgctcttctgtagtgtgttgacagttcatgttcaaggcaaggagatagcttcggggtcaactctaagaggatgccttcatcttgtggatcttgcgggaagtgaacgggtggataagtccgaggccgctggagaaagattaaacgaagcaaaacatataaacaaatcactgtccgcacttggtgatgttatagctgcacttgcccaaaagagctcccacgtcccataccgaaatagcaagctaacacaagtgctacaagatgccttaggtatacagaatctcttaagagcctggatgtgtttcatcaagaatgccagctgattatgttttcttgtcttgtgatgtaggtggtcaggcgaagacattgatgtttgtccacatgaatcctgaagcagatgcttttggtgaaacaatgagtaccctcaagtttgcagagcgtgtagccaccgtagaacttggtgcagctcatgctaataaggaagttgggcaggtcaaagatctgaaggaagaggtatgatattgtgttgttttaaatgttacacgatcatcatcggaactttgtttctgtaactcatggtgtgtaattgtctatcagatttctaaattgaaattggcattagacgacaaggaacgtgaagcatcaaagctaagagatatcgcgaaccgtgtggcctctgaaaagagaaatgcaagaacgaggtcacctctaaccaccaccttgtcctcgaaacctgaagctggtcaggattccagtgtagacacttgtacaagcgaggtaccacatactagaagcagtttcttgcaagttacattacagtatacaaaagattactaatttgaacatatgtctaccttgttccatttgcagatcagaagctcatcatctggaaagcagagaaggttccgctctccattgtcagtgagagaactggacgagaagtcacctgtcatcaaccgggagttatacttgagtgccaagttcaagactccatctcctccagtaagaagttcattgtctgccgagagagttggcattgccaaaagcgtggagaggtctgaaaacatcgactgcacaccagtatcaaggattgaagtgcccccaaaagtacagcacagtagctctaggaagaccccttcatccgtcctgacggctcaaagcttacggaaattccgagactccgaagaaaatagaagcgcaaagccatcggtccgagaaagcatgacaaaaaccaggctcgacagtgcaacaaagccgcctcagaaagaagagcaaactgcaaacaagaacacaggtactagagtgaggtcagaagccaagatccccaggaacatatctgacatagaaaacgagtttgcaaacagtgagcccaccttccattccaaccgaaaggcatggaagctcccaccacagtccacaagacagtcgcagagcattgatcttaggtactaagattcttcactggtaacaacatgacatgttttccagttttcctgttgcatacaaatgcatctgtagatgtctctctctttttttttgtgagttcgcttacaaagatgtctctctttttttttttggtttgggttgtcacttttggcagagcctctgtccgggagatggaacctctgactgaagggaagcctcgccggagcaaggcgccccacggtgatagaaccaacgtccccttaccggagacccggcgcagcgtctctctgccccgcgggaagatggctctcgtgtgaaaaatctagttttttcgtcaggcgaatttcattgtaccctgtgatccggctatatctgtaggtcttctacggctgggtagacgaacctgagaggaacacaatcattcattggtttgttcttttttttttcctttcatttttgaagttcgtgtgtctgtttcgtacgaacctcacgcccttttgtacaatgtaaatgtagcaattgccattattatatctcattttcagtggcgattgccttattggaagctgaaagcctgaaaccactagcactttgtatcagtatcaccgttcgtgcagatgttcggagttctaacaaatgatttgctcctggtctttgctactgcagtgcagcagactacaaggcttgaaaagctagtttggttttacaaattttgctatcgattttatattttcagcgaaaagagagagagtttgttttttttttcgaggaaaaaagaactgtttacccccgtatgagcttttgcagttgcagccttgcacctccctcccattaacttgtcctcgctcaccaaggtgcccacgtcgctgcgcgcacaaattcgggccatggaggaggcagcggcgccggagcggaagcggccgcgcgacggcgacgtgggtccatcgacggcggcatccggggaggcgcagtacgtgtacctgcccatcgccgacgcgctgaaggcccccggggcccgggtctgcctcttcgccgccgtctccgagatcggcgcggccgtccgcagccgcggcaccggtgagcctccttctcgcccgcactttcgagtcccccccccccccccccctgagagcagggtttagggttttggtcgctatagcggatttggagctgtttggggttgctactggactaataattttcagtgctcaaatgtgctcggtcatggtgggggagattaggtcgagtttccgcacccgatttgcgagctgttctgattgtaaatgctagggaaagaggaagatgtggggttttaggtgtaggcctatagccatgccgaagttctgaacactgaacagaacagggtcatttttgggggatttttgctgttaattggatgaagaagcaaacctggtgagttctaatggctgtatctgaaatcgccaattatagatgagcttaccatgttccaccttggaggagtttctttggttggttattgagctcaattgtgattatattcttatccatttgctattgcagaaatgcctgtatgacaggtttaacaatttttgttttttgttgattcttttgtgattatacctgcaattgacgtcgtgctacttatccatggctatcatttgtgcagatttcactcttacgttgaggattgtggatcactcacgtgcatctgcaatctctgtgaccttctttgctgataacactgcattactgccctgtgttaggtcaagtggagatgtgatcagtctccataatgttgtggtacgactgaaactaaacactctactgaaatgtactatttgttacattccatggaatctttatattatgtctttgaaattacggtgaattatcgtgtgacggtcctcacattttctaactcggaattgtatttgcatacttttcttcaatgtcttccattctgcagataacaatgcaccatggcgaattctttgtcacatataacaaaaggttttcttcatttgcgctatttgaagggaaagtatctacgggatgcataccatatcagcattctatgaaataccatggcagcaaacatgacagtgaatttttgactcacttgagaatgtggattgtatataatcctccaggtgagtatgtgactgctagttgaaaaattattgttgctcatttttctcttgtccactcataagctatacggatgatatgtcttgtgaagttgtgatactccaaaactttgcacatctacgaatattataaggaacaacatgcctagaagctcctaacccacatgagaatatgttgttatcaattcctgattttaccagttgctgtgaacatacatcgatatatgactcatatacaatcattagtatacaatcgataacatactctcctttacccaaaagttaagcattattacataaacacgtgtacaatagaacacccattcttttctttacaaccttaggacaggatgcctaggtttcggtcaaataaaataaaagccttcaaattggttgtcagctctacatttctttctaatttttttaaatttttggttgtcagctctttagcattatcatgttttattgactgcctgtcctagcagtacctgttgagtatatgattcacctacttttggatactcgtccgtctattataatgtggcttatgctcaacagcatctactgatttacgtctatgtattttgcacaaaatgcagattaccgaaatatttatatcttctctgctgaatacatgcactacaaatatctgttgcaacactctttctttttctaacaagctattttgctctctaggtctgaaagatcttgaactgcagttaaggagtataaaatccgattctacttttgatctagtatgcaaggttagctctatatgaagttacataatattcaacagttatttgaatagaggaaatctgatgttcctttttgttaggttctagatgttcatgaagcttccaatggcgtatggattttgtatgtttgggatggaactgatacacctgtgaccgagttcccgacgtaaaaattagacattggtgtcactgtttaatttttaattcagaaataacttaaaattaattctgcaaaataggatggtgttggtgcttataacattgtgttgaagtaaattgtgcctctgccatttctttcataacgtatggcataatatgataataacagttcatttttaactaaattgcgcctatgttgtttggcttggttgaatgcagcttggacaatgaatcagtttctccaccccctctacatcttgaaggagcacctctgccaagggaggttttgtgcacattgccttgtgttgggagtgtgctgagggttttctcaaacaggtttttcaaggaaatgctacacttgcaaaagggtatttattgggccaggttctgtaatatgacgtgcaagcagcagtttggcatgtggaaagggattctgctgccttctagcagagtccgccttttatcaaatgaagatggcagcgttgctgatcgtctgaagtaatcttctgttttctcatgaatgctgattgccatatgaaacttgtttctaagtattaaccaagtgcattaattattacaggctattcgacagtcgcattgccacccaaattcatcgtcagccaatggcaagcctccccaatgcttctgatattgctggtatggacaattgagcttaactttttagtcagtcttgcatgattgctctgagcttattttgttacatggtgtgaagttctccgatgcatgtgctggttgttatccttctaattgtttgcaaggttctagtatcttctgtgcaggtgctttgaatgctatgatttcctcttccattgactaaatttctgttcactggttaattgaattgcataagaacaaaagaccatgccaatctctctcatctttctttttttttaatgcactaccttttcacagatggtgatatctgtctgctatttctgtttcatcttactatacttcttgttcagtggttaattgcttaagaacaaaaattctagcctactaagt

SEQ ID NO: 49991 - DNA, 4879 bp, Oryza sativa
atataccctttcttcaacttaatccatggcaggccaaattttttggtggtttcctgacggcagaagctgtgatcagaaagatgaacaagcttctgggtatcccagaagacaccgaggaaggtgctccatcgaataggaacccaccttggatatggtgttgcttgaagtcttaccgtctggacaagaacgatccctggggaagcagaaggtatcggatttttggcacagagatcagggattgaataggggagaaagatttggagcaacttggaaattactgtgtacagtggcatttgcttgtggtacagacacgcaaattgactgagttgtaacagctaggtgacagcctttcggttggtgctactacctacaatgttactgtgatgctgttagcatttggtaatgccagatgatttattttagtttaatcaaatgaattatatgtatcacataaaacttttaattgattttattaaaattatcaactggcataaacagaatttcctctctcccaatctggaaccctaatagaacaactctttcaggaatttgaaaagaatactagcagcaattcagtactcttcttaacttaaaatatactacctctgttttatactccctccatccctaaatgtttgacgccgttgacttttttaaacatgtttgaccgttcgtcttattcaaaaaatttaagtaattattaattctttttctatcattcgattaattgttaaatatacttttatgtataatatagttttacatatttcacaaaattttttgaataagacgaatggtcaaacatgttttaaaaagtcaatggcgtcaaacatttagggaatgagggagtattatttaacactttgatttttcttaaagccaaacttttttttatctttgaccaaatttataaaaaatatatattaatattttccacataaataaagaaactatcaaaataaaaatgctataaatgttgctatatttttctataaatttgattaaaattttattaggtatgattttaaaagaatcaaagcgacttataatatgatgaagtggagaaagtagcaatataggttcagattgaacacaacctgaactacgaatttaggtaagggacatattcaaattcttaatgaattcagataggagaaatattcaaattcgtagtgttatatttaggataaagggagtaaataacagtataacttccatagtaatagagaatttttcgtaatctaaggctggaagtaatgtcgaagacaatgaaaaaaaaaaggctaaaagcgatactagtactaactaaatgcccgtgctttgctacggttaaacgaaaatgtattaatgtggtgttcatctttttgctaaagggaatgttcatcttaatctaatttttttgtgtttatccatttagatttgaatctgttttaatactaagaagttcaagtggtaacttgcaaaatttacaatggaagtaggtggggtgacagattcactgccaccatcgttaccttcttttaaactactccctccgtttcaagttataagatgttttaactttcgtcaaagtcaaactgattcaggtttgactaagtttatagaaaaaaaaattcgatccaagataaatttattataaaaatacatttaattattaatttaataaaaactaatttggtaatgtaaatactatatttgtctataaacttagtcaaatttgaaacagtttgactttgactttaaccaaagttttataaactgaaaacaaatatagataaatgcaagtagcgtccacttcacctctcttctttcgacgcggatgcggccgtccactggataactcacggacgtctggggaaataactaaccccccgtgccgcctaaacaacggctaacgtccaccccaatccacgcgacgctatacctcgcggttctcccacttctccttcctcctccataaaccgcgaaagaaaatggaagctctcgctatcggatccgcacctccccgcccgccgggcctcgcactcccacccctcacccgtcaccaccacctcctcctccaccgctccaaaaccctagcccctcgccgtttcgtcgccgccgcgcccatggacgccgccgccgccgccgccggccggggcggccccgcccctccccgctgcgcccgcgccgagacggtaattaagctacgatcccctcctccttgccgcctcggagctggatgccactcggagaaaatctgtgagaggtttattaatttgggtggcttaacttatcgttgcaggattcggaggatgcggtcgcgacaacaagctcgccgcacttccgccgaggccgcgggcgcggcggagcagggaacggggccccggcccggtggcggatgccgccgacgtcgagggggttgacgggataaggatccggaggcgccccgtgaccgggccgccggtgcactacgtggggccgttccagttccgcctcgagaacgaggggaacacgccgcggaacatcctcgagaggatcgtgtgggacaaggaagccgaggtttcacaggcacggttcatgctttttttttcctactctccgaggagcaaacaatgtgtgacagtgtgtgtgtgtgagagagagagagagagagagagccagtgtacgctactctcggatgtgaatttctggaaatttgtggctctggcagatgaaggagagaaggccactgtacatgctgaaggggccgctggagaatgctcctccggtgagggatttcgttggggtgttgaaggcgtcttttgatcggactggtctgcctgctctgattgcagaggtcaagaaggcttcaccgagccgcggtgtcctgagggaggacttcgagccggtgagtttggggggatgaaaacacatgctaagattaggtgtatggatctttaaatgttaccctgtatgatatcggaattcacctgctagatggatgtgaatcatagttggtacactatcattgcagcgagtgtttgttttactaagttatctgtagaattttagcaatttaaatctgatatttatttagtgaactggttattacagcctgattggtaacgattgatcaatttatctcctgtcatacaacagaagggtagaaatgtcatggtgactgtccttttatttactttaagggattggaatcgatcatttcaaactttacacacacatattagctgtgcgctcgctgaaatgttgcagaatagtcattgtctttatgttgaataacatatatttataatggtcatagctctatggcattccccctgataccgacttatctcaatcttcaagcaacaaatttttactatgttacatagaatttcatgatgccttccttttatcttttagttgtgtacttatggcactaccactttaattgcgtaactaccagttagtgatatcttcatttgttgacattctgaataaagattcatgcttttgtcttaaagaaacaacttggttacttttcatgtgtaagaagaaaatgcacctaaatagctaactgatgtttgtgggggacaaacaggttcagatcgcccaaacatatgagaaaaatggagcagcatgcttaagtgttctcacagatgcaaaatactttcaggtcagtaatcttttcccttttgacaatttggctactcctctgatgcattacgaaattatgcatgctgaatttgtttccgtttgttatgtaatcagggaagttttgactatttggatgctatacgcaatgctggagtacaggtctgtaaatttgctcatatgttgtacttccacttacagcagtcaaggaaattcagttgtgtggttcgaatgtatggaaaggctcattctcttgaatttctaaatgcagtgtcctctgctgtgcaaagagttcattgttgatgcctggcaactttactatgcgcgtttgaagggagcagatgctgttcttctgattgctgctgtcttacctgatcttgatatcaagtatatgttgaaaatatgcaaaatacttggcatggctgctttagttgaggttagctgagttatttgtgatatgttttacatgtcaaagcacttccaactctcttatgttagctgctttggagtcattctactagtgttgcaacttccaattcattttcttcttccaagtaaatcaaatgcaacctcaatattcaaattttgatttaataaacaagctaaatgtgttctgaaggtgcatgatgaaagggaaatggaccgtgtgttagggatagatggtgtccagctcatcggcatcaataaccgtaacctcggtatgttattcttgtttcacatgtttagacaagttactttggcacatatattatataacaatgtatggattcaactgccagtgtgaccacacaattctttgtcagatttgttccctataagtcactgtggctaagctatcatggtgccacctgaaaacctgttggctcatattgaactagtggcttgtgcattttcatctatcgccacactagtggctcatgttgaagtttctattacacatggttgaaaagtgatttgggaaattatggataaactaagctatttgattcttaaaactagaactagagttcatttataaatctagcattcagtcagtcaaacatgatagtgtggtccgtttcagaactgggcttttagagctgctaatgttatatttcaattcttcatataattcactgcaaattaaatattattgcagagacttttcaagttgatatttcaaacactaaaaatcttcttgagggtgaaagaggacaaactatagctcagaaaggcataattgtaagtgcttctttaacttaagttctgttgaaatacaagagaattc

SEQ ID NO: 49992 - DNA, 2455 bp, Oryza sativa
caagttcagcctgaagtgcaggaaccaaaacagaactacgccaaattcgtaccctcatttcaaaatcatccaatgagccaatgtaccaacggcacgaacgtacgattacaaaactactatcatctaaataattaaaggctgccactgccacggtcctgcaacatgccggatctaaacgtatcgaaccgtttgaaccccatccataaaaaccagacaataaagaaaaggttaaagacaagccgaacaacaactcaacaagcgtttgaatctcctgggctcacaggggaaaaaaaaaacctccagtacagtaattactccaccaccctactgtgccccccacatgcgctggcccaaatagcaaatccatactactcttccgcacaaaatataaaatgtatatagaggtttatatatataggccatgtttagttcacaccaaacttttcccaaactcccaattttccagcatatcacatcacattcaaaactttcctgctcacataaactctaatttttttttctaaactaccaacttttcccaaacttctccataattttaggaactaaacacaaccatatgtattacttctattagaaaacgttccatcggattatattgttccatcggattatattttaagactagcacaacccatttctaaatcatgagagcaagtttaatagtatagcccactgctaagtgtctaggtccaattcatttatagccaatctaataaccaatttataaaatagttgtttcctatactattagtatatggttctacctgtcatacatacattacgtctcgaagtccgtgctgcagctcgctacaaatatgtagcccactaatcttctctctcatattctatcttaataaaatatgtttatatagctagctaatagtctgctattgtatttgctctgagccactccgatgaccaaatcttgacacgtgtgacgatcccgtcggccgccgacgctgttgctgcgccggcctcccgcagcggatggacgcgtgcacctctgcctatctttccgcgctcgatgcagctcggtcaacttcgcggcttgccccctgaagtttcaaaatattactcctacgagttcggggggtgaaacttgaaaagctttgcctcgtggatgccgcgtggcccacggccacaccgtcttcctcgggccccggaagtttttcaaatagagggagccgttgcgcttgcgcagcagccacacggagagagaagggaagcagagctgcgtgcgatctgagtgggtaggcggtgacgtcggcgagctcgctcgggagtcgcggcggcgatggcggcggcggcggagggcgggaggcacgatcaggggatggcgctgcgcaaggccgaggaatccggtgagcagctgttcgtctcttctccctctccccgtctctcgggtgtggcatttttctcgctcgcgcgatctgcgccttgcaatgcgctcgtgctgtgcgtgtgtgtgtgtgtgtgtgctggcgtctggatcattggatggcgtttgaggcgagacgcggcggcgcgggcggtcacctcacctggtgtactgtgctgcctgctctccggcgcgcgtgccgcgtcggcggatgcgcggtggcagcgtgcgagatttgggttgagatcattggtgtgatttgtttagtgcgctacttgttgcaattaaggctcctgcatatggtaagactcttgcatgcgccatgagtgtggttgaagcattgagcattgacctgggtggtttgcgtttggttgaagttaactttgagatgcatttagtagtacacgcgacattctcgtcggtttaatcaataatcaggagttgcatttggtcatttggtaatcgcgcaaagcatggtggaaaaagaaatgcagctcgaattcaggatccccaaaatctccgcctcttctgtttccgattgactcagaattcaaaaagtaaatctgcatcacggggggagagaccatgttcatcttctgcacgaatcgcgaggcaaactgcccctgttgccgatgtggctttccgctgactctgttgtgatctgttgccgcagccgcgcggaggtgcgaggcggcgcgatggctgcggcagatggaggcggcggcggcggagtccctgccggagaggccgtcggaggaggagttctgcgtggcgctgcgcaacgggctcgtcctctgcaacgtcctcaaccacgtcaacccgggcgccgtccccaaggtgcgttgcttaagagttcaagacccaaacaaaaaatcgatcggattggaagtcatttttttttttgaaatttgcaccgtatccgtggtagagttggaatctaacgagtgctcgtttgcggacaggtcgtggagaatcccattgttgcggtgcagtcgtctgatgtggcggcccagtctgcgattcagtatttcgagaacatgaggaacttccttgttg

SEQ ID NO: 49993 - DNA, 14789 bp, Oryza sativa
attcctgcagcccgtctggaatagaacaaaatctgaaattaatctccagccagggttccaaaagttttgataccacagagagtcagatatcactatgagtagagaacacaaaaatggcatgctttatctattggttgatcatattagtagcatattttatctattaattggtcacgaaacgttttaaatattatcataccagtagtatggaggtagaaatgaaaaggggaagaaattgaaaccttttcgtggaatgaacggtttactccccacaatttctttgcatatactaacacggaacttttcaaccattcaggtccaacctgaattttggatcttccaaatttcatctgaggtttctttacctcttgaatacatatgttacatattagatccagacagtgaagagctgataataatgcttcacttgactgagcatcaatagttgactttgcaaaaagttctgaaactgagacctctacagaattaacgagaatctggaagaggttttgaagcttcattaatatattggacatcgcaaatgctcctgcagtgcatcaggtttataagacataatatcaagcctgtcttaacttaatggcacaagaaaagaaataacaagtactccttccgtcccaaaatataagggagtcagtccaaattcatattactaggatgcgtcacatctacccaaaatcctttatatttttggacggagggagtattcatgtaggatgtgcataaaacttaaaaaagcgtaaaagatattttataatacaacagtgtcatttccatatagtattgttcttccactgtattctaaactaaaccaaacaaatttccattaacaatcaattaactattctgattaaacattttccagtccacataaccaaaaggaaagtgcaactgtgacccccccccaaaaaaaaaataataataaaataataataaataataataaaataaaataaataaataaatcaacagttcattggagatagtaaatttgttgtttagtgtgttgtttcatgaaaaagctagcaagctagaaatgcatggtaaacaaggctaaattgtaaatgaatatagattaagttgagtggtctgatatgtttactgcagagctttctctggttatcttacaaatgaatttgaatttaaggaggcgtagcaacataaattgaatatcaaattagggaccaataaaacatgggaaacatgtagaagacttactacttcctgagttatcttcatcaagagtacatttccaaagttccctaccagaaagattatgaacctgtagacgattagaaaatattctgatcattccaatatgacaaagaaggtgtttgatacagatacattgctgaacatgcaaattttctgtttcactaagttagttgctatagctccaactaattttaagagtaaaataatataaaatgatgattcaactgtacaaaccagtcgatttgatgcatcaccattttctgttgcataagcaacctgagaaagacactgcccgagcccactaaggacactgttaagtttactcttatcctggagatgaatcctgtcattgctcagtacagcaagaaagttgttgaagacctatcagaagaaataatgaaactgagattattactaggtatgaatgtgctaaatctcacataaatcctagcaggaattagaagaagtttcaatagcatatgccttggtacatataattagttgatgaaagatagactatgaaatattttatgttaatttaacacctcccatcttctgtaaatagagataaaaggaagaagggcacatgtcaggggcaagtagccaccaatacattgcctcctaacacaagaaccttttcaactttcaaaacaccaatacatgaaagaaacccattcacctgttcagcgtatcctggaaaggaggatgggaaattaataacaacaagctccaaaaatctgaaagacattaactggatatccatggatagatgggtcattccgttcaaaatattggccatcagcagaaacagtgtactgcgtgtcgatattgcattgtcctgccataaatagataccaattgtctcacatatgcagccaatagcatagaactagaaaatggaaatgatagaaggaataagatatggaaatccattagtagctagaagagcccgtatggtcagcatgatgaaactaaaatagacaattgggggaagaaaaacagtgatcaagttaccaatagcttgtgaatcatagcaacctcgtgagatctctcacgaattcagaaataactggcaagaagtggggaaatacctctttcaaagatgggaagacgagagactgcagtatactgaacaaggattcacgaaccaccttgtcagtgtcacatattctttcctgtagcttctcaacaattgcaaccttgtgaagtttaagctctgatggatgcttagcaacaagatcctttatcccattcagcgcagcttcaacaaaataacataacaatgcagcccaagttagctagtctcatcaagcacaggccgaatcgatcgatcgaatcaactgtttatctggccatctgggtggcagtccgcgcagagactgcctatcggtggctcacctcggcgcacattggcattgtagtggcccgtctgctgcaagagctcccgcagcgtgagcccgcgcttgttcacggccatgccagccctctccgacgccatgctctgctccggcagcacgatcgctgcaaccacacacgcgcacatcacaatccgaaaccctaaattacgcgccctgctgcgaaaacctcaggccaccgagggaaaaaaaaaaaaaagaggcgcccgcagctcacctctggacttgatctccgtgtcggtggcattcttcggcggcggcagcttccgccccaccttgtgcttgtacttctgcgagccacgaagagaaaaaaaacacacacacacccgaacaccagtgagctcgtcggagcgggcgtcgcttcagttgggggaggggagggggggaactcaccttgaagtcgacgccgccgcgctgcttcggcttcgccttgggcttcttcgacgaggaggaggacgccgcggcgccgcccttcggcctccccatggcgcgggcgcgtctctctttctctctctctccgggcagcgcttgctgacgagacggcggcggcggcggcggcgtggtgggggttttgcgcgcgacgggcggtacaagggctaagcccccgaggctgcgggccgtggcggagacggtctctcgttcatgggcctcggagacgtccctccccctcgtgtactcccggccccagaaaccgacgccgaaagaagcccacgttagagtccggccttctgggtcgctcagaaacccagccgagcagtgtactgggctgggccacgctagtactcaagtcttccctaatactgggaaatgtttctaatagagtcagggtaccaagcagtaaatagatcgcctgttaggtttaattattttatgattgatgaagattttatatcccatagatcctacttttctgtgtaggccatagcagcacactatagtgatgagattggtaggtataccgtatacaatgcaaccaaacttacgcaaatagaaaatacttatagaattttcacgtactaactgtattaggaaagtttgatgatatgcagttggggataaagacacatgccgagccgaagcgcggaatcgggggtggtctcgccggtcgccgccgccgttggccaaattcgccaattcgggctgcgttgaaccggcgaaaacaccggtggagtcgcggagatacgccgcttcaccgagaaaatcacagggcgcgtttatttgtgcgatcgtgccaatgccacggacgcgcgagccaccgcattgtgagacggccgcgacgacacccgtacgtcggccgtcgccaccggtgacgcgcgcctgattttacccaaccgctcgctctgaaccggcgtggaggcatcaaaccaacgggtggcagtgaactcaatcaggcgagcgcacggtggactccatggggagtagcaagaatccctggtagtgaaaagtctccggcaaatcgcatccctgaccctgaggctgaacaagtgaacaacgtacaaacctagctggttaattaactttacagcgattttacagtgggcctctcggttagtaaaaaaaagctttgccttacgcagaaccacttggtaattagttcttttttatccctgtgagatctgtacttctctactcgtgttacgtgagtgcgcgcgtaattctttgacgaccgggacgaggggtgtggggttgggatcggcagccgcgcgcgcgcgcgtcgtacgatgagcgggcacgtggccgcgcgcgaggccggccggccggcggcgacgacggtgcagcacgccgacttgccatgtctgcgtgcgtatgaatacatgtggattcggtcgcgcgcgaactcgtcgtctcgtcgtacgtccaggcgcgcacgcagcagagaggcagcgagctcatctcccgaaagccacccaccaccaccatgcaccaccactcgtcgccagcaggttggcacttggggacttggggcagaacgcccctcgtgcgtgtgcatgcccgcccccgggccccggccacggccactgctgagtgcacacgaccgtaccctctccggctctccctgtaacaaggctgtaaattgcaccaagttctctatcttcaaagtcacgtgattttatcactgacataattttgataatttagagctattttggattgataccaaaatatgccctaccaatttattagtaccttaaatagtaatcatataggtttggattgaagccaaattgttagtcatacctatgattaatttgtcactaatctagaaccttcttctctatatcatcaatacttgtcatcatattggtagcaatccaaacatatataatgaatctctacccaaccaaaaaattgatagtaccaaaacatgtcaagaatttggcactaccaatgatttggtaaggtagagatctaaacagcctcttaaagtcgtgtgactttatcgctgatatgtgaacctaataaatactacatccgttttttaatagatgacgccgttgatttttctcacatgtttgaccattcgtcttattaaaaaattttatgcaaatgtataagatataaatcacacttaaagtactatgagtgataaaagaactcataacaaaataaattataattacgtaaatttttttgaataagacgaatgatcaaacatgtgagaaaaagtcaacagcgttatctattaaaaaatggagagagtattggattcatatgtcagtgacttgtgactttgaaggtggggtatcttgatcaatccccacctcaccaactgcagggcgggcaagcaggttgaaaaagaaaaatacaaagagaacccaagtaatcaagtggtaatataaccgtggtctgagtcctctgataggtaattaggtagatatctgatgctaccggaaatcaatctgcaatctggcatgcggagcggacctcatcattttctcagttaagtggctaattaacgcctgatcttttccgggcatttttatctgaatccgatcgataatacgcacgatgcaattttcacaggtactccacagtgtccgtcgatcggcatgcacgtacgcatgaatcaacacggcagcttttcgatgggtagcatgttaattaccaccatggccaaccgacgttaatttgcatcaaaaggggttaattagctgccagagtgacacgtcgaccactgaagctgtgaagactgaagaatcatcccgctccatgatttgccgcgcccatcgaagcttttaaacgtacgatcgacaaggctttgctttttttttgggtagcgatacttcaacgagagagaacaatacttccatcgttttgttttcccacatgatgatgttttgcacaggtattcagaaatgatgcagagcaagtgcagaatatacaatataatgcactcttggatactttggtgggtgtagccttgtatatatatgttcagaaaataatggttgatacttacctccaggcataatcaggaccatgggttaaactattcctagggcttggtaaacaaaaccatgacagatgtacgggttagaagagatgtctttaggccttgctttgacagtttgactgcatatcaagttatgaaccctatagctaagctagctagctaaacctgcaatgcatttgcactgtatatcttcttctataaaaggcctacaacccccaacactgcatcctctcccctatccgtcttcatactaacaagagtacgtacaagatttcgtatcgatcgtatagagagatcgaagtcagaaagagagaagagattataagttaatttcgccatgagcagcagaaggactagcgcagctaatcttcttgcggttgccctgctgatcatctccttgctgttgttgcctcttcttcaccttcccgttgcccatgctcgccatggtgagttcaatcttcattctctcatgagctaataaacccatgtgtcctagctatatcgtttgctaataatccgtcgatcctgtgctgattgttcctgcagttgctgtgctgaaggctactgacagttctagtgccatcagcatcagatcgggacatgtggtcagtgaacacacacacacacacacacatatatatatatgcctcaatatcttgattttctagtaggcatcgcatctgtacgctgtactcatcgatcctactgaactttttgcattttctggacgaatgcttgcaggagcccaccccggcgagcggagcagtgcagaggaggccagctagctccggtgcaagtaaccgcggcggcggcgggcggcggcggcgagcggcggcaagcagcaggagtacggtggagatgcgcgcgtcggcgtgggcgaagcccccccgcgacgaggtcgccaggatgcacgagatgctgaagagggactacgcgtccaaggcgcgccgccgctcgccgatcaacaacggcgagccgtcgctggaggaggaggacctgccctaactaagcttcagctgcatattcgtagtgtagtgtagcgtagcttagctatagctcctctgaaagatctgaactgacacacataggtagtacatacagttattactagagctgctcttttagttagcaaattagcaggcaggatagtgtagttactcctatggaataacagcctttggtttagtatagcatccaagctggggcgtcatttgttagccctgagagtcagagagccatgaacaaacagtctgaaactgggcagttttgtccctgatgatgctcatgcttggtgctagctaaagcttttagctagcttcaccctgtaacatacataaatgtgcaccagtgtgtcaggtttgcagttttagcttgcagatattatgtcacaggcttagtgatttacatgcatctttttgtgcctcctgccttgctcacatggtcacagagagagagagttacagactatggcgatttgtgttcttctgaacagggtaacacagtccagtttcagttttacagtctccagggatgctcatcagctacaatacttttcaccaagtataccttcatttctcactctcaatgcaaattacaagccactaccgaatccagacaagccattaacctgctatagatgagtaaaaaaaagagagagcaggacatggagggaggggggcagcaagaggaggggtggtggggaaaggggagaaatgagcaacattttgaatgaatttaacacggctaccacgacgagctcaggggcgcgacgcgaagagctgatctcaaaaagaaaagatatgcgggagcatgcagattcagaatttacagcagaggattctataaccccaacctcggtcccgtctcaagcgcctgcggtccgctttcgccatcttcacagggctgctgttccactctgtctgtagcctgaaaaattgagaaagaaaaggaggagcttgatccattagcttcatggagtatatgggaagcataaattctgaatgttatgtggattggccaaagagaaaataattcaatggttaatctgcttttccagctaagatctcagtctgctgtgtttagataaaaagaataagcagatgacaccatttggatgtgaagagaactttgaagctgcttatagagataggaggggaagagtgacaacctccctataaggttgccttcctagaaaacctatgtttcctagcttctgacttctagttccttttctagattctatagctatagattcctagaatctgagtgacaatctgtactgtttgggggagctagaaattccgggagaagctgtagcagctaaaaactccccaacatggccatatactatttacctcaagagttttcttgtgcaggcaaatgaatgattccaattaatggaacagattgggtggaaaatttatgtgaaactaacagaggagaggaaatgcacacaaatgtgtaagaaaacatattaagtaatggttttctttttcagaaaggtccacagaatatacagtacgatccattcacagttggctattttcctgatctcaaagaaaaaggccgtccattttcctttgaaatagaggggtggcagcatgactgttataaaaagcaatagcaatgcaggcaagggagctactctactctgagaaaatttaattgaagtgcatcttcacttacactggaaatgcgaaggaccgagtacttgttgtgctgctatccgatcgaagagaaatgtttccagaataaggtatatgacctgatggtgttagtggacctgatataatgctaggtccagaaaaacttgactcaaagggattgcggataacatttcgagctgttacttttgcactgtcagcttcatttggttgagctacagattctgtttgcatggtcacttttgcactgtcaggttcattccgttgagctacaggttctgtttgcattgtcatctttgcactgtcaggttcattttgttcagttactggtcctgtttgccgtgtggaactcttactatctttgttgtcctcacttatatttgtgccatcgtttgcttctcttgggttgaaatcatgtccgtcttggacactatcgatctcgcattttggatcattctcacttttcgcatcaataggctctgtcttaccagttaacggagatgtacctgaactcgtcccatgtgctgcatcagttctaattccataaacgaaattatccacctgatcatttctatcttccgaaggttggacatacgacctacttggacttgcttcagtagagtctaatctactgtcttcatttctcgctccatctgtttcagtagaactaagtgccctgtcaacaggatcactcaaactgtctgaattttcaacaggacttctctgatcaacaggaatttttctctcatcactcaaaatgtcatcacttcttgcttcatctttttcttcagatgcttggacatcagtcatacttgaattttctacaacagaatctaatgtactgtcttctgcaatggattcaccagtttcaagaaaattaaatcctcgcagtgcaccatagacgatatcactaaaactgtctgtcttttcgacaggacagggcactgaataaacatcatcaacaattgtaggtagggagtacttggttcccacgtgtcctctaatgatccatatgcgatgaagggattatagtgattaatttggttgatttctgtcttatttagtgccacaccagaaacaccatcttcagtcaccaccccagagtggccatcagcagttgactcaactgataaaccattgacgttagtgatcgcagatgcaatactagctccagtttcatgggaatcatttgatggaacctgtaataagagtatcatatttagtggtccaattgtggagagaagtcatatgaatgctaaaaagatcatcattcagtgtgcaaactcatattttgaatcaaaaaaactcaaatatagactacagaaccaaaagaacatatagtcttatcataataaagatgaaatccaatcaatgacgatgcatgctgatggcaacaatgagttttaagaactaatgtgacaaacatattgatgattttctaagtgtctgtaatactgtaagttgcagtttacctgatcaactggttctccattgagatttggcccatgattttcactgctctcagaaacatctgcacccatttgttggcaatattctgcattgtcattacttactaattgtttgggcgtcgatttctcaacatttacaacagtcaatccatctacactactgttgccttcgagatcatgcaatttgcaaggatgattttgttccacagtatccccatcagtaacacatgcttcgggcaggacaactatttgcgattttaaatcattaacagattttgcaggttcatctgctgtttcttttatccgaataccatttgtatctccctttgaagaattcaggttcagtgacaccttttctgctatagccttctgatcagcaagtactccctcatcaatgcagacatccttaacaaactgaacgccataattagaagagaccattatatctggcaatttgatttccacaacatccttgtcataagaaacatcctcaggccgtatctggatggctttatctacattttgttgcccggccttcataaaactatattctgatggattggtttgttgtaccattgtatcaagcaaaatatgttgtttagtttctctttcaatttctccatctactttagggccgccattggatacaagctcatgaaaaacattactatggtaaggccttccatcatctgcaagcatacatcaaaatcatcaaccgttgagagagtgaacagagaagaacatgatttcacaacatagcaacatgtacaattctcaccattgattagttctgatttagacagtcaaacagtaactaaaactatacttgatgtctaagtgatgagacttttttccaaaaaatttttgaaaaggagaccttttacaatggaatgagcaaaagagaacctggttacttctgctgtcatttctctttcatttcagttgtactgtcatttttactcatttgcaaacacggattcttttggctgtgactgactcaaccatcttactgcatcataaaggtggaacataactgtgatagagacaaagctgtcttgttggttaagtaaggggttgttggtattattgaaagaacgtaataaataacaacccaaaacgttaattttgggatgaaattgacaatcttcctaccaaacatatcaaggttcaacaaatcaaatcatttattttgggtcacaatcaagtcaatttgatgaatgagaatttaaatgaaatggatggataatgcagccgtcagtagtcagtactgatccatatcatacctatcaataaagacatctgtcacagcaagtcactgaacgaatacatttttcatttacaaaacaagatttcataaaatgaatcatctactaattcttatgagggcattaatctccacaagtccaaattcacctcagaacatatcccaacgccatagtgtgagataatgcaactgtaaagactagaagctacaccgtagaaataagatcagctctttaaagccgcacaaactgtgtatcatctttaatcttctgttgatgaatgatgaatagtaatgttacgttcaaagcaaaccaatctctggaatatcctacaaaccaagcaatcaccgtgcttaatttctacagctaagccaatgtcatacagatacaaaatactcctataaggtagcagaagattgataggtgagagattcccttaccaatcttcatgatctgcattgtgtgcttaagtcctagtcatgcctcaaacaatttccttgaaaatagagctgcttatttcctgccaaaaaataaaaaaaaatcaatcaagagtcaatgcattgcatccggcatccggcatccagattacattaaaaagaaaacaacacacagacctaatgccgatgtccatctatcgacaaacaaatgccgtgctttgcgtaaaccagattccctctagagagaaaagccccccagcatcctgataaaaccacccactttacacaaacctttatacgagaagacagtacaccccaaaagagaggaagataaaaaaaaaataagaaggaagaaacaaaccaatctcacaaaacacaatgctagaaaaagaaaaaaaaaaggtttctgatgagcaaaggcgaaattgtgtgacgagtgacgaccagtctgtctcaccaaacgcacataggtacagaacacagcacgaacaccgaacaagaccaccactactagagactctgctacagagcagtacaaggctaactgaaaccacaagttttttttttccttcttttttttacacggcggagcagagcagagcagagcagagaccgacaggtatgcaaaacgcagcaagctttactagacgaagcaaaggatctctcttcttttttttctttttctgccccttctctgtcacgaaaggggagcgaggggatcgacgacgggcgaaatcagcggcctttgcaccgatctcggcgtcggcggcggaagaactctgacgcaggctttaactgcgcgcatcagatggtgtcgccatggggagtagtaaacgggagcagtaagacagtagcagtaggaggagaagaagacgacgactttgagaaaattttataatctttttttgttgctcttgccgttggcgaatggaagatgaaactctaatcaaccaaaccgctgatgtaaaaaaattccacaatccgtctcatcagttcataccgaaattcatcaaaagaatcgataagggaaaaaaacagcagagaaaaaacaggggaacacgaacacgaacaagatagccactctagcagccatcagccgccatgggcggcgaaggaaaacaaccaacaccgagaaaaccaaaaccaaaccaagaaaacgacgagacgaggaagaagaagatgaaaaaggagaaggatcaagaactgacctgagttcacttctctctctttctctccctccccggatagcaccggcaattcacttcacttcaccgcgtcgagcgaaaaaaaaaagtttccgggagaatcgccgggagcagcgggaggccaggccggcgaggagaggaggagtgggatcgcgtccgcggcgagcccgagaaccaaaaaaattctcgaaatatattaaaaaggatttcccgggcggagggtggagactttaataagcggcatgaagaggcagctcagtgcaataaattttcatggggcgtttttacagaaaggggcatgtgatttccccatatttgcagatgcatccctctaggtagcaacaaacaatgcccctttggatggagttttgtgggactattttcatcctagtgccttcgtttacaattctgagggctgttcagattgatgttatttttaattattttatttttgggtaaagttatcaaaaaaaatctacatttagtttattgctaaatttggtaaatacataagaaatcctgtcaaaattttggttatattatcatcttgccaaaattttagcattgctaaaatttgataaagtttattttggttacaatctgaacagacccttggcattctcatggagatggattattcaaaaggatgttttttaaattcataaacattgaaagggttttatgaaaatgatactacctgggatggatttggatccggtgcagtacctagtgtgactgcaacataagcagtcacactaggaccttttgatgcaaatcaaggatccaaaatctacgaagtactgttcacatctgaaaaaactgtagaactactgtagcatcaacactgtagtatcagatctagaccgttcattgaaaaaatggatggctgagatgatgtgcagttcctaacttgcagtcacagttaggactgcactggatctcaattcacttgggggatttggatccggtgcagtacctatatgcttatagtatgccttgcttggacacgagattttcgcgggtataccattgttttggaaacaacattatctgaagatagcgtgtgccatttccttgatttgtttcaagagcaacaatttcttaagctcatttggaaatgatttacaagaagtgattttttttatctctcttggaaatgatttgtatactactagtgttttctcaggtgtacactgcaaaacagggaggacaattaagtgctgaatcctggagatagaagagaattgatagcatttcatcagtaagaaatccataagatacaagtgcattgatagcaatggcgtcagttatactctacgttatacattgccacatcaagggacaagctaactacgtattgatggcataatctcaacaaaatacaccaaaaaggtgatccatcaaatatgaaatatcccaagacttggaccagccgaggagtggcatctgtcaagatctccctttcagaacaacactgaaaccgaaagatatcaagaaggcgatctctgaattttcagaaaggtattaaatacctttaccgtcacacgatctcatctagaatcatggtaagatagcatcataagaaaacatagcatatgacatcgactccaactaatagtaccctaatactgcactgaatattgttagtaca

SEQ ID NO: 49994 - DNA, 16906 bp, Oryza sativa
aggagacagctcggcggcattgaagtattctaaagcctaaactacctctatggaccccaatttattacacacacaggatccaccatgcttcaatttacctaggataaattgaagaaaaatacactagtggtagcttaacaagtgtgatcgatttacaaataatccttgtacgtgtttctagctctaggttacatcagggggagcaccgttaaagatttttagaaagatggaaaaaaatcctcattcatatgtgagtttagagaggttttctcccataatttgttgtagattttctgtaatttttcatttaaaatgggggttaaatgaaattgatttgtctgaataggacaaaaaaaagtgagaaaaatagatattccgtacccaatgtcgctatctaactataataccgttagaacacatatgtacaacggttaaagcgactatcatcgttatatattttacactataaatctaatatatagaagcaacatgaaaaagagacggcgctatggcgtttaataccactcttttttttccttcatgtcttatgcgcaacccttcttttttttctatttttttctctcattcttgtaagtaaaataagtgttatgagacgcctctttatatcaattgatattatatatgtcctcattatgtgcagtccacttgtcaatatgtaggagcaataggtttggaaagagttgtacttgattttgcttttgaattcctccttttgaaactataaacgcctctttcagtgacatacaaaccaagtacgtttatctactaaacacaatctgtcatggtaatgagaatacaatatacactgaactctagatgaaaactagagcatacatacaagtgacatgtcatttcaatagaaaaaaggagagagaatctattatatatggatagttctaggaatatatgccattgactttgcctcttttccgaatatgccatcaagcttcttatttagtctgcaatgttgaaactaccactagttttcccggtgaaatgttcttttacaaaaggggggcaaatgtctccccccttctatactcatagtcacttataaaatccaccaacttattttttttctccgataactagcataacgatattacaactttgacaaacttttttttaagaaatgccaaagtgaatatatatttcaatgtaaaatattactatagtaatttcgactacaaatcaaatgatatatcattgatgctaaatatttatattattcaaaataccgttgatcaaattagttgactctaaatagttaaacttatggacggacagagtatcatactaggacatcagagacgatcacatataagtaaattattaattccagaaatcattttgtggtgcccccaaggacaaggaggcccttttctgggggccaaaaagaaagggttgagaggaaatgatgccattgacttgtgcacctctaggcaagaggcagaagcaagaagggagagagcggtggtgcatgtaaacttggatgattggctgctgccgaggccactatggagtggcaacgatgaaacagcatttgcgctttctctggactcatctgtttgacctcagatggctcgccatgatgcagggcatcatgccatgctcccagcttggttttctgatgtgtgttccagcctacaagggcaggctccctggttccctctttcagggatgcagggtttttttttttttgggtgattgccatgtgtgtccatggtgtagacagtagagatgatctatttctccctgcatgtgtgctgttctatctggaaattggaactgtcccaattcagtgcttgtttctgcttattggtgaaaatagctccgtttttttctcatatgacctattatatatgctaaaaaaatactactggaccgtcttgaaatatagatgtataagatctttacatagttcgcaacattatattttgatcattagtttgttatatactccatattgtcaacgctataaaattaatataatataataatacattcaaatatataatgacatcacatacatgacaaatcaagcatatatataattattagtacaaggttacgaatgttttttctcttaaaataaggatgctttagtattttggaactgaggggttcagaagattgaaaaatcaccacaacaatcgagaaaacatagagagctgtaacattatttattgttggtggttataacgtaccactataaaccaggataaaatatcccacgctaaatacagttcagaaattccccgcaaaaaatacagtttagacataattaagattcgaactaaaaatacttttgcaacgatcatcatttttccatcgaagaatatacatcgcgtggagtaatgtaggagaccaaaggatcaataatttttcttttgaaagcagaaaagaacctactacgactactgcccccctcctgtttcttttggaaataggaataatcccattgagagccacagggcaaagcaaggcactactctagaaacagtagatccttttcccctcttgcggggacagcagaggggtagatctaagttctagctagggcgagctgagctgccctggtctgtgcaagttgagggcgagttgattggcactttggcacggcaggcaacacctcaaaaggcagaaattggcgcaagcatgcctgcaggatcgatggtgctgtgggccattggcataatacaagtgcaagcatggagctgatagcagctgttggacaaggaagcatgcatatccatacaattttgtgtgttaataatttcctcctggttttaaatacagatggcattgtcaacttttgaattaatatatgctttgatcattcctattatatatatcgtgtaaatatgtaaaatgataagtaatacttaaagtatacctttagtggtaaccaaaatacaataaaatatatggtaattacatacttttctatgagaggaatgatcaaattaatatatgtacagaaatcagaattaatagatattgatttgggggaagaaactaagaaaatgaatactttttctttctttttggcgttggaaacttaggtgcacatttggaataaaagtctactagatagttatgatgtgatatattctaatactacgaatctatgaatcgggataagaattatataaatttataatactaagatatatcacattatgtgatgattttttttacgaaagaagtagtatatttttcaaggttcagaaagttgaaatattccaatatacagtggaaacgtatggtttacgtggttcttttgttacctcgccacgtaattttcagtacctatcagctttgtcattcttttttggcatagtccaattggtaaataacctagcaacctccactacgtgcgattcgaacttgtaatttttttagtagtcttgcatacgcactggacacacctcgtcatcagttgtcacgttgctagctagctagaccttttttgacacggaagcgcatgcggatgggtgttaacgttgcgcacgtatatacgaaatcacacacgtacgtgacattgtgacaaccaatctgtggtacacatgcatcattcatgacatcaggtttacaaaactgacaataaccatatacagagttactatggtactcacgtttataccattaagacatgataaattttaaaaccaccgtaaccacactaaaattttaatagtaatttaatttttttaaaattgtacacggtttcttacggtttaacacgattacccgtccgtgacatacttcgtcctcatatactacaccaaccgtcgtacgtcatgacacatagcgataggtgtgtgcgtttgatcgatcgatcgatctctctcgcgcgcgcgggcaatagacttgagtactcgacccgatccgtcctttaattcttccgatcgccgggacaaagatgtgtactcatgtaaggcagtttcctctctacatctgatcgatcgcgtacgaactaccagccattgatctgtttgttgcccgcctaattaaggaactgttcctgcacggccaccaccaccattattcaccaacctacaccgctacaccttagatgtactagctactgctgtagaattgaagctagctagattgggaggacaccaacaatcttaatttcctttgtggaccaagcaattaatccaaaagaaaaggaaagaaagaaaaaggcaaaaaaaaaggggagggtaagagtggtgtggtacactacttagagcaagtttaatagtgtagccaattattggctccaaaacaactatagctaatataatagcccattcatacaatacttaactataaaaatatactacaccattaatatccggtcctacctctcatgcacacataatgttttggagtccgtgttgcaaccggttacaaatctgtaccgctttcttctctcttctattttcttctcgatatgctattatacctgctcttactattggtgatcgaatatcgatggatggatggacggatgggagaagtgcagtgagagtctgagttcagcagagcagcagcagtatatggctgcatgcccctaatcgagtagcagtcgttagtggtgcggcgactagagaaaaggctcctgaaaaaaaaagggcttcgcgcgtcgcatgccgctgcagatgcaggtgaggccgtgcggccgggtgcagggcagctgcacctcaccagagtccaccggccaccaccaccgcgcgcgcgcacgcacgcacgcatgatgcaacggcccgcgcacggcacggggaacagctttgctagctcgcgcgcggtcacgaggctggcatgatggctagttggctacgcgcgcccgcggccgcgccctcctcgcccgcggccgcttttgcgcgccgccaccatcgctggacgtacgctgggtttggtttgtttggtttggtggggtgggtgtggcccgtgtgggttgggttgggtggcgcgagcgcggtggcggggtgggcgcgggacacgggtactctctcccgagacgcgcgcgcgcatggatcgccgcggcacacgcccgccccggccggccggccggttaattcagcggtttgcacgaaaccatcgatagagtgactgacgagatctggttatggcgcgcagctggggcaaagggtatccaatgcttaatgccaagcaacaatagaagtgcaaccgacaatatgtaatcaatctagtcataaaacccgacgtctctctttgtagctacacctcaccttgcccaccttccttttttcctcttttagtaaaatcctagcctatccggctattgtacagggtttctctcttctttaatacaaatacaccccgcggggtttaaaaaaaaattagtggtttgatgcgtggaagtcgaacgggtgtatcagttaggattagagctagctaacatcaaaactaaggtggtgcattaccattgattggaaacctaggaaacttcaatctaacattgtgcattccaatgcttttaaagtgagaattcttggctttagataggctcctgtgcaccatataagttgaacgtgactttgcaattgttcctcggtctaacctaggatcaggcgaaacgtgttactacaaatttaaatataggactttttagattattagtagtaagatatatgtctcatccaataaagggggtactatattatgggatggatgaagtaattagttgtacgaaataccatgcagtatgctattagcatatgattaataaattattatttagtgtaaacttttaaaatatatttatttgatttttttaaggaaacattttaaccatataaaattttagcataaaacgtactcacgttattaaacgtggattagcccaaaccaacgcggccgtagctaggtgatctcgctgcctgcctgcctagctagctgctggcactctcgcgcgtggacccaaaattaatcaggaccgtacgtacgcgagagggaggaaaaagtgcgtcgccttttttttcccgatcgataatttcccaccgcccgtgccgatctgacgagagcgatgtgttgcgctgccattagcgatttcagcatgcgggtcgaggttgattgatcgaacgatcgggtattcgggtgggtggaaccgtggaagacgcggaagagatcgatcgactgagtgcgtgtcacagtcggattatcgacggatctgatggaaattaaaggacagtttgaatagtaggaataaaaaaacaaagcaatagaaaaacgtggaaatttaatttgaatgaaagtataaaatacaagaaaaacacgtgaatgatagtttgattgaaccgtaagaaacacacaggaatcggatgagatagactcaaagagaattttcccagagcctggccagagctttaatcttttgctaagtttcctttaaaatctctatagtattactcattccatatgaattttaatggattggatatgatttaatcatttaattcaaaaacattcgtaaaaattttctatagaattaaaatccttcaaaattcatatgtttttctccctattaaaggagttctaacgataacgattttggcgttgattaaacatgtccctgtcatgtctaggggtgattcacaggatccatttcctatgaccataaaagttgttagctaaaattttggacgtttatgtgccagttcggtgctgtgtctgcaggtctgaagaactggcatgtggcactgtcctctcgttcatcggccgaggctgaagccgtgtgattttttctcctttgacaagtgacgacatatgcctgcctctccaggtcaggcttaaagaagatggcattttcttccttaaagaaagaaaaagaaaaggaaaagaatatgacattttttttcttccaaacttccagttcagttatgctgccttttcacatggacacgcctttgcgtgaccacgctggtttcaggacacaggtgctgcagtacagttgttcatggagtgctcgcaaagaaagaatccatggctagctgctggccggctccggacacagcatgcattgcatgaaacatgcagtttcttgtgatactattcattgtctcattctattgtgatgcacctgatacactgtccggtaaaagactggctacgtagcaatcgcaagaaaaatccctcccttgatgacccataagtcagaacacgtccagaatcgtataagaacctccaacagcctcgtataagagtcaagaatcgcaaatgaatagtctaatttgcatttcactctaacggactcttttttatgtactatccaatctaaatgtgggtcccacctatcagcctctctactatttaaccccttcttcttcaccctctcctctcttctcttctctgctgagccactagccgaatccgcacgaggttggtggcggtggaggccgcgtggtgccattggtcgctgttgccaccaccgtccttgtcatcttgggcataggtggtggatgccgcatgtggacaggggacggtgacatggattcgagtgaacagcggtgacgcggattagggaagacgacggtggtgtggatttgggcggacggggcttgtgcggcaggggcgacgacggcgttaggccgatgaacaacaatggtggtcattcaaagcgtcacttcttctccggcttctcctgcaaggcgtcgctgccttcggagatctcactgccggctcactactccgaggggatcgggtaccacacctttgtcgggtcgccagagatctcgccatcccggggcttttgctgacggccaccagctctcccccttagccacgttgctcccgaatgaaggaaaagtgaataagaggtggtgggacccacatattgcaagtaggataggctggtaaagtttggcaaatgagggaaagagtttggccatccgtatggcttggagagtaagatgaagaggctgttggagtcggtcatttaaagttgctaaattttggcttgaagagtgggatggagagactgttggagatgctctaagcacatgaatcttttccttttgtctccctcctattagcgatgtgaggccacaagtgaggtaacctcgcctcctccaacacaactgcctccactacccaacacgctgctcctcagccccattggttgtcctcctccccaagccgtgcggctgtcgaagacgccacgccaccttcgtctcctaactactccgtatctaatgcaccacaatcctccaccgccctactatagccccgcggcttgaatggcgacacaaccgcccaccaccattcgtccaacattaggaaacctcaaatcctaatccataggttctttgcgagagttggggtgtcgccaacatcgaagaagacagggagtttaccggggacagaggagaaggagtccgaacatgaatcttgctgtgcggatacaaatggtggagaaatcataagaaatctccctctgtccacaaatataatggagtttgagggtacaggtttatctgcaattttaaggaattttgagtactacttgcatcactcaaccacccttcatttgatttttatttaattatattcctaattgtttctcatttattgagagacattatatccatttcccttaaccttaatctcctaaaaaaactaaaatgcattatatttgtggttgtaggagtacatttaatatatatccgtaccttttaaattatttgtaacttaattgaaacctatatatagagactgtctttcaaaattaaaattcggctcataaaaatcaacagagctagctagtaagttctaaaaaaaaaactagtgcgtccttactaattagtacttctagttaataaaatggtacggcgcttgattttcgttagtagaacgtctgcttccagaacatgctaggcataattcgatggggatgcgcaccatcactcgacgcagtatcaaaaaactctaattgagaatcgacttgtcaactaaaaccaaaaaggtttctgctttcctccctttcaagacatccatgccatttctttttccttatgagaatatatatatacactttagttaattattagcttctcctgattgaacctgttagcttggatagagtgactagtgaatccaacttgctaagtcaacacagcactatatgcttgacttatttaattaattgatttgtcatatgtgttcacatgatatcatgatagccgttaagcaaaccatgcatatgaatctagctacccggtcccaagtaattaacgaaaaggataaggtaaggcaaaatgtgctcactagctagatttgatctgagcaatcatttaggtatggatgagatgataatgttaattagtatattggtcctttgatcctttaattttttgtgaaaggtgtattaattagcactaatcttgttaagcagaagatgtcagtacgaccttaatttaaaacctttctaaaaagagaagatatcacagagctgatctgaaatgttgcaactattactactagtttttattcttttctctctaagtagagtgtttcctatccaacttttcacaaatccaaatctggctccacgcactactacaatacccattttccagtggtgtctgggaaaatcgcgattttcgcatacgggtgcttatatcacccgcacgtgaaaaacaaaaatccaaaaaaataaaataaaatttcacaaaaaatgaaaaccctagattggcgcggcgatgccgccgctcccggccgccgccacctcgtcgtcgacgcccgcctcccaccggcctccacgcccgcctcgtcgtcatcaccgcccgccggatcccgcgcctccaccgtcgcgctgtcgtcgctgtcgccgcgccgccgccgtatccgtgcggggacggccgccgcccgccagatcccgtgcctccaccgccgcaccgtcgttgctgtcgccacgccgccaccaccgcaccaccatcgccgtgggccgccgccgccgctgagaggcagtgagtgcagagagaatcggctgagaggagagagagagaaagagagagaagactttgggagctgaagagacttttgggctgagagaatcagccagataaaagagagagaggaccgaggcgcgcggaaaaacggtaaattttgaagtgggtaggaggaaaaagagagagtactatttttaggtgcggctcttttaatagatccgcatgggaaaatcggtttattttcccgtgcggttcatttaagaggaccgcacggaaattttcccgtgcgggcgatagcccggcgccggtccgcctatttttccgtacggttccacttacgaatcacatggaaacaaaagagggtagcgtccaggaaaatcaatccagtagtagtgacggttgaacagtacgatacatactccactaggaccgtactccactggttccaaaatggaaccaacttagtacggataaaacatattctagaaatacaaatctagacatgccacacatatccagattaatagtattagatattctcatttcgtaccagtgttatattttgggacgggatagatatagattgaagccatttcaaacaacctttgagtgtagcacatcttttgtgctagttcgaaaatatagctagaaatgtaattaacgctgaaattagcagatttaagtatttaattactccctgaaaaaaaaagcagtatcattcacatcacgccctattgtgaacatggagatttcagtaacagagaaaagcgtgtggacacctaaaatgccagccagccacagaggcagtatgtaggactgattaacaagggttaattattaggaggtcctacagataaaatggtccatttagtaaggccattggaggatggagctctcatcgatcctaacttcatgttacttttaacatctagaagttcacttcacttccaaagggcacaatagaaaaacgaagatgtaggcacataccacacgtacgtccacactcagattgccatgtgaggcgatccgtttgaccaattaacttaattaagcacaagagcttaattaaaaccaaggcctagctagctaggcataaactaagagcaagcttaatagtatagccaactactagctctaattcatttatagtcaatataatagccaattcatataatagttgcttactatactattaatacatgatcctatctgtcataaacacattacgtcttggagtccgtgtaacagctggctacagatatgtagcccgctgctcttctctctcttcctttatatctttaaaatatgtttatagctggtttatagcctactattgtacctgctctaattaaacaaagatcacccaaattgcatgcatgtgaggctggggcaaagtccaaccgggggaatgcagcgtgtgcatgcgaagagggacgcagcccaatcatttgactgcatccgtgcccccactgcaaggcccaagatttgagaattttccaaggatctgatcgatcgcagtcgcaggcaggggagccacttgcatcctctggaatgcccactttgtttaaggaaacaaattaagcagtactagttcgttaaacgtacacggtttcaggcctacccgcatgtacttgtttcgatcagagagacacgtgagcttagcttagcgttgcttaattagttccttgtggtttaatttaagaagccatcctacctagcatgcaatgcaaccggtcagttcttttcagctaacttcaattcaaataggttattgtcacggattatttcctcaacatctttagaaatgtggttttgtgttaaacaaatgtcttctacaattctactactacattgcttaagcacttgttttaagctattcatttttatatttctaaaaattatataatttatttctataattaaatacttccttcgtctgtccagatcgatccgttgtcctagtaaaggtcaaaatcccattgtaggtgacaatattttgagacgaagaaaatagataaaccataccaataacctaaagaaaaatttgttctgtacagcgtggagtcgctgagagaggaatggactgagcgtactgtggaggcacatgagagatgatgagatgctgtgtggttaaagttgcgtgaagcaacaacccccccgtgttgtgtgcgtgcttgcagttgcaggtgaggtcggtacggtgctagcttggcctctccgtgtttttctttcttttttcttttttttttctggcagcgtggcgcatgccgaattccccgagaggaggcaggttgggtttgggcgtttggctaagggattacctattcatttatcgataaatcttctcttaaaacggttcaaaaatcaacaaattccgaggaagaaatttgccaacagatttatagcaaaatagtttgggcaaaatatgacgatcaccaaccgagcgcaaagagtgtttatgggcgaaaaaaggtttgtaagcgagcttagaagcttactctatctgttcacgtagtattaaaatatggccctgtttggatcctatcttaaaattttttatccgtcacatcgaatgtttgaacatctgcatgaagtattaaatataggcttaaaaaaataactaattgcacagattgcaactaatttgcgagacgaatcttttaagcctaattgcttcatgatttgataatgtggtgctatagtaaacatttgctaacgacggattaattaggcttaataaattcgtctcgtggtttaccaacggattttataattagttttttcattagtacccgaacaccccatgcaatactctatataatacctgatgtgaatgggggtgttattataccctatataacacccccatatatcacatctcgtattaatttttttttgttttgtgatggaaggagcacacgagccaaggtaggcgccgacagtaaacactttacagcacaggtacgtgtctgtaggtagccaggtgggtacaccggtacaacctattccctccgtcctaaaataatacaaaccctgtgtttccgtgtacaacgtttgaccgtccgtcttatttgaaaaaattattaaaaaaatcaaaaagacaaatcacgtataaagtattaattatattttatcatctaacaacaatgaaaatactaattataaagaaaaattatataaaacggatagtcaaatattagacacggaaactcagggtttgtctttttcttttttagacaaagggagtatatatacacacatacacggggttcgtacgccggtacgcgtagcagcagcgtgtacgtacgtacgcgcatgcagtgtctgaatctgaagactgaagatgcctgttttggctgtatggtggtgccagatgattgaagaggaacggaagaagccaagccagccgcgcatgtgggcggcggtcatggaccgacggaattaataagaccccgctcattaaatcggagcgccagctgctgccgttgcctgccgctgctgctgctgccttaggagggtctcgttcggtataggtccggtgaaaggcaagggttcacacaaccgatgaaatttcgcgataactgattagcttttatgaaaccgctagatctcggtttataaaaaccggtcaatattgaccaaaagttattggtttttaccggttttcaattggatttcggcaaaccggtgacgagtggtttttacatcgaaatcgaaaagttaaacctggtgaaaagcactgaaaggtacggcgcggccggcctggtgctggtgcgggtgctcgctgcgcccaagctgatgatgatgtgccaccgttagcaatcgccgcagcctgtttgcccacatatgtactctccagcgaaatcaaggcccagcagttatggaccaaaatctccatctgccgattaaccggcgtaaaaggccagcgagcccacggcccagcagctatggcccacacgcacacaaggccatagggcctctgtacatagtacatgaaacaaagctgattgccacattgccagggcagcaagtcaggagctaatgaaaggattctgccacttcttttgcaagattgaaagaaaagagagagagattttgcgaggggaacagttattagtactaatagtttgcttatggttagtatttctggagtagtgtaacattacaccaccacttcatgtcataagtaaggtcacccaccactcgaccgtctttagagtttagattagaggggttctcaaaatgtactgccataagttatgtttaactagtgctgaatatataaggttcttcttacttgtgtcattctctgttccttcagttaatagttgatacggctaagcatggtttctacagttactccggggggactgccggactggggagcggaagtaattgtccaggactgaaaaagaactgataatttatctgcatatatgaataagcaaagtcagcatatttgaccaaatcaacactcaaaaatgaaactgagcatattattggtgttccaattatccagtacaattggatccagcaaacaaaattagtgaaggaattgaaattgcaatgtaaaatttaagtcgaacttcctagcagacatgaagccaagtctgccttgaatatgcagataagcaatatcgtcgattatatctcatatggagaaaaggagctagtggcataaaagcttcattccacacgctactagtcacatctgacaaaaactaactgaatctgatgttttttttttagtatgtcaaactccacattcctaattttagaaaaagtgtgatcatatgctgcatgacatggcccaaacatgtctgctagatactgctaagatcaaatgctggaaattaaagagaacaagaacaagaggtatctgattctggctgatgaatttcaggggtattagtaataagtaactacttgcaaactcacatgtttcctgacaccgtccatgaacaggaagaagtcttcatttttgcaggattagcatggagtaaaaacacttagccagatagaaaacagcattccaataaaaacatcaaacagaaaaaaagggtaagaatataagatgtggccaacacatatggtgagtaatagtacatggaaattacataaaataaataaataatcaaacaaaatactgtgagatattatgattcatgtttaacattatttccaaaagaactgaaaatgatataataatcgactacacagtaaacaacaagttgcaactattacagtttagttcaaaattctaaaatgaataagcaggtcccctgctcattgtcaggaaaagagcaaaagacacctaaaaaaatgcacaaaattgtttgtcacattgactaatgcatcataatggctattggttgagtaaaaaagaaacagatatgacaccatactaacattttgaagagaagcaccgtaaaattaatgagatgatgcataagcctgagtgaaaacttccataaaatccacatttcttccacaccataaccttgtgaggtctgttgtgacgttttgcttccatgttcatccaaaaccttcctatgtttttggtacaataaaacatggactaaagggtactaccaatcaaaggagcttctctatactgttacacaagaatatcagaagaacccctatacatagttgcaaaagtctaacagaaagtgtcaaaactaaattacaagttagagcataatgaacagtttctccaaattagtgcctgggtaacacaatctcagcgagtaaacatcagaaagagacactgagacactgcttaaactacgtagagaagatatataatagagaactgttaataagagaatgcttattggagttttaattaccatttggcctgaagacgataggaagtgcgggaaatcagcaatgccttcctggatgatcatcatcatcaccatcccttgatgaactccgtgacctcacccggcctctcctctcgaagtcacgctcaggatactcctggtacctcctcctgtcacctccataacgatcactctcatcccaattcctttcatgctccctctcctcctccagcactcgcggccgatatcgacccctctcctcatggccatgcttcctggacagatcaaacccatcacggccacggccacactgcctcctatctggataacccctctcattgccattggcattgccagtgtccccctcattcctaccacctgcaggtcttccccgccgcgccgtgccacgcaccgttccatagtctccattgcggttgggctgctgcattggcggtttttgctgatgccgcggcatcccgtaacctccaaaattccatggctgctgtccaacccacatgccggtcatccgctgatcataccacatccctgtgccacccatcgccatgccgctggctgccaggaacgctgggttcacatggggcgacatcaccgatggcatcatgctggtaccaatcgccgcattgcactgccctatcatcggcgcgaacccgccgtagccagcgccgccgccgcctcccaacatcccaccaccgaatggaagctgaggccgtggaggtggagccagagccggcggatcaccaagaggaggccccacattgccccgagctgtcgtcgagttgcccccgtggccgccgcctcggcctcggcctcggccgcgcgcggcgcgcggggcgtggacgtgggggtcatcgccgccgccgccgccgccgagggggagcagcgtgggcgggcaggagagcgaggcgacgcagtggcgcccgtcgaaggtgcgcccgtggagcgcggcggcggccgacgcggccgcgtcggggctgaggaagtcggcgcggcagaagccgcgggacttgccggtgagcttgtcggtgaagaagtggaggccgtggagcgcgccgtgcggcgccagcgcgccctccacct

SEQ ID NO: 49995 - DNA, 3217 bp, Oryza sativa
gggttttgggaggggacgtcgggtagtgggagggtggcgagagggggaggaagccgaggtcgacgtcgccgtagaggtcgtcgcagtcgtcctcggtggtgggagagggggcgtgggagtcatggacggcggcgatcgcctccgccggcgggaatgcggcgtcgacggcggtgagttcgccgccggcgtccatggggggatgggtgggtgggtttagcgtgttccgtttggttgggtgattttgttgagtagtgtaaaaaccagagtccaacagaccaacaggggaagaccagtgtagaaatatcaagggtaaaaaaagaccaagagtagattaaatactagctcattggcttactcaaatcatttctcaatcagtaaatataactaaatactttctttcctccagaataaaacaatctcataccggatatagcacatcttagtatgatcaatctagacatacttgtgtatatagattcatcgtactaaggccctgttcgactgttcgactctagatttggagataaatttttgttgcacacaaaacaataaatctcattagcacctgataaattaagtattaactattatgaagttgaaaaatagatttatttgttttttaaaacaactcctatagattttttttttaaaaaaacgcaccatttaaccgtttgaaaatcatgctaatagaagacgaggaagttaaagtttggagttgaagaataaaacagtgtctaaaatgtatcacataccgtacgaggttggtttattctggaatggatggagtaattcttattgaaatcatttcattcactaagcggttaagagctaaaaaatgtgttttgagagaagtaaaaagggggagtattattgctttatcatgcaaaacttgtgcgttcaatgagtcctcaccatacacaaactgcatgtaaatttcgttcaacggaactttcaaaaaaaaaaaaaagggcgtagaaatggtatgtcataattgagaactgccatactttaaaggattcaactatagttgttctttttaggattgtatttctatggtgtacaacatcttaaaaactttcctttgatttgttttctttttccgttgatattgtcaaagggtcttcgttgtgtttccctatcctgcatttaaaatagagccttaatgtgacaaaatatcggcttacacagaatattttggaccctttaatttatctagggaaatttcttttcttggtttaaaccgaagaatacgtagaaatggtatccaacaagaaaatgagaaaggcactgtccagattccagaaacaaccacccttgtaaatgagatcagaaagttttttttttccctttcatcagtaaaaggttctgtagcctacagtgcaccatgtgcacacaataaacagcaatcttggcatcctgccaagtagattaatgaaataagatacccatcaaaacaattgttattcagagcagacaggcccaaggagaaggcaaaaatgtaagtcatgcgttactcattcgtttgccaactgatgttttgccatcctgtagcgcatctaagatatcctggtatgaaaaatcatcgtcgcctttattcttggagccagacttcgctcctcctgactgctgcaccgaggcaggcacagttccatcaagagcactcccgtatgctccggatccatcagcagcattgcactccttgaacttggactcgctgtttgaagttgaacaaaccgcttcagcttgatccgcgaaggagaactttgatacagaggagcggcaaatatctctgtaggtatcatattttgccgctcgtgttttgcctccttccagtatagttgacaaagggtgcaagactgaaatagcactatctgcactctctaaggtagccttcagatccaagaaatcgtttacagactcttgtttgctgaattgaacaagaaccgcagtggaatcaatcgggaagactgatgtaacagaagctcgaccaaacactttgcagatgcagtcctttatatcctttggtctcaccttagactggaatccccagataagaatgacgttgtcatacacggcagcaggatatctacgcttataacctgcatctggtctctccgtgccagtactcaaatcaagcactgttccactgttccagcatgggggcagcagattgatgtgtttcttcagattaatgtttgttgctaggtcctccaggggagagagttgctcaaatttaatgccatgataagcacagagctgaacaaaaacacatccagtcatgaatgcatcataacctgcttcatgcttagcacctgaagtgaagcaagataacctgcagaataggaaaaaaaacaacaaaatagaaacatcataaatagtaccagttggtaagacctactagtgctactaaggatgagtataagtgtacatgcagaaacaataattacattatatttcaagaaataacaagaaatcatacactgtttcatctgcctcgacttcaattctcacagaaggaagggtggatgacttctcatcaggtgcatgaagtgcagggcacaacaatgaaaaggctgacgaaagtgatttgcttttgtgcctcatacgatactgaaccgcgtcattaacagacataagatgcctggtatctgccatatgtgggaacattctgttgatactcaaggcaaattcctccatggatgaaggaagaggaccaacaaatttgctgtagatttgtgcaatatctgtgtatgcaaataaagatatttagtagaagatcaaaacttatgctagacatcactcatcaattcaaagttggtcatctaccagagcaaattccaatacattcaggagaactgtgtgagagagagagagagagagagagagagagagagagagagagagagagagagagagagaacctaggaaacaactatgaccaacaatcaatttcctttctgaggcaagaagatcaatgacatgacggatccctactgctgatttgacttttgcttccctgctttttagtagatcttcccgaacatttttctgtagcaaaatagccagggtgattattgatcattaaaaatatctcaaatagaccatcatacatgtttagattggtgaagtaatctaaaatcaaagaaaaatacaaatgtaaatttcaaatgcgacaaggcatcatttgattctcagtcaaatagtaagcctggagcag

SEQ ID NO: 49996 - DNA, 1109 bp, Oryza sativa
cagctagaatatcatcagaagggatcaaaatggattgaaaccatgcaatgatgcaaagcaaccaaaaaatgtatactaacatgagaagttctattgatgtcggattctaatcccaacccgaaccaaccatatatgatccaatagtattttgtgctttggcttctgtctttccttcctcttggccggcaatggcttgccatcattgctaataacgactgagtggagagtgaccatgatattcatttgataaaggtagaacaatcactttgaaagaaaaacaatcctgtctttccatacatcattccataagggataagctaaatgcatagaggtttgtgtctcttacctctgccctttcctgtattatcttttcttttttctgctcctgagaattgtatgcaggatatgaaatactgctcggatgcctcatcacggtggtgattgttggggtagtttcaatttcgtgccatcttagaagaagagcacacaacctgaaacgatccaagaaagatattggtaatttcactaatcatgcaacccctttgcacatactggtttcttttactcagtaatatcgcaatatagttcatgcatccttcttgcagaggtcactgctgtatctgttgagtatgaggaggttacctgcaaacagatgtgtaccaaagagatttacgacgcaactgaaaacctgagtccactgaatgtcattggtcagggaattgcaggtaaatgacaatattagtcagttggacttgaaatccttattccatcatgcagatgcaatacataattgtgatgtgagaaaatgagatatgtaagataatagccatgtttaacgggttatttcttgccctgaaagtgggatgtatcttctttattatgtgatttttcagggaaagtgtacaaaggagtgcttgcaaatggctggcctgttgctgtaaagcacatcgttaagaacgagcatgcacactctttcctaagggaagttacaagcctctcacatgtgagacatccaaaccttgtgtcactaagaggttattgcgatgggcaggaggaatgttttcttgtatatgagttatgtatcaacggtaacctgtcacaatggctat

SEQ ID NO: 49997 - DNA, 5001 bp, Oryza sativa
attcctgcagcccttaccacgcacacttatgattgtttgtttgtatagcatagaacattttagcaatttaatttactctggtagttgtgcatatgttaatgcagttacatgcaatgtttacccttataaggagatctgttaattcaactataattcactctttgattttgtgatgcttcttatcacagtttctgagctccttatattgcccaaatccaccgcaagatttagcattgcttgaaatcttatgccacatgctcgttcattacattgtttctctccagatcatgcaaaatgcatatatggtaaacttttgtgcaacgaggaaggtggaccttgtgcctggttttgtggaagaagatgccagcaggtataatcctaaaattcgaccttcactaatgctagccatatatttaacagagacagcgaaaatgtttacttgaagcagcctcactgtgctctgattttttgcgaacgcgcaaaaggattgcacgtcaatatattagcaggaaaagagtttttgttacacaaagcaatcagccatcagccagactggcttatgcctaactcactgtgctctgatattggcagatttatatgaatttgcgatctcgtgttgggatccccattcacacaattgatggcttctcttgcactgttctccggaacaacggtgatcaacgggtctctacagctgcagatattgcaatcctcgctgagtgcaacatgaaattagtgattgccttgagtataatggaagaatgcttcttacctataatagacgcacgaacaggaatagatattatcccacctatactatataattggaggtgagaccgactatttcctttccaaattaatcagttgtcctcttaatgttattaacgaatatttgcttttatctctcttttttttagttccatgtattttcaggcactcatttattcctttgtatttcttttccaggtctgactttgttcatttggattacaaggggttctatactgtagtattggaaaatgatgacaggatcatttctgtggcatccatcaggtactgcacgttcaaaagttctgacacttacggagttcaattttcgtatgttcgaaatcaacaccctaaaattggtcagattatctaatatttcagactctgggattaacacagatttttatgcaggttacatggtacagttgtggcggagatgcctctaatagctacttgccttgagaatcgtcaacaagggatgtgcaggcgtctcatggattacattgaacaggtagtagatagctggatactgatgcttttgtagtctactttggattctttattaaaaagatcacccaaagaatcatgtcatgcttactccctaagcatcatatccgagtcaccgagtatctgacttattccccaccgtatccttcttaaggacctgaaaatttccacctgtatttctaccaaatatttgctatctgcatccgacttactctctagcctatatcctgttcaaacttaacaatcgattcagtcttctcctcttgaagtacatgtctgagcttggaattttctttagatcaaaggtagattaacatgcttgtatataaaactgagcttggaaattaagaaccaatcaataatttatcacacaataatactccatccatcccagaatataagaagttttagagttagacacgtttattaaaaaaataggtagaattaaacggggagatgttgtgattggttgagaagtggaggtgtgtggaaaaagtgaacggtgaagggttgtgattggttgagaagagaatgttagtggagaaattgttatagtttgggacaaattctaagcgaagagaatgttattttgcatcattgcttatcgtgtgcagactatttctatgcttcatgtgtaccacttactactagttaagatatttgccactctagaacttaaacctacctgatgttttctcaacagatgctgaaatctctgaaggtagagatgcttcttctatccgcgatacctagcctagtcgacacatggacgatggcgttcgggttcgtaccgatagacgacctcgacaggaagaatctcagcaggctgaggctggtgtcggtcccggggaccgttctactgaagaggaacctgtacgagtgtccgggcaccaatgcgggtgagctgcgaaaccctgaacccttcaaagtttactcacgctctgccaggaaaaaccgcgacggtaattctgaacatgacatttgccaaatgagatgaatcacagcgggtggtggtggtggtggtggtggtagcaaggagaatctcgcgttcgtcgatcggtcggtggcggtgacggctgcggatgctggacagcagagggccgtttgaggatcgctcgccggtttcttgtgcagtggacagcctcgccgacgagctgcggagtttgaagatcaattcgtcctgtgaaaatcgtcgtcgtcttggcaaaactactgtaaattcagctagtaccttgtatgaaaggcctgttggatgctagtggccgttagcgactagtgcgccgtctgtgaactctgatctactgtcgccgacgagaacctgaacttctcaatgttgactcggtgtcgctgaacattcttgaatgtcctgaatctgtctcagatttcctactggtaactgacatgaatgaccggagaccaaggtggtgtttggatccatggacttaactttattctttatatttagacattaatttagagtattaaaaataaactacttacaaaactaattacataaattaaagctaatttgcgagacaaaatttttaagcataattaatctataattagagaatgtttactgtagtatcacataggctaatcatggaataattaggctcaatagattcgtctcgcgaattagtccaaaattatggatgtgttttattaatagtctacgtttaatatttataattaatttccaaacatccgatgtgatagggatagtcccatctaaacagggtccgagcaatgcttctcttgcatgactcttgcatgaattttgcaggatttcagctcagatcctgtaaaaaaaagcagtcaaattctttccgttacaaaggatgcgagtgctatttcgaagggattcaaaactccaaaacttttttttttcgcgaaagcgaaaaagaattgcacgtcaatattagatgaaaggagaagagagtttatttacacaacataattaaccaaaccgatttataccaaatgaagagagaaaagagaaaaacaagaaaaaccaagaaaaaaaagaaagagactactacgacaactatacgtaaaacccaaaagaagcaaaacttttggttctgaatgaaaagtgtgccatggcccacgggccacgtggaaccaaaaagggcgacctgccacttccactgttctttctacccgttggagggggagggcggggctcttgttgcgatttgggaagacccggcgcgaatctcgaggcagatccgacggccggctccctgatcagcccgaaaccgcgattggtttccctccaagcgggggttttttcaagttttaatcccctcctctcccgctcacgaaccaaaataatattggcctcgtccatttccgcagaaacccccaaaatccccaaaccccaactccccgtcttcctcgccggccaccgccgcgtctctgctgctgcggcggctgccgcgcgggcgtcctcctcccggcggcgccagcttggtcggtctctcaggtgattccctagtctctggtccagtcgcggcgcgcccttgatggctggggttttttgttttttgggtgatttttcgaggctaattctgtgggacgttttggccttgtgccctagcgcggagggggtgccggcgagggtcgagggtgagttgtcttcggatggttgcgtgggatgttgggggttaggggtagggtgttcggcggaatgcgtgaagcggggtttcagtgagatgggcgggggatcggggggggggggcggtctagggtctgggagcgcgcggtggcgagggcgtgaggcaggtggccgcggtgatgagggcgttgctccaaccgaggagcagcgagttcagtcttacagttcacagccgcgaaggggcagccgtcagcatttgcacaatcaactactgacatttggttgcttcacccccttaggtcttgttcggtttggtggggattgaagagaattgaaggggattgagggggaatcgttccacaccgcaataggcatggaacaaattccctccaatccctcccagtcccacttgggattaaccgaacatggccttgagttttctttttcctagtgaaagcccattatgctgtctaactgaaaggtggttatccgcaaatctcactattccttttctgttttggtgaactgtacaatttttgttcaaatagatgccagagagtacataacttgtacattaaacacacgattatttctacttctaaactgcgtgcggttgtcaacttattatgtgtatatgtatatgtctgtcacttgtgttattcatagttaagctttcaatagttcctcatttgaaccatgctgagacttatcactctcatcgcagagattacagtcccggtacatgcctcattcttgatccagctcgcgaggtcatcaagaaccaacattcaacaggttcgcatgtgttaattgttgccatggtggatgcaagggagaaatagcctcaccgttgggtccacctgccatgataaagccaagggtcaactggtcggatcatgcaaatgctgttcaaagctcctgtatcaaagatgaattcctgagttcaagttttttgttctctttaccaacacaaaggcctaatcaggaagcagattgtacgggaatgcttcctttaaggtacagtctactttcttatacaatagagtattttgttgttgggtgaatagctaaagtggtcctctaagtttcatctgaggctcagttta

SEQ ID NO: 49998 - DNA, 15720 bp, Oryza sativa
gtcggtgtacatgtagcggagcagagcctcgaagtcccgcgcctccatgtcgtcgatgcgtatggcggtgtgatccaccgcgccgccggtcgtggcacccagctccttgcttggcccaaaaagctctgcacggaacaccggagaccgggccgcgagcaccagcctgtgtgccgcgaacgtcttcccgctgacctcgaacgtcacgtcggcgccctccccggtggcgaggaggcctccgaggtgccggtgcaggtccgacggtgggaccaccaccgtaggcggcggcggcggcggcggcgttgcggtgtctacgtcgatgtcctccgtctgcagctccatgaagacggtgaggtcgcacacgatcgtgaggcagtcgtcccggagatactccgatttctccagcacgtccctccggatgaaactcacaaacccccacccgctgcttttgaaggcgtgcgggttgcctcccggcacggtcgagcaagctaaacttgaactgagctttcacgtctacatcgtcgtcgaggttgaggaagatggagatgcagttagctttgtccgagtcgttgccgctgggatagtagctgatgtgccaactatggcctccgacgcggaaagatcgggacttgacgttgctgccgggggtcgggagcttgtccttggtgtgggagtagccgtcgatcttgagaaggtgctggccgctctccgtgccggctatgatggtggaggcagaccgcaccggtttgcggctgccagtggaggttggcatagctatggagattacgcttgattatttatgatcacgagggccacaattcttgctgttcaaggctgcatatgtgtgcggaattaagcaattagtaagggtgacacgcttaattatatagattactccctcgatccgtttcacattatgagtcgtttgacttttttcttagtcaaaacttttagaaaacaatagtaacatttatagcaccaaattagttttattaaatttagcattaaatatattttgacaatatgtttattttgtattaaatatattttcctataaacttagttaaacttaatgaactttgactaagaaaaaaaagtcaaacgacttacaatatgcaatggagggagtacatatttatgcctcattggtatatggtgccaaacattgtctattcagtctagtatttggtcctaatcaacgaggcaatatggagagtcactgttggatccaagtattggtctaggtgggctgtggcatgaggtatagaactaaaaactcgttctattatggacgtaattaatcaatggttgtgtagatttatgagcaactatatatggatggagatttagcaatagtatttccttatgactatgttattcctctctgtatgttgaagtgtttgtgattctttgttatcttatggattttatacattggtagtcttaattatgggctgcaaattatgtaataagtggttgtaaattgaagtaaaggccgagattcccattaactaaaagaactattaatcaatggttgcagatgatgttttttaaaatgttgttactatgaatgcgacctaaattatgctgggtcagcctgggattttatccgaattacgaattacctgggtatatagatgaatatcgaacggatggacaatggaagtaagtgtgagagacaaaactgaatgtctggttaggtgtaaaaaaagaagaacaaattgtcaaattatccatccattttttcaaaaatagatcaagctgcatatccttttaatttgcttttgcaatgattctactgaaagacagaaagacttctcgcgcggaacttcatggagtacaaataatgcataacacacaaaaatagaagtagaagaagaagggatacaataaaaagtttgagcgtcaaagtcaccaaatgcggccaattaatcatggagcgcaaatgtacaatggatatgtcatcttgatgaagctttgaggcatcaacgaatcagtcaccgtgcaaattaatctagcagagtttcaataggcatatatgaggttcaaacaaagaaaggattttacacacacctgaaggaccatccgaatcaggtcagacttcagagacagagatatgtcgttgattttgtcttggctggagatggtttgatccagctaggattagctgctgttgcagggtcggcagatgtggcatctatcgacacagatttatatcggaagcaacagagagaggaaaaaaaaaggtcattgcttagctaatttaatttgttgttgaatctccagcttccttgcaagctaccgtctactcctagctcacatggatacacgcctgcaagtaatccaaggaatctgggaacctctgcaggtctgcaatcctttgctcccgacaacgggttcctcttcctcctttggtcagggcaaaaacttgggaactcactgagaatgagtataataatacagtaagttaattatagttgggaaaactgatccaaccactagaagggaagaactgattcagatggaccagatattgttggcctcatcagtttgttgttttttctgtgtgtttatttttttaaaaaaaaactgttgtggaaacaaaaacacatcactgaacatgtttgtcagagatgcatacaaagactggcacacataaacaaaaaaaatgctggaggaaattccaaatttacactaaaacaaacatggcagataaattttactacttccaaccaaaaattaccatgtttatccattttcttggattccatagaagatgcacacatacacatatcactatgcagtatacacacacacacaccccatacatccaaacaagtgctcctcctagcatatgttcaaagagggaccgacgacaaatcttgatctcgataaatttctattgaaatacattcgcgtgtagtacttgtgttggagttgtattacaatgcctgttttcttttatcattccatttaataatttattttccctcttcttaattactactatatacatatatacatgttgacacatggctacattagaggactcccaaactggttgcatatttaggcccactgtagctcagctagctacgtttagtacagcagcgagcttggcaattaggtcctttaaaatagaagggtaacttttgctcagattctctagtccctctgccttcacgatttccctcaattttactgtatcatcgaggaaatgcaagcaatcggagaatattaaggacggcgggatgggcgctcgctcgttgcgtccacgtcggattttgctacagtagctacggtgcgcacggggtggaaattatgcgaaaaagccctccgatttttcgtaataatgtataggtccctagcgtcctgtgtttgaagaggaataatcgcggacaggggcttttttgtgatatgtggaagaagaggggcttttccgcaaaacagcatccactaacgcataccccccaaagccctagctgccgcctctccctctcccgccccccctccggcgccgccgccgcttgcgcctaccctcgtgccgccgccgcctccgcctccccctccccctcgccccatccacgtcgccgagcgccgccgccgcctccactcccgccgcctgcgcctaccctcgcgcagccgcctccgcccccctccccctcgccccgtccacgtcgccgagcgccgcctccgccccctcgcgcgccgcactccgcctccccctccccctcgccctgtccaccccctcgccctgtccacgtcgccgagcgccgcctccgccccctcgcgccgccgcctccactcctgccgccgccgctgccgccgcagagcgccgccgccgctctccttgtcccgcgccgccacagagtgcctgccatctcaccctctccctcttcttctcccgccgccgccgccgctgccgccgtcaccgagtgcagctgtctccacctccgccaccgccatcgccgtcgccgaggccaccgctgccgctccctgctatccctttctcaccccgcctgcctccggtccccctgcttacccgcctacctcccccatgatgcggcggcggcggtggcgacgacgacgacggtcgatggggtcatttcctccccacagaggtaggggtccacgctggctgcggcaaattagtttgttcgcgctgttcagaaacggtggtcgcgtttcatgtgtacgggctgcgtttattggtgcatgtgaaggcacgtgtctttgagtgtgtctgtggcagcttgggcggttcatccgtggtaaagagggaaggggacggcgtggcattttctggatgcactcgcatttcctcttcgtcgttggccgcgccattccgtgcgatttttgctccgatatcagcggctccattgttttgcccccctgatttggtattgaatcgatgctctttctatctcagtgccgaatctgcatgtctggtgtgatttcttcctccttatacattttctccctggtaatggatggccagttaattggtgttggatgtttgcttgttgttcttcctcacttgtcgctgcatatcagagcatggtacaaatcgttcagggtgcccgctcacaccactcaagatgctctgattgggccattgtggcgtatgccagtcgagtctcgtcgctgcgggaggatcccgccagtgcggccagtgtcaggtgcactcaccaccactcgtcgttcgagggcgggacggagagctcgagcatgcctggtcaatggcagccggtcgtcggggctgcgaggtggttggtggtgtctgtgcgtgttccggcgagtggtcggtcccacggctatagccaatcatgctccgctgctgttcgggccccacgtagtcgtggtccatgccaattgcagttggccgctgtagcaggctccgccgatgtgccctttgtccggcgcagtgttactgctcggcgttcgaggcgaacacggagagctcgaggatggcctccgttagagcactgatgtgttacgtcgtatgctgtggctgaccgatggccctgtcatctgtggggtcctattgacagcctctgagtatgttgttttttatgttacatatttttttgttttgtttaccagtataagtagctcattgcctgccaatcttctctttcccttctgctttttcaccatttcctttgcattgccttttggtgcccgttcgctgtttttcttgtcgtctgttctagcccattctccgctgttgtgctttcttcgttcgatcatggaccctggggggtgaacgcgtgtgctggtgggttttctgtatctggcctagctgccttcctttctgtctgtgccgtgtgtttcctttttatcctgtaattaggcttggtgcatttcaggtagccatgtattggcctgtttgttgcacgggacttactgtcacagagtttttaggttttaggcgattttccccgtgttcatgtttcccttttgacagtggatcattgcttatctctgttgttcttctttcagtatatacttctttcagtaaatagatggtggctattacatagatgaagcacacggtcgttagttaatgacaaatatcattgttttttttattcctggttctgattcattattggatcatgtttcaccattcagagtgtgtcccgtggtgttttcttttcgtgcagaaccatgtggttcatttgtatttttgagtctttccttaagtgcatctctgtacgtttacatgtttttttttttgtcccttcatatcgattttttttggcgcaggtgcttattgtcgcggtcaggtccgtgcgatacgtttgttgctgttgtgctgctgttccctttaccatcagctcctgttcaggtgagctttgtttctttgctatttctttgggctgacatcctttttgttttttagtttatttgtgccttgtggtttggtgtatgttctttcttttatctgatatctagcttaaattacattcttattccctgcaggttgcggaccgcatcttctgtgcctgtacatgtcagctaaggtataacaattggcctctgatttcaccgccgtttgggatcgcgtccctgacgcgggagtagccctccgtcttgagcaggtgctgcccgctctcggtgccggcaacgacggcggaggctgaccgcagaggtggcctacggctgccgccggtggtggacatggcctggccggagtcgatcgttctctgttcgttcactgaatgtacctgggaaaattggcagattgttttcacgcctgaagtgaacgttgctttaatttatttcttaaagtaaaatgcaaatagcgatgaattacgataggtatcaatgcaatcatgcatatactccctccttttgtttcatattataagtcgcttttatttttatcctaatcaaaccattttaggtttaaccaaatttatagaaaaataaaacaatattttcaatacaaaataaatatattattaaaatatattcaatgtaatgaaactaatttgatattataaattgttggtaatttttctgtaaatttgattaaacttaaatatgtttgaataggataaagtcaaaacgacttataatatgaaatgcagagagtaaatttgaggtgtaagttcgaccaaccatcaaagacaaaaaaaaaatccactatgaacaatatttgcactttttatcaccatgttttatatatatttgtcttttactttgtaggtcaagtttaaatttaaaatttaggggagtgaatgtctgcgatcgtttctccaacaactcttgaatgaaattttggatacttgtggcacgtttttttcaaaatgctaaacgatatgtttcgtgtgaaaaatttctatatgaaagtttctctaaaatatcatattaatccatttttcaagtatataataattaaaactcaattaatcgcacgttattaccacctcgttttacgtgaaacacttaatgtttatcttcatcttcatgagattcaaacatgcatgtgctctacgtttccctttttttctgtatttttcattgccttttggattgcatttgtgaagtaaaggtacgcaaaagattatccttctagggatgaaaacaaaatggaataaaattacctggccgaatgtttcggctaggccctgttaaaaaatggagcaattagtttgtattttccccaacattttggcaaattgaccgttcaaaaaactaattgcaaaacatatcgtaccaaaatctacctgaaaaatagattgtttgcgcagtacaaactttgatgaatctgagctataatattttagcaatattaacattggcactaaggtattatttgaggtggcacgactttacagtatactgatttagcaccaactgccatcacattggtgctgctcgcagccttctatggacagctaccgtcacattcggttcaaaacccctggtccatagttttttttttttcacttacccggtttttagcttgttctttaaggtttttttaaaataaaaaaaatcacatattctcaaaaaatcattttattttcaaattggaagttgaacttaacttatataatatttgtattttttttgttttttctctaatttttttaaatcacgtgttttattttggtgtctattgaaggacacgcatttatctggtggcatcatttttccaaaatgatccaagctcattgccaccacaactctacccactcgaataaatgtgtgtccttttaatataaaaaaacatgtgattttttatctcatagctagataaaatgaatcttttgcatcaaaactaaaaggataaaatgaattctgaaaacatgtgatttttttagtacatactccctctatcctacaataaatcaaaccctagcttcccaatgtagaattagtgagaaagataatggaccaaaatatccctaattaatagagaagttagtcaaacctagcttcccaatgtagaattagtgagaaagataatggaccaaatatccctaattaatagagaagttaggtgaggggtattaaaggaacaaaatttctcgatctacggtctgacggtagataagaaggtaggagttgatttattttagtacaaattcaaactttagaagttgatttattttgtaatggagggagtctatgtttgtgatgattctaccgaaatgggatgtgcaagctgccatagcatgcagcggctgcagcagttcaaactagctgcaattgacaaccatttacaaatgcagtagctgcagcggttgtgacagttcgcatagcggaacatgcccagtaattgcaatactttcatggaatacaatacaatataaatgaattaggaaccctaacaataaacctactcatcaccctatgccattactgcacccagcataacaaaatgtatatattctatcaggctgaatcattggcatatataaatgattttcagtcagtatacacatttagcagacccaattggtgtaaagtacaaacaaacaaagaaaagatttgcacacctgaaggaccctaatcggatcagctcagagatagtatggttagcttagccggagataaatcagactgttgtggcagggttattagcagagaaccagacacatttatacaggacacgagttagaaaaagaaagaagagacgaacaccaagacaggatcacaggatgtgtgtccagtcattgcctggcttatttgccacaaaaaattctccagatttcttgcacgctaccgtctatatcgtgcaaaatgaacgcatctgaacgtactccctcccacaagtatgtatgtaacccaaggaagagagagctagtaccaaaggcaaattcttggaaaccatgcaacaactgcaagcctgcaaaatcctttgctcccgataacggggtcctcatcaatcgaatattcatgccaaacttggcagctcagctaggccacatggaaaaacccaattttcacaagaatcggaaaaaagaaactagacccccagcctttttttcttttagagcaagtttaatagtaatatggataaaatcccttatatatatatattttaggatggaggtagtaatgtttttgtaaaaaggtaaattcctgatttagactagaaccctgaagtccgaacctatccgcttccactaagatttgatattcacttacatgcatcaatccgtttttaaaaaaagtcgacggtagtgtaaaaaaagaagtcgatgattcagaacagtttagttttatctcgatgatcagttgccttatttaattaggacaaaatatatgtgcaacaaccttttacaactcaacagatttatttatactggacatgttatctctactacttaaaaagttcgtagtggtggtcttgattcctgacacagcagacgcatgtgacagacacgcctaatctcaaccatccgtttgccatatccaatgatcgatctcctccccacgctcgctcctctctcgatccaagagatcactccccacgcccactcctccttctcccacgccgccttctcgccgcctttttcgccctcctccctgtatcgcgccagcgctgcgtcgcctcctcatctcgcggctgcgtcgcctcctcacctcgccgcaaacgccgccgccgtcgactccgctccagatccccgcgtcgcctcctcacctcgccaccaacgccgccgccgtcgactccgcaccaaatccccgcgacctcgccccatccgccccagccggcggcggccgactgccagatccccgcatcgcctcctcacctcgccgccaacgccgccgccggcgacgttgccgctgcccacccgccccagccggcgacgctgccgctgcccacccacaagtaagtctgttctgtaccagtacactgcaagtaagcattgctgaatcaaaagaggtcaaaaacatggttgtcaataccagacagttgtttttctttctcttcttccgttggggtgggaaataaatttattcaaaaagaaataaatttaatgttatgcattatgtgggggaatagggcaattgacagtttactctaccgaggtgctgctgctgaatttgtaaactaccgtggtgctgctgctgaattttattttgaaagcactttgcaatctgtgagatggggaaggaggttagcctagatcttactcataaagacgacttctctaacccaacaattaggagttactacaaagtttttgttgaggtaattatcccctgcatgaaatgactgacaagtagtacttgcattatacacataacataatttgaacataatgtatccttgtatttgataaacttaggttcggctgtaaatactgaataattgatgcaattttcgattggatgaaattgaatgtaccatgcactcctgctcactatcgcgactgagtatttcttcgcagttataatgacattgcaatcaagtagaaatatccattagttaaatattgacttagctgcctccctaatttgtttccaacatgcattatccaccaaatttaaattacaaatctgactaggtagattacaagtttttatgctttctagctttgcactcccaaaggaaaatctccgattggctatcaaggacccatgttagtatgcaaatgtaaaactgcaatcgattccgattaaatccaatgattttctactatgcgtgtagggggttatttttgcccttttttttaatcttccttcctcttttcctctttgtgtaaaaatataagatacgtctcaaaatatattgttttttttttgtcatcagtcattccttgtttgctaaacgaatagtatgtcatcgacctcgccgtgtcatctcgatgacttgcatatatagaggatgcaggaagggcctgtaactaactataggggtgccatgcataattggattggatttcttttacctttacagaacaatatttttgaacaaaaggaatattactttattttgatatcatcttttcttgtattgcaggttttggattcttaaactcgtagcgtttgctgtctatgtttagatggtatattactgatttgcagtatgagctaagcatcggtcatcttttcatttcattcttgcctctgaagataggtactgtgccattgaagatacatgtttgtgtgcaagctaaatcacacttatgcatttatgcatggttaattacattgtttgctctgttaatctacacaacatgatggcgttctctgcaatcttaagggatttatagttttatgcatgattatgcttttcaggtctttagtaaaaaaatggtggtcagggatttagtaagaaatgctggagcactaattgatcctctgctcaaattgatcaaatagtactgtccatttatgcctactcttttctgatcacatggtattgtgtcaaataaatttgatatttagctttggtgtccttaaatggcatggttgttttataagaccctgtgattttctacatgtcaccttaacaatcagtaggctctgttggatttgtgtggactcataaagaagaggtgcttgtgtttgctggttcatcaaacagctccatcaaagcggtagggcgtgggagaagccaaaggtttggctgtgctgctactactactagcatccattcacattcattactctgtagatcaatagtaccatttttatttgcggatcagcagtagggttctggacttacattgccgatcaaatgatttgcggatgcaaataatgaatttccatatgtacacctgtagtgggccgtatgataataatatatctggtacattgcagaaatggctttgtagtccaaaattgctcatataattaagttgtcaaattatgtgcacggacaatgcacctgatttgtctgcgataacaggtaatgacgtgccaaattgctcttcagcttctgcatccgatgtaatcacgtttctgtcaagtgacatttgatacttagatgctaataaactaaatctgtatgacaacagttacgggttgaatcaactaattttctgacagtacatgtgcttaagtgcacaacctaaaatttctttaattcagaagaacatgtaaccacattaggtataaaatttgcaagatatcgatcttaatggcctggtgctgctaggtgtatgcattaattctggtgcgctagatatagtttgcttgcctccaggattatatgataagttagatgtattttgttggcctgctggatgtatgcattcagctcctgacttattcttgatttatttgtgcatgccggatccatggaagaatcaacccactaaagtctgaactctgaaataaggcttttggtatactgtggcctatatattctgcacgtcatatagctttcatgtcacagtatatgtacaggttagcactggatggaaattaatacctcatttgttttctatcttttcaagaactttgctcagggttggtataaatcaccacttaagtaactttgtgatggcatccatctagccctatggccatttacatagagcaataactatgcatttatccgcttttcttcttatgtaagtgaaatgatctggtggtatatgattctgttattctctaagtcaatatcttggatgatcttatactgctttttgtctgcaggcttcggggaaggttgagtattcaagccttggtcaagagttttttttttcttatatggtttgacaaaatagatatttggttgtatcgctgacaaaaatgtttgatatagcatattcttgattcatgtagattgacaaatgatttcacaagcaaatgaaagagtatgtgttttagacatttagtacacacgctattatctactgatgtcacgggcaaggatgttggtggaaggattgcggcgaagcgagtatttgaaggacgttgcaggacgtggccctggacctcgtcggcgcggcagagccgtgatcggcgacgcaccagcgaggcagggagataaactagattggactcaaaattgattgctctatttcctggcctcaatcggcttaaataatacatgaactgtaatgctaacaaactcaagagattaagatgctaacaaactcaggataaagcctaataacaaactctagaaaagaactcaatcctaacaactgttggtcgcccagttgttgccgccgcgcggcacctcgcctccttgcatacgtgagtccccacatgacaactgaggagctgttttcacagcttatctacaatgagtcaaaatttaaagtcaacatcatagctacaatgctagattaaatagggttatgaatatctgctcagaaatatttttgtatactcgtttttattttatgccaaaaattttgtattgatgtctcattgaaattgtttatatataggaatcatatgtttattttcactatgaattccctgatttatcctgcactttcttcagaaatttgggtgtaatactctaatttcttttgaatcctattgttacttgggcactgttgaggaaggagggtgttggaactgccacggaggccgagctccaagtggtctacgcgtattcattggcaagatcggtctcaagctgcaattctggaggtttacatattaactaccatcctacgggcttgttgacttggtgttgtatcatattctgttatcaatatttttttaattaacctataagtcaagactgattgattatgtaaaactaaattatttctagctttgttttgtcggtgctaaatatggtgattaatgcgatccgtaactttggtcattgcaatgtaagatagcaacagatatatggagacaatatataatgcatatataaaattagatttcagctatttggtccttgacatctgatgcttttgtttggaaaaaaaaaagaaagattaactataactggcaactaatcaatatggcattcttgcttaaaaaatcacaaaagcaaacctgaattaaataaactgaatatattttaatgaaatgaatacttttttaataacatgggttctacatatcgccgtagcgttagcacgggcaaattactggtataagagaagtcgttaaccagcaaatataaaattaccaccgggcacaactacggttttgtagcaaacatggcaattagatccttcaaaacaaaggggtagcttttcgtcagatgctcaagaccttcagtctccacgatgttcctcaaatttgctggatcttcgagtagctgcaagcacttcttctcaagctcggggcattggtgttccccagcaaacgccaacatggctgccacggttctcacagttacatactcacatagcttatcttcacagaccaaccttagtctctccatcttatacctgttagccgccgcgaccaggtctgggagcatcgccactgcgtctccacctttcatctccggcaacgagtcggtgtatatgaagtggagcagagcctcgaagtcctgcgcctccatgtcgtcgacgcgtatgatgacaccggcaccgccagtcgcggcattccccttctccgttagggagaaaagctcttggtggaacactggggatcgggccgcgagcacattccgatgcgccaagaacgtcttgccgtcgacctcgaacgtcacgtcggcgcccactccggtggcgaggaggccgccgaggtgccgggccaggtccgacggtggcagggttacccgcctgccgccagtgtcctttgcctcgggattcttcatgaccgtgatgtcacacctgatcgtgaagcggttgtcccggaggtactccgatctctccagtacggccttctggatgaaacgcagagatccccgatagcggccgtagccatcgaaaatttgcaacccatggctgtagatgtaggatgtcactggctcccgttcttggtcgagtaagctcaacgtgagctctgctctcacgattgagcgaccgtaatagtagtcgtgggcctcgtggccgtccaagacgaggtagatggatatgcaatcggaaacgttcgagttgaagccgttggggtagtagcggatgtaccaatcgtggccgccaacgcggaaatgccgagactggacgcagttgccgatggagacggcgtccttgatgctggagtagccgttgatctcgagcaggtgctggccgctctccgtgccgcctacaatcgcagaggcggaacgcagcagtttgccgccggcgacggtgggcgcggtggccattggcatatatatggctttaatttgggacggacaaatagtatcgagctgcagaatttcagataacaggagttttgacatcagtggtcgttattcggttaaagctgaatggaatcatcaagtgaggctgtgtttagttcagcgcaaagtttgcattttggttgaaattggagatgatgtgactgaaaagttgtgtgtgtatgacagattgatgtgatggaaaaggactgaagtttggatctaaactttggatctaaacacagcctgaatacatgagagagaatatacggccgagcttaagtcggtcaaaacctctctcatttttatacgcacgtttttcaaactgctaaacgatatatattgttttttaaaaaaacaatcatagaaaaattgttttagaaaatcatattaatccccattttcaaaatttttttaaaactaatacttaattaatctgcgctaatatattgtttcattttgcgtgtcaaggggaaaggttcctaacatagaaaaattatgtagca

SEQ ID NO: 49999 - DNA, 2521 bp, Oryza sativa
ataggagtgaaaaatgaacatccgattagatgcattgtaaaatttgtcgagtaccaacctaacaaatacttttctcaagaatagaacaaacttcgtcctaagtcctaactttacgttgaggttcctcacttgaaatctattcagggaactccatttttccaatttagagatatgttcgagtagtgatcgattctacgtactgaaaaagtatttctttagggaagaattaagattataccaaaagagtgtttgcaacacctcatgtaacagattcactaataaaaaaacttcacgaaataaattgttttaaataaagggaaccttcaacaatgtgagtccgttgctctatcagactcagtttgctatgggaaactatgatggataaccccgataatgtcttgggatcaactatatatcttgaacatgaatatcttagcatattgaaatagtataaacaacacgatcaactcacctagatcaatcgaatcagcttatagagctgagctggagatcatatggtagatgatttgacaaaagatcacaatgatatgcatgagcgaggttgcgagtagctacacatatatttatacttggttccagaaaggccttgataatgtaaggagaaagacctgaaggtgggaaccacttatctggtagaggtgtggtgcatgatttcattcattagggtttgaagtcttatgtcatctttgttgtgtaaaacttctacctatgtggctggcaaattttaccaaccgagaggctaggttattagttcatgccataattgtgacataccgacttcctagcttggcaatgagtccactcgctataaacacatttctttgtcacaaattgtcacatttaataagttgttagtcgaatgtaagtggagcaggtaagcaggtttttttttatcataattttatttaatatttttcttcacaattttatactagcaaatggaaatgaaccatgaagtgggtttttatgagagttattaagcatgaaacacttggcaaagatttttatggtgaattccacacactgccaaatattttaaggcaaagtatgaaaggcaaaaaaaatattttacaaagtgtggatgatatccaacagttcattaatgcttttatttgcactctctgagttccttctagtaaatcttttgtaagattaaggatttattaaaaggataccttgtagcagtacacacagtcatgtacatgtgtggtggtatttgcgtcttttcgcagtggaaagataaaagtcataggctgtgtttagttccctttaaacttccaaaaattccgtcacatcaaacgtttggacacatgcatggagcattaaatgtagacgaaaaaaagaaccaattgtacagtttgcatgtaaattgcgagacgaatcttttgagcctacttacgccatgatttgacaatgttgtgctacagtaaatatttgctaatgacggattaattaggcttaattgattcgtctcgcagtttacaggtagaatctataatttgttttgttattatactacgtttaatacttcaaatatatgtctaatatatctaatataacaatcaaatctaaaaattttcctcaactaaaccaggcttaagtataaccacgtatctctagttgcctacggtgcgccgtctcttcattgggccaacataattttttcatttcagcccttgttatatataatttgttttactggttagatcttttacggaaagaaccactgcgtttttaagtgactacgtatgaatagacttccctctattctatgctagggaattctatgctatagcagtagatagttggttttaatattatatttcttactattaaatttgagttttaacattcgggttgactaaatgtatttaagaaaaatatagatcacacatattataggcagcgaggtctagaatatatctactctatttttattgattgataggtaagtacgtataacaaattgcgttagatgtgaaccaattaaaacaaggaataaaacacatctattagcagtaacctttatttagatttgttaaaaataagagcccaaaacattcaattaaaaagaaaaacaataccttactttttaatttagacttaaaatttaaacctaaagatttacgtcttcttaaatgattttttttacgtgaaacagcaggagcaggagaggctcctactgcgctatattaataataaataaaaggtttacaatatttacaaaaatacaaaacaattaagagagagagaatcaatccatgattgcaggatgggtttgtctgcttttttactctgtgcatatgcagagcaaaatccttcttgaactctgatttcccttgactaaactgatagtcacattgttgaaaataaaatcattccttctacaccagatgtgccaacaaccaatcgcctgagcttcaaagaagaagttgagatgaaaagatacttagctgttgtaatcatgttcatgagctccagcgctagatttcactgaatg

SEQ ID NO: 50000 - DNA, 2739 bp, Oryza sativa
atttatgcacaattgcacagttccatgaaatccaaagataccgttaatgaatgtttctagattaggtatcgggactgtaaaccctgcctataagtagtcttggttatgcttatgccaaacttgtaatcagcgaggcctgtgtcctttgttcagtgtgatttggtcaaggcacaccacaacagtgtagctgtagcgaagcagtgccactagtagacgtccttctatgcctcctaacaaaactaagtaatctcaatcggtccgaagtttcacccgattgagatatggtcgcactgccatggtagatcggcataaaactagagcccgtcacggataacacttatctgtgacgggccatagttgagccccgatggagatgagggttccatatctcaatcggaacctaaaagtagcccgtcacaaatgacaatcatctgtgacgggctccaactaaagtctcgattgagataagtttaatgcccgtcacagatgacactcttctttgacgggcttttattaaggcccgatagagatacttgtatactcgtcacggttgattgttttagggccattacagatatttgttgcacagtataaataccccccaccacctagtgtaattgtatcccactatttactattttggtgggaggctgtagggggcgattttctgtcttttttccaaggaaaacagaaaattcctaaaagtgatcaaaatggagcaataaagtgagtaatattaatcattaattgagcaatttcatcacgtcttattttagcaatactgatcttataagatgtgcctgtaattttttttttttttgcaattgatcgaagttccgtaaacaaggaaaaaaaactgaacaactccttagttacggtttactgtttaccttacataaaaaaaactgccactcttctcacatataattataattgaatgggttatgtttcatttgtattattttcttaattcttacacacaagtatatttatacaattagactcattaagaattcatattcccaaggggcctctgaatctcttatgtttacgaagaaaaatatggactgcatgtgtttgtgatccctttcttctcatgggctcataccatcaatcacacacattcaccttcatccttttaactcaaccaaaaagatctaaagcctctatttgagattattgagcgaattattactactgattatctatttataaatttaatattttgacaaatacatttaacaagatagctcaaactgcacggtttaagcaatactatatttcgaaacgtggtagtacaaataatccgtttcagtaatccgatcaataagcttaccaaatcatccttctcaaacggttcaagataagggaggaggtccatggccggagagagcagctgctgtactgatgacgccaactggcaatcaatcaaccaatcaccagcttacaattcggccacacataaactcgattcggactaaagacgccttgagaaaaaatccgctttccttactcgttggcgcataagagataaatacgccttcttcctcgtctcatagtagtatacacaaccaatcatcgcgatccgccctcgcaaacaaaaagaaaaaagaaaaaagaaaagaaaaacgaaacgaaagcttcttcttcctcctcccatggagtcgcttgcgtcgcaagcgaagccggcggccgtgctctggctcgccggcttcctccaggccgcgcgcctccaccgcgtcgtctccttctgcgccaggtttcgcccgctcccttctcttctcgccccacccccaccactgcttccccatctcgaattctcgattcttggcgcgtcgagatggggggattttgtggtggtggtgggggagtttttcctcctcctctcgattcgctgctcggttgctaacgcttttgtcgtgtgtggatgcagctcgaggcctctgtcggccaggatcgcgcagtgcttctgctcaacgggttcatctcctggggaggtacagtttgctcgtaattgaggttgaaatctcggctaaatttgtgcttgtttttttttcgaaatttattatgaaagggggcggccaaaattcaatttgcgtgagtgacacagtagttgggggtataatttgccttgtgaagcaatttagcctggggttagcgtgcaatcggcccattgcagtaaagaccaaagaggctagcaaattagcgaatcgtattatatgtctgagtctctgagaatgtttagcctgggatgctgtagggtctctgatggtgtagacaaatatgctctccgttttggaattattcagggcagtagggcacaatgagcacttgatttttgatatttctcttctctagatgagtctaagcggtctgtcactttgtttactcaagttcttccacctcgggattaggggatttatatgcaatgtcatgatcttgttctcaatattactagcatggctgtttttctgttccatctgattagtaccctttctaaaataactcttacactttatagcttgttaaccctaaaatcggtggtcattccaatcctttcgtggatactgcctggggattgcagtcagttgcaagggcagcatctgtgtgatcacacagtagctgtagcgacctattcatttctacgctctgttcttattcaaatattctatgtaagttcttctctttatgcattgaaatatattaaggatactgattgtgttgctttttttcaaataa

SEQ ID NO: 50001 - DNA, 757 bp, Oryza sativa
caacatgcagatgtaattactctctttatgctttcatttctctaaatcttaagtgagttctctgtgttgcagtccttgggtttcaacactaaattgtgatgaataaaatctaaacttcgatttactcataggcacatatttacaatttctctatggaaagctcaattcttgattttttttttctgcattgttacattattacaggtatggactattgttttaccatcctcaagattcccgtatttcatatactaaacagtggtgggcccaattgtaccttttgtaacattggccatctcacgtcaggtataatgacattgctaagcatgctttggatgttgtgaaaagaaagagcctagatgcaactaaagcattggatgctcacaccatatctgaatcaacagagaaacctgaagggtttgatgagtaggttcacatgaaaactcgttgattgcttgttgtttttacatgttctgcatgttgacatgctattgttagggttgcaattggtattggagaacaggtctattcaattcttcttttaactattttctttattgaggtatgtttctttgctcatgtttttccatttgtcatgactcacttcacatctaatttcacagaacatgttttgttggcacctcatgctcatttaagcttatctagtgctattcttttatgctatctttttccactgatatttaagttgatgctgtacaggtttcagtaattggttacataccttactttgggaagc

SEQ ID NO: 50002 - DNA, 18835 bp, Oryza sativa
tccaacatattctgagtgcagttatgcaatgttgtctgttgcagtttgtattgactgctgcaggtacccaagcagaaaaagtaattgatcaactgaaaccttcgcatggagggaaactgcagagaatacctgttttcttcatagctaagcgactaacgtaagcactcatcatatcactcattcaagaaaattgcattgttatatcattcaaggcttcacaggaatcatgccattttcttgtatagaattagctaccggtgctaatgatgtgagaatagttaattgctattgtttgatatattatcttttaaccatatccttccaagtaaaaattggtattggttatttaattcttattttcatcttcttatagtcttaatctgaattagaattcagtacagtatgctgagtgctagtattcagaatttcagattaatttccttttagggattatcacagttttcctgcaccactgctactttgcttcccttgggtgcactataatgtattgaaacttgtctgaacctgtatgtgcaggactcaagtgctgcaattgtttccagaggtacacaaagaacaatgaaaggatccacataaccatagcaaaggaaacaaacgctgtgctgggctttatcacagtgctgctgttgaagttacacccgaagggtgtataaccagaactgtaaaactgtaaatattccgccattgcgattgtatatatggggataaagggaattaaaaaaaaaactatacttgtgcaatgatgtcattcatatttgtgtacataagtacataacaacagcaacatctctttgttctacgaaatgttatagccagcagaaaggttaatgccattactagtgctaacttctaaagtgattctcgttggttctacccttgtaggtttctaggttcactttgtgtattcgagatttgcatgaacgcgtggcacatttgacatgaacacagcccaagtcgttaggaatttaagacgtcaactaatactttgacatattcatgtatacctctttttttttcctttttggcaatgatatattgcgtaattcaggacccgggaatacgccgtgtacctgcttgacttgcgtgtacatactccatgaaagcgagcgtgcgtattttgtgttaaccactgtagcttaagactgtttatcactagtactatttattaagccgaattgccgaattgacgtgtaaaggctaaccatgttcattaattcatggattatctaaccacgtgagtcgtgactaggtctcacacgaatatggagcgcatttttttttcacatcagaaatttcaattgacccgaacgatttctctatgtacaagagcgcaataccaagatgtaatattaatattagtgttagcttaaaaatatgaacatcattagcctatttttttcgtggaagcagcctttaagattgtatgagaccggttttgtacttttgtaaggtgctagacaaatttccatgatttcatcggcgcagcattattagctggtagtttgtcctcttgtaattcttttctcagtacatgaccatccataccctcatgtcttctccattttgaattagcatattagcatgcagtcatgtacacaatagtacaatacagctagatgtgtacaatgacaattctaaatactagagtactattactactatcattgcttagaaacgaccaaaacaaaggcagctgaaccccgatcagcgactaacttgccatcaacaataatcaactatattttctcccccaatcaaagcatgcatggtagtctgctttcttcctggcaattttgtctgccatcttccttcagtttctatcatgaatattatacataaagcattttcctacaaatgtgtaaacatttttttatatgaaaatgattggatggtgcagatgaactggactttcatgataataattcacatctcacacaaggacgaaaaagttggtactttatgagttacacctccgtaaaaaaaataatacagaaggcaacttaaaaataatttataggtaatttttatatatatttatattgttcgtagcttaaaagctagtgttgaaaaatataccgccatataacagaaaaaatactaaaattaaattaatgttttaaaatttaaattttggttgtggctgataaaccaccgagcatttgtgttttcttttaattaatgcattctgtggccggtgatcggattgaacagtctttatttaatgcatcccctgtttcaactaagaagagttggctgctatgagctgcaccctaaattttgtatggcaactggagcagttccaattcttccttgtggatttgcacaattctcccatttcgtgcatgagtgcctgtcatccttgcacagcatcattgcttgatgttgtgttgccacctaactcattagcataaacaaaaggatgaacaggagctaagcatcttacccactataggagcattacttgatgccattgccatgtactccattactacaccaatgcaaatacaaagaacataagtactcagtttcatcatgattactaaattttctgtggtgtctctggccaaaatttaccgtcagctatgatttgccaaaatttggtacaccctctgaatgtttgctgtctctttacaagaactcttctgtgttacttagtgatagatattgagtttattggcattgtaggggatgtaataatcgttaatgattaatcattatatatggttcatataataccagacgaatgagcattaattggtcgttattacgaacccctcgagctaatcaatatctcagatgcaacttagatctcatgatggattggtggagccgaagctgcagtggatgtagctctcagcttcctggaccagtactaccactgcccttgtgctgggttcactgatccttttaagaatgttgagctagctagctagttcatcttggcaagcaacaacttcatcttcaatgcacttgcattacttgcattgtgttatgatctcttgtctttttggcaagcttgttggtgcgaaggtgaccggccctgtcgtccggtgcgtgtatcatcaccattccatcgaatccatgttatgatgtgaagtcaacttaggcaaaaaaatagggtcatttggacatgcttatgtttgatgagatgtcttgttgcaaagtaggccaccttcatgtcaagatatatatttacagtgtaaatggcaagattcccagtattatggtagaggaagtttgcctcagatgaacttgaatgttacaatgattttcgaagaaattgttggtttcccttttcgccgcgtttggaacgagggaatttcttctgtgttttattgcgggaattgaaccttttttcctatgaaatctattcaatactttcaccaagcattactctacaagagagatgcaatcaaatatatggtagtacatattaacaggcagaccttttttcctgttggttgtcaacattattgttttgattccgtcgacccacaaattaatcaatttcttgcttttcttgaagactaaaatttcttgctcattatgatgctggttgaaaacccctgtttgcgcaactaacccatagcgtatatgttatcccaatcggtgttaggatgagcgtctacatccattaccaagtaaaaggatcattccccaattggatacaggtaaaataaaggaaatattactgaccgaataataagcaatgcaattaagcaaatataatttctgttataattcctgttactttcttgcagtggcactgctcatcatcagtgcaatggttgtagtgctgtactaggcttgtgtaaagcgccgaaatgcagctgtgttcctcttcttctttttcagacaacagaagctctgtctcctcgccgtgccggtttgtccctcttttccactcgtgcatgcatgtactagaaaagatggaatcatggaacaatatggtacaattaattaaacttatactaactcttacaattattgtgccttttctatcaaaaaaagataggagtatattcaatctacagaaagttactgaaagccgaatattattagcctagaattcagcgaagaagctccaccacgaaactcctacatttattcgaaatggcttttttcaaatttgcctcgcttttgcagatcaatgattcgaagaggagaatttgtcacgaacttttccttgggatttccctttcgtttctttcttccagaggtcgtactggcgatgtgtgcgcgcgtgcgcgcactctcctctcctttcgctttggcttccgggtgattgtctccgcgatacctacgctggctttcggctatctcctcctccattgaaggtaacagattaaccgatcagtgcgcattgcaccacggaaaaaccaaaggaatcggaaaaaaaattctatgaaaattccttctttttagcttctgcaaagggaatgaattgcaattaagaaaggtttttcctttttctttgagataatggaataaaacttcagcctttactcaacgagttacagccaattattacataaatttacccgataacgagcacacaccagaaagtccataaaagcacacccaaatactagcaaacacaaactaatatgcaccaacactagataaagatctcacaattattgaatcttatttgtgaaccttcgttcgaagttgacgaaaaactgcatgatcattgactcaaattaagagatgcagtatttattaactcgatgttttcattacaccttcttagccattacattgccctgaaaattatatgtatatgtatgtttttttaatatgatttgccctaaaaattaagaaaggtttggagtgagctagctagaaatcgatctgttgataattggtcgattcgtacaatttgattaggacttaggagttttgatgatgctctgtgttgttgcacagtgcactagtggaagccggcacagtggcgtctctgtgactggcacgttgatgacatggcacctactgcgtgtgtgccatggctgcctttgatttgtttctggccagtggtaatcagtgcatgcgtggttgctttggattgaatatgatgcttaatttggtgtagagcaattaagcaagcctagttgacatctcagttggtgcatgtaatgtactatagtacagtatactttcgtgtgcttaatcagtactacgcctggccaggtgaatttattctggtttatgcatgcaaaaaacaaaaaccaagggtccttgaatttgagcacagaaatggaattttcgctctatgactccttccttttgaaccaggacatgatttccaaacttttgaactgctcagttttttaagaacctttttgagcatttaatttttccaagttttaaatagttaatccattcgtttgcatgctcaaatattatcacgaaatcagataatgcatcactcgttctaaacaaaagaattgagcatatagtggaattttcgtactattcatgtcaaatatatataatttgatgaaatggcactgaccccacaatgtggaaattcatgtaagtagcactttacggatttttctatgattggcatagtgaaatgacactatcacaccaacccctcgtacgtggtgtggtaatgttaattcggtacaccagtatgccaatcagatcgatatcaaaagttcaccgcgctagttagattagcgtggcaagacaatactgttgaaagatgttgcaggtggcgtgacaatgttttttcatcgtgtcagagaaatgccaaggggtttttcagctagttacataagatggtaggctagacaacctgagttcgaagccttacctcttctaattatttgatattagatctttccctaatattcgcgtctttttaaattggcgtgataaaagattcagatgtaaaaatattttttaggagtatttacttttaaaacttaaaaagttttattaaaatttcgcagcttgcaacactgatgaccatacaagttagaatcagcataaatcgtaattacgagatggttggttgttagagtagctggaacagatgattagatgcaacaataggcatgtaatccgacaaatcaaccgatcatttgcgacctttgcgtcgtaaacaaacggtgtgaattggccaggggtcaatcggcggcgggttagtgcgtccaaatctccgtttataaaatagtcatgagaaaatcatactgtttttcatccgtatcaactgatggtttcgatcgaccaaaaaagacaagaagtactggagtttgaaggacgctggagggtgccaactctgttttacttggttccgtcgttacctccccgtgtctaatccacatctaatttattgacaaatgtttttttatagtacatcaagttggtaactaaagtttcctggaattgaaattggcttatgcatgcatatgttccatttgatatgacaaatgcgtttatttctcgtgtcaactggtatttacgttaaaaggagaactaaattttcagttgaatatatggcctcagctcattgagatatcctcttctaactgtagttgtttctttccgtatattttgaattcagtcccatcattttttcctacagctgactataggccgtaacacttattagggaacaagaaataatttataggtaattttatatgtgatgttattagtgacttaaaagctagtgatgaaaaataaattacaacaagaaacattaaaatcaactataaaattaaatttttggtagcggttgataagcttatagagtattaatcatcatataaagtttttcattaggaacaagaaagacttaactaccgtatattttatttaatatgagtatgtggtaagaaagaatcaataaacattctccatatacacaggaaacaagtgtttaactacttctaaatgcatagattacgataatgttgcacatcaaaataaaggattaaggttatatgatatgataatcagtatggaacggagcgagtagtatataatttgatacctcatgataacggcgtactaataatcggcaaattttgctacaaaacaccacgaacccactttaaaaatatgcctaataaaactggacactcttcattggtatacacgcttgaaagattcacatatgtttacctatgctgcgaaggattacattaccatctcaagtgacagatcctcatactcctctgctgacgtgtacagagcatgccagctcagcatccacgtcacgcaactccccgatcccacgtggtcaccgcgacctctctactcgactactccataaaaacccaagcgaactcacgcctacgcctccaaaactccacccacccacccacaccgtcgccatgcccaccgacgccgccgccgccgccgccgcctcgtcgccgtcgccgctccttcctccggcgccaccttccgccgctcgccgccggcgccgtcgcctcctcacgtccccgaacccctcggtctcctcgacctcgacgtcgtcgtcatcgtcgtcgtcgtcgtcgtcgtcgtccagcctctccttcccgttcgctcccttctcgccggcgccctcgccgttccaccaccgcttcctctccccgctccgcgcctccgccgtgcccttctcctgggagcaccgcccaggcatccccaagacgcccgcgcgccagcaccagcaccaccgcggcggctgcggcggcgggaaggtctactccacgccgctgcccctcccgccgtccctcctctccagcaaggtggtggtcgccgacgaagaccgcggcggcgccgaccgcctcgccgtctccgacgacgacgacgacgcgaaggccgcgaggaggaggagtcggcggcggcataggcggaggctgctgcagcggccgcggcggccggcggcgctggccgccgccctgacggactggctcgcgtgtgagcctgaccggtcgtgcacgaggtccgtcgactgcctcgccgacgccggccacgcgccgacgacgacgacgacgacgccggcggcgaaggccgggtgagaattgagatacgtactttgcgttgcgtggacgggtgggtgcgattaagagtgtgatttgcggcggattaatcaataatcacgtcgatttgtgcgacactgtaattaattaaggtgggttttcttttcttgtctgtgtgcatgtgcttgctccaacataattagtggatggattaattcgacacgattagtacagtaggctgctaaatgactgtatgtattagtgctgctgctgttgcgattggtccatttttcttctttttcttcttcttttcctttttaagaaatgtaatttggtcagtttggtcgctcatgtcatgctaatagtaatccattctgctcaatgtgtggtgttgcacgtttactattactccaagcctgtttggagaagtttctaaccgtttaaattttaactcaggtttttagaagttgtagttgtagaagccaagagttgggttttccggcttctccagattttcaccaactgtttttcataattttaaactcccctaatggggcctctgttagtatggactgtggttaaggtacatctgccactggctggtgggttcactaagggcctgttaactttgatgccaaaaaaaaccttaccaaattttagcaattttgacaactatgccaaaattttggtaggatttcttacatagttatcaaaatttagcagcaaattaaatgtagccacttttttagcaattttaccaatatttggtaaggttgaaaatgacatcaaagtgaacaggccctgaatataattttctcctcgcactctaaaataaacattacaatatgtgtttttttacaaagacatgcataaaataattcacattttctttgataattaagttcacatattggacctaccaacatagatactgcttggttctcgttttacaattctaaacgatttaaatttttaagttagattttaaagaagaattatatatgaagatattttacttgagctatgcaatgaaagtgacagaaaaaacatcttaatgtcgtccgaaattcaggtgctttggatttcgattataatataaagatttaccatgcaggacctagagttattcaccaaggatatataaaaaaatgtaaatatttttttaattatctaaccaaactatatatatgaccaacagttcagctgagatctctagcgaatggaatagaaatgttccatgcatttttttttttcttctacatttggtcactggctcactgctaattatgcaagcattagtttaggttggctgatcagcacatgcagtcggcggtttgaaacaggctgcagctctgcataaaaggataattaatttgtgcaaaaaaattcctcccacgtgcaaatatgtatactacttatttcgttcgtattataaattgctttgacttttataaagttaaattcttttgattaagtttatataaaaatatactataaacatttatagcactaaattagttttattaaatctaatatttaatatattttgatagtctctttttctatattgaaaatattgtttttttatgaacttgtcaaagtttaagaattttgaaaaaaaaagatcaaaacaacttattgtatggattatataaaacgtggtactagtaccgcagtatgggatgttccaatgttttatagtttccccttaacgtgacaatgcacgaataagcttgttgacttgacagcatattaatcaaatggatgtccaaatctagtcaccaaacattcaaaataattacaaataagcagtatcatggcccgggttataagcacaatttacatacaccctaaattgcaaatcctaaaaatactagctctgtgcctagctatgtaaactggtacggttcaaaattaatttacggcaaattatttttaaagaaaaacaatcgtcaccagttaagttattttgaatacatgcgtgcgcacaaagaatggaaggcaagtagtagagatattttgatgaaattatattttgtatagtttgaccatgagaatgtgctgtacttcacgctcgtctatcggactatcggaggctcggagcgaccattttcaaggttcaaatcaaaatctccaacaactcacatgtttacaatgaaccttcgactgtgaccaaaactgtaatttaaaccaaaaatatgataaaccgcaagacaaagataactagataagcataaaaatgttttttttttgacaaactcatacaaacaaaaaaaaactaaccaaataaacagttgtaataaaacaatactaaacttcacaacaatcttgaataaccgacaagtagaaaagaaaagtagtagcaaaaaaacaaaaccagtgttttctactgtgtcactaattttgttttaaccggacgattacatacaaaccaaacctcgtttttgtcaagtactcatcgcaatcaattagtgagtgcgaggtttaagaaaaaaaaaggattagccagtacgatattaatgtctcgatcagacgatcagctcactaatcactcagccttatgtcacagagtataaaaatgcaaattataataagctgcttccttcgtttaaaaatgtttgacaccgttgactttttagcatatgtttgaccgttcggtttattccaaaaaatttgtgaaatatgtaaaactatacgtgtacataaaagtatatttaataatgaatcaaatgatatgaaaagaataaataattatttaaattttttgaataagacgaatgatcaaacacgtactaaaaagttaacggtgtcaaatattttgaaacggagggagtactactaccagcaattgcaagatgcacagtaaacaggcaaagctagctgtagcattagcactagcagcagtggatgcagagacagcgagacagggcgttcgttgggtcgcgtccctcgctcgtcttgaccacgaaagagccttccattggcagatgctgctggtacaaccgcatgctaattggagtaattaaagtcatctgcaagaactagctactcagctggttgatgttgaattcgagctgaatttcctattaaattcctgtgaatttggtgtttaactccagcaacagtgcagagctcgcctggttagagcatccgcaatggtaaagtaaggtgctctctataaaatatgtatatcttagcaatagactagattaatagtaaaccacctcaataatatgtctacatgggtatctatagctctctcatgtattgcctcgtttttctctatagactatctctaaattagtagatagctttgctctctctctcttcatttaatatcttccatgtaggaaaatatgctgacatggatctcttgtagagagtctatagataaccattgtgggtgcccttaggttaggtgatgatgaacattggacagggctatgtagccatttgtgccactcaaagtcaaatcgcgatcgggaaagtaggttaaggctatgtttagttcaacacaaagtttgaattttggttgaaattgaagatgatgtgactgaaaagttgtgtgtgtatgacaggttgatgtgatggagaaggactgaagtttggatccaaactttgcatctaaacacagcctaagcagcatcggtgcaggtgtgacactgtttctaccaaatcgctctcagatctgcgtgagtaaccaaattgatcgatcggcgtcagatctgggcagatggactgatggatagcaaccactctgacatcatggtcttcagtaattcagggagtatactgtactgtacttctgctgaattggatcaatcggaagaggtaacttgacgctaaagctactactactgctgatgagctacagcttcgtcaaccacgcatgcgttatttaccttggccgaggtgaaagtgaattcctcgtttgactgtaacaaagagttaatcctgcttggagtgcaagggaattcatggcagaatgcagattaatcgatactactagtcactgatccagtagtcgacactggtttccaaaagtcagcgcaaagtctctctctttctttctctctctctcgtattttgtccgtttcatataaaaaacctattatcaaatatgagatatcttaatattataaatctgaatagaaatagcttatattcagattcgtaataccaagttagtaatcctgagttagtgtaatagtttgattttctggggacgaagagagcaagctagcaaccctacatgtgcaatatgcacatgtgcaatcgatcgatgagtgcttgttgccgtcacgtcgggctgtcgctgattgatccatactatgcctgtctggataaaagcttttcaacgcagaactgtgcatgtgtttgcaaatgtcatgggtgaataatgctgccatgtcattgccggggctgggtcccgggaagaactgcactgactgcgttcttgcgttagtggcttcatgcctgtttcgcgaaaaaagaatttctagttgtcacattggatgtttgacctgatgtcggaagggattcttagatacgagtgaaaaaaactaatttaataactcgtctggaaaccgcgagacgaatctttagagcctaattaaactgtcattagcacatgtggattaatgtagcacttatggctattatggactaattagagcttaaaagattttgtctcgtgatttccatgtaaactgtacaatattttttgtttttatctatatttaatgcttcatacatgtgtccaaagattccatgtgacgttttgaaaaaaaaattggaaactaaaccaagcctcagataacaataaatagccaataattggaggaccttttctcctgtaagagcaggtgcaatagcagattttgaaccagctataaacacattccgatgagataaaagatgagagagaagagtagcgggctataaattcttagtcagctgcagcatggactccaagatacatgtgtgtatgataagtgggaccagatattaattgtgtagtatatatttataggtaactattggctattaagttgactatagatgatttggagccagcgattggctattaaacttgctctaagagcaagtttaatagtatagcccactactggctccaatttatctatagccaattcatacaatagttgcttactatactattaatatatggtcccacatgtcatacacacattgcgtcttggagtccgtgctatagctggctataaatctgtagcccgctgctcttctctcttatcgtttatctcattaaaatatgtttatagctaactaatagcctgctattgtacatgctctaagagctctgaagatagccgggccctgtttagatgggactaaaacttttaagtccctatcacatcggatgtttgaatattaattataaatattaaacgtagactattaataaaacccatccataatcttggactaattcgcgagacgaatctattgagcctaactaatccatgattagcctatgtgatgctacagtaaacattctctaattatggattaattaggcttaaaaaatttgtctcgtgaattagctttcatttatgtaattaattttttaagtagtctatatttaatactctaaattagtgtctaaagacagggactaaagttaactccctgatccaaacatcacctaagactgtgagattttgtgtcatcgatttgagtagtagtactagatgatatgtcttgagatttgagagttgacattgttcctaattcgcttttgttaatcgaagtgtggctcgtgagatcgatcgacggttgcattggcagcgtgtgcaagctcaatagtggttgccaattataaggctgagtttccttttttcacttttccaactcatatctctcatttttcatgtgcatgcttttaaaactattaaaacggcatgttttttaaaagaaaaaatatacaaaggttacttaaaatatatattgatttatttttaaactttttaagttaatatttaattaattatgcgctaataggaacaatgtttttcgtgcgggagataactccacctcccttacacagcctaagggcaggatctaacacgagtactctttcatcctaacataaattagatttacgtgttagatttatttatttggggataaagagagtatgtatatcgacatgtttttttttagaacgtggaaatttggtattaattgtttggtctcttcgtgcacttatctgaagctagcttcatactccttccatcatattttaagtgcagccatactttttcgtgctcaattttgatcgtctatctgaaaaaaatttaaaaacataagtcgcgcataaagtactattcatattttatcatctcataacaacaaaaatactattataaaaaaaatttaaataagacgaacgattaaagttagatagggaaactcatgatctcaatggatggagtaccagcgaggcgtattttatcgtttgttttcctcgagttatctgaagattttaggtacggtcaagtgggtcatacagtatgtactagtagtacaatctgctggtggcgtcagtagagatactcagcagagcagagcagagcggtgcagtaaattggctacaggttgggccggcagttctacgtacggtgtgctatctgtctaaacggctgtttgtctgcagcaaactaatcaatcagggttctggtataagatggaggcaataatccgatgaatgatccagtttggccggtctataaactactccctccgtccaaaaaaaggcaaaccataggtttccgtgtccaactttgactgtccgtcttatatgaattttttttataatttgtattttcattgttgctagatgataaaacatgattaatattttatgcgtgatttgtctttttaatttttttcgtatttttttcaaataagacgaacggtcaaatattggacacggaaaccagggtttggtttttttttttgacgaagggagtaaatggtaagaccggtttattgtcgtccttgtcaaattttatttttattttttacgattacacgacagacgcaggcctacacatatataccactctatactcacaccgacgaatacgtccccacatattccgagagatgaaaactaccggcacatctctcattccgggaatgcgccctcaccaatttgttacatggttgatcgatcgcggccatatataaccaaacatgcattcagcaaagctagtataaaagacacaaccaggatcgatcacgtacggtgccggccggtcacgagcgccatcgccaaataataatgcgcctaattcgatagctgcgtgctgtagctacacattcattcgcctcgcatgcaggcgtacgtggctggctcgattatattgaccgtgcggttgagggcggccaccacgtacgatgataagaagaagatgcacggatgcaatgcatatgcagctgcaggtgttgattcgaccgaccagatcgacgacgatgtaatggatcatgtatggataagtcatcatccgaatcgatcgatgatcgatccccacatgacatgcatgatcctgcaatttcctgccgaccattttgccctaccccactatcaattacgggtggtcgatcaaatgaaatctttctcgcgctccctcgacctagtttaagagcatacttgcatgcatgaaaggtttcttctaattttcagtttggacaagaacaataaaaatgagcgatttgaacagcttgaaaactaacattccaaaaacggaacgaaacattagcatataattaattaagtagtacagtattagctactacctccgttttttaataaatgacgccgttgactttttctcacatatttgaccattcgtcttattcaaaaaatttacgtaattataatttattttgttatgagttattttatcactcataatactttaagtgtgattaatatcttatatatttgcataaaatttttgaataagacgaatggtcaaacatgtgagaaaaagtcaacggcgtcatctattaaaaaatagagggagtaatttttttaaaaaaattaatataacatttttaaaacaactttagtacgataacttttttaaaaaaattcaccgtttaaccgtttgaaaaacttgggttggaaaactcagctgcggaacacaggctgagtagtaatatctgtctaggccctttaatttcacgcttcatatgcatatgtatagcctcttattcttctttttttttttttgagaatttgtatagcctcttcgatcgtataattaaccagcgttgcgtttggagaacggccgagcacacaagagtgtgtcctagcctgccgtggccgtgcgtacgcacgtatacacgtacacatgcgtgtgcgtgcacgctgctgggtggtggtggtggtatatagtggatacatcagccggccacgtacgaaacacgactactgccctccaggtagctagctgaaattgcgacgacgacgacaccaattaattcgcatcgcacccgtacgtacgcgagcaatcgcaattcgcaatcgacgacatacatccaacactggtcgcgcgcgctactgatgcaacggcgcgatagcacgtacgtacatacgtcggtacgtgcgagatttatttcttcgacgtacggcgcgtgttaattaattttgctgtgtacatatagcagtacacagcttacgtgcattatcattccgttctttttctccaacaaaaattaaatgaagattaaagttttcgttctttttctccaacaaaagttaaatgaagattaaaatttttgtggcacgttttctaaactgctaaacggtgcgtttcgtacgaaaactttctatataaaagttactctaaaatactatattaatctatttttcaagtttgtaataattaaaactcaatcaatcatacgttaataccattttattttacgtaaaaaacttaatttttctctttatttttatctttaggagaaaatagcatcaccgtatatgacagtagtggtgtatctgcagtgccgtgtcggactcatcatcgtcgacctgaagggcccatatatgtgtagtgcagatgtatggctacaaggcccatggaagcgaaactttcactagcgtttttttagtcccacctcggggagcctagcgcacgggcgcggggtaataacatctccagggcgagctggtggcgtgcccaaatgaaggcacacccggcgcaaccatgcgcggtatgcgcatttagcaattgaaaatgctacgcatacgatcttgttacgataagacgcaacggcacggacggcaacagcaaaacgtcacgcacggcgcagtctaagcgtacttatgagccctaaagcccagttcacctctaaacctaactttacgttcactactccaaaccctaaatctgactttcatgttctgatctaatctgcaagtgtgaaactaatccaatagcatacgcatcgaagacgaaggtatggcatcttatttacttgattttctttagcttcacaatcatctttttttttacattattctctctttcttttttttcaaggaacatatttgtatgcgtaatttgcttaaccatgccacatgataaattcaatgttgagtgctaagtacaattactatatacagtaagatattaagaagaggattgcttaagatatgattgaaaagaaaattgctttggttggctcattggctctccaagcaagccaaccagatagcaggccaggacgtcaagagcttgggcttggatataggatcaactgaggcctgagggatccgtttgattgtacaaccatcgtacgaaataattcgtacgtatagcagcgctgggtatgaaggcacacccggcgcaaccatgcgcggtatgcgcatttagcaatacctaaaccaaagttaagtaattggagtcgctgcagggtgacagtgcgagcgtatgacacatacgcttagcaaaaagtaacaacttttttattgagatttcttttccgcattagcactcggggctggttcactttgtagctattttgaactctactaaaatttagacaaattttgatatattttggcattaccaatttttttacgaattacacccccccgaactatcgcggtcaaccgaattacccccataaaccacaaaaccggatattcttcaccctcaactatgtaaaccggacgaattaccaccctcgacccaatccacggtggttttggtctatatagcgtacgcgtggcagtccagtcagcattctatattaaaaaaaacatgagacccacctatcatactcctcttcctctctctctccctctctcccagcattctatattaaaaaactatgagacccacctatcatactcctcttcctctctctctctctcacgggtcagcggcaagcggggacacagagcggcagcagtggctaagggcggcggcctcggcgcggagctgcgcgttggcgaggcggacgaggcccacgcggtcgcgggtggcgtgcccgcgcgccgcgagctcgcggttgcagcgtcagagctgcccagcgcgtgtgcggagctcgtcgaggtgccgctgtttgcgcgcggactcctggttggagatcttccggcggaggcgccgctcgtcggcgtcggcatcggccttcctctccggcggctgggtcatcatcacgcggtggctgcagcggtggcgccgtcgaaagcgagggcgacacgcgggaggtccatgaagtcttgccgacgccgacacttcctaaatccccatcctctctctctctctctctct

SEQ ID NO: 50003 - DNA, 4808 bp, Oryza sativa
ctgtactaccatgtagaacaacaccaccgcggattgggtcgaggggggtaatttttccggtttgcatagttgggggtgaagaatgtccggttttgtggtttaggggggtaattcggtcgaccgcgatagttcggggggataattcgtacttttttcttcttttttttgcggggtacttttttccaaattttaaaagtgatggatgtgtttagtttaaaactttactaaaatttggtacaatttttgagaatggaaacttctggaattgtcaaagtttggtagggtgatattggcaagtatatatgtttagtttgttgtaatttggtgctttcaaaatttgataagattgaaactagcgataaagtgaaaaagttattaataagcccataaatgccattacgccattgccacgaaacacaaaatccccgtgcaacgaggcccgaacgggggcgaatgggcgatcgatctcatcgcccgctctgcgccaagcaaacaacaggcaaagccgcggggacgacgttacgttacgttgttgtttagtcccataccggggagctaagcccaagcgctacgggtgataagaggggtggaccgaatgggaggcgtgcccaatgcaggcacacccggatacacacgagacgactactcgtgctgtggtgggaccacgtgtggaatgcacgtgtagccgaaatcattcaggaattcaaaaatccaccggcgagtgacggtgcgagcgcatgacacatgcgcttaagcgatctccatactttttttaaatttttttttgggtccatcaatagatggtttccatgcttgtttcatcaatgtcgtttcaaggccatgcttgtttcatttcatcaatgtcgtgcacagttatcttggccatttctgttcgttcaattaattggattcggtttatttaaggacatgtccagcgcagcgaaatcgatctgattttgccacggctccagatccaggctagtggcccaaccgttgtggcctggtgggctcgtcgcacacacgggtgcagatggaccgacctgatatgatcgggcccaaagaagagaacacatgtgatatataaaaggaaaatgaacaggacgaaatggcaacatctgagtgaatcaaatcaaatcaaatccactgtataagcagaagagttgttcatgtttggctctttgccatggatgaccaaccatgatttattgcaccttttccccttcgtacaaaacgcgacaaccatacggcggctgcacgcgctccgggatgaccaaattatctgagaaaaaggggctctcctgatcgacttcttctacctatacttggctggtgtacagagcgcaatgcataccagccagtgagacagatcgcatcacaagattaggacaacagtaagaagcttgatgccttgattagcttccattttcaaacctacaaaaatgcccagatcaaacaatctgcaagtatacgaacctctcgggagagaaatgccagaccactctattcgtaatgccacgggacacgcacagtactccaccctgcagcaaagcaaagccagcaacgacggggaggagaatgtttagtcccgtaccggggagcttggcgcgtgcgctccgggtgataagagggcctgaccgagtgggaggagtgccaggatgaaggcggcacacccggatacacacgaggtgagtcctcgtgctgtggtgggatcacgtgcggtatgcacgtgtagcaacaaaaaaatcttggtcatgacgaatcaatccacccagaggtgcgattgactgcgcgggcgcatgacacatgcgctttggcaatctccccccaaccctttttatttttcccctttttgggtatacattcccggttcgaacaaaggtactggaggaaatggcaacacgtatcagtgaatcaaatcttttttttttcagcttctcagttcgaacaaaaagatggaatcaaaccatatactgatatgctaaacccataacgttggacgtcaaacaaaaatgaaaaagaaatggagggagtatttttgactctttttctatgaatcaccagccttttattgcatcttccccttcgtacaacatgtgacaaccgaatggctgcaacaatgaaattatagaaccctctctgtaacgaccaaataatcggagagaaaaaaaaaaggctcctcatttctactacctacttgactgatgtacatgtacagagcgcaacgcatgcccacgtcgccaccacaagttttaggacaacagcaagaagcctagcttccatttacaacctacaaacaatgcccacatcaaacaatcggacaggtcacaggcgtcgtctggtgttttgctcttgtcggctgctgtgcagtgcggtgcagtgcagtgcagtgcagtgctattcttgttgtgccttgtcaagatcagatttggttagaggtgaggtggactgctctttgtctttgtcttttgcatttgccggccggttactctggttgacaaggtggtgaagccagacaaccaggtccagaatgtagtcctcggtcttcgccttgtccgcatggtagagcgtctcgaccacgtccggttggcctggcctccttccaaccctctcagtcctgaatgaaaacagcatacgaaaccaaaaatgtaaatgccatgtgtgaaggaaatcttagtttgcacaacgaactcgtagggcattcgataatgtagttcttaccctgatctcgcccattcgctaaaccgcaagaagcctcgggcactggagttcaattaaagaattcatgcaaacagagcataaaagtagttataatcctgaacgctcgaaaagctaaaattcaatgaagcttaagacattcattactacgtaacaaagcacagtaccacgtggtattgatggccattggaacaagccatttcaatgttttatccattgtagccctaatttgatcaatattgagctgcaacagaaaatcaggatttcagaatacaaatttttatataaccatagttctgtcattgtgtagtggtatcacctcctgaggcactgacgaagttcttaatctattaggtagtgccgatctcactcttggtggcaatccttggtagagagcatctcttgtatttggtggtatatatcctgatcgagaaaccttaaacagacaaaatttagtaaaatagctacatgcaaatactagctagtgggctttgctgaaaataccaattacgctctttggtgctctgccactcttatgttaagtgggtacaatatacatatgctaaacctacagacaaatgtgtagtagtttccaattgatctatgataagatagccaaatcatgccaaatcttgggcagacgtcgcaggcaaaatctgagggaacttacaacgctatagatctgtatgataatatttgcatagtgtaatgcaagtccggcaggtcctagtctctgacagtcttcagtagattcagaactcaattcaccttcatctacaaatatattacaaggatcagtggatagtcctgtatgatcgattctaacatgagaagtaggaccatgaaagtaccagaagatccaaaagaagcgttgatctcaaaatgcaagtactgcacgatgtctacaagcttctcaacaatctataaaaagaaatgaatcttatatgttataaacaaaaggaaaggtcaacagagaatataaagggaattccacagtaaattgttctcacatcttccaatgtcttggaccacaaagatcttttcttcaagcttttcacatagttcctttgactcttcaattctattctcacgacctcaatattttctcctggaagattatctggacacagtgccgaaattccaaaagattaaaagtggcattgctctgacaacttaactgaaatagatatggatattgaaaatacaaagaaataacatttttcccttagcttgagcaatccacataagtcatttgtttgggtcatgaatatcatttggttaggtaatgggcacagaactattgacacaaatatttgtcactctgtccaagaaatagctagaggattttgtaaaataggtatcatacctttctgatatgaatttccctttaccgtcagcttgcagcgataatcttgctcaaatctatccaacgcatgcagctcgtgatacaaatcctggaaaaaaacagccaaaatgagcaaaacctagattaatcaaatgatatattgaactacagcacaatgcttacagttgtacgatgaacaagatccatcaacttttgcatctctgcaactgctgtttcttttagctgcttctgtggtggattttccgattctagcctagattccgaagtaacaagtatgattaaggtctaatctttataacgattgccacatgcaaaaacatgaaaactcttacttgacaaaatagcggtccaggttatgccattggggatctttacaacggttgccaaatctgacaatctcttgtgaaaatattttcagctcttccctgcaaatattagccagagtgcacaaaacagttattgggttgtcagatggtaacaatgaaacattgagaacaaccatcaatcatctcttcaaccttttgtcattggctacaatccgcatcaacacactcatgtcactggaaattaaattctgcacgccttcagaaggaagcaccacttgtttgaagtatgtaacagtgtcttccgaaagagattgcataatagtagcacctttcaatatcgtgtttgcaacctcaaaagcaagaattgatatcggacatcctttggttttagccctggaaat

SEQ ID NO: 50004 - DNA, 7843 bp, Oryza sativa
tggattgactatccaattccagcttccccagcatggcttcctcggcaccagtgaccatctgtttgtgtgcagcggcgctcatcgcgtcggggaatccgctgatgccatccgcaccatcatccacggaccacgcatcggcgacaccaacgagccttcttgatttcagcactgccaaacagaaaccaaaccaaccgtgagcacagagcggaatcctccacctccaatcctatagcagcagcaagatccaaaaagaagagcacgtagacgcgtactgtagcaatccatccgcaagctgaggcccgtgcccgcaaggacggcatgaaagggtggctcccaacaaacccaattaacgccgccacccaacaaccgcccccccgctcggccgctcccctccccagcccacaacagctcgagccgcacggaaggtgctcgacgaaatgctcccctcccccaacaagaagtcaagaacacgaaatggggacgcagtcacacaatccggccaaagaacaactagaaacctcagcaagcgcagcagctaaccaacccaaccagcagaaacccaaaaaaatctctcacgcagcagacgcgcccaccaagaacggggagaaaaacacaccacagcggaaaagaaaaaacgaaaccgatttctccgacgcgggatgagcaggcgacgcgaggaggagagtagccgcgcttgtagcttgcttgaggatggagatcgggaggggaatggagtggatcaatcggtcgcccgccccagctgcggatggagatgggagcgatcgatttctttttcagctctactttttctttctttcttttttttttcctgggagccagcgagacagcgccgagtccacgcgctgaccctgtcttttgcgggggtttttttccagggggttgtcgtttggttgccggcgccaggattcgttctctgcgattggccggccgtcattgcttcgaatttttaaaatttttaattttaaaaagaaactattccaaaaacttagaccctgtttagatcccccacaccctaaaatttttcaatacatcacatcgaacgtttgaacacctgcataaagtattaaatataggctaaaaaataactaattgcacatattgcgactaatttgcgagacgaatcttttaagcctaattgctacatgattttgaaatgtggtgctacagtaaacatatgctaataacagattaattatgcttaataaattcgtctcgcggtttattaacggattctataattaattttttttattagtgcccgaacacccaccctatataataactgatatgacaagccaaaactttacaccccctgatctaaacacccccttatttatagaatctgatcatttgggctatgtacagtccatctaacgtggcaaaataacaccgacacgtcgcacacagggggagtgacagttttgtcttatcatgctagctagggtgtcatggtcaaatacgctgccacgtcagtcagaatgtgcgtggcactgttattttgccactctgttcaaatattgaaaataggttttaaaaagatttgtttttgaatttaaaaattcagaaagataaaaaaaatacgattgcgtcggaggctggatcaaccgcgtttttggtgatcatagggtatttgtttaccagctggtgatgagtacactccagatgcagagtgatggtcgtcacgttctttcaccgatcctctttcccgatgcgtacacatggatgcagttttatttttgttgatttgtctatatcgatatgtaagggcgtaaagattgtgtttggtccccagttcatttttttggtctggctcgactgttttttttctcttttctggttcgaaacgtagaaaggcttcagtctgcatcgatgcatcagttttcggcactgctgatcctggccctgctgccctgaggcccctgactcctcaaactgatctgcggccgtttgccgactgtgactcgggccgggattcccagtggggccacgcaggagaaaacggacaagtggaatcgtcacgcagggcttacaagttagtacaagttactcctacatccctgtagatgtagtataacctgtgaatattctggcagctcgcaagtcgcaaacgagcagcatccttttgtctcagttctcacaacaacaacagcaagaaaacaaagctccacgttccgaccagcgcgtcccgtcaagcccgtcgctgcgaccgcgagagcgagagcgagacgtggtggtggtggtggtggaaccgtacgtgagcgcgacgacctacctgcaccgcgcgatcccgacgcatcagctcggctcgggctcgcaggttggcgacgcggcagccaccccggccacccgcacgcacgccttcggcgtacgacccgcaagcctcggcgtacgaggcggatgtgggtggatcgcgggggtcgccgcgccgtgacggcgtcgttgggtggctcgcgcgaggaagcggtacaggttggttttccttgcgcgggcggaggaaataatcgagccggacgaccgtgcgaagtgctcatgtggtggtggttggtcgggtactcggggttggttttggtccttcctttcgattatgatatatgtggacagagacatctgtcctcacaccacatatgccacctgggggatgttgaatctgagccgcgcatatcagttgactttaacaaaatcgttgatcgaacagggagtgtagccataattttcttaggactcaacttgcataaattacgtaattttgcctatatctttcgtattttttgcatttatcttttatatcttggggttttgacacgtaatttttactccctccgtaatataaaaacatagaatgagataggactgaaacgagtgctacgaatctagacataagagtctcatttggtttagacggagaaaataatatatatttaggcttaggagtatggttataactctagctgccttacttctattttcaccacggttccttaatccatattgataatttgattaacacaataaattaatatttttaatataaactttgtaaatactagcttgtaattagttgaatgcttgtgctttgctacgggtaatagaaagtatattagaatatcatctaaaataaattaaaatatgttttatattgattatgttaactatcctttgccatagggaatactgagcgtaatttgatcttattcgtgggcatcatttagattcattgccaccaccattagcttcttttaaagaagtatagagatctttcgagaaaccatgggctgatttggtttgaagccttaccaaaatgttggtagtaaattttggcactaccaaatttgatagagtagatttattattagttaggcaaaaaatagtcacaatccaaatgttatcaaagtactatttaaagctaccaaaatattggcatggtacaaattggcactaatctaaatatgcctcatatttttgaaagcgtggagcaaatacaaggtggaagaggtacggaaaccagccaggtttgctttgtcaactcgtgcctggcgccgacacttctacgggactactgcgcgagaacatttctcctgtgctacaactccctacccatatagaaaaagaaaaactatagaagattggttgtccacgtaacaaggtcaaatctaaacttgatttagaaaacaaaatcagttgaaaaagaaataataaaccctatataggaaggaattttcatgactttctaaaggcactttcgcagcaacgttttaccgacgattgtactgccagctctcatcgtaacttcatcgaatttcattataaatggccaatttgtttgcgggtggatgaggcgtgatctgagcaaatcctgacagaactgcaattttaatgaccaccttcagaaaactccatctgaaacagcaaatggagaaaatgtacacttacgagatgtcgagatccctatataagctaaattagagcaattggtcagacagtagaaggattctgcacgattgagtaaaacgacagagatttgaacttcttcaatgggtcatccgtgacgtcagcgctcaaactgaaaggtggagctagaaatgtatgtacccacgtctggtctcatgatgatgcagcatgcttcaagattcagagacaaatagtgctactgagtgaacaaacaaataaggcaacgcttctacttgaccacaaacaaatcgtaattcgtttttcggctcaatggtcgaagatggcaatagaatcaagcccacaggccacagtacattgtacaaggctctcatcaacatcagaataaaaaaacaagcgtaaggctcatctataaataatcaacttacagcagtactaggacctttcgatgtccacttcctgaagctgttgacatcaaaatttgccatagtaatatcatgttagttacatgcgctacgggaactatactgaaaaggactactaccatatatgttcagaagcaacctaacatgtggtctggttggtgccatcttacaagtagttggcccaaggcctacataaagctcaatggggttagcctaggatcctacttaatgcatataaattcttcacataaattagaaactactagggggtgttaaccctaggctattctggcggactgccacgcaggtaaaaccctaccagaagccacaggcttttgtacactgtatggcacttcattgacttgttcacaaccatctagctcaagatctatgtagcggacgtcctggacgatgctggcagcatcagatatttcctgccttgtacgtgtctttgcagcgcgtttcttggactggaccgtgcgttcctcaaagtcgtcacagttggtagaggtgttggtgacggagaagcctcttcgcttcttgaccgcctcgctgtgctcgttgctgccgccgctgctggttttcctggtcgcatttggatatctggcgaggaaatcctctatggttgcaagcacacggtccccgtacttgttcagcttgttcctggatgaaaagcatgtgaaaaacaaatataattcttgctctacttctgaaaactgcttgtcaaaattacattgtgccatggggtagagtcattacttgccgatgccatttatctccacaagttcctctttcgttcttggcattcggttgctgatttccttcaatgtctcgtttctgtaggttaaaaaataagaaccacgttataagtcagtgagttctgtgccacaacaaaatgcataacatataacttacttaaatatgtggtatgccaataattgtggattttcatccattatctgagtcctaaggcattgcaaagcttcataaagctcggctgcaaggctctgcaattaatgaaaatagccattatagcataacaaaaacaattactgacaaaaatactgaagtagtagcttttataactaaagagccacagccactaccccgtccacttgactctgttgattagtcttattaattcgtggaactgacgattcatcgagtacacccatcttaggagccttctcaggagtggggaacctgcaagataagaggataaagaaattactctaaaaaaagtagattgtagtttacaaactattttttggtcacccagaatgcaaaattgtattcgttaaataacacaagggaacaacaccctgcatcatggaaacataagcaactctagagacttttatacacacactttcccttgtgaatttgcaacagtaatcagttaggcaacaagataactatatcattcaatgagggcaagtggaataaatatatggctgcttgtattgaagaccccaaagcagtcaaaattgcaaaaccataatgaactcggatgttcaaacctaggatgaactaggaaagctcctaatactatctccagtcataaataagtgatgttttggaatgtgttaacatgtttaaactttgacaatcaattgcgcttttaaatactttgattcaacttttgaaaatgtttttgttatattcatcttcaaaatttgtttcaaaacattatacctttgatatattttttcataagttttaaactagtaattagtaatagaagtgtattagtgaccgtgccattgtccaaaacaacacttatttgtggccctggcgggagtaacagtcaaaacaactctttaccagtatcaagctgtacatctaattttttttaaaaaaaaataacatgggattaaattccaacagattttagatgtgaagttcatatgcaaaagaaagatgtgattaaaaaaggataattttcagcaatatgtgtcgagcaaaatgagaaaaggacaaacaattttcagtaatatgttttaggaagaaaacaaacttgaggacaacgttgtgcttgccagagagaagatcaccacttttcttatgattagtctgcttaacaaacattcacaaaagaaaactatgtattagaccaaggtagagactagaagattaaagaaaaggaaaaacctagtaaatttgtctcaaagtaaaccattataggtgcagggtatatttcacctttaagacagatgatacagatccatagttttcgctctttttgacatcctcaatgagtatttcctcaattactagatggcgcaatattctcgctgcttcacctttagctagatgctttccagctccatgaagactcaaagtatcatggcggtgcttcttgacctgattagtagtaacagataaatttcaaataatggactagtatgtggttttccctgccaacatgacatatccggcagtaaaccaagatgtgttgtggaccatggagatatttccatggcactaaaagtagcctctggtgatgttatcataacaatgaacctcagaaccaaatgacattaattacttgcataatacatacattttggtttactgaacctctgtatacttcgagaatatgagtagttgaatatgtttgctttgtcatcattaccagatcaacctaaagaaacaatgtgagaatgtcagtttcagacaaaggtctgtgcatgtgttaggttgtttagaaggggcacagagctcagctgaccacataccaattgtctagcaatgttggtcacatctttttcgacccatctcaactctttcaagcaattatcacatgtttttgcacaacatgaaggattaaacatctctccaaagtggatcagctgtagtagacgtctgcagtccacatcattttcgcagtaactaacctacagacagaatatggcattgttatgatggcttccaaacttcaagcatgcagaagcatctgtaagatatgatagataccattcgcaggagattttccttatgcgtttcaagcgcttgttcctgcgaagaacctcctcgtggtgctgatgttccttgctccgcaaatccttgggtaaccatgtgtttgagacgaatctagaaaattttacgaggaaaatacttattaatggttagatatgaaaatagtgaaatactgataataaaaagaatctcttaactcacataatcagaataattgtagaacaggacacaagttgaaagctgactgtcacgaccagcacgtccacactcctaaaaggataacagtcatcaaacacagctaagtttatgccattttgatgtgcacacattggcgaaacttatgtcattgaaaatacctgatgatatccttcaattgatttgggcagggaatgaggataacaaaacggacatcaggtttattaatacctgcaatcctgcacaattagcacgaggcaccaataaacaacaaatatatgtgcacactatgaaaatcaagttacccatcccaaatg

SEQ ID NO: 50005 - DNA, 4167 bp, Oryza sativa
cactggcttaggtttcaagcaaccattgatttagtattgctttctcctaatttgattcaacgctctatttctcttaactccaaacaacagactaggaaatactacccaatcaagaaatggaaccctagaacatgtgagtatgggtacagccgtacaggaccactattacccataagtaaaactggtaaccaactggttactacccttgttatcaagcccgtacatctagtcacgactagtcatcagctagtcggccagggagcatgactcgatttgttggcggcagcagacacaataaaacaaagaaaacaacaatgaaccacctcggaggtctggtccatcaggcattattactgggtgaaagggagatggaggagagctccaccaggtccatcaagcacagcatgacgcagcagactagcagtaaaagcaactgctatgtaataatagtctgatagactagtcaactcaatgagtagtcttcaactagttgcgactagtcgccaagtcactagatggtaactcaagtagactttacaacttaaaaactatggtcactgctgcaatcttaaaccctaaatgggaccatgacacacaaatgggataacatacaatttcctaaatactcaaaacttctattaccaactagtatcatgtagtaaccaaaccttctatttacccacttgcttccttgtctcttttcgccttctattttttgtacttgtattcttcacagtattgattaaggatgattgaagagattacacattacaggcaaactaaattcaacaggtacatagtagttaatgttttgcaatattctaaacataagtagctaaaggttggcacataagtagtaattttagtcaagaaacttgagtaatacagaaacaagtaatatgttcttatattaccaaactgcaactttattacatatggggggctctgcttaattaaccagcatgtggaagtagtgcagaataacttcatttgagaaattccagataaaaaagaggaatggccctaattagatttaaaattatatcctagaacaatacttcctccgccccagaatgtaaccatttttggggtaggcacgggtattaagaaaatactgtagaaatgattgaagtagtattgtcattggtgaagaagagaaagtaggtgaagagaatagttgtgattgattgagatgaaagggtaggtggagaaatagcttcattttgggacaagttactgtgttagaaatagctacattttggaacggaggtagtacatctagattctgacagtattgaggactaagttaattcacagaataagataagaattttaatgcttaaacattgaaaagtacagcaggcttgaacaatttatagtttcaagaactaacccttaatttagcagccactttctcacaatccatcctcgaaaggcaatatatgatgccgcattctttattatgatttgcatgtataaagttatggatatcctcgaggcacttctttgtcttgggccatacaaaatacctgcaaaagttgggctgagatggtctggtgcaattggagttgaatgtcaatgtcttctgaattctgatagacttacctcagatttggacgattaaaactttgtctgaaaataatgcagtttgcaaggcctagaacttgcacgacatcttccttgacacttgcagttgctgttgcagtcaaggccaggactggcgtctgcgggaacttctgtttaaaatgcctagatgctgatggataaagaactggattaaaaggttgtcaattatttaacatgaaaatctgcttcctgacagaaagtacctggtaatcaggtcggaaatcatgaccccactggctaacacagtgggcttcatcaatgacaattctagagagatggcctcgcgaatataaattttccaattgtctcaacagagcatcactcctgtactcaggaaattaatgtgagttaggcacatgaattggcaaagcacacgtcacaaaagaaaggactaattgtgtgagaagctaatacaagctaaaggtgttgaatctcataaagaaaaacaaagaaatgtaaccaatagtccaatactagtgatctggaaatgcgaactgctgcatagtgacagcaggtcattatgagcttacttatactatatcagaaaagactacctttcaaatagtcaagaaatcatataacatgactacgaatcaacagcagaattccacttacttggctatcttttcaggcgtaacatacagtaacttgtacgtgcatgtaggagacattaattctcttaatatctcctgctgttctgaccactccatgctggcgctaaggtaagctgcagaaatatttgcctgtgataaacaacacgtgagcaattagaaaatcatcaagaaataagtagaaggaaacaaaacaaccctttacctgcaataaatgcatgatctggtcttggatgagcgatacgagaggagaaactaccaatgtaacgccattacaaatgagtgctggaagctgcaaagtaattgatgagttttttttttctttttggacgaaaaagctgtatgaaaggatcctacggtatatactcatatattaagtaatgtacatatttacatgaaaaaccaaaacaatgactctttctaattcctgtccatccacttcttaataagaggacaatacctctctctctctctcttgctctatggataaccatggcaattgaaatctaaagaaagcacgggaaaacttgtagtatgggattgacatctctgaagattttattatttcttataatccagatgctccaaggtaacacaagcaatagaatcttaaatattaacatagtactacatccgtcccaaagtatagctatttctagcacagtgacttgtcccaaaatgaagctatttctgcacctaccacctcctttcaaccaatcacaaccattcttcatttaatttcttcacctactttttcttctcaaccaatcataaccttcctccaatcatttctacctactctcttaataccggtgcccacctcaaaaatactaacattttgggactgaggaatcccaacaagtacagattgaaagcagtatggcttgttacctgatatgtcaaactttttccaccaccagttggcatcaaaacaaaaacatcattcccactcattgtggcgttgattatttctcgttgatttgggcgaaaagaacggtttccaaatactcttttgttgttggcctgatgaggcagcaagacaagtcattctcacaaacaaatgatgtttgaaataattacagttgattttgaagaaaataacctcgagttccttagtccatgcaaagtgtgtactactccactgtttatcaccagaaccttcagtgtaactgatatcaatagcccttggagtgtaatctctctgaacagacggtaatggcatgcttaaaccatccatataggaatatggagcagaagaaaagcataaaccactttccccaggttcattcctggtgtaaatcggtgattggaatatattggtatcctttacaaaagagctacttaggatgctagtggggtgatggccctgatgagctgttgtggaggccatagaatgagattgctgtcgctcttcatcttgggttaacctcgccgtatactccccaagcagctcaatctgcttctttaggagtgctctgcagagtgtaacagtaacattgcatcagaactgctggtagtcaaaaggagctaccaaatgcacgttgcaagagtcaaacttcatattttgaaccagaaatgccatcgttgggttcataatacggtcaagattatgtagttttcctccttttttattggaattgtgagcaatacattgtgagagaaattagctgtcaaagctcaagtttggagatcacaccgaatcaaattagatgtcaatggtgtaaggaaatattagttagtcagaccagaaaacaaacctcttttgatgaagatcatcagattgttgagggctgagttgaccgtcaataagctcatgggatattgcagcaagttatccttcatttcaagcaaatgagacttcgcctctgggcaaaaagctagctatacaagtatagtagcaagtagcaactagtgagcttgggctgcagga

SEQ ID NO: 50006 - DNA, 38932 bp, Oryza sativa
tttccatgccctgggaagagaaaacaggcgcattactttgtcaggtgactcataaatatgatcaaccttactcttgtcccatctttccttgccatcaatcttccacccagcatccatcatcagaagattagcgtgtagacggagatgatcccaaagcactgcatggctgtggccatacttatgctgccctctgtccctacgctgtctaacactggtaatgtcaaccctctccagatcaagaacactgcaaagttttgctctttggttcctgcgagccactgccctacgggtgtacaccctctcaacggaaggcggtgtccactgtatcacgagatcagaagcactggccatatccggaaagcccactgtcttctgcattttttgtttgtcattgttgcagaacacaagatagcttgataagttgccatatgtaaaagactcaaccacacggcagcgcgccgacttgtgattggaggcagagctcgaaggtgtgttagttgatatcaattctttgcttgcatctctcagtgaactgctctttccatcccggcgtggatggcgggtgcttgctccgctagtgcctgttctgcagaagagctcctcaaagatcttcctttcttctttcgaaccatcaaatgcgtcttccgtcagctcgataaccttctttccaaacagcattgttgtaatgtcctcctccttcatgcctatttccaccaagtctttcgcatccattctgttgattactagccagagcttgaacccaaaaggcaagcagtcctgattctttacgaaagtaagcagcaagagtactacaatgcaggtcgaaccaagctccggcaatcaccgcgatgatcgaagcgatcagactgcaatgaaagagtaaacatatgagcatcagttcacaaaggcaagacgaaaatgagaaatgatgaagaaaaatcagagcaaaaaaaaaaagtgcaacatcagtccatatctgacaatgcagactgaaaaaaaaaatgaaagcatgacaattccaactaataatgccatattgagacactacccgaactcgtcagtcgcgaaatgcagaaaatggccacctgaagcaccaaacgagataaacaacgatatccaaaatagaagcttttaccacgtcagtccacccatgaaaagcatagccgcctaactaaaaatggcaactgcaaccggagtgaactggatgaatcatgaaccagaaatgataggctggtagcagttgcatttgcgtccttccaggaacacaaaaaagaagttgaaatcttttcttctttgctattacaaaaaaaaagttaaaatcttttttaaaataaaacaaacacactgaagccacaccacatagatgagttgagtgtggaacccttttcttcttcttttatctgaaattacctcggcgcagacagataacatttcatcactgaaatcatagatcagatgataagcattccaatggaaagaatcacaacacaatgacccccacgagagagctcagaaatgcatcaggcacctactatataaatccaaaacaataataagaacaaaaaaagaaagaaaaaacccaagaacttgtctacccaacgcatcgtccttaatcgcctcgcgccacgaatcaactccacatcccgattagaccaaaacgcacatttcctccaaatctccctcccccaaccttatccatcaacaaaaccgagagagaaaaacacacacaatataacgcaacgatgcaaccaaccgccacctgatgataggaaacgaaacccgcgcgtattcaccgcgggaacaaattaaccgcccccggcatatatatgccaccaggaacaagcaaggaaaaaaaaaacccgcgctgcggtgcggcggctgcaatggcgacgagcagaggagggcgcgcgggtgggcgtcgcgtacctgtgcctctgctcgcggcagcggcaggaagcggcggcgttgatccctctcgtccggcggcctcgtctcctcctccggtcaggtggtgggagttaatctaccgccaactcctcctctccatggaagttgccgcctcgcctcgctcctcgtcactctcaccaccaccgaaccgaacagtgaaggcacttcactcactctgctccgggacgcgcgctcaaaactcctctctctctctctctctctctctgtccctgtgtcaaaggcaagcggcgcaaacggatccgcctccgttttacgtgtgcttgtcagtgggtgggggcctccggagggggtggtgtggtgtgttttacatgtggtgcgtacttgcgtacgacgggtggcaggggtgttttgacgcttggatggatgttgggtggtactctggccgtctgatgactgctgacggatcacgtggatccatgagaacgggtctgggagctttctatgtgggcgggattttgactgttgaacatgaacatgtaggatgtgtttggttgcccgcatcaacggtggctcgcaccggtacggtgcatgcagcgagctcactgtttggttgcctggacggaggagcgagccaggatgggcgggtgcaaaattgcctctccgagccaggccgaggaggaacgcaggcagggccggcttgcatcccctcaccaccttctcacatttgctcacacacgattcagtaggaagaaggaagatgaagaagtcgatgatgtatctagacactcgaggtcaaggggcgccgccgccacagcctccattgcctttctcttcccatcctcaccgtcggcggcaccgtcttcctcgccggttgcttcctcccttgatgagctcccacccacgcaccagattccaaaaacaacgagcttcggcttctagatccccgatgacggtgacgaactgcatggagcgagaagagcggtccccgtcattgccaccgccctcccctcccttctctagtcgccagaccgccggatccggcggctacgagctcacagccgtcggatctgtccaccaacggtagcaagcgacagagggtggaggggaatatggagagcagcgtggctgaggagggctgcaactggcgtggtagaaggaagaacggggtggcgcaaatgaggtggagagatcgcagcagcggtggaagtcggctgcgcagagtagcgatgtggcagcgatggaggtcgcctcgtccgagtcattgggcgacgatatccacttttttctttcattttcctttttatttttcctattttccttgaccggtcaacatataccgtaagttttgatttcattttcatttttttcctgaccggtcaacatataccgaaagttttgattgggccttgctatgattgatgtagggaattcaccaattttagttctcaactgtcggttaaaatatgctatgcaccctatttttttttcatggaattgcaaggggtaatctcaccacataagaaacatgaggtaaccaaactcagcccatatgcaatcaaccaaacaaaaactctgatgaacagcatccgttgtacaaccaagcaaacactatctcataccatctaccgaacaaaccctttcgcacctactcacccaggccctggagagcctggatggctcacacgggccaggctaggagtgatgcgagcaaccaaacacaccctgcttagttctcaaaacaaaaattttcatgctgtaacatcaaatgtttggacacatacatgtagtattaaatatagggggaaaaaattacacagattgcgtataacttgctagacgaatcttttaagcctaactgtgccatgatttgacaatgtagtgctacagtaaacatttgctaataacagattaattaagcttaataaattcgtctcgcagtttcctggcggaatctgtaatttgttttgttattagactacgtttaatacttcaaatgtctgtacacatattcgatgtgataactaaacccaaaaatttcccccagctaaacaagaccattgtgttggtaggagtacttgtttttcgatcgcccaccctatcatatgtggttcagtgcggctattgatatatcaaaacctaggtgttgttgagcatttaaaaaacaacctactccctccgtcacatagtatagtaacctatatgatgggatattttatagtataatgaatctagacatcctcctgtccagattcgctgtactataaaatatcatatccaatattaaattattatattatgaaacgaagggagtacatgtaatttgtttggttggcattctggttaggaatggcaatcacgccctataaacccgtttgatcgtgggtaaatgaccctagtatcaggtagttctttgttatatctgtaggtatgttgtggggatgaaatcctatctctaatgggtaaatcagcatgaatatggataatcacatggcgcttgcgggtatgggtatagggcatgagcaaggtttattgctagccactgataatggttatgactgtatgtataaaattattttgtgggtccgatacagctatgtattacttatgttcattgtgtccgattttttttagataaaggatttttattaatctggcctctatatctatgagggatatacacagccaaaaggatacgagagcactgagactcagacctcagcaaagaggagaatacaaccaaaaaaccgaaaaacctacaacctcaacacatccctgcatcccaacattctctcatgaaacagtcgaaatcgacgattgaaagtcgtctagtcgccaccgcccctagtgcgttatcgcagcgaatctccactggtgccatcttcatctgcttcaagtaagccgatgccacacgccgccgggtagtccaccttcatccattgtcgtccagtcagaactagccgaccagacgcgagctgaaaggatatgcttcgtcgaattcctaagcctctgctgcccatagggccgctgccaacattgtaatcctcctccgcctctcggacttctagcccgccgccacctctatcgggacctggccgagtttctctaggtctacacgaccgggatcgaggccgccgggggtgacgacagggtcatggcgaacttcttccccatggccctgaagggacaggcgcggggttggctaatgaacttgccgcccgtgtcggtccactcttgggaggatttgtgccagcagttcaccatgaacttccaaggcacatatccgcgcccagatgaagaagcggacttgcatgcggtacagcgaagggacgatgagtctcttcgctcgtacattcagcggttctgtcaggtccgcaacaccataccatgcatccccgcacacgcggtgatctacacgttcaggggggggcgtgcggcacaaccgcatgctcgaaaagatcgcctccaaggagccccagaccactgcggagctttttcagctcgcggaccgtgtggctcgcaaggaggaggcctggacctggaactccaccggttccggtgtggcagcttcggccgcccccggatccgccgctcggtcaggacggcgggacaggaggaggaagaagaggtcggcccattccgacgacgagagacacgtcctcgccgtcgagggcgcttcgcgggccacccgaaaggggaggcctgcgagcgacaaatagaaggaggccggcgctccctgttgcaccgtgcacaacacctccctccacgacctcacggactgccgcgcggtcaaaagtttggctgagcggacgaggaagtgggaggaggagaggaggcaggagcgccgtgagggcaaggccccggcggctccctccggcaaccggcgaagtgaggccaagcagaaggcccccgccgaggacgtcgacgatgacgacgatgacctagggttccaggagcctggggccaccatcgccaccgtcgatggaggagcgtgcgctcacgcttctcgtcggagcctcaaggccatgaagcgagagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaacatgaagttggggcgtgtcctcatagacgggggtgcagccctcaacatcctttcccccgcagcctttgacgccatcaaggtcccggggatggtgcttcggccgtcccagccgattatcggtgtgacgccggggcacacttggccgctaggtcatatcgacctcccggtcaccttcggtggatccgccaacttccgcacggagcgggtgaacttcgatgtggcggacctcagtctgccttacaacgcggtcctgggaggcccgcgttggtgaagttcatggcggcggtccactatgcctacctccagatgaagatgccgggccccggtggccccatctctgtccatggcgacctcaaagtcgcgcttgcttgtatggagcagcgcgcggaccacctcgccgccgcgtccaagcccgagggtggcaacgagaggctcagcacctccgtcccagccgccccgaggcagcggatgatcacgtgcgacgaggtcccggtcaaggaggttgccctgggcgacggcccgtccaagaccacacgaatcggtggtcttctggacggcaaataggaagacgcgctcgtctccttcctgcgggcaaacgccgacgtcttcgcctggagaccggcggacatgcccggggtccccaggaaggtgattgagcaccgtctcgccgtgcagacgggcgcaaggccggtccggcagaaagtgcggcggcaggccccggaacgtcaagccttcatccgcgaggaggtggcgcgacttctggaggccggattcatccgtgaggtcatccatccggagtggctggcgaacccgatcgtcgttcccaaggcgaacggcaagcttcggatgtgcatcgactacaccgatgtcacaccctgaaaattcaaaatatataaattgttgtttaaatggaatttttagaattaattttaaaagtcttgaaaagaaaacctaagttttaattaataaattccaatataaaattgggccagataaaatttcattaaatactttgcttaattctataattcctagatttttctgggatttatttgagctaaggaagtatttttaataaatggaattgcatttaagaaataattttaattgaaaaaggttttaaaaagtcttcttttggctttgggccgaaagtcggcccaaaacctctcttctctctcctcgacccagccggcccagtccgccgcccgcgcgcgccctcgctcgctgacaggtggggcccacctgtcagtcgtcgtctaccttcggccgccgccgccgaaaccctagtttcgcgccgccgccgtttcctttccaaatccggccgttcctttccttctccggccgaattgaaagaggggaaatgatcctcgggatctcctctaccttttctcctttggaatctttggctaaatcgttttggaaagagttggattcgagttcgtctcggatttgttcttcccgagctttccttcgccgttgccgtcgccgtgggccttcgccgccgcctccgagcccctttaaaaggacccccggagtctcctcttcccgtcgccaccctcgccttcgcctctagtcgtcggaatcgctctagcgccgtgtgccctagcttcgccgtcgccgccgccgctccagccgtgcgccgccgtcgtttcagccgtcgccgtcgctcgggaagaccaccatcgtgctcgccaagttgtcgccgtcctcgtccgccccttcgccgtcgccggagatcaccggagcagcttcgccgtcgtcgacccgaaggttcccgccgcttcctcctcgtcgccgtcgccgtctgttggtcttccgccgccgtttaggtcaccggtgagttcgccgtgttgtcctctacgtcttggtgccctccgtttgcgtcctcgcgccgccgttcgccggcgagcgtgcgccgttcgagccgtcttctccgccgagccgccgccgctgtcgctgacgtcgtcgctgatgtcatcggggtcgtccgccgtgagccgccgtggacccgatcgatctcggccgtccgttttggatggatcgatctcggccgtccgttcgcgtgaaccgccgcccgtgcgcccggtccacccaaaccctagccgctgacgcaataaatccccttttccttttcaaaaataattcattattgcgtcgtaattcaatttaaaccgatttaagtgttttaatccggtttaatctttaaaaattcataactaattcatcttagctccgatttagtcggttcaagtctctaattttttctaaaattgagatctacacattaaaaatatccacatgtactgttcatgcttgtttatgtgctgttttggtgattttgctcttttctgcttagattctgtcgtttccggagagtccgttttcgcagaagaagagtttgaagaattccaaggccagcaaggcaagtcacacagatcccaaacaaccctttgagcatgttgatcctatttaaagctattgtttcttttcaactattgcatttattttcgaatgtcattgggtggaattaacctattgtttgttatagcccttttgttcttgattaccttattccttgataccatgggttattataatttgactagttgagctttatttatattggttcaactagatattagatataattgcttagccctgcttagaaacattagtacacattcgggataactaatgactcactattatttaatgatggcttattgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtggtacacctctggccaaagtaaaactattcgaatagccgtgcccgcggttatgggcgggtctaacaatgtctttcgtgattagtctcacacctctcatcattgtaagagatgcttaaactggtaataatttgtttagctcctggtttggaatggtacattcctggtttggagatagaactgtgcagccggggtggttgttcagaatggttgggcctatacaacagggcatgttgtatagcgttggattaatattgtttaattacttaactgttttatcaaattctcaaaggtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaaccgaccttaacaaggcatgtcctaaggacccttaccccctgccacgcatagatcagattgttgactccaccgcggggtgcgaccttttgtgttttctagatgcatactctggttatcatcagattcgcatggctagggaggatgaggaaaaaattgcattcattacccctataggaacttattgttatacgacaatgcctttcgggttaaagaatgcaggtcctacttttcagcgtactactcgaatttctttgggtagccaaataggacgtaatgttgaggcctatgttgatgacttggttgtgaagacgcgcaaccaagagaccttactcttggatctagcggaaactttcgaaagtctccgctccgcccgcataaagctgaaccccgataagtgcgtgttcggcgtgcctgcgggctagcttctcgggttcttggtctctgcccgaggcatcgaggccaaccccgagaagatacgagctatagagcggatgcgccccccccagcaagcttagggatgtgcaatgcgtcaccggctgcatggccgttctaagtcggttcatatcgaggctgggagagaagacgctacccctatttaagctcctcaaacgctccgggccgtttatctggacggaggaggctgagcgggccttcactcagttgaaggcgtacctcagttctcccccagtcctggtcgccccggagccagatgagccattgctactctacctggcggaaaccccgcaggtggtcagcgcggcgttggttgtggagcgcgacgaggacaaccctcaccccgcgcatccccaccctgtgtcgactcgacccgggagagagcagggaggagaggcccccgagccgaacggcggcccgaggcccccgacggccggagctggcccttcgcacgtttgtccgacggtgccaggtgcccccgacccccaggatggccccggggccactgcgggaaggccgcgcctgtcgccctccgaccccgaggtcgtcggcacagaagccgagtgcgccccgcgcggcctctcggacgaagagcgccctggagatgcggcccctagcgaagaggatcggccccgccgaaagatgcagcggcccgtctacttcgttagcgaggccctccgggacgctaagacccgataccctcaggcccagaagatgctttacgctattctgatggcttcgaggaagttgcgccattattttcaggcgcatcgggtcacggtggttacgtcttaccccctcggccaaatcttgcataaccgagagggtactggacgggtggtgaaatgggcaatcgaactctctgagttcgatttgcactttgaaccacgccacgcgatcaagagccaggccctcgccgactttgtggcagagtggaccccggcccctgagcacgtctccgcccccgaggccagcttgggcccctcgcagctgcctcacaccgcctactgggtgatgcagttcgacggctccttgtctcttcaaggcaccggtgcggggggcacgttgacctcgccgagcttagacgtcctcagatacatggttcgcctcgattttcgggcgaccaataatatggcggagtacgagggactccttgcgggactcagagtggtagctggactggggatccgccgcctcctggtgttaggcgactcccagttggtcgtcaaccaggtctccaaggagtaccagtgctctgacccgcagatggacgcttacgtgcgccaggttcggcgtatggagcgccattttgacgggatagagcttcggcacgtgcccaggcgggataacgcggtcgccgacgagctctcaaggctcgcttcctcgtgagcccagaccccaccaggcgcctttgaagaaaggcttgcccagccgtcggtgcgacccgaccccctaggggagacggacgcgcctgaacggcccccgaggcccgtcgaagtccaggcctcgggacccgaggggagcgctcccagctcccttagattgattgcttggatcactgagatccaggcgtacctcacagataagactctacccgaggaccgcgaagggagtgaacgcgtccagcgcatctccaagcgctacgtgctggtggaagagaccctctatcggcgcgcggctaacggagtcctcctgaagtgcattcctcgggaacaaggtgtcgagcttcttgccgatatccatgaaggcgagtgcagagcccactccgcctcacgcaccttggttggcaaggcctttcgccagggtttctattggccgacggctctcaacgatgcggttgacctggtccggcggtgcagggcgtgccagttccacgcaaagcaaacccatcagccggcccaggccctgcagaccatacctctttcatggccgtttgctgtctgggggctcgatatcctaggtccgtttaggcgggccccgggcgggttcgaatatctgtatgtcgctgtcgacaagttcactaagtggcccgaggcttacccggtcatcaagatcgataagcactccgcgcttaaattcatcaggggcattactgctcggtttagggtgcctaatcatatcattacggataacggcacccagttcactagtgaactcttcggtgactactgcaaagatatgggcatcaagctctgcttcgcctctcccacccaccccagaagcaatggccaagtggagcgcgccaacgcagaaatcctcaagggcctcaaaaccaaaaccttcaacatcctcaagaagcacggcgactcgtggatcgaggagttgccagcggtgctctgggcgaaccgaaccacgccaagccgagcaaccggggaaacacctttcttcctcgtctacggcgcggaggcggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggtgctaccatcagcgccacgtccgggcccgatcactctgcgtcgacgacctcgtcctacgccgcgtccaaacgcgtgctggactgagcaaactctcaccaatgtgggagggtccgtatcgagtgatcggcgttccccggccgggctccgttcggctagccacgggtgacggcacagagctgcctaatccgtggaacatcgaacaccttcgtcgcttctacccctagtgggggtcgggtgtcaggtctcgggctcgggccaaccccgcacccccccgggcgtgcagggttggccgggggcttccacatgcataagcttatatttttttcttccgtatttcaataaaagcattttcgatttcctaaggactgtgtctgtgccattgtttcctttcgaagaatcttggcttgaattagcatgctcgtgctcgatcctgccctcggtggcccgggccggctaaaatcgccaaacggggcccagaaccgagccgtgccccggggcgtggtgaactccgggggagaatcggcaaaggcccacaatcgggtcatccataaccctcggtcaccacgttcccggcctggccagtctcgacacgcggatctccccaggcactagccccgacccgcgccatttgaggctgggacctgggcacgagccctcgttcaagccaagacacagaaggaccgcggcacagaccatcctcgtctcatacacacaacaaacagagctgacacaaaaatttcctctttatttgattgcagattgaattagtttatacaagaagggagcccgaaggcctcagaagaagaaagaaaaagctatttaagattggcgggggcctgggggctcacgccgacgcgcccgggctgccggcctcgtcgtcgctgtcgtccgcaccaccgtcatcgccctcctcgtcggagtcgagggcgaacgcgagccgaggggccgtaccctcgaagctgtggacgatgtggtcggcggcatcccggacctgtgcgcgcgcgccatcctcggttccaggagggaactcgtccagcgctgcctacggggagaagtcagggtccctggcctggtagcttgccagtacgagctccaccgccccccgggcgaggtccctcgaggatgacttgatcgtctcctcgagctcctcggggagccgctggatggtcccagccatctctgagaggcgctgggcgaggcccccctggttggcggcatatttcgcggtccgcccgccccagaggcccgcctgccgcccggcgcggtctagacgggagacggcgtcccgaagcatgccaggccctacctcgcccatcaagcggagggcttcgacctccccggcggacgagtccagcgcgccctgcagctcggcgatggtgtgttcggcggctgcgaggcgggcggctaggtcgccgtcgcccgcggccgccccgccgctgcgcgctctcgcgtccagctccttcgcccgcgcctcgaattcagcggcccgctgatccagtgtcacgtcctgataaattcattccgaaataaaattcattctctaaaaggaataatagaattaattaaaagtcgaaaagaaattggcaaacactaaaatacgtgccagaaaaattcgaatgtggcccggagaatttttgttaaattctccttggtctaaaaggagccctcaaattttacttgaattttcagagcaccggaaatatttattaaacaacaaaaacaattatcaaagtttattaaaaagaaaaacctaagaataatccctctccctcctttgggccaagtctggcccaaagcctccctctctctcccccggcccgcggccgaagtccttccctcctccctctctttttccttccctctctctctcttgggccgcccttcctccttccccggcccactccctcctcctccctctctccccgggccacccctcccctcctctcctcctgggccggccgcccggcccacgccgcgcccctgcccgagccgccctcctcccgcgtgcgcacgcgcctgtcacgcgcgcgcccacgcgcgttgaccgcgcctggcaggcgggtcccgcctgtcggacccgtcttcctcccccagccggcctcttctctctcccgtgcaaacctagcgccgttcctcctccaaatccgccccattcaagccggctctttccaaattaattggggggttttaatccccattgaatcctcttcagttgcccccaatttcccccttgaatcgtgcccccaatcgccgggaacgcccgcgccaactccggccaacttccatggccgccggccgcctttaccgccgccgttccgacctcccccgtggccggctccctctcctctcctataaaatggaaccccctcgccccgttctctcgttttagccccttcccgcgatctcccgtggtccctagccacctccccgccgtcgcccttctcttttccccgcgccgggcgcttccagccgcctctccctcctcgaccgtgcgccggccggccgtgccgtcgccttccgcggcgtcgcagccgcctcctctcccccggcctgccctccgtttcgcgcggtgaccaccggaggcgcgttcccgccgttgtccagtggcgttgccgccactgtaccacctccagccgcctctgtctccctgcctgagcgccggtcgacgtcgccaccacctccctcggctccgcgacgccgccctcatccccggcatcacctcctcctcgcccgaagctcgccggagtggcctcctcgtcggcgtccagtacctccccgtcttcggtcggctcctgtacgtcgccgtctcctccatcgacgtcgcagcgttgtcctctcctccagctgctcctctgtttcaccggaacgccgtcgcccgcgccggcctctccttcctcctcgtcgacgtcgccttcggcagcctcttccgccgtgcccgtgcgccggccgacgtcgccatctccacctccggcatcgctgcagcaaggtcgccctcggcctcgcctccccttcgaccgaaccccgccggtgttcgtcgtcgtcatcatcgttcctcctcgccggctcgtcatctcgcggcgccgcctctgtcgtcggcattgcagcggcgtggaacacgccgtcctcgtctccgtgcagccgctgccagctgccctcgtcgcctcctcgccggccccggtcatcatcgtcgtcgtcctctcgtcgttcccggtcgtcgtggcgttcgtccctccatcgagccgttctcgtccgtcctcggtgtttcgtcaaggtcgctgcaggccccgtcgtcgtcttcgtcctcggctctgcgtcgtcaagcctcgtgccagccgcgtctcgcctttgtccaaggatcgccgctgaagtcgtcccctcgccgttcgtctctgtcgttcccggccgtctccgccgcgcccgttcgtcgttgtcgttcccacgcctcgtcgcgtggtggtaaggatccctctccctcgctgccccgtcctcgtcctttcggtgtcgcccgtgtctgtcgtgcggttgtcgaccccggtacctgtgtaccggtgtcggtagtcgttcgcttgtgcgtgtggtgaccgtgttagtgtgcccgctcggtagccgcgtggtttccacgcgtgcagcccgtgtggtgtctagtggagtccgtttgtcggccactcgcctcggttgacacacgggatctgcttccgtcgacccgtggaccgtctctgtgtactcagtttaccgcggtcctttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattacgcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgtggcccggtagtcgagatgtcatggcacagggccagtgtcctgctgctagggggctcaattctgcctgcctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttgtcctgggatggctagggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttctaaatgctgtttactgcaaaagttaacccctatattattatccccttgtactcccttgcattaattatgcatctccggtgtggcttgctgagtactgtggttgtactcattcttgctcaatctttcccctcttcagtaagagaagctttggagaagatgtcttaggtggagtcctggcttataccccagttgaacgcctgtgaagatggagccgtaggcccgctagtccgctactgtttatttttgattgccaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacatccagtgcggccctctcggcgcgggcgccttccagattgaggcgcgcctgctcctcccgcagctgcgccgcgacctcggcctccttgagagctcgctcccgctcagtgagctcgtcctcgcggaggcggagtgcggactcctcttcggcgcaggcggcctcgtgcaccgccagcgttgcctcccggatggcgacggcggcctcgcgacccaccagttccctctccttcgtgtccagggtgcgggcgagctcctccagcaccgtggcgcgagcctcaagggcctcttcgcgctgccgggacgcgtcgagcttcttctctagctccgccgcccggctcccgtattggaggcagaggtcgtcccgtgccgtgttgaacacggcggtggcaatgagggcagtctcccgctcctcctccacctccctggcgatctccgccaggtccctacgacgggcctcgagctctgaggcgtgccggcggtgtgccttgcggcccgcctccaccatggcctccaccgagcgtcgcccctcttcgacacgcgcccacgccgcgtcgagctccgcccgctctgcctgcaggacctccatctgggcacttaacccgtccaacaccgtggtgttcgcggcggccaaggcctgcagaaggggctccgcgctcagtggggcagcggaaggcgtgggggagagccgcctcggtaaggatgccgcacggctcggcccaccgatcgacgtgccgaactcgggggcgtcccccgaagcgggctcgtcccgaacgtcgcccgaggggtcgggcccgagcggcgcgcccgcggcctcgtcgtgggcggcctcggaagtcgttgtcgcctcgggtggagtcgggtcgggggcttggcaggccgccctgcgtgcgtgtgccgcctccgtctcccggacggactcctcggcccggcggagtctggcctcctcccgagcggcttcctcagcctggcgagcccggacagcctcctgggcagcttcctcggcttcccggaggcagtttgcggcttctcgccggtcagcttcccgcctccgggcctccgcggtcaccgtctcctcggcctcagaccggccggacttggaatggcgggaagggcgcgacgggatctcgctgaggcagaagaaaaaccagaagacgaaaaacaggtgagtgaaaacttgccttgggagatgggagaatgaatacggccgcagtgggcgcggggacgaacctgcgaggaggtcggctaaacgaccaccttgggggggagatgaggtttccccggcatggttcggtcccccccccatcttgcggagccgctttttttttcgctccccctcgggctacgacgtcggcgcagcaccctccgggtgcctgctgctggcacgcaccgccccgccccctcggggaggagatggggagggggtatcctcctgtttcctcttcccccgggcgtcggcagggcggctgccccccgggcccccgtcacggggcccagaagcacgaccccctcccgaggtagattgttcccccctgcggctcccgctcgcgccatcgtggcctcgaggagcccgctcccctgacgccccgaccgcctgcatgatggtcaggatgttagcgcgctctggatcgctgcagagggggagaacgccttgagggatgagggatgcctccacggagctgagattcagcacccgttggaccactatcctgaagtcctcagggtcccagtcccatttgcgcccctggtgggtcctcatgtagtcctcggacccggtgtactccccggcggaggaggagcttgagagcgagtgagtatggcaagggtagggcgcaggaaacggagtgtcagagcacaagtggcgaaggcaaggggaagagtggcgagaggaaggaaacaaatctcttcctcggcgtctttatacccttgccaacgctatgcccggctcctcgcttcccgctcccactatctcgccccctcgtttctcgcgcccactcctccactaatcccgttcgcccgtttgcggcgcacgaggcggatgtgcggccgtggcagtcaagatgggacatatcgtgcgcgcgttaactacgctcgctgaccgatgcaccatcatcacatcactaggcgaaacgaaccggttcgtcccgattcgcgcgctactcaagtaatgtagcggtcttgaagaggccgctcattattgtcgatcggtttctcccttgccgatgcgcgcgatttgcgaccgttgggtttctgcccgcctgtggggaccggccccacctgtcaccgggcctaaggagtggcatctcgcccgatcgcctccctcgaggggggcggtcgccctggcgtgacgccgggggctactgtcggtgacatggggccgggggtatcgtgactagaggcttgggtagccgcgatcactcacgtggcccgaccccccgagggggtcgggcccgacggtgacatggccacccctccctctgtctccccgaggggtcgggccgctcccgtttcggccccgagggctggggcgccccaaccccctgtggtgttggcgccacgtgtgtgggttaggtgagcatagcggccctcacctaaccacatttatagcgggttagacgagcgcgtcacgccgcattcaatgcggcgcagcgcatgcttatccggtttgtgaccagtcgcggcatgtgaccggtcacagaccggtcagatcgcgggttaggtggcaacaggcggcctgtcgcacgcctcgccccgtcccgtcggaatgatgagagcctctaggcactcgtccctagacggagctggcgtgggaactcctggagttagcacgtcggtcccggctagattcataccaggcttcatcgcaaccattacaaggaagtcattttatgaagaagggctaacgcgtggcatgctaaactgacgcgtggtagacaagaatgaccggtttgtgactggtctgacgccggtcacgtcatcagcaaacaaccgtgctcccacgttgcacctgcctccgtcatctggaggttggtatgacccatcccatcggagggtcattcggacagcagccattgcaaatctccgcccataaatgaaggaaggacagggttatcccggtgtgaggcgaaggcatgagccatgttttggtcaaagtagaatgggtccccacccaaaagaaggataggtagaaatggtgtatgtggtatccccttgagatataaaaggaggaccatgcctaccaagagaggagaaagaaaaaaaaggagaaagaggaaaagaaaagggagaagaaaaggagagctcgtaaaaggaagagcggagctcatagaggagagagagagggagagggtctctagagtttgaactctcttgctctccagctctttgtaactccttcatacacagatccaccagaacacaggagtagggtattacgcttctcagcggcccgaacctgtctacatcgcccgtgtcttgtgcatttgctctctcgcgaaacattccacaaatcgagggcttagaacctcacctagcgtccccggccgaaccggcaaaggggggcccgcgcggtctcccagtgaggagccccacgctccgtcagtgtgtataagtaacttaagatttaggatgctgattcgggatgtgcataaaatacagggattaactctagccattagcaaatcaacaatgaaaaaagaagaagaaaaagggacctcgagggactgccgctaccccctctttagtccagttaccaaccggactaaagattccctactttactctcggttggtgttactaatcgggactaaagatcgatctttaatctcatgtatttaaatcggaactaaatatagcgatctttagtcccggattcataatcccggttggaaaaccgggactacaaaaggttctaaatcaggagtaaagagcatttctccaccaatggattcagattctaatacgttgcatgatacatgcgacctctacatttggttgctacttccatgttctgacttgggcatcaagctaaagagagatagatggattaagattcgaatatttatatgccacgtctcggcatagttcataccagaccatatgatcgataaaatgtaatgataattgttcgatcggttgtggttatttgacttaccgagcaagtagaaaagaaatactaaaagcccagattttaaaagtcaacctatcattaatatggaattacttcaaatttcacccctttttttagtaatagagggcattcatggttagcaacaattctaagtcactaaactaaggttcataccaagacatcttactcaaaacgtatcttgtgccgtgtcatgccatgactttaagataggtacttcctctggagcgataatacttgttattttagataaagtcgagatcaaattttagaatctttgattatgaataatttttaaaatatttgtctttcaaatatggtgaatacatgtatagattaatcttaaaaagtactttaataaaattatatatttgttaacccttttatatatattataatgaaaaatattggtcaaagttgttttttagagaccgtgtcattgtttaaaacgataagaatgaattatcaaccaagaggggagtatatttctcttatatatactccatggaactactagccgtaatacaaacctacttgaaattattactggtttatttttcttccttaaactatatacatttaaattgacggccggttgaaattagaaagagagagagaaaaaaaggccagtcatctcttatttcctcatcccttccagcatgtggccacgcctgagatatgggtgcgtcgccatctttggcggggcggccgatcgatggcaaacgtacgatgcgggtgcgcaccagggttcatgattccaacgaaaaccggtcgaattccgcaaaattttgaggtttcgataaggctcgaaagtaaaagctgtctgagatttcgatgagtttcatccaaattcaaatttaaattgataaataaaagaaaaaaaatcaaataaaatcttataaatagtataatattcataaaatctattggatataaattttcaaaaaaaaaattgatgtattccgtgtatttactgaaatttgaagtaggaaataaaagaataacgaacttaaaaaaaagaaaaacaatttcagtttatctctttttctagttaatgattgaaatttcgatgatttcgctcagaatttcgtcaaagccgaccgattttcgcgagcttatcggtaaactcaaggaatctgtattcaaattttggtttatgaaatttgtttggaatctaccggctttttatcggatttcacagaaaccgtcgttctgccagagccctgaaatggaaggccatcttagaaatcgtaaaccctggtgcgcactgctctcccctgcgaagccgcggccatgcatccggcaggcggcagctggaaattcgcgaaagcgaagcgaagggcaagccgcacgatgcacgcagcacgcggtggtgtccgtcaaagacgtacgtggaacccacactggtggtggggattggggggcggaatggccgatgcacgggccgcgcgggcgtacgtacgcgcgtcggccgtttgccttgcgcgcgcgcgcggcctttccgttctcgggaacgcgcggggtgggtgggtggcatggccttcgagttcgagccaagctacggtgtctagctgcgtccgtgtgtgcccggccctgtcacccgcgcgctctctagtctctcccagtggccgacacacgcgcgacgtacgtagcgtaggccgatgcggcgcgcggtgcgaatcgaaaatcgacgtcgcgacgacatgtgcgcgccaccgctgtgtccactccgggaaggcaccgcgagggcatgcacacatgcaggatttgcctgcgcgcggttaaaacaattacttgccggatttggatatagaggcgccgagcttaccagtaataagtagtagtacgagctgtgcaggcggtggtaggtgagatgagcgagcggccgttgccttgccggctttgcgtcgccaacgccacgtggtgacccggcctgggcgcttggctcgttgctcgcctcgccgcgtgtttgctagtactacaggcgaaggcatttgccacgctatggtgatcgtttagtaagaacaggacaaaattgtttccttgctgcttagtacaacaacatcagagtggcgcagcggaagcgtggtgggcccataacccacaggtctcaggatcgaaacccggctctgataattgatctttttttttactcctctgccttgctaacttgctgttcgccttttcttgtactgaattctgcacttctgcaacaacgtttttggtttgtcatgcaaattctgatgtttggcaagttttactcccatcagatgcgttaactgggtgaatctggatgagtgtaattttgatcttaatcgctcctagttaactcgataaataaatgtactatatgattcctgcaaaaaggaaaacgatggcattgctaacatccaaaacagaacccgttttggagggaaggagaacaaaagaaaaaacataaaagtttgtaaattttagtttaggttatcttttaatattttattatcggtgtctcattttagatcattctttaaccaatattttcatatgaatgatttcgagtatgtcggctcctatttatcactgaactccaataatacatttaaactattgttctgacatatgacaagtggatgcatatacataaaatactttagggtggtccaaaataaaataaaggtaagataacccaatctaaagtaaaaatattagttaaaagacagtacaaaacaaaacaacggtaataaaaagttacgcaaagtgaaattttccgaaaagttgtacttctacgagtacagatattggtgtggccatgatgaattgcagatgaaatccaatttcttgataatttgtactagaatctggacattgtcaatactccctccgtccaaaaaaaaaggcaaaccctgagtttccgtgttcaattttgattgtccgtcttatattaaatttttttataattcgtattttctattgttgttaaatgataaaacataattaatattttatgcgtgacttgtcttttcaattatttttataattttttcaaataagacggacgatcaaacgttgagtattttatgtgtgacttgtctttttttttttaaaggacggagggagtacgcaataactcttttttttttcttaaaagaaaaggactagcaagtactcctactcatcatcattacttcatcagactggcagagcgtctcccttgagcaaatgactactagtacgactaccaaatgacttgagaggctcactccaatcccttggtcctttcagagaccgtcctgtgccaaccacaacctggaatgtagcgagtttctaaagaacgcatgtatcaaatgttcaaatccttcatggtgcaagccaagaacaccatgactacttccattgctttttaaatgcaggaagccagaacagagccatcgtttcacttatttacggaataagcgaaatagcatatttgcaaacgaaagtattttgtaaataaaacttttatatacatgttcttagcgatctaaaagcaaaggttaaaaaataaacttcgatgaaaaaccttaaaatttgctctaaatttaaggttgaaaattcaaattttagttgataagcataagcataagcgaaaagataaggcttttcttcgagctcagataaacgcaattacgagttagatcaccaactctccttgttcatcattaatcttaaaaatactaattgtatcttctagttatttagaaaggtcggggggaaaggttattagagaacttgttgagataatgaattacagttccattgcatatctttgcggcaaacagaaggatcgaggatggatacagaaaaatggtcaaaactgagcagtaacacacagctcaactacagttacacatgcaccagacttactagtaggagggcgtggaagaaatcttgtaagctagcagtgcaatgagggttactgtcgtggcaaagctcacggccaaaccaccccacagaatcgtatcaacatctgggaacctcctagctgctacatttagtcgctgaatctcccctacctgtttcgctgtatcactttcgctacttttcaccgctccttcaacatttcttctcacaagtttagactgaacagcttcctgatgagtagcatcaccacaggattggggcgtcgaattttcggatcgctctggaccgggattgcattgctgtgctgcatcagagcatgtgcaggcaccacaagagtccgtgccgcagcaagtggcttcctcaacctgacttggcctgtattcttcttgcagttcactgtgattatgcttctgtgtttcctttgctacaacggatccttctatcacttcaccaaacacagaccatctcccaacagatgtgatcttcacatctgctgatgttcctaacatgctatcaggagcaatgacaagcacctggatatatcctttggtatgtccaacctgtgcagcaaaagataatttcaggaaaaagtttatgtgactataaatgtggcaactcgcacaaacaccatcgatgataagattgccagcaataatgacacgcttaccaaatgaacaccatcagtagctatttcagtgatccatatcctctctactttgccttccattccttggtagggtgaaaatgactcgaaaactgaggtcaattcacggctccttttcttcacttcaacgcttggaacctttttcatcctagcagcaggtgttcctacagaacacaaagaaacaacattatagacaaagacatgggggaaaactgatgaagaatatttctagaaaacaaaagttagaaaaagatacctggtctggggtagaattgtgatatgtgaacctgagggaatagatattgttttacaaggttaacagtttgagagaaatcctcatcagtctcacctgaaaaatggcaagattatactttagcttaaactactatcgacatctttgaatgatttaataaacaaagatgaaggttattcataaatgatcactttaagtaaggttgaatagctaaaccaagatatttattttaccggggaatccacaaataatatctgtagcaatttgcattccagggacaagctcacaaagagtgtcaactaccctcctgaattcactcacagtgtattcacgattcattgcctgagatgtatagttgtggaataagtcagggccaggcgcaaacactacagataggttacaagcaaataattacccaattatatttgggttttatatccatatgttgctgtaagttcaagcataccgttaaaactgcatcacttcctgattgtacaggaacgtggaggaaagaataaacacagggatggcacaaaacactagcaatctccttcaaatgctccaatatgaaaggaggattggtcatgccaatgcgaagcatcgtgcttctgtccgcaggaagctcagcagcaattccatttaatagatttggaagatttgtaccgatatccctgcctgaaaacctcgcaaagtcagaggagcaaattgccataataattctatggcttatctctcagaaggaatccaaaaagatctggacaatggtattaccataagcaccagtatcctcactactcaaccatatttctcggacaccttcagagacaacaattttcacacgatctacctagagtagcaaaccaattttcatgcttgagatttaaataaataagcaaaacttcctacaggaaacaaaacatctatgaacgtaccaaactttctatagtatagcttccaagatgaccacgagcatgctttgtcttgcagtatgtgcaagcacccaaacacccaacattaataggaagaatctcgataaatttgttcttccttacctggaaattgtagctgtggtcagtcatcaggaatgatattagtatattacatctgtcagtggtaaaaaggtaatagcacataacattggcactatactagccataaaagattgatacatataacatcatgtacagaaatatgagttgtaccttaggtaaatcaagtgagggcagtgttttccgactcaacaaccgaacctcatggccttttaaggtttcttcaacaacttcaacaacgcggtcaatctgttgcactccaataacgctaataccttcaagctctttcagatcccggcttccttgtggtacacatccagccacaaccaaaggcttgtttgcactcttgcacttcgatatgagagttgtcatggcagactgacttgggtttttcacagtgcatctgaaatggcaaaataggtgtcggtcacaatatattcttcacctctgaagttaatttgaaggtttgcccctacgtgtcaatatatatctcactcttcggcactgcaagttggatttatgcttattatcccaagtttacacagctcatggcatattctagtgcaaaaaatagcgtagctagttttccacaacacaaatccagagcagcaccagtttgaaaccatcacaggttaaattcaactcatgtgtacttttaatgaacgtcaggaggtaatagatggaaagaaacaaataagagaagaaagaaactaaaaccatacgtgttaattagccacaaatccgctccttcgggctcttcagtgatcgcatatccaaacgctgacagctgccctgacatgtactcactgtcactctgcagagcaggaatgatcaactggttattttacatagctaacaacagcagaaccattggcttcctagcatcagcacaatgaataagcccgctagaaccacacactatcagtggatcactacttgtttcagcacttcaaccagaatttcttcatttgctagtggaagtaacagcatttaacgaatcatatagcacttcataattcatatcagtattctgtaagctagcgtgccaaaattctgcagaaataaatgtggacgaagcttgcctggttatgcgagcacccgaacgtcttcacatatatcgtctgcaacaaaacgaaaccatcaagcgcatcagattaaacgtggaaacgcagcaacacgctcattggagctcgagctacggcggcggtttcacctgcgtcccggggatccgggcctcgggctgcggccgggtctgcgcgaccctggacgatctcggacgcttgggcttcacggcgacggcggcgagcgggagacggagccccggagccgccccgccgccggcgatcccggccggccccagcacgtcctcgatgtcctccatctccatctccggcggctgctgctgctgcggcggcggcggcgacggcggcggcgcgtccaggcgagtcgtcgtgggctggtggcttccccgaccgagtagggtttctcgcttgcgtcgcgacgacgcgagtgaaagtgggcttctcggtttgggcccgctttgtgggctatcctttgcaggccgagacgaagcccacccaattcgattttttgggccgccccacctttccaccggccgcgcccgcacgcgcgcgagaaccgaaaccgcgcgacgcgcggccacgtcccgcccacgcgtgtcgcctcgcggcgacgccgagctcgccaccgcatccactgcggcgcgtccacgcgtacgccgcggcagcgcgccacggcctcggccgccgcggccgccgggcgcttctacaaccatcggcggctcagcgagcgcgcgaatttaagcccgtcattaggcggcgtggtcgaaccagcaatgcacttttaccgcggtagcttatgcttcttcgcactgagctccctccactccactcactggaactggaagcttacgagtgttcgtccaatgccacggcgtgccgctctcgccatgatgaacgtggtggccatcgggctcgtgctctccaccctggccgcggccggcgtgtggtcgccggcgccgacgccaccgccgtccacggccggcgagcacgtcgtccgggagggacgccgcgtggtcatcgtcgagtacgagcgggagcacccgctgtaccccggcgacgccgtgaaggagacgcacgtcctgccccctgactccctcgacggcggcgagggcaggctcacggacaaggccaggggcgcagtctccgacgcggccgacagggtggccgacgcggcggagggcggcaaggagaagatgtccgacgccaaggagagcgcgacggggaaggtgttcggcgcggtgaagcggtgcaaggacaggctctgcggcgcggccagggaggcggaggagggcgcgaaggacaaggcgtcggcaggcgagcacggcgcggaggaggcggcgagaggtgcagaggaggcgctctcgcatgctaaggagatagctgaggacaaggtgttcgacgctgcgtccaaatgaaggagaccgccgtgggagccaaggacaaggtctccgaagcggcgggcaaagccaaggagagggcgtctcacgtccagcacggagcagcagagaccgtgaggaatgccaaggacaaggtctctcacgccgcgagacatgcccgggagagcgctagggagcgcgccatggacgccaaggacagggtctccgacgtcgccgagagagccgagcagtgcacggaggacgccgcggggcgcgcggcgcagaaggcggcgcgggccgaggaggccgtgaaggcgaaggccggcgaggcggccagcaacctctccgacatcgcgcggagggcgcgcgacgtggcgtccgacgccgccgcgcacctcctcggcggcgggcccagggaggcggcgcgcaccgcgacggcggtgatgcacctgctggggttcgccgcggcgtacggcgcgtccctgtgggtgacgttcgtgtccagctacgtcctcgccgcggcgctgccccggcagcagctcgccatggtgcagagcaagctgttcccgatgtacttccgcgccgtggcgtacggcgtcggcctcgcgctcgcggcgcacctgctcggccgcgagcgcagctccctcgccgcgcgcgcccagagcgtcaacctcctcgccgcgctcgccctggtcctcgccaacatgctgctcctggagccaaaagccaccaaagtacgtaagctcacctcacttcatcgatcacccaattcttttcatagttttatgatcgattccttgcgttcttgcacaggtgatgttcgagaggatgaaggtggagaaggaggaaggcagggggagggacatggccgacatcgtcgacccgccaacggtcaccgtcgcggcgggcaacacggccaccaccaccaccgttcccacggcggcggcgcgcaagccggcaggcaacaacaatatggcggcgaagtcggcggcggcggcggcgccggtggacgagcagacgtccaagagccgggtggcgacgctgaaccagcggctcaagaagctgaacggctactcgtctctgtgcaacgtgctgtgcctgatggcgctgacgtggcacctcgtgcacctggcacgtcgcctccagatagccagcgtctgctaggctcaaaactcttcgtcgtccgtgtcgtttgctgtgaatctgacatgctgtagcttcttgtagtttttaccgttttagttcaggcagttgtcatggcgtctgatctgttcgtatgtatcaatgtacttgcttaggtatatttcgtcgacgtaaaaacagtagcatgtcgatctgctgttgtttgtagtttcctgcagtgttcttgcaggttgggatgtagctcaaaactgctgcatttcggacacgacgtccgttgttggcttgttttagctgggatgaatgtaactggaaacccctaatctgttttatcacgcgcgatcgatcgttgcatcgaccgttcatcgacgatgggtgctcaggttcttgagttcttctcggatttgcgctgcgagcatatgagcggcattgcacatcccattgctgatcgtctcaactctcaaattggggcaaaagacacgaatttttcatgcgttgagccggcgtgttgaaatgttaggcaatacgcgatctgtttgggtcttagtgatgggggaatataggccaggcccgtcggccgtggcagacaagtagcaactgttagttaggcccatgggttgtcctgtgcaattctgctgaagtcggggtaactaggccgtgaccttgaacgttcccaatcccgggctatttcggttgacgcaatgaaacgagcccgagcatttcaccgaacgaataagtctactcaggatccctctatctactagaggtttagtattcattcgtgtcgctagagtttcccttaatttctaaaacccatgcgaatcgagtctactttgtttagtgaaaccgatgcgaattgaaacatagttttgtttagtgacgtgatgagagctgttttagctaatgcaacgttaagtgactcgatttacactcaatggtgaagccagtgacactatcaaacccgagctactaaggccttgtttagtttcaaactttttcttcgaactttcaactttttcatcacatcattttaatttcaaccaaactttcaattttcgcgtgaactaaacacactctaatagtgaagacggcagtggcggagctcggatggtcacccgacctgctcaagaggtggccactactattttcaccgtttttaaaaggttgacaaatataatataatcggttctgtggtcgaggaacgtcgatgaaagtcaaaccctccaagtcctcaactagttgatatacgtaaagtgggtattttcctttcgccgaatcaccgacgtcagggaccagatcagccgggcgaggctaatcgggatttaccgtaatctgagaagaaccgatcgcggcctgcctccgctgactggaagcctctatcgctgatcgggatttaccataatactccgtacgaggctactcatgaggcttggaaggaacgaccaatgttgtgccatctcgtgcggtgcattgctagcggcgtggatcggagcgacggtgttgagaattccgccacaacgcgtgtgccttccggtttgcagccgcgcaccacaggtggcgtggtggcgcgggtcgtcaactcgtgatgacggccctgtgtttgctttgtcttctgcaagactgcaatgcaaaaaagctgtcctctagtagagactgcaagtttggcagttgagactgtttttcatcgttggattaaggcaatcaacggtctaaacatatgctacagtagctttaattacatactacaggaatatgctttgtacggtttttatttagaaaagatctagaacgttaatttctgatccaatggtgactataggactgcttaagtagctatagctactgcaggtgatcccaatccatggatcagacagccaaaacagcccaccaaaccaaacaaaatcaaatcactcacgaacacacacacacaaaaacccctgcctcctaccacacaaacacccgccactgtcacacattcgatcggatgactgaccgatcgaccccccagccccaggtgctctcaaaaagcaaacggagcgtactactagtacgcgacacaaatcctcgtgggatcgtgtcagatccctcccgcaccgaaagcccccaatcgtgccggcctaattgccatcatcaccttacctcctaaaaaccccggctcgtgccgttccaccgcgacaccggcaggaggacgcgccgaaaagacaactcgcgacgcgaccagacgcagccggcccatttctcagccacacggggtgaaaaacggtcggaatagatagcaccgctaggtttgatcaactagtaatttgtatttttttcctcatttaaattattcagtgttaacattaatacaaaacacaaagaaattataaattttatagtatacaacaaaacgatactagtcagaaacggtaatccttccctatataaaaacgaagctcgttcgattaggaattttcgtgatcattttcattccctggaccgccatcatcaccgtagaaaacaaaaagagcagatcaagcattagctagggtttcccttaccataggagtgggggttacagcacccggggtgctgaatatgattacacacgcaataatcaccgtaacaatgacaaaccatataaaatttgtcgaaaattcaaattgtttttaaatttaatggagttacagcggtttaaactttctcgttcccaacggtaaacacagtaaccagacggtttccatcgggtttgtaaacccaaccttgtcattagaagcgcgacaagaacccgccacgagccccacgagaacgagacgagacgctgctcacgctagcggacgcgacgcgacgtggggagccgtgcacccgagcgagccgttcgatcccccagctggctccaccgccgccgccgcgctgtcgcctccgccttggccgtcgcattatcctccgccaaatgccaacaaaaacctcagcactactgtaccgacacgacgttggtgagagccaaatctcggggaagaaaaaaatctcgcgcccaggccgaagcaaatggaagcttcctgcagtagtggaggcacacgcaccaaccccaacgcgcgaccgatgcactctcactcactctcactgccgtggccgatgctgtttaatgagctaggatacgatgattagtcactgcaatgcaatcagtggtactacgactgaaaatgagatgagacagtgcagcagcagctactactactacagcagagtagtactagtggggggagaaattacagatatgacctccattagcttaccacggccgcggtgcggggggcaggagggaagtgggtcattaattaattaacgcggaactgagcgactagcggctaattaatccatgggatattgctagttgaattagagctaattaaaccctagtgattaagtgaactcattagctagctaagctaagctaggctaaggctaagctagtgtgtgccagtgacagtgtgtctggctgtctagctagacgctgatcggtgaaggggagggggaggacacggcggcgcggggcggggagtcgtcggtgtcgtcgtcgtcgccgtcgccgtcgccgctgatgccggtgccgaggccggtgccgaggccgatgccggcgccggggttcatgacgccggcggcggcggcggcggcggaggtcggggaggaggcgagctggttcttgtggttgtgcatccagaccttgaggacgtggcgcttgacgccgatctcgacgcagaagcggtccagggcgccgtcgtcgttgcggttgatgcgccacccttgcttctcggcgaactcccgcatccgctccttctgctccggcgtgaacttggtccggaaccgcttccgcccgaagatgccgccgccgccgctcccgctcccgccggcgctgccggggccgaagtcgtccatccgcgggggcgtctccgagccggcgcggcctgccgccgccgccgccgcgtggtgccacgccgcggcgggcacggcgtggtacggcagcgcgagctgcggcggcggcgccggcgccggcacggacgacgggaggaagccctgcagcgcggcgtggtgcgagtgcggctgcggcggtggcggcgggcggaagaacaccggcccgccgccgatgcccgcggcggcgcggcggtggaagctgcggtggcagccgcacgcggcgcacttgagcgagtcgggcgacgccggcatgtactccccgcacccgtcgaacgcctgcccgcccatcgccgccgcgtggttccgcatgcactccttgtacttccctccacctcctcccccgccggcgctgccgccctcgtagggcaccaggctcaggtgatccatcatgacgatctcactcgctgtcactcccggcgtcggtggcggcggcggcggcggcgtcgctatcggaggagacgaggcgaggcgcggtgtttgttggtgttgatagcggcagcgaccgggacgagcagagaggagggggagcttttatgcgcgcgcgtggacacggctggtgtgaggggtgtgtgtgtgactgattataattaatacagtgatcagttatagtcggttagttaatgtgaccccagtttggacaaagcggcaaaacagtttcaccctaatgaactgagccggtacgagctagagacagcagtgaactgtcaaagagaactgacccagtatatgcatttttatttgtatgtattaattatacacatttagtactattatcacggaccaaccaccactcatttagtaagtaatactcctctatagttactgtactccactacactacttttgagtggttgtattggttcggttaatccgaacttgatagttgatactagtactacgtagcactagcacatgttttatggggtaactagtacaacctctctcccattttaatattttacttacactgtttaaccactcatcttatttaaaaattatgcaaatataaaaacaaaaaaactatgtttaaagtattttagataataaaataagtcacaaataaaataaataataattctaattttttttaaagattacgaatggtcaaatagtgcaaacaaaatatcaaaatccctttatatcaagggagggagggagtactgtatgagatcttctctttctttcttaatttagggcccttttgaatcgtaggtataaaaaaacggaggaatagtaaaaacatagaattatgacaagaatgtaagtttaaaacagaggattgcaaaacacatgaatgatcgttagattagaccacagaaaaaacacaggaatcggataagagagatagactcagaggatttttactaagaggttggacaacctcttactaagtttcctccaaaacctatatgcaacaaaatattctatagaaattctgtaggatttagaaaacttcaatctttgaatcaaaagagctatatatgaagatttcctataggatttcaatagttccttcgtaattcctttattcaaagggcccttaaagaaaacctaaacgatacttctaattatatttgtggagggagggagcacaccttgtagtactaattactgtactgtgattaactttgctgatgatatgatgcggtagttaaatcgctgggttgtcttgcctgaggcagcagagtaggcgccacgtgccggtcgggaggcgacggctcccggtcccctgcagacgcgacgcgccacgccacgccgccacgtgagctgggagaatttactatttgccactctctcaaaatgcagtgcccaaatgccacgtgagctcgggtttcggccacgcttgacgggaccagacgggggagggaggcggtaagcagtgttcacgtgtcgaccccgcattgggccccccggtagaaagaaaaagaaaaactcactgtactttctaattgctgggccccgccacgtggccgtgtagtcgccgtgcggcgtgtctgatccgatcaggtgcgcctcgcacggatggcccagatgacgcgatcggatggcccgacggtggagatttttcctagcctcctgatcttctgcggttcgagcccatgtaatatagataaatgaacaaagcaataaaaataggacattgctagacatctaatggtagctggtttatctaccactccatctatgataaacactatccacctataattcaaatacaattttctcttaaactagtcatccgatctacaatcagattacaccgttgtgttcatacaattaaatcattataacaagatctcacatgattatattttgatgaaaaaatatatatcacatttgtaatatatctaaattacttttagatttcactaagttacttcttagacatataaaagtaattcaatataacctaaaagtaatttacatatattatagaagtaacttataaaaaaagaaaataacttctataatttatgttaattactttaaaactttattgaatttacttttatatatttaagaagtaacttagtgaaatctaaaagtaatttagatatattataaaagtaatttgtgattttttatcaaaatataatcatgtgagatcttgttgtaaagatttaattgttacaaacacaatggtgtaatcgtgtcggtgacatgggaccgggagtatcatgacttagagacttgaggcagacgcgatcacccacgtggcctaaccccctcgggggggtcgggcccgagggtgatacggccgcccttctctttgtctccccgaggggtcgg

SEQ ID NO: 50007 - DNA, 1896 bp, Oryza sativa
cctgcagccctcatcctaaccattacaggcaagatgttgtgtgaagaagggcgaacatgtagattgctaagctgacacgtggtggacaagaatgaccgacgtgactggtctgacaccggtcatgtcgtcagcagacagccacgattccacgtcgcatctgctcccggcgaaagtggaggtagttgtgggccgtctcatcagaaggtgactcggacggcaactatacaaatctccgtccatttatgaaaaggtgggggaagtccccacaaaaaagagagaaatggtgcatgtggtatccccttaagatataaaaggaggaccttgcccacttagataaagaagactgaacttttccagattaggaacccagaacaagggagaggctggctcatactttgtagctccttcatacacagatctcccaaaaacacaggagtagggtattacgcttctcagcggcccgaacctgtatacatcgcccgtgtcttgtgtgtttcctgtctcgcgaaccttccacatacagagagcttagaatctcaccctgagtccccggccgaaccggcaaaggggggcctgcgcggtcttccggtgaggggccccacgctccgtcaaatcggattgtaaatcggatgagtaatttaagagaaaattttatttgaagcatagatgataggaatatttgttctacttgcttgatcaattagtactatagtaaagtaagattcttcaagacatatctggacaacggttgattggatgatagggtcgctcattatgactaaatcgagagcgctctcgatttaaattttacgataaaaataatactaactggtttaaaaagctaacgctaataaatggataatgaaaatccctcgtaataaactttaaaatttcgttattctaggcatataagctaacgaacaaacgatgaggacccttttaacgagtgtaatttatgtttgggtcatacttctttcgtcctataatataataatctaataccaaatgtgatattttatagtacatacgaatttggacgggacatttggtccaaagttgctatattatgagacagagggagtatctgataagttaacgttcagacgataatgggcctgtttggtttggttccaatttattaccttaccaaaattttggtaacttcaatagtagcaagtgaatgtttggtttgctaccaaattctacccacaatagttcaaattgaatactactcaatttgatagtgccaaaatttaccaatgttttggcactaccagtttggtagggtaaaaattggctccaaacgaaataagcccaatatacccaattttaacttcatttgttggaaatttttttgcatgcaatgtggtgtttggtactactacagagagtgctaatgagccgcgcgcgctgtcacgttccgccattgaagctgatcacacgatgcttacccgtgcaatcaatcaggggagggagggcaccgtcgccgtgggggcaagcaaagggcgatggatcgatggtgcatgttgctacagtgcttaatggcagaggagtaataaagagaggaggatatccgtgacacgtacagatttttcgctgccccggtactgtacaatgctaaactctatgcatccatcttcctgacctattactactacccagcgataacgccattaatatcgtcatcccgtatgatctcatctcatcaagtctcatccatgatcgatatatggatgtacatgtactcatggacagattccgaatacccaattggttggatgctaatcctgaagtaggagtatagagtaaggccccttttctaaattaagggcatgtttggtacagcttcaactactaaatataacttcagaagttgagtttggagtggagttgtgg

SEQ ID NO: 50008 - DNA, 2101 bp, Oryza sativa
ttcaagagattggcgttttttttttcaaatactaccattctttttccctactgctctagctggcctgtcgaaatcattcgtgacctgagttatcgttgaaagcttgatgccgtccgacagagacgtcgagctgcctctttttttctttttttttatgataatccaatggttttacatcgctctctgttaattttatgttttaatttcaagcggagtagcacagctcaaaagcttgtgttctgcgcggtggcgagacggagttgttttctggccggtcaccggctgcaagagattggcgttttctgatataccgcttttgtctcctgcttccagttggtcagtcgaaatgcttgatgcatccgacagagacatcgagctgtgtctcaagaatgaatcgggccccttttcctcttcttcccatgcggtttataaaataaatgctcgtggtccaagcgatgaaaaatgattttaaggtgatcctcactagttttaaaacatatgctctgatcatttaagaaaaatgaacaaagcaaaaaaagtaataattcacaaataaaacataaatatttgtgttattacggtttaaaagccaacgataaaaaaacagacttaaaaaaaaccctaaaattaaatctaattatgttcacaaaatttaaactttgagagaccaaggacctatttagtagggctctcaaactcataaatctaatttcaagttatggattggcccaaaccccacttcacctctttattcattttttgatcatcacaaccagctccactttctttccactgggactgaaaacgttaggtcgggtctgccctgagactaaacaaaaaaactctataatgttctttttaaaaaaagccttgaaatttagctgtgggcttaacaggaaaatttggctagttatctttcatcaattaccatcacctactagctgaataattaggagtatttttttttaaaaaaaataccacatcatgttctggttttgggggcattcttaactcaaaatcccaagttttataatttgcttcatgcaatcttacgttttagggcaaaatatttcttataacctttaggtccaagcctaaatcatccactttggctaatatttttcttttaaaactgtaaacaattgtatgagatattttgtcttcctccgtttcataatgtaagctttctagcattgcccatatacatatagatattaatgaatatgagcaatgctagaaagtcttacattgtgaaacggagggagtatataatataaatgtcagttgctttgcaactagcgttgatcatcgatggtttgataatttatgtgtatatttagcttattctcatgtcatgaattacgttaagttttttaataccacagtgcagaattgaggaaaagaagataaaatacacgagagggatgcatattttgagtcaactagtatgaatttatgtaaaaaataatcatatagtacctctattttttaatagatgacacggttaactttagaataatgtttgaccattcatcatcgggctaattcgatccatgccaccgcaactttgccaaattaaaaaaatactactactattcatcgtatcggctgggcgccactgcaattttgggaaattggatccataccactccgtcgcgttttccatccactcccgttgacgccgtctttccccgtccgaggactgagccagaggacaccaccactgactccggcttcggcgacgacaccgacgcaggcgcaagcggcggcggcggcggcggcggcttagggttctcgtggtggcgcaggcgcgagtgaaggccggaatcccgtgcggagcagcccccatgccatgacggcggttgaggacaccgcagggagcgatgcggctgctcctcgtcgcctcgccggtcgttcgctgcgaaaaggacctcgtcgtgcgcgtccttggccagggacgctgacgctgctggccggagacggtggcgcagccgcggcccactctgccgccttctccttggatgcctcggcttcctcaccacatgccccgacagcacgatggtcgccgagtcgacccgtgaggtggctttcgttgtcagcg

SEQ ID NO: 50009 - DNA, 1346 bp, Oryza sativa
ccggtccccgaggttcgccgtcgtcgacgtcgcggcgctccgggcggtgcgggtggacgcggcgaggggcgtggcgcgcgccgaggcgggggccacgctcggggagctctactacgcggtggcggaggggagcggcgggcggctcgggttccccgccggaatctgcccgacggtatgcgtcggcgggcacctcagcggcggcgggttcggcccgatgatgcgcaagtacggcctcgccgccgacaacgtggtggacgcggaggtggtggacgccgaggggaggctcctggacagggcggccatgggggagggcctcttctgggcgatcaggggcggcggcggcggcagcgtcggcatcgtcgtctcctggaccgtcaacctcgtccccgtcccggccgtcgtctccgccttcaccgtccaccgcctcctactccggcgaggtggccacgacgagcaatctctcctccgcctcctcaccaaatggcaagccgtggcgcacgctctccccgacaacctgttcgtcaaaatgtcctggaggccaagaccacaacgacggcgacgactcaactgtcatccattggtgacgttcaaatcattgtttcttggaaattgcagcgacatgatcacccaaatcgaccaccatttgcccgaactcggcatcaaaccaaccgattgcagggagatgaactggctgcaatccatgctgtactcctacggctacaccaatggccaaccagcagaggtgcttcttgacaggacactgcaacccaaggactactacaagatcaagctcgactacctaacctcaccaattccgacacccggcctgatcgaattgctcaccaagatcgtcgaagacgaagacggctccatcgacattgacccacaaggcggcgagatgagccggataccggaatccggcacgccgtacgctcaccggagcggatacctctacaacctgcaatactttgtcaagtggggaggtgacaagaatgtgtcctatgaggatgatcatctgagctgggtgagggggttgcatgagctgatgacaccctatgtgagcaagaaccccagggctgcatacatcaactacagggacctggatttggggcagaatgtggagggaaacacaagctatgaggaggccagggtgtggggggagaagtacttcaggggaaacttcaggaggctggcaatggtgaagggtgaggtggaccctgatcagctgttctggagtgagcagagcatccctcctctggttgtgagcacaagggatgctggattggtttcagatagctgatgatggttcagtctgcagcttgatgtatagtaagaatctgtgcctt

SEQ ID NO: 50010 - DNA, 729 bp, Oryza sativa
gttgtcctttgcgtgtgcgccatgcaagcgcttctccatcccatcaccagctgcgtccaaacttggacggcttgagatactagtttcctagtacttatttatggttgtttatggtttaatttgttctagtgagggggcaattagttggttagcgccttggtggtgagcattcagttgagttgagcccttgaatgagcgcgcgatgcgatgtttggtgttggggcgattagcaaggtttgtaagtcatctgattagtcttgttgggactcttgctagcttattgttatgaattcgtagggtaaatgccggtatgcagttagtcttgcagtaatcagccgtgccaagtcagcacatttgtgtcacctgtttggtccaagctccttgaaatgaagcaatccaggagattgtcgatagtatgtatcgcttggatttatagttctagtgctatgggatggaatcattagtgatgtgctgccgctttagataattgaggcagtagatgtcatgaacctgtttgttttagtggtttttctttctttgttgattgttgatgttctgccttgcctcactggttgttgctacatgacagcacggtgcttctcttatggaagggagtgatcctgtcaccggccacataatctccacaacgattggagggaagaatggagaacctaaaagggtaaattataacataaatggaagccacaatatgttattcaatcttatgtg

SEQ ID NO: 50011 - DNA, 1217 bp, Oryza sativa
tagtgtccgataaggattttatcttttccttttatctttagtttctttcctgtccgacaaggactagtatctccctatgggtataaatatgtacaccctgggtcattgtaatctatcaatctatcgatcaatacaactactctcggcgcatcgccaccctctttaccgaggtttttacttatcattcgatggaacttggcacctgacgcggggctgcatcggctttcgatcttcagcgaaggggtaagtcctacgttccgtcggcccaggcaattgtctcatctacatcagcgttgttcaaggctgcatcagtacattcgacctcttggattgctccggtttggatgatatatttgtctacctatttatcatatgtctctgttaatctagtcttagcatatcagtttacctctatcggccgcttctcgctttagggtttctgccggtatcggctaaatcgtgttgctagattagattagcttagacatttaccaccctaaaaatcagtcaacggcttgattgtctagatattatgtttcttttcatacttagtactgcatcagttgagtttgatctactaagtcatgtttagaaccataatctctagcctgcttcttgattgccaataagggtttcatcggggtttcagccgatgagttatctggacgttgcatgggcttacaaggactgcatatacatataagttggacttagccgatcacaacaaaggttttactgtttatctaatattgtggattttataacattggacctccagccgatgtatgctttaaccttcggatcagtgtttattctatcatctcattgctagccgattggtttatactgtattatattattgttatactatattatcatcagtcgattgcctttatatcattatttaagtcaagtgtcagactctacattggacataaagccgatagcttagaaccctatcgttatcggctggcatcggctatcggctggtatcggcatcggctggaactactccatcggcttgtcagccgatcagccgtttgatctactgtttatatatcttgtcagttgcagggtcaaactgactggcacacccgcatctcatcaagatttttggacctgcactggagttaagcagatctcccaggcctcgtgtttttcgcatcaacacgcttttggcacgcccggtgggaccatgattttatatccacatgttt

SEQ ID NO: 50012 - DNA, 2870 bp, Oryza sativa
ataactagacagctaaataatttaaaatcaatattaccaatatttcactataaaaaataaaatatgttatttgaactgccacctattctttacctgacaacccaaataacatcctatttttaatttatttgaactgtttatttatgttactcatattttactatgtaaaatttaaaatacgtaatttgaacatacaccaacaagcaaacaacactgaaacattgaaaatttgacaatatgtattatgtcatcttaatcattctacataataaaaaatagaaaaatacaaagtcaccatgtatgaccttttagatacatgctaaattaccaagtgtcacattttaaaaattagtaaaatcttatatattaaaagaaaaaaaataaaacatctagctaacggttttcacctagatcgatgacctattaacattattttcaactatctaatctacttttgaaaaatatatcttaataagtggcatgtcacatattttaaaaaaatcttgcaaatcttaggaaaattacatctaataattggctttcacttaatcacttagaaaaattaaaaaaaaaatcccctccacacgcgcccatcactacacagccgctccttcccctctctggctcaagctctaaactttcattcctcttacgttccttttaactaaaatataaataatctataattataagtttcacgtctgatttctaatctaactattgctctgtttataatcaaaccaacgatataagatccatatgcctatagtttactatacaacaaatacgacattttaacacaatcagcctattacttacgagtatctcaaatgcagcttacgatacatgcccgcgcgaatgcgcgggctacctttctagttaaatataacaaagatattgtggagattatgggtaccccatacctacatggcatattatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtagggggtgcgtcgaattacctgtcgaaaagtgcgatggaatcaacttcagaagaaaccccgagatcaatctcatcaatttcgatggctcaaatcttcaatcgggtctaccgttccaatttaatctctattagattaatttttaatcattgtttgatttcctgatattttgacgaatttcatatactggatgagatcgaaacacgaccatcatcgtcgcctacttgggtgcccttgccgtgtccgagtgctcctctcttcctttccttgcagatggacgtgttgcaggagtggcacaggccgccaggattcgattcctgtttgcatgtatgatggttgatgggctccgccggctacctccgatgatggcatcatgccgaaagaacatcgagttagctgttagttgccggggcttatacatgttgcatggcacgtcgccggctatcactcatgatccagcctcactgctcgacttgagtttttcgtttcaatttgttatcaatatatattagattgatttctaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccaccggcctgcctccgtcgccgccgactggtgtccccgcctatacggttggttggtcacaccaccgttcatgggcgtctacgacttcaccgccggcctgcctccgtcgccgccgactggtgcttctgcctacacggctggcctattatgccactgctgttgggcgtctacgacttcaccgccggcctgcctccgtcgccgccgactggtgtttctgcctacacagctggcccattatgccaccgctgttgggcgtctacgacttcaccgccggcctgcctccgtcgccgccgactggtgtcctcgcctatacggttggttggtcacaccaccgttcatgggcgtctacgacttcaccgacggcctgcctccatcgccgccgactgatgcttccgcctgcacggctggcctattatgccgccgttgttgggcgtctacgtcgtcaccgaccggccacctcgaccgccgccgactggtgtttccgcctgcacggctggcctattatgctgccgttgttgggcgtctacgtcttcaccggccggccgccgcatccgccactgactgatgtcaccgctagcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggcctattatgccgctgttgttgggcatctacatcttcatcgccggtcgtctcgtctgctgctgactagtg

SEQ ID NO: 50013 - DNA, 971 bp, Oryza sativa
cgttggatggaccgagtaacgcaaggtgctaagtattattcggaataaatcaaaagcatagagatgagataaatttattttctgctcttaataattgcaaaagtacccgagtagtaaattctgatccgtgaaactttgttccattaatgacgaactcatgtcactcatatgcatgtttgggaagtgcctaggccgactcccggtgcttgatggtcatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaagatccagatccagatatgcataaaagggattcatggctttaagcttatctcttacgctccaggaatggatcagtcagaacatcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccaccgccgactggtgtttccgcctgcacggctggcctttatgccgccgttgttgggcgtctacgtcttcaccgactggcttgcctttgccgctgccgactggtgtttccgcctgcacggctggcctttatgccgccattgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttcgcctgcacggctggcctattatgcc

SEQ ID NO: 50014 - DNA, 720 bp, Oryza sativa
ctgatgcttcagaggaaactgaaaagatggagacagatggtcagaaccaagaaaatggggcggatgagaagaagcaaaatgaagaaagcaccccaattgaagaggtaatgataatatttgctgtatagttttgcttttatttcatatgccatcatgatatcaattgcttctccttacaacttttgtattattttcacaggattgaaggcatatgcacacactgatataatctggcaccaagttggtgttagatttccgttttatttgtgggggcaaagccacattgcgatgcctgatctcgttgaatgctctcgctggtctctagcatagtaccggtatttctgtatcttgtgaatgctaacatttttcagaagatggaaaaactatttgctgtgtttaggaaacaagcttggggtattttataccttccagtaccgctagatttcttgatgttgtagactgtagacgctgtttcatgtggggcatgcgagatgttcactcttattttctggaaatttcccccttattgctctctattgggaggctttgagtgagttgtttgaatgcatggcaccatttcaaaaattccccgtagatcgcgaaaagaaaattttttgggtgtcacatcggatgtttgactggatgtcagaaaggtttttcggacatgaatgaaaaaactaatttcataactcgcttaaaatcgcgagatgaatttataaa

SEQ ID NO: 50015 - DNA, 1034 bp, Oryza sativa
ggtcacctttggtgatcctaccaacttccgcaccgaacggctcgactttgatgtggcggatctcaatctgccctacaacgcggtccttggcaggcccgcattggtgaagttcatggcggtcacccattacgcctacctccagatgaagatgctgagccccggcggccccatcaccattagtggcgatgtcaagatcgccctgacttgcacgaagcaacgtgcaatcaacctcgcagccggagaacggcggcggggggcctgagacttccacctctcgtctcttgaagaagcggatgacttctggtgacgaggtgtccgtcaagaagattatccttggcaatgatccgtccaagaccgaagattggtggtaacttggacgacaaataggaagacgcgctcgtctccttcctgcgggcaaacgccgacgtctttgcctgaaagccgttggacatgcctggggtccacagggaggtgattgttgacgaaaaaatcgaacacaccggcctgggagatctgcttaactccagtgcaggtccaaagattggtgagatgcgagcgtgccagtcagtttgatcctgcaactgacaagatatacaaatagtagatcaaaacagccgatcggctgacaagccgatggagtagttccagccgatagcgataatagccgatgccgataccagccgatagcgatagggtttaagcaatcggttatatgtccaatgtaaataataatataaatgcaatcggctgatgatgatgtaataaaataacaatataatccagtataaaccaatcggctagcaatgatatgataaataagcatggatccgaaggttaaagcacacatcggctggaggtccgatgtcatgaaatccacaagattagattaaacagtgaaacctttgttgtcatcggctaaatccaacttatatgtatgtgcaatccttatgaaccgatgcaacgtccagataactcatcggctgaaaccccgatgaaacccttatgacaatcaagaagcaggtagagattatggt

SEQ ID NO: 50016 - DNA, 839 bp, Oryza sativa
agaatgtgttggtatttcttaacgacatactagaaatataattcccagcaatgatttacaaagtctgtcagggttatggataccacatacctaatagtagttgactaaatctcggcaggacccaccacataccatgtcttatacggaaataaccttcggatatggatagagttccggataaggaaagacaaccagagttacacaccagggatggtgttcctggtgcattcgcacacccaaaatccacttccattaaatggtgaatgagggggatccttcccgtgtcggcctgcgtcagccgacatgatttgatgggccccgcacaacagccgatactaagaggacttccacgttgtggtgcaagacacatatttaatatagggaatatttactcccttcactgggcggcacacccccgcgcatgtgagagaaccccttggagtataaaaggaggttcatgtccagtgaagagggggggtcgaagaacaaagagttggatcgcttagccctagtttgtacaccagaggttcagagatttggaaagctcagaaaaatcatcatacacaggagtagggtattacactttttagcggcctgaaccggtataattccctttgtctcatcctttttgaggggcccgatccccttgacagcttccaatcttcccagctccttagctttcactcgctgccctcggccgaaccaacaaaggaggggcctcacggtcccccgctcgaggagttcgtcctccgacaagcccaaacccagctccacatctctagtttattttatgatagtgctctagtcagctctgtacccattttaagtggagctgaaat

SEQ ID NO: 50017 - DNA, 1995 bp, Oryza sativa
atttctaaacatattttcggagaaagtggtaccgtatctcaatgtgcttggtccttgaatgttgaaccggattcttaacaatgttaattgcactgttgtcacaaaaaaaacactcaaagacaagcaaccatacaccttcacttgtggttttgaatttaaacttcaaaagcccaaaaggacatctctcataaagaggtacacacccatgggcaaatgggccggcaaagtgactctaagggactactccaaagggctccaaagggagcctactcaccctaacatccacctctctatttatagcccaagatggatgaaatccccctaagataatgtcaaaattgcccttggggcaaaacccatagctcagatgaaatctaggccatccgttgttccttctcctcaaaggaaatatctcagatgtccaaacgagccgaagcttctcatgcgcacgcactccagggtgaacccgtgattcgcgcgaacgcctcctcggccaatcaccgcacgcacttgcttgcatttgcatccttatctgtcacttggtcttgatttttcaatctcttcaaataaccaagtttgacttgcaatattatttgctttgtggagcaaaatcaaattttcaaaattttgcttgaagttgccaatgtttccatcaagggggagattgtgaaacaaattgtggttttgatttattgtgatggaaaattggcgagtgtcggaagtgcaagaaatgtgtgctgactaacacgagtaaggttgtgatatctatgcccgaacaacgggcgttttgtttacgtgtgtgtgcaggtgatcgaagtcaaccttggtcaatggcgaggaccgggactatgctcagggaggaacggaggtccgacgcagtcaagaggccatgtgacaaggtgggactgacgtcaggatccttggaggtctctctaggtcaacggcagatcgggactaaactcatggaagagttgaggtccagaagagtaaaggatgccagttgacacggttgagtacaaggcggtgcccgatgaacgaacaccgtgtcagtagtacttcgcaacgagattcacaaggtcaagtgtgcaagtgtctgagattcgcgaagagtaatgtacaatgctagacgatacatgcacttggacagcgtatgtgtactgtactcatgcaagcaagtgattgggttgcgcatatgtgcacgtggcccaatgccatgcacttgtgcatgagtctgatcgacttggcttggaggaggtcaagccaattaggctcttgcttgttgacccaagacggaggcggtaaggcgtccggctagcagccttgttggcagggaggccgaaccatgctggtccaggtgatggtccaagacgatagttgcagatgaggcctggctagatgcaagacgcagcgagggcatggaggcgaaagccgtacgggacatgcggttgtctcatactcgccgcacaagcgcataaggtcgcataggtggagcgcgcctcccagagacgcgtggtgaacgggtattcggcgagcggcaaagacgtggatcaacgacgaccaagtacgtgtggtgattggccaaggagcatacgcgcggatagcaggccccaccgtagattgctcgtgccggagaagcttcagccttcagctcatctcactggtaggtgggcctagctagcaaggtgcgcgggaggagtggttcgatgcatattttatgtggaaaatgggatctggagcgggcaacaacatggaggacatccgagttatttcctttgagaaggaacaacggatggcctagatttcatctgagctagggtttcacccagagggcaatttgaacattttcgtagtgggatttcgtcatcttcgactataatagaggggtggatgttagggaaagtagtgtccctttagagccccttggagtagtcccttaaaatctctttagtgtcccttctgcccatggatgtgtacttctttatgagagatagcctt

SEQ ID NO: 50018 - DNA, 1729 bp, Oryza sativa
acaatgtacttaactccgcgacattaagtgctataggatgaacagtgtacttaacagtgcaaaatagacagaacctaacggcgatggcattttgggacaaaatcgtttgtacgatggtatttcttggaactcacacttgctaatggcattttttggatttggacgcttgtcaatagcatttcttggattatctcaaagatgatggcgccaagaccttgtcacacgttgtaagcaatccacgtcactagatggtcagctccaggaaccatccacgtcactagatggtcagctccaggaaccttggcattgatggaataagccttgtgctcttagtagccttgttggtttttggtctttgtcgttctgttttgcttttagcatcttaggacagcatcctttcagttttacttttagcatcttaggacaacatcctttcggttttgctctttagcatcttaggacagcatcccttttatgctttatgttttcctttcacctttagactagcccgcagctagcaagctatggctataaatatgtatccaacctcccccggatagtatgacttggtactagagccactctatcctgtagtctagacatctcttgctcatccccttcacgagctcccctctgtcctcaaccggcagctggaacatcggctattcctgctcatccctcttcccctgcactgacgagcagcagctcgtcagaggcaaactcttcccccacactgcaggcccccaatagcatgccatgcccgcaggacagtcttagcgctcggtcgcctcgagcgcgcggctccggcaggaggccgagctcgccgcggccgaggaacgccagcaagcggcagcagagactgctgcgatggcagcgagggcgtcaaggctgcctgcggcggaattggtggcggcaagggtggaagtggaagcagcggcggatgcagcgcaagcggcggcggcagagctcaaggctctgcgcgacaatagctccagcagctctgtctccgcctacgacatccctgctgatgagctgacgagggaggcagctcgtgagcgggtggagcaacgggcagccgcgcaaccccacacgcgccgtagcagcagcccagccgggcgtggatgcgtcggcggcgttcctggcaggagcgcgcgcggcagcggtagcccagacgggcttggacgcattggcggaccccttggcaggggtgcgcatgacggcggtgctcccggcggcaacggcttggtcgacggagatcgcggccgttgcaggcggctcgtctctccctccccggaccggtaccgtggacaccacgggattcaggccgtcatcagggaagtcagccccggcggtggttggcctgccttcaccaagaccaactacatcgagtgagctgcggtcatgagggtgaggctccaggtgcggcacatgtgggaggcagttcggtacggcgacgtcgactacgacgaggatcgacgggcactgaaaggatgatgtcctaagatgctaaaagcaaaactgaaagaatgttgtcctaggatcgctaggatgctgtcctaagatgctaaaagcaaaactgaaaggatgttgtcctaagatgctaaaaacaaaacagaacaacaaaaggcttattccatcaggcattgggcttatatacttcttaaaatattaacacaccattagaacaattatacatgtgtggtgtggtgatgagatgcctgctcttgcc

SEQ ID NO: 50019 - DNA, 738 bp, Oryza sativa
agattataaaagatctagtccatggtctgcttcaaaatcgagctcaatgctctttagaaatcacaacaccacttaaacaaaagcatcaatgtttatgcctcaatcaaataaacatctatagcattagcagtatgctaacaattcctaggtaccaaatgaattgtcaatgacccgagaacacttaaaaaaaccatcttcaggtttagcacttacaactaataaaattctatcacttgtaaacatcaatccaaaacaaatctattgaatgaggcaatttcaagcaaatattggaagcgctatcctaggtcacaaaagggaatggagacaatgaatgctttaaaatcttctaggcacaggactaacataaacaggcagatacgaaaagcgaaatgtttcatccgagaaagagtaacggggcctttacttgatgccaagatcaatgtgctcctggataccgaagccgaagcatccggtgtcactgaagttcctcctgagcagctcgtactccttgaccttgagcccgctctccagcagctgcatcgccttctcccctctcaccgtcacgtagcacgcgatcttctcgttacgcctgattccgaacgaccgcacggtgtacctcgctgcaaagaaagcgccccccgcaaactctcgtcatcaccacaacgaagctaagagtaaactagagtagagagacggcaatggcggagagcttaacctacccttggagaacaccggggt

SEQ ID NO: 50020 - DNA, 2153 bp, Oryza sativa
atgtttccgggcaagcagaggccgtggcttgcagtactagtgccagtgggtgcaaggtgatcaatcgatcctaggctcaatactctgaacggtagtctagctgccacggctgcagctagagtcgtcatccgaaaatctgaaaagaacggaccctgaatcaattccaccggcaatcgaccggcaaatgatcactatcgttgagtttaattacaaacgtcggggaatagcagtgaacgtaaccttcctatacggtttacaagagtatttatagaagataaaagaaaaaataactaacaggaaaaggcatcaagtcctactcgaaaattaatctgaatatagtgtagacctaaattcggatcacatatttaacaatcgctaccttgagacgaattttctcttatagcataaaaattatcaatcaccaaaatacctcatgtaggcaaaatcaccatgcgccaaatagtatgtagaattaaagtattagaaaagttttggatggattaatttgaacaaaatcatagcgaaatgattaatcacaagttaatgccaaaaaccgaacaatctctatctccactattataaaaattaaagatgtttttgctggtactttgtttggttgtttgtttgtttgccggtattataaaaatctctatcccatgtatttttgtttgtttgtttttacactaaaatgcgacataagcgacatgttaatgacacgtgggatgaagaccgggtcaacactcccacgtaggcgccacgtcagccaaaaccgcttccaataccactaagaaatatattttgcattggttttgatagttggaggagtcgatatacccggttttttgtttggaggttttaagtcatacttggaccatagttgagggagtcgaagtatactttttccacaagtctgttccctcgctcatctctttgggccatcttatatttctagaataagtctattctgcatccctattctcttttatcatgccctgaattaagtctgttttgaatccctcgaccatatttttctttcgtgctcattggttcgtgtcatgccgggccagtccaccatgccaaggcatcaacccagacacggcccaactatcgggctaggccggcatgggtcgacaccagtcatggcatgccatgcttagaccgggccaaatagccatgctatgggccgggccgtctagcctagcttcgggccttatggccatctatatgacgtgctagtctgccgcatcaagagtgaggcaacgtcaatgtgggtgcctacacacaagcgaggagttagggtctgtcctttagccttcccgtttaaaattttacaccgtgatggtactcatgaggaaattaaatttgaaaatataccgttcatatcttttttttcttaaaaatatcctagatgcaaatctttggacacaaatataccgttggtcttgctgaaccgttgtgcaaaattgacgtgggatgaagatgcagacagtcttgtagaggggcagcgtgagaccgcgcggtgtcgagcgacgagcgtgtcaaaccgcgagcattctcgtgcaacaagtctacgaaagtgtttcgaaaattaaaggcaaaatttgctcttggacactcgaaaaatatggtctttgctgaggaacaccataagaacgtgtatttgcttgaggacacttaaaaaacatggtaatttgttgatagatacttatacgtattattttataatttttcgctattacagagagagaattttcacaaaatgacacttttgcccctgagaccaatcttcgtcgacggggatcaaatccggtcgactcagcaccaaaaccggcctcgctgcccgtcgctttgtccacccccgccatcttccacagcagttcgtcacggtgtgttctccccggggcgacaactccatccattcattcacaacaaagagcagcagcaagtggaaagtcgtccgtctgcccatcgcgacggcgtccttgccaccgccgctcggcgcctcgtccttcaatcattcgtccgcgacccatcctcgatgtccaatgccacgagccgtcgccagcctgtgaagtaacagcaacaggagtagcatttttgtctctgtttatgaagcaacagcagctgcgaagccaacatcctcgccggcggca

SEQ ID NO: 50021 - DNA, 1300 bp, Oryza sativa
acaagctgctagatatcgacatcagacataagcctaggaaaacccgatatggtacctacgggaaccaaagagaggaatctagcgctatctctgatctcgccggatgcagatttgaggaggaaggctaccctgttgtcgactacgagtcagatctttagaccgccacgttgacaacagttagataggctaccccaaatattgtactggtgtgattatgatgaataagatcaatgaccggcttcggccaataggatgtagggttattacctgataattcaggggcccgaacctgtataaaaatcatcgtctccatctcttttacctcagtctcgcgtatatcttagtaccaacgatccccatactatgcaaataccggaatcgcgacatcaaatgtcgacaatactccatccgtattttaatgtatgacaccgttgacttttcgactaacgtttgaccatttgttttattcaaaatttttgtgtaaatataaaaatatttatgccatgcttaaagaacatttaatgaatcaagtcacattaaaataaatgataattatataaattttttacataagacgaatggtcaaacgtcaaacacaaaaattaacggcgtcatgcaaggtagtcctacgaacggagtttccataaaaacacattccttacaaaccttgactaggattgaccttcttcttcttttttttctaatacagagaatggataccgttgtacacaacccaacaaccgtccatccactcgttcaggcgctcacacccccgcaatccattccgattcgagcaatgggcggcgccgcctccgtggagccgaaccgaaccccagcaccagcaccagcaccaccgtaagcctccctcaacgacgacatcctcctcgccctcccgtccctccatgccctctcgtccgcgcggtcctcgcctgcagctcgtgggctcccgcgccgcccggcttttcgccggggttccgccgcctgctccacccacccggaccctgccccctcgggctcttcaccgaccacggcggcctcaccatcctcccggcaccccggacttcggccgccgccgccgtcgccctccgtggagccacgagctggaggactacgcctcccacggttggcatgccgtggcgtggcgacctcctcctgctgaacccacaggaggctcgccatcctaaacccctttgatctgggacgtgtacttcatccccgctgttgctcggtggcatcgagctggaacaggaagagcatggagcttccgcgctgttccggtttacagggatgaattcaggct

SEQ ID NO: 50022 - DNA, 1128 bp, Oryza sativa
  unsure (1)..(1128): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcagtattaactatctattgatccccaagctatctaaacattcaccaggctcttaggtttgtttgttaattttggctgcaaacgaagaactcacggctaatttggatcatttcacgtgtcatcttgtttctgactttgcagggtccagagagatcatggaactggatgtgacaattagtgaaaaagaaacatcttgttgtcaggaggacgtgaagaaatgtacacagattgctttggcttcagttttccctgcctttatcacggacttcctgggagcttatggcttgcaggaagcctaactcagagatctggtcgacctcgtgtccaatgctttcttgtaatttcttcacatgcatctacttgatcactttgtttcgtgtgtcgccttcagctcggctagcttgtgatcccgagttctagaaaagcatctggaaatgaattgagttctactttcaggaagggataagcttgattctgtgctccgatcgattaggtcactaatgcgaaattgtttcatccatgctgttgaccagtcatgtctaaattctgaattctggccaaattgaaatattcatgactaaaaaaaattccgtacattgcaacaagatctaataacattagataatctaattaagactaaacaatcactctcaaactccaattaacaatgacaggattnnnnnnnnnnnnnnnnnnnnnnnnnnncaacatgttgtgcatgaagcaaatagggatttaaacatagtgctactgctgcatggccggtgccacattggtcaacaaagatggagctcatagaaagagggttggg

SEQ ID NO: 50023 - DNA, 3940 bp, Oryza sativa
tttaaacatagtgctatgctgcatggccggtgccacattggtcaacaaagatggagctcatagaaagagggttgggagaggagaggtgattgatttgtgctttctcacttacttagggggtgtttaaatgtaggggtgtaaagttttggcgtatcgcataggatattatatagggtatcgcatggggtgttcgggcactaacaaaaaatctaattgcaaaatacgttagtaaaccacaagacaaatttattaagcctaattaatctatcatcagcaaatgtttaatgtagcaccacaataacaaatcatggagcaactaggattaaaagatttgtctcgcaagttagtcgcaatctgtataattagttattttttagcctatatttaatagtgttcaaatgcttgatgtgatagggtgtaaagttttaagatgggatttaaacagggccatgtccatcaacattggcttcttttttaaatttgcatagatactagtcatttcaaaatgttactaagtacaaccttgggatgagatttgatccatctaactagattcgttgttagaataagttaaattctattctactactagattacaatattttagacagatgcagtaacttcccactcacaatacggatttcgtcaccagacatcagtaaaggagaaattcattccagtcatgacgtgtcagctcgtagaaattatagtatactctctccgtcccataatataaaagattttgggtggatataatacattctattacaatgaatctggtcacatccatctaaaatcctttatattatcatactaatccataaagcgaacttggcaaccttgtgttaattaagctgaaaattttattgacagaaacaacgcaaagacaatgttcgagccgcttagactgttctggccgtggaacccaacatgctgctcttttggcccattccaagcccacaggagaaaaaaaatgtccacttggacacgtgaaggaataaaccgtcaaccagtaaccacctgtctaatacctgtcacaaatcacaacccgtggacccaccatgagcaccggagtcatggacccaccatgagcaccggagtcggtctagctcgcttgtctacgtgcaccgagtccacgagcaccccacccacacccaccgacccaccccaccaacgcatcggcgcaacgccgtcgccgtcgccgtcgcggtctagaaaaagccgccgcgatctccgaccgtgtcgtgcgctcctgtccccctcctctccgacgagccgcctcgcccatggcgtcgcctccgtccgctccctcctcctccgccgccgcggccgcgcgtgccgctccccatcgcccgcgcttgcggtcgcggcgatctctccggccgccgccgcagccgcagccgcgggtgcttccctcttccgtcgcctgccgatcctccgctctccgggtgagttcccagatctcgcgggcgccttcgttccttctcctcctgctagggttccgcatcgggggaatagccgcctcgctgatgttcatcgaggctttagcacgtgtactattggcacgaaatgagtgttctcttctagtttttccccgtctgattatccatgtgttggcgagttgggatgctgcttgtgtgattcgtttcgatgctatttgatctcgtcgagacggttaggatgttgcctgttggagaaatcatccacagtatcaccttggatttctgagtggtgactttatgatggatgtttgtatataactaattgagtttgcgcgagaatgattcgtttgacaaaccaatgcgtgtgaaatggttaagctaaggcaatcgcattgtcatttaattatcctttcaggacttccaattcagaaatatctccacgagacccacaagcaggcgcgatgtccttccagttgcctctgcatttgatgaggtactgttttatttttctttagataacattgattcttatggagtttcttgatacattgattcttatggagtagcttaatttactattagcgttggtttttatgtaggatctgggtgatttctcgctggtgcacgctgatggggatgaccctttagaggttgttgtatattcaagtgagagcgactggagcgatgaggaggtcgtgttaaatccaacgagtgatgttgagttacctctaaagagcaagagccgctttgagggtgtagagggtgcgatgacagttgctgcccataggtttgccacgattgagaaagggcatagggacagcaggcaagataataatatcttctgataatacttaaaaactagagattcagcgtgtagatttgtagcatgcattatgatcttccaggattatctgtttatgttattcctggtaaatggcacttaaaagttatcaaactagtagtaagaaacacacgctttttacaagtgtttttgctaggttctgactgaagctctttacatcaattcccagaactcaacaagggctgatgaataatgttggactgattgctttcttagcaatattacttttgtttgtcgactggtgttcttggcggattgttagactacctctggactctttttacttgacacgtccttttttaatatcatcagttctatcagcattagctggatttgtttttgcaccagttgctgataacatgaagattcatcatttccggaggagagggaagcttatgtctccattctatagaaagccaacaccagcaatgggaggattgttctttgtacctattggcatttttgttgcaagaagacaggttggttcctcaactggagtgaatggagcagctattataaccctcatatttgcaatggttggatttcttgatgatatttcaaatcttgtcatggactgcaatcgtaaaataccgcattggatgagattatttgttcaggtgaatggtgctttttcaagagagatgataggatgctcttcccttatttttttgacgggagatgctcttcccttattatgttgaaagcaacttacagttcttttgcagattgttgctgggatttacttatctatctggttaagttctacaaatatttcaacaccatataacacgtaagcattacttcaacttatatatactgaaaaactaactgcagtttgaattaatgctttatcggttaggcaatgtggtaaattgcctttttttttttgatgaggagtaacctttcttaatggcctatatcaaagtattatcatgatgcagtacaatgtacaattcagttaataaggtgcacaacattatttctgcctccctgtactcacaggaacactgcacagatacttcgtgccttacattacttccaaatgtactgatttaacatctattttcaactcatgctagtagctagtcactagtgatcgtgttcacatgttaatttagaggcaagggtgctttgctaaccacttctgattttcatttcctatttagtgcaccaagctagtcatgtggccttaaattccataaccagcattgatgtggccttaaattccataaccaacattgatgtggtcttaaactccataaccagcattctgtaacaaaaagatacatgtcactaccgttgtcatagttctatagctttgccattttgactaatactttaggatgtttttgacttttttcacttgtcagctttactaattcgaatttgttcatgaaggaaattccttgttcctcttcctcctcctcttggccttgcattcataggaaaaatctatctcgttttggctgcaatatgttctctttccatgggcactggagttacattggttgatcatcttgatggcttggctggtggcgtcgctgctttagcacttgctggattgtctgttgcttccctcccaatttgttcaggtaatttgccattctggcttgttgagctaatctcaaatatactt

SEQ ID NO: 50024 - DNA, 3627 bp, Oryza sativa
gttcattccgatgttcatcgcatgcagcatttttcttcttgagctgctcttggtaatatttcaggtaagttattgcttggattacttcctcttttattttttttttggagacaatcacttccttttgcttcaattattttttatatctggtggttgttacacttagtcagcatttctataactgttacaaagtgtagcttctgctttgagctgcatgaaccgatttagatgttttccagtagataatggttgagtattgttggagttcattatttgattgttctcattctctgtcaaagagcatggacgatcttactttggttatagctttacacccttttaataaaaatagatgggttaatatatctgaccatcaagtgatctttgttgtaaaccactattttttgttatcgtttccatctttctgggccccgcagcccaaaccttatgtgcttaatcaggaccccctagaaggcccttttactgtccatgagcaattatattcgtatggaagtaaatttagctgagttatgcttccataatccacgttgtgaagtttgcttatccttttcttctgaaaagtaagtttcgctggtacattaatcgtatcatgccttgtgtatatgtttttgctgaacagtttttagttaaatcttggtctagtcagattcaaatatgacaatcctttgaagtagagcgcatttgatcatagaatactttttggtgatgaacaaagcctgtcttatttatacgattatctctcacaggtcccttttcagatggctaagaagcacttccttgggacaaatagatatcccttgcgtattcttccctcgtattactttcttaagtcgtggggtatcaaggaaccttatattgtggctggcgcatacattatatcatgcctattgacggcatttgcaggatatcttggtcttgtttcagcgtaagtggaagcttaggttacttactattctttcattctttttctgtcgctcctaccttattcttttcagaaagtttgaacctatagcattcttttagaatggtagttaccaagtgtatgattcatacaacaaacatagaaaatgtagatattggacctagtaggattcctaacaattgtgggaattgggtattatagcatgatatcgtgagctacgttttctgccttgcataaagaattgtatccttttgtgacctaaattattgtagttacaaaagatattagactatcaaggaaaatagcttatgattcttgatttgttttctccctggtatgaaagtttcaataatggattggtatgctttgctagaaattagttttgaataaatgcctaaagggctagcctacaactttctcgaggaaaaagagtacagaagttttagccttttagggaaaaagtttttgaaagatagataatctaatcggtgtatcagtgattcagacattcaatgtatgtgtcacagactcacagttgggtcggatacatattcagctgtttcacaagtcggaggtagcagtcagttttctaaaacgcactgctaaaagtgcaataagttagtactacctccgtattataaatataagacactgtttacggcattgatgtgtaactttattactatcttcatcccaaaatgttataatctaagatgtgatttgactcctgacaacaaatctggacgactagcttgcaacattttaggacggaggaaatacttttctatttgatataacaataatgtctaaaaattacaatattataaaagggcttataaaacatagttattttgagagctatctatagtcacagttttaaaagtttgaccaaataaaatcaataggataatatatttaaatacacatggtaatagtagcaatgttttttttttgacctttacttttgcaatgatgagtttagggtttgtttcgatacgtgacgacacaacttatgcacgcaggagtgatcttgcacgtccaagtcaaaggtccaaaatgcccctgacatatcgtaggcaaataacggttgatatgaattcagtggaaaataaggaatattcccaaaaatatttacaggtaacaaaaagaattctgataaatgtacatgctaaattactgtacactagtatgaaacagatttctacaagtggtcagaacacattcgctggtggttaggttaagttgttcactcgaaaaaaatgattttgctgaaattaattcccagaaaaatgattttcaacgaacgagatgaaaagtgaaattggaatcggatttgacgatataccaaccccaaatgaaaacattataatagagatacagatcagaagaaagagagtgagacgtgggtaacaataataaaaggggagctataagacacgtgccacaaacacaatcgtgcgaactgcacgttattacacgtacaacggtacaagcacgaacatgcaattatgcatgacgtagagagcttgttattactcaccgttgacttttacgtgtttgatcatttgttatattaaaaaaaatttaagtaattatttattctttttatatcatttgatttattgttaaatatacttttatgttcacatatagttttacatatttaacaaattttttaataagacgagtggtcaaacacgtaataaaaagtcaacggtgtcaaatattttcaaacggagggagtactaataactgtgttgacgaagagaaccttggagggagatgactggggaaatgaaaggagcggcggggcaatgaagaatgaacgagatacgtaatgcccatgcagtggaggtggaggaaaagaaaccgagcggagcaggactgggtaacgggaaccagctcagaacgatggcaacttgactcagcgctgcttgaggtagacgacgcagccgtccctcggcaccatggtcggcatgtacaccggcacgtcgcagccctccgtcctctcacgccggaagtcgacgagggagacgaagagcgccatgaagatgacgaggtggttgagcgcgtaccgctgaccgacgcactggtgcgggccggcgccgaacgcgaggaagttgcgcttgtacaccacgtcctccctccgcgcctccgagaagaagcggtccgggtcgaacgcgtcagcgtcttggaacccttggaacgacgactcgtacaccgatgggaacaccatggtgcccttgggtatagtgtactgcgccgtcagctggaacgcctcgacggcgatgtgcggcaccagcgtcgccggtggatggtaccggacaacctcgcgcgccaccgcctgggtgtatttcatcgccgacatcatctcggcggtgatgggttcgccggactctggcgaccagagagcggccacctcagcacggacgcgggcgagcacgttcggatgggagtcgagcgcggacaccgcccagcagagagaggaggtggacgcgtcctgcgccgcgaagaggaagccgaacaggagggcgccgacctccacgtcgctggtgtgcggtggtggcggcagccccgctgccgtggcctcgtcgatctcacgcaccgtttcctgcatcaagtagtccggaggcactctggctcgccgccgccaagcatgcgttgcctgctctgacgtgcgcagt

SEQ ID NO: 50025 - DNA, 1259 bp, Oryza sativa
gccccacgaacaccgtttgcgaggtctccaggttcatgtcgcggcagggcacccgtatcggctcggccttgccgccgttggaagcactccggtcgagccaccgccggaggtgggagatgatgacacgctgctggatgacggcataagtggagagcgcgcgcggcgtgaagttgggcgcgatccggcggcgcaggtccttgtgctcctcgccgaccaggtagacgaggttgtgttcgccgaagagcttcttgccgaacgggtggctgacgacgtggaaggcgtcggcgcggacgttggcgaacacgcggtgggacagctccgagtcacggatgaagaccgtgaaccggccgaagagaaagtccgcggcgagcccagcgccggacttgcgagcgagcgccgcttgcacgtcccagaatccgaccgggtcgcggatcaaatgcgcggcgctaccgaggaacggcacgacgagcggcgcccctggcatggaccccttcttgcggtggtatgacagctgctctatgagcatgtataacgccacagctgcagccagcaatggcgccgccgtgcggaggtgtacgaggccgtgaaacgactcgattgagccggacgggtcagtgctggttctcatagtgcgtggggtgctgaaggctctcgagctcctgctcagacagttgcacttatgttctactggacatgcgcgtatacgtatttataggaaaactatttcaatccggcgggcaacgtacgtcccatcagtttattcaaacaccatccaaatattcgtgttatacaatacatctattgaacacattgactatagggttaactatagataacatggctatcaattgaagcgccaacaacaggctctcttattaaccttgcttttatacaagctctctctcttaatagctatatataaatgacctggataaatattgaagccagtagcctactaaactattgaccttgctcttagagcaagtttaatacttagtagagctactatctataagcctatattaaagctaacatgcctataatagatagactataagattgcctttaatctttttctttttctttttctccaactatctatcaactattatatactaaaaatccattaaaccacgtacaaaagctcttaaaccatcatatgacactcctatgaacgcttcttaaaccatcatatgacacttctataaacgcttctagctagattagcgatgtcacgtgtcgctctaataaataagaga

SEQ ID NO: 50026 - DNA, 870 bp, Oryza sativa
tgcttcttcgccatggatgccggtaagccctccacctcggactcgctggtccttgccactgcagctagcaagcagtcccctccatctctcgttgctcctccgccggcagcagccatgacccgtccattcctcatcgtccccaccggcggacgcgacaccctcgccgttgtcgttaagggaatcaacggccggggcgcttctccgccatggaggccggcgagcccaggaggacaacggctaaggggaacgagcgaccggggagccgagggtgaagctcagcgggacgagcggcacgggggaaggaggtcggtggtggcagcgacaagggttgaggacggtgacgcggcggtggctgggtggcaaccggcacaggggcggtggccggggaccttgccgggggagcagacgatgacactgtaggcgcagcctggcctgccggctccgagacgaggggctcgacgacgacgacgcaagcgcagtctggcctgccggctctgagacgaggcactcgacgacgacgacgacggcgcagcccagctcgccggcttcgagacgaggggctcaacgatgatgacgacgcagtgcagctcgacccgccggctctgagacgaggcgctcgacgatgacgacgacacagcgcagccccactggctggctcagagacgaggcgctcaacgacgacgacgcaagcacaacccggcccgacctccatctctaagatgacaacggcgacgacacctgccgcgtcaatggtggtggcgagagaggaaggggaaatagaagagaggggagggaggtgggcccacgtgcaatagggggtaacggggatttttgacggaaaatatggagtggcacgtattcaatttctcc

SEQ ID NO: 50027 - DNA, 8034 bp, Oryza sativa
atgatctcatgaactttattaaagtgatggatgcatataatgaagcaccaaacagctgaacatgcatcaaagttaacagtcataaaacatctcagattctcaggaataaaaattttggtgcatttgccctggtaaggcatttctgtactttcatgctgttattgatgagaaacagtcgagagaggaaggcatgatgcatgagaaacctattgaggccagtgtgctgatatttacattctgctgcagtgctaactatacctggtattaatttaataccaaccaatactattgtaacagttttatatccccttggatgcttggcccatgggtgtcataggacagaaggtaagatctagtgctgcaaaaggggcagcaatcgatggtggaacattaataatgttggttctgcatccttaactatggttacaatgaggttcagacatagtagctgtctcattggggaacagtcttatgaatttcacaattattcaccaaacagtcttatgaactaaatcactttatcaagaacttcctgcttgtgtttacctatttagtacttcctaaagtactatacataaaagcaacagagggcaaagatgaaagaacaaagctaattcttactagataaggaaatgacctaatgttgaaaaaagttgacatggatcttgcttcaattgttgcagaggatatgattagacgcaagtcgggccgacgtcgttgaatctggtatatatgattatattcatgtaaatatacaagcatcgtgacagataaaatattattcacacgtgaagatatggaaagatcagactagcacattccaaagatgaaaacctttttcagaagacccagcaacatgtcagttgaaatggatcgttcatgggcttcatcaaccataattacactgacaaaaaaaaagaggattagtgtgtgaatcaaagaaactaaaccatgcaagacaataaataatacagcttagtcatgcattttcttaaactagaaaaagggtttaataccactgaaaatatgtcactcaaagtatttcactcaaaacttgtgcaattggatcaaacatggttcaataatcaatacaaatggacagttgactacttgaatggccatcttatgatcatgtcgacgttgagggtgatataaactgatacctatacttggtcagaagaggatcttccatcatttctctgatcaataccccatctgtcagaaatttaatcatggtcataccctgccaaaccaggtatgtaaggaataagcagactaacaggagagagagagagagagaaaaaacaattttattctaatttgtattgacaaacggtgaaggaatactgtagatatacaacaatgcttcatactgcagaatccatataaaaaaaacaggcataaaaaggaaatgggtcatactggatttgtttgatcctcaaatcggattgtgtaaccaacttcttctccgagtctcacacctacttcttccgctactcttgatgcaactgactgttcaaattactaacattatgagttggaaggcaattatcagataaaaaaaagaagcatttgcaggtgcaatctaagaaaagtaaaggtctatcagaactggagcatgaaaataagaatgtcatctacgaatgaaactgtaaaaaatttcattcagttgacatcctttaagtcagtaaacatgaaattctatccactaaatgatctagaatggaaagtgaaactgtaatgggcatgttaagggttggcccataggcctagtcaaggtgttcctggacccaagtggcatgtctgcatcatggaggcattgacaccgcaagggcaatgaaaagagatggaacatcagccttatatagaaggggtgacttgacccttcatacactcatcttttaaattaagaaaatgcaaacaacaactcaatataatcttacctctaaagatcaaatccaaatagggattgtgatcattaaccacatggacaactgttgcaaacagtctaatacatatgttcgataagttattgtggaaatgtgagacatactgcaaaaataccatctctaatgcttaagaagaatcttctagctcagatgccatgtttatttgaactattggactacacatgcaggtatttccaatgaggatgagtcaacagagcacaacagtggcatggtatgagatcaaagtgaaatagttctctgtagccaagaaaaaataatgtcacatgtcatcatcagatggtcaatcagaaagacatgattttgtgtagaatctagagacagctgcaaaactaaataaaggttgcaaacactggatacctgcacggccaatcgtcttggttgagtgcagcctataagtcgaccaccctcggcccatccagcctctttaaggtactgataaaagaatacaatgaagccagaaatgaaaatcatttgccagtaagatggtgggaaattatgtagtgctgattcaatatacaatgaagatggaaagggaacatcatccgccagaagacaatggcagattatatgttgtttgcagttttcatgggcttttaaagtaagtaacatttaaacaaattcctctaggtgatttgaaggccattgttcatgtttactatgatatgtctttatattgatatatgtccctagaatatgacatacattaacagaaggtgaatataatcaaacaatagcaccaaagtgattcaattaaatgcagaaagcaggaaaatgaaactggagatccaagccatagcacatgctctcatccagtcaagcacccagagctcatagcataggccagtcttgcacacaaggtgtttttactctcagtctctcttactagggaacagacatgaggtattcggtggaatcaaaacgaattagtcagacatgacatgcaagtattcacaattttgaaatgtaaccttccaccatgctgcctaaggcacccagacaaaagtgcatgcaggtgcagcataaactgcggatgcaactacgtatgcaccggtcgcacgcaagcaaacccaggtgttcgaccaaatgcctcggacagatctctccgcacaccaagaaaatcgtcccagtggcaactgcaatgggaaaccgagagccattcatacgcctagaacacatacctgagggatctgcgtggactttccgctgccggtctcgccgacgacgatggtcgtggcgtgccgctccaccaggtagaggatggccttccggtacttgtacaccggcagccgctgccgctgccgctccaagctcgcgtacccaaacctaaaaccaaccgcggcgagagcagcggtgagcagccacaccttcagaaaccgcgagtagcgcgcgcgacaatgcgagagggaagagggggggtttagtttagggtttgggggagcacccggatgaggaggaggagctggtgcttgtgggcaggaagaggacgccgccctcctcgtcctcgacgatcgccgccgtcggcttctccgaccccggcctccagaacctcgacatggcacgcgccgccgcttctcgtcgtcgccggtggggaagaccgtgtgtccgtgttgtggtggatgggggagcgatagtgtgggaggcccgcccactgccggtgcttcaaatgggcttttgatttgggcccaccttggatgggctattaggctttggaatgaagaacaagtctattttgcttgataactctatgctcccgattaaatcgtctccttcaaccgcaatactggatataactccacgtttatctccgaaaacgaaataatttgctttggtttcaaagattgaggaggcgttatatccggtattgtggttgagagaggcaatccgatccggagtaaaggttgagtgtggtaaaatagacatatgaggattgttgcccggttcctgaggattgatgggctaaaatcaaacctcacacatgcgatggtgctgggcttctggaaagtcggttcgattcacagcccaaggcagccaactgaatgtgctacagtggtgtagcttagattgttcctaaattttcttatcacacagtagtcgcacatgcacaatatcacattttgacttgtgcaaatacgctccccaacacaaacttaaaaagacgaaatcccacgatatatcattgatctcactaaaatcatattaaaagcccaccttcataggtgtagtcatacacccacaactccatcaccatattactattacttctttagttcgcagtgacattgttttcctctcaccagtaatcgataaaaggtgaatgccaacggctaaaaggtaggagctgtactagaataaagcacctcgacaacatccatgataagccatgaattcgacgatccactctattctctttaatcatgcactctgtatataggttccttgctatcaaaagtacatctatttgttccaatcacaggatcgagttaatcgtccggaagggctggcctcgtaatcgtaggttgttcgtgtcgatcagatcatatcgatcgatggattgatcgagcggacgtatccaaaggcgacaccacccccaatttggtgatcgaggttccatgcatgcacgtctcatcatcgcttgctttccgtccatgcacgacaaaagctgaccaaattaatcatcaatacgtacatctctggggtcaatatatgcagatatgttccgagtgccgagccattctgtctcaactctcaacccataggatcaaattaggaacataggtctattctaaagatgttaattaagctgcgttcgttcatcacatctcccctcctctgttccatctttttccttatttttcctaaacttttaaagatatacgttaataagttgtttcgttttaggtatgcatcctaacccaaactgaatttctatcggaaaaaaaaacccaaactgaattttcttaatcatcacgtgtttttcacgcttacctctcatgctcggcgctttctctcccacgtgtctcttcctctcccccagccagatctggtcctgccgctgccaaagctgaccggcgtttgcgcggtagccaggacggtggcggaggggaagtgggaggcagaggtgcggcgatggcggccagaggcagccggtcctgcgcctggccgtgtgggttggggatggctggaggtggtcaggagggcagcgggaaccggcaaggagtcggcgatggagtccctccggacggcggtagggacagcgaagcacggcggaagatggtgacggcgctcggcggctacggcagccctaggggctgcggcgtcccaagacagtggcagtctgagcactgtgaatccgataaagtggaagctgatcccatcggttcgtgtatggttggctagtttcagctaaacgacgaatgacgacgcatgaaagtgggctaactggcggcatgtggcgtcagcttatctgaaatggataaagatggcaccaacggaggtttacattgacggcgcactaggggcggcggcgactagacgactttcactcgtcaaatcgggctgtttcaggagaacaaggtgggacgtagagaaacaaggatgtgtcgaggttgtatggttttcttttcgttttttggttgtgtgttttcctccttgttgaggtgtgagtctaaatactcacgtatcattttggttgtgtatattattcgtggatatagaggccagattaataaaaatttattataaaaaaaatcctaacccaaactgccgaaaacggctttagggtgtgtttgaggagaaggggattgaggagattgggaagataagcaaaacgaggtgagccattaactcatgattaattgagtattaactattttaaatttaaaaaatggattaatatgatttttttaaagcaactttcatatagaaaatttttgcaaaaaacacaccgtttagtagtttgggaagcgtgcgcgtggaaaacgatgtgcattctcactccctatcatccaaacgaacgcagccttagagcatctccaacaggatggctatttttggctctccatttgtctatttagccaactaaccataaagattcctctcccaatctgcgcaaagactctctaaatcctaatggctagtttcctctcaaaaaatccatatattgcatttagttcacacataccatatccatatattgcattggtccatacattgcattgcattcagttcactaaattaaaggtccatacattgcattgcattcagttcactaaattaaaggttcatacattgcattacaaaagttcactaatttaaaagtccatacactacactgcatacattgcattgcaatcagtccagtaatttaaaggtccatacattctattacaaaagtcaaataatttaaaggtccatgcattgcattgcaattagtccactgatttaaaggtccatcatattgcactgcatttagtccgtagcagtacacaaaagtttagaggtgattaattttgatgcaaataaagataccccacttggaatccttaaaccgcttaccaaggatttcagcttgcaatgagtcatagtacattttccttggtccagtcaagcaaaataatgcagttcatacaaaatcaatattgtgagcaccatgcttctccacgcacttgcaaacgcaaacactataacaacaaggtacatttgatgcacacatatttctttcgatcttcagagttgcacacattacagagcaaatacacattacagttgcacacatatttctttcgatctttcgatctacagagcaaatacagaggggattttcgatctacagagccaatacagaggggaaaggagtggtggatgggggttttacctgctttgctatgggcatcggcagggtggtctcagcagggacggcggcggcctcagcaggtcctatcggcagcagtcaatggcggcttcggcaacaaaagtgaaaagacgacggcggaggggcggccctggtagcagaagacgacgacggaggggtggcgcagaggggcggcgctggcggcaaaagacaacggcggtggtcgacggcgtcttggcaacaaaacacaacggcagaggggcgcccctggccgagaggacgccggcggaggggtggcgcacaggggcggcaccggcggagagatgcgcgcgctggatctgggggaagggaaaaacgcgatctgtggaagagaggataggtgggagtagtacacgtgcgtgggcccacgaatggctaggcctttttggctggccaaatttggccagtgcgagcagcactttgtccagccggatggcttggcttggccagtttgttggaggacaaattttaattaaaattgtcaaaatttaatttagagagtagactaaggaggctgttggagatgctcttagtagtagtatcgaacatcgggacataccaaacgagagggattttggtcaaggatttactaaagtagtagtagatcatacgcacacgtatataaacagatccatgaatccatatccatgcatgcatacatgcaccgtcatcaggatattccaactcttttggagacagggtacgtgacagggcccgaaagcgatgtgcctgcccttttttaggctccggccggaactactagcgtagccatgcaccctcgtaaccgagcgacgagatatatcgatcgcgatgtggatggtgccggccgtcgccgtcgccccggccagccgcctgcatatatgcagctgctgctgcgcgcggtggacgcggctcgtgcatgtggtgtcgcggcggtgtcgggccggtccccgcgcgcccccgcctccaccacggcaccaccactccggtttgcgctgcttgtttgctctccgctctcccctaatcatctccacatgcgacttgtacgcacgtagagtaggggaaatttactccatcaagcgctacgtgaagcaagatagtgaaaatacgatccgattcgatgttatctcgtttcctatatctcgtagaaatagttttaaaaaaaccgggaatgctcattggcgggcgtccggcgcg

SEQ ID NO: 50028 - DNA, 10905 bp, Oryza sativa
gcgcgccctcccccacgtgcgtacggcccacctacttctctatctcattttttcaacaaaagatgtttcaactagtgtatttacaatgtttcactatttatagatataatgttgcagtgaattaaaatactcttttacaataaaaactcacatattttgaaaattctctattaagggaatttggtttattttttgttctataaaaaatgtttcacctagtgtactcacaatgtttcactatatataaatctaatgttgcagtgaacgaaacattctattgcaacaaaaaaacccatatattttggaaaccccctattaagggaatttggtttattttttgttccaccaaaaaatgtttcacctagtgtactcacaatgtttcactgtgtatagatctaatgttgcagtgaactgaaacattctttcgctatttgctgaaacattgtttttatataaggtgaaacaacacccgatttaaacgagtgaaacattttcgatctgctcagtgaaacaattccgatatacctagtagaacatcgtgcaacatttaaaaataattcaataataagttaaattttttttcgtcggaatatatccatgtgtggtctgttttgaagatttaattgtaacgaatttaatggtgcaattggatcatgatttggataagtaatttaagagaaaaatcattttaaagtagttttgcacgtaaattgggcgctgacgtcagcgcccaattttaacaattttgcatcgggcgctcgagcgggaggcgttcactaaaaaaaaactgacaatatttaagtttaaattttatttttataagttttaaattttttttaactgcctgtatatgctagagtttaaattgttcttctttataaatggtggtagaagttaaatttaaacgtgcacatttgtgtagtagagtaatatatttattttaatttataatgctaattttttattattatttgaactatttagaaatgagaagtctgctgcaaaacgtatctaatcttctcgggtccggaaaagagacgcagaattacgttagcatgcacaaccgcatatctacaagcgactctgcaaggctctcagaatcaatcaggccgtaccatactatcgtccttgaaacctgctgctgtctattcctagatctgcacggtcatggccccctctgttcttaaaaaaaaaagtttactcgcttttctgtgacagtgacactggctgccccaggacattcattcatcttttcctgtgcggaattacttgcagtggttatcgtgacactggaactttcttttcctgttcctgtatgcaacgaattactttctctgtaaatttcttaatagaattcgttaaattcctgcgctgctgcttactacttactccgtacttcagctcagtggatatgtgaacagtgaactaaacaagaagaaagagtgaattcagtgatttatatattaccagcaaacaactgctcaactccaaaattgcagtatgaggaggaccaggaggttgtacatggtacttggtcataattcataacaaatcatttgcttgtagccaaaatttgaattttgaaacttaattttagagttgattttaaggattttttcatcatattttattttctatatgattggtttttaaatcaccaagaatttaaaataaaggtcttattcataacttatttctagttaattattcaatttttaaggtttatcagttgtgaagcagatgatgagaggccaaacctattttttaagagtaaatttcataaaacaccacctattatgatctaagttgcaaaaagacacaaggattttggcacgtgacacataactccgggtattatatttctaaagtttcatgaaaccacatcgttaaccatttgacatactcatgtattaaatattttaaaaaatatgtaccatttgacatcctcataattttgaggtgtgattgtagaactcaaaagtatgatagatcaaagtcaaaataattaatagtatggtctcgtgaaactttaggaccataatacatatggtaatgtgccacatgccaaaatcccaatagttttgtgcagcttggattataataaatggggttttatgaaatttacttattttttaatgatagtgtaagggtgaaatttcaccgagatatgaaagcacaaaataaatataatgcccataattaattatgcacataaagtgttgtatcttcaataagattttagagaagtcaagggtttattattgtccgtacacatttttttaagcgtgtatttaagaggacacaccagtatttgtacatgtacagtgttatgagagtgggcagatacgtccagtggtgttcccacgtatatacttcttgggtcacaggactcaatgtagattattatattctaactaaattataccatgttaattattaggatatcagttagtaatcatataattagtattagtatgtattattggatccttgcataatttttattttaagatcatcgctggattctcgtcgtatatatatgtatggtagtagtgcatcagtttgtatcaacgagtgtaagctcggcgcctccagcctgcaggtgggccagctggtggctaggttgcccaaactcgtttatacagcctccggtcccatgatcgatttaaatcagcctgcgtcaacagcgtgatgtacacttgcacacgtataggtacgatctgattgagaccgtgtatcatatatactctctctgttttaaaaaaccaaatttagtactagatgtacttcctccgtttcacaatataagtcattttagcatttttcacattcatgttgatgttatatgtagattcattaatatcaatatctatatgagaaatgctagaatgacttatattgtgaaacggagggataacatattatagtacaataaaattagatagagatatgtccagatttatagtgttagggatgtgttacatctagtactaagttggttttttataggatgaaggaattacgtacgcatacatgtatagcatatcatcatacgtatagttgggctgtacttgatctgaatcgtgaggctgggttaggtgtgcatctctactcatggcattttttcaatcataggtatgtagagaggggtaatgcagctatagctaggagagtacgtacgtggtgcgaaacgtacctctcgtgtatatggcgccagctgtggcatgcacgtgcatgcatgggatggattggtgtctcgtattctatcgatcgaacgatcgagagcgacacgcgcgggagatgattacggaacatgcggacggttccgcgcgcaattgcgatcggtcgatcatatgcagctgctggtaggtgggcgcgcggcgcgcccgtggcggcacgtgagacgccacgacggccgtccaattaattcccatgcaagacatctcgctaccactggttagtggagtactacgatcaaaactcaaaagtgtccagttacccccgaagtatatctcgatgtagaaagtgattcatttaattatttaattcttacggtaaaatggattttttagtgtatttgacagaagactaataacgaatgataaaaagagatgaaaagaaaaaaaaagataatataatgatcgatgtgccatgcattcatatatttaatttatactgtaagatggaattttcgtatgtatagtatatttgatagaagactaatgacgatgataaagggaaattaaagaatagaaaaaagataatatgaatatctcatccaacggtggagccaattagccaaattcccggagtggtcaggcggcggccacctagactccactactgttacctgactggcaatggcctacgaattttatttttttttacggcgcctacgaaaattaattgatctcactgaaaaacgttatttgtcgtttggctttgatgatgccgttagattcgacactggtcggtgcaacaaagcctatggtaactaggccttgatccctaagcatgtctcctaaatctctttccaacgtcatattaaaaatactcctatatacaatacggagtataaagatataaagcaagatgcatgcgttgttaaattccagggttcgctagtttcttggctttgcccctgctctcaaggagtagtacaacctgcatatttcctttgcacatgatgcaacacacactagctccatcccagagctcccaaccactgcgggcggcagccaataagggcgcagcaaatgcagaaacgagggcgaggcgaggatacaaggcaaaagctgaacacacaaccctgcagctagctagcatacatgcatggaagctcccaggggcccacatgctagttgctgcgtgccggtgagtccatcaatgcatgcacgccatcgaaacaaaaaaaagacgacacgtagtaggaaacaacgggagcacactagcacaggcaccagcaagccaatcgaaaatgtatatataaatatagtggtttcaaatagagaaaaggcctaaaaaaagggaaaaaaaggggtaaaatatagagctagcattgcatgcatgtggtgcatgtggtggatcatgcatgcatggctataacagcttgggagttgggaccaattacacattgtgccgtggagggaggattacaacattggtgtgtgctagctgccacaaagaatggcacatggagaggaaaaccacttaataaatagtactagccctactaatatacatctactatgcaatggccgcccgtctactacgtactcctatatatctgcagcgtcacctggttgtagaatcgaatcacaagaactaagtcaaccagaggggggtgaatggttggtatacccaaaaaccgaaaactcttagctgaaataaaagttaccctcaaaatcgacggatcgcggtctgaccgaagttgtcttgccggtctgacagcctggttgccgtcggtctaaccgagattatatctccggtccgaccgccgagatcagctgcttctcgctgtcgctgccgtcggtctgaccgccgcttgccgctggtctgaccgccggtagatcgccggttggaccgccggaacccggtaaacacaaatcgaagaactcttaaagtagatgacgactttattgattctctctgtatttacaaagtgcaccaacagcactctttacaaaaatttcgactaaactcgaaaccctaactcaaaactcaactcaattgctctcaaaagcgataccgggaagcctcacgctccccctctatttatacatgaggtaggcagcctaaagccacgaaccaaactcatactaagagttctaaacaccttaggaaaccctctagtacaagaaagaaactttacataaccaatcgtaccaaatttggactccttccaaattcgactccgcatctcatacgcacacaataactccatcgtatgccatatggaatctccatcaaccacgtgcatcaactctagcctaagtatcccgcatgatctctgaccaccacggacgtcgtcttatccccaaaccgactcccggtccatcaccgcaaatactctcccgaggcatcaagtcacctacattagaataaacaaagaaaccatattctgagaccaagctatctccaacttgactcattagtagcaaacaacagtattacatacatatagtatccatctagaagtcataatcaagaaataaactcggatatacaaacaaacaacccgaaaccaaaaccgacacagtgtcggccggtcagaccgcgggctgcgccggtcactcattagtagcaaacaacagtattacatacatatagtatccatctagaagtcataatcaagaaataaactcggatatacaaacaaacaacccgaaaccgaaaccgacacagtatcggccggtcagaccgcgggctgcgccggtctgaccgcgcattacacgccggtctgaccggctaccagagcccggtctaaccggttacatgaaatcacctgtgaatccaatcatctccaaaaccacttcgtgagtaaattccaaatatcaaaaccgataatctccaatgcccaattgttcataacagaataataataaaaaacacttttgattttacactggtctccatcatctctctgatcatgtggccagcattgccaggtaccgctttaattcgagacgggtagttatgcgaaatttctcacatggtgtgtcaaagatgattgatcactagtttaattgattcaagacgtttgtatgcatgcatgaacattgcatgccacatgcaaggtgtcaaataaattactaactggaaagcacgctgtttatattgcacagtttggaagtacaaaaccaccatgattaacctgtctgtgtctggtatactactatcgtttcccagaataaaagtgctgcagcttgaggtaattctggtcgaatgcttgcacgtacgtatgctctccgggcgccaagttgaagaactttaatactccaaccatatatccagcagctatatatagctagcagagtgatgaacagttgactagctagctggaaaatgctcaccagaacagtgtgagatccgaagaaccggctgggccggggctatctctcacatatgcaagttgagcctcgctaagctgacacactcggtggatcatgcaccatccatgcacgcagatgcagccatgctgcagccatgcgtgggtggctcaaattgctcaaatttatcgctcaaccgcgcgcagatcgatcggaaacaaaacaaataatggccaatcgatctgtttgtcgcccactgcatgatcgtacatgtgtagaaacgttttgtctaccctgcagtgccaaaaccgtttcttagatctaccccaatcaatagatctccatagtcacattttttgcttacgatatgaactgggcctggcggtccaaacaaatggcacagtgcaaatgcaggcgtaaactaaaaaaaaaacaaattaaaatcacaaataaatcgcacaatgcaatgcatcacagcaactacgtacagcgtacgacgcattgtaagagttctttttttttctttttgatttgaattctactactactcctataggaagattaatgtacattctgattgtagccttgcacggagctcgcagcagcgctggagccgtattttaggccataataactcgagcaatgaggggaaataaggggagtacggactacggagtaggagtacacctcactgagaagtaaacaacgacgacccaagctgaaaagaaaaaccgaagagatcgaacagtagctagcgaccgccccggcctttggtgggataaaaaaaaggggagaaaataaaatcgaacagaggaggcggccggagcgggcccaccggaaaaacctaggggtcacgtcagcacgtggcggatggtcccgctagttaatttaaccgccccgcgcagtaggcccagcccaccacgacttttgagcgcgcggccgtttaatccattaatccacacggcgggggggattcgcttaatcccattgacggcgccgcgcggcacggaccgcgttcatgacccgccctcgtgcaccgatcgaatcatccagccgtccatttttgcgcgtcaaagatcccgcccggcccggcccgggagccaatgctttactctacaattttcgccggtagataaaaccgtactccctttatccttaaagaaaatatgattgaacgtgacatatcttactcagattcaaatacgttttggttttttatgaaacggataaagtactatcgagagccacatgatacatgatacggagtatttcattattccgatttaatgcatgtatatttttaagaaaaaaaatagtactgaaatcataaattttggtggatgctacgagtatgataaacgaaaaacctgtggaaaacattatactccagagatgagttcatgtcaacactgataagtatatatcactccggccctttggttaaaattattcgccaattccgacagtaaaagaaactacgagcaagtcatttgtacgatggaaacgaagagtacttttgaccggaggaagcatttgtgacaaataatcatactgtatatagtcacctcattattctctgccaaacactagcaccataaattacacatatgcccgggtttattttgactaaccaactactcccgtcatcccaatttaatcatacttataaaagatatgaagaccaagaaaaaaaatcatttcttctaaaatttaatctcatagatcaaggtgatgtgttagacatgcatatgagcacacaaacaagcaattggatgcatgcgagacatgcaataatactctcacggttctattttaactacgttttgaacaacattaaataccaataagtacctaaaagcacccacaatggttatttataagctctctacaaaagatccatgtcagcatattttcctacttggaagatattaaatgaagagagagagcaaagctatctactaacttagagatagtctatagagaaaaacgaggcaatgcatgagagagctatagatacccatgtagacatactattgaggggtttactattaatatagtctattgctgagatgtacatgttttatagagagcaccttactttaccattgtgggtgctctaagtctatgtttagttcctctaaaatagtaaaagttttgcagttttggagtactttttgtcaaaatggatctaatcattagtagtaaaagttggcaaatttgacatttatcatttgggagtctagagtagcaaattttgctaaaatagtgcgttggaagccgtgctctttctctctctaaaatggcaaaatcttaccatgcatctaaacacaccaataaataaaacttcaataccaaatcttttgctaccaaaacttttgccaaaaatatttgctacagcaaattgatctaaacatgccctaattgggacacatattcccggctatacccatattaagggcctgtttagggagcttaagattctgagaagcagctggcagcttctgagaatttggaaaagctgggtttttcagcttctggcttctagtttattttctggattctacagtatctcagaatttggaccaaaagctggactatttgggggagcttctgattctgaaagaagctgcagcagttagaagctccccaaacaggccctagatacattcagggacatcacaacccaataattttatctagctcactttgttaaaaccactattttcaaagtattgagttctatgtttgagtcctgtggcactctatttttccaatgactttggtcaaaacgaagcaacagatgcatgcatctttattgtgtttgcatgcaagcagggatacttctgggaagctattagggcagtcccaaccctctacctaggatggtgtctatggcattaactacattgccatgtaggacttttagcttatgtggtactatattaactagctgggtggcccgcgcaattacacggctagcacccaaacaaaatcatatatttttcagtatgattttacttaaaatttattaaatagctatctcgtcgtcttaagactttaaaagactaaatcttatcatcccgtatttctaattatatagtttttaaaagtcacaccagctactaccccttacttctgtcatatacttctttatttgcttgcttgatctaccactatttctattcattctccttgaaatctttaaaaatcagatcttatagtttttataatttctagaagtctcgtcaaacgctgtcattatactcctctacgggccgtcaactgtcttttctctatattgtcattgggattttaattattttaattattccgagttttaattaatcacatattggatttctatatggacttctctttcaatattgcatatttttaattccgaatttcagctattttttattgtgtttatatgtggactcttctttttttttctccgattaacgtgggaatttctagcctccacagcgaacgtggttatgtatttttggcttgctaatttttggcttggttgtgtatttattggcatgacaataatgatataattcggaaacggcagagtttgattaggattattttctttcaatgtttctaaaagtggtgtcaacacgcgtattcccaaaatattgtccgtttccagtgtataatatgattaggtttttcttttcttttcttttgttttgtttttgaccgattgtacatttcgtttccagtagattaggttttcttttttttttaagacagattgtctgattccagtagtatgattagtttttttttttaccgattgtccgattcgtgtttcttaatatgcctttttttttcctttcttcagtttttaactaatcctaatctagttctatttttttcttttttcttattttttggagtaatgtgagaatttttaggccatgagaacgaacgtggaggctcctttttctattactttaaagatataatagatagatagattaagagagagagagagtgaagagaggaagaaactgggtttcatgcaagacacagcttcaacacaagaacctatgcactagacactatcaagttttgcgttaggagagaatagtgtctttataatagatgaagaatatatatgattggtagagaagaaagatgatatatttattaatggcccactttaagtaaccatgggttgtagagtgtagtttctattgtgatgtcttattgacatggcaccatagacactacttatggacaccatgggttgggaccgcccttagcctggaacttggaagctaagacgtcaattttctctatccaaaatctattactccctccgttttttaatagatgacgctgt

SEQ ID NO: 50029 - DNA, 35760 bp, Oryza sativa
aaattataattacgtaaattttttaaataagacgaatggtcaaacatatgagaaaaagtcaacggcgtcatctattaaaaaatagaggtagtatcctctaacatcagttaatagtagagaacaaaactactatttactcatgcacagataaattaacgaacatgtatacaataataccttttatttatgcgcgaataaacaaatacacacatattagacgatcaatttaatttaggaagaccttataaaacttaggagtagtaagctatgccctaccgacttatttttttcaaaaatttgtcgatatgtttgtagtaattttttttgtgcttcctttatttttcacaacgagaagtttaagcccctctagttcattttgtattgtacatcacagtactactactaatgtttagtttattgtgctaagctgtcaaaatgaacttcagtaagagggaggtccacggatcagcgctgtaggcataaaccatgcagggcagcagagaggagtgtcacctcttcttcttcttcttcacctgctataaccaccagctgttgctagctgtttctctccccttgtcatgtgacctccctactcccatctctattatttctctctcccctccctgtccctatcattcccattgcccgatttagcgctcgccgttgttttcgcagcagcggcggcggcggcggtggcggcggcggcgcgcggcaccaacaaacacgcgagctaaaacgagggccgcacaatctccggcacccgcgccgcgctacattaggatacgggcgctcggcgacggggaaggtttcgggcgtcgcgccatcgatcgcgggcgcgcatttgcgttgattccgggccaggctccctccccggccatggcgcagctgccgcccaagatcccaaccatggcgacagcttggccggagttcgggggcgggcaccatcaccatgctgcccacggccaccatcaccagcgcagcccctccatgggggcgttcctcgcggcgccattgccgcccttcccgctcccgccgccggcgccggcgaacggcggggcgcagcagcagcagcagcagcagcagcatcagccgtcctgggtcgacgagttcctcgacttctcggcgaccaagcgcggcgcgcaccgtcgctctgtgagcgactccgtggccttcctcgaccccgtttccgacgacaatgccggcgtcggggcgcacgacttcgaccgcctcgacgacgaccagctcatgtccatgttctccgacgacctgcagccgcctccaccgcagcaacagcctgccgcgcccgcggcgagcgcgtcgtcgccgtcggaccacaacagcatgaatgacgagaagcaagacaagggcgagacagatgaggcgcagagcgagtgcgacggcgccacgcccgggcagccggcctcccccgccaccgtcgatcccaagcgcgtcaagaggtactacaattccggcaatgcacagcttgcgaacgcagaattccccaattttccctcatcgttcttggcgatcccctcaaccgcaggatcttggcgaaccggcagtccgcgcagcggtcgcgcgtgcggaagctgcagtacatctcggagctggagcgcagcgtcacgtcgctccaggtgcgtgccgaattacgcatttcgtgcccgtaatttcgccgagcaccgcatgcgcgcgcgcgccgtgaatttgacctccaaccgtttgctctttttttctttctcccgagcagacggaggtgtcggcgttgtcaccgcgcgtcgcgttcctcgaccaccagcgctcgctgctgacgctgggcaacagccacctcaagcagcgcatcgccgccctcgcgcaggacaagatcttcaaagatggtgaccgccatttgccacctcaattatgctactatatatcgttctcacaatgtcgctgtccgaattcaattcggcgacagcacgcaaccaaaattccacagctaaactaacactcgttctgaattctctcttctctgctctgctcagctcatcaggaggcactgaagaaggagatagagaggctgcggcaaatctaccaccagcaaagcctcaagaacgcggaatcccaaccggcggacgcggccccggtccgcggccgcgacaatgccgacctgatcggcagcgagggggccgccgcggccgcgccatgcccgcactcgtgatcggccgagatccggacgctctctagacctctagcgaggtggcgccggcccgtcgcgacaaccacgagcgttgccgcgggggtgggccggcgccgtgttaggattggtgcattgttaatttgggttttgcattctttggggtgtaatgtaacatgatttgttcattcgggttgcttttgttcattcttgtgcatcctctgctgctgctgctgctgctgctgctgctcctgattcttctctacttccctgatttgtaattttattccggcattttgggcgaaggttgtagctaagaattgtaattcagattgggtgaggtcaagtgttttgtttggctggtttttttttctctttttcttttttgtatctgataaaatcaaatgtaatgttccttcatttttcctgtatgatccactgtatgtatttacagctatccatcagtctctctctctcttccctttaatccttctttcctctcgccaactttcgttattgccaactgttacgaagctcgcatgtaaagttcatctacacgttactgtagtatctaaccatttttttctctctctctcaattggactgtgggtgtgtgatgcatactttacaatcaagcagtacagggtaacaccggcgtcagtcacatgcatgcaattcgcaggtcgacaccaaacatgcaaccaaagcatcacattccttgctgtttcatcgcgagattttaaatggtgaacaaggagaggggtcaccgggagggaggtgccttgcttttgctgcaagggataggcatgttcgtctgcggcatgtgcatgtgcgtgctgcgcccgtatcggccggtacaagttaactctggcaaaaacgggttaggtttagcgtacgtgcctggtgttagtaccactacgactatacattatccttgggcttgggcattcgcatgagtaattataggttggttttggactctggcttcgctggttctcgtcgtcagcttgcccaagagggagaaacattttggagaaaccaccgggtcggattttttacagtttagtttttttttaaaaaaatattttacaaataaaactccaagaaaaacttgtttcagaaatagatctttttcttggcggtaatgatcatgacgtcgaggtccaacgtatttggcgccaacgacactagtgccgacatcctcgtccctctcagcggcggtggcaatgatactaacactgaggatctatttgtaagaaaaaaaattcaaaaaatccagaacctgggtggcgcagatgccccatcaatggatagtctgctcttgtttgtggtgtaaattttggccctagagaaaaaaaatgctgctacatggtagttacatcagtggcggagccagaaattatataatactagggaaattatataatactagggctaaggtagggctcgactaatggaggattagttttctgaaaaaattacatagtgaatcaacaaaatttaagcaagtttttggaggcaggcctagcttgagccctaggcctacctccgcccctgagttacatacgctggatctacctcccggcgaccccggacagctgcccggactcatcggcagataatccactaaaactccatgtaattaggaaaaagaatgaaatataatttctgtagtaaatactagctataatgtagtttgtctgggctctgtaatatttcctgataggctactgtatacaccttttgtactgaactactgaagggctctgaagtagcctggctgctctgtttcaaggctttccaggaaacaacaacccatggcgctgaagaaacactgctgcttgccgacctggaatgggagagcaggaatggtcttcgtcttattcatgttactctcggttgccggggggaggtgggcacatgcggctcgaactggaaacagcgcgcaacgaagtccgaagtcggcgatgcgtttggacatgtaggaatattcggctgtcgtacgcgactacccgttaatgcttactgtttcgataggaatcgagttgtttgatagtatgagatttctgtgaaagtctcacagattttttgcgtgtttcaaaattagttttgtttaagctaaaatgttatcaaaatgccctcaaacatgaatagggggaacattttggaacaccatggagtgcatgtttcgtccgaaaggtaagaaactggcccaagttatgacctaagtctattttacctccttcacgtctggcttctaattacattgcattctttaaccgcaaaactagatataacgcctatcccacgtttaaaaactagtgcaactgactcctctagtggtttggaaaatggtttctgctgatgtgacaggttgactatgggaggctgagaaagcagatgagataataaagaggctgacatgtggccccacttactaaagagtcaatcgcggataacgtgccatgttagcagacactgcttccaaaaccaccaaaagagccgattcacactcgttttttaagatggtggaaacatcatatccggttagacttattctaattccaacggagccatcgtttgagtttagcccccaaacaagctcgtgcacaagaatgcggcccaccttgtcaagcccataattgtctctatggctttgaagtctgacagatgtatgatatagacctttgcaagccaatagacttgttttaagagatcaaagcccatcgattagtggcattgtagcacactgcacagtgcacactatctgatgaagaaaaggaaaacgatttctatcttgcactgaccatctgaacgaactgacatccaagatccaacacatcaagcatcagatcagaacgcagaaaacgcagaaagatcggcgcgtactagcgtacgtactaacagtactagagtacaataggactcttgcacgggccgtacgtgcatgtgccaagacaaacctgaaattctgaatactgtacaattgtactccctgtttgcgtggaaggcaaagacaaaaaccaggacgtgggatcggctgatctggattactattgaaaaaaaatccaaaaaataccattgataaacgtcccaatcaaaaaataacatcaacgaacacaatttcttacaaatgtcgtcatacaaatgtcttatacaaatgtctttgttccagaaatactatctatgttaggtttccatttgcatccttccgttaagtggtataaaagatcattttacccctacgaattgttaaaagttgattaaaatttttgctcttttcgttcgcttacagtatatttgtagtttgctttttacactaaattattttaagttgactgaaagagtaaaagttttattcatcttttaactattcttaggggtaaaatgcctttttatatcatttaacggagggctactaacggaaacctaacgatgacatttctgaaacaaaggcacttgtacgatgacatttcctgaacaccaatgatattttttcaattggaatgcttgttgatgcaattcttagattttctcattactatttcgtgagcaatttctgtttactgctagctggaaaagttttttatccaaggtcacaaattaatacagacggtatacactccacagtactactacctccgtctctaaaacactatatttctaactatacacacggtaacttaattcggttgcccacacggcccgagagttataccctacgtgcaccgtcgatcttgtccttaatggcacatggccacatccatttgtcgtataactcaattctgtcacaaaaaaggccttttctagtatttaaattttatcttaaaaatacaatacaactactttttcatctactatctcatttcaaacgattacaatcatatctcatttaatttctgtacatagtactatgcatccctatttgacttcacttatctctttgatgtacatgacaaatttgagatgtgcttatattttaagacggagaagtaactttgtttttttaaaggaaacctaaccaccagaatagatgccaattatatttcactaaacaaaataaaaatccgaatgagttacataaaaaaaggacatcatctaaacaaaagccccaccaagcttctcaacaaacaaacaccactacgccactacggccggctgccactacactaggccctatttagtcgcgaaaagaaaatttttgggtgtcacatcgatgaccatatgtcggaaggggttttcggacgcgaatgaaaaaactaatttcataactcgcctggaaaccgcgagacgaatttattaagcctaattaattcgtcattagcacatatgggttactgtagcacttatggctaatcatggactaattaggctcaaaagattcgtctcgcgattttcatgcaaattgtgcaattagtttttatttttatatatatttaatgctctatgcatatgtccaaagattcgatgtgatgtttttgggaaaaactttttgggaactaaacaataaacaattggcctaaaggttcctcaaaatagcagccccacagggggacacgccatgaatcgaccatgcatagtcacattgctgctcaaatcctgccacttatctgcctaatctggtattgtggcctgccgtcaccgtcctagttggccgcttgggcttccggcgactagctcaagtggtagtaaagcggggaggagggagacatcagctgctagggtttggttgtctcctttgagtgacgcaagggaggggcaaggtctagtttgtaactttgttgtatcgtaggaaagaaaggaaagttgtttactttctttatacttgttggtaacccatacgtgggtgcacggcttgttactgatatttgaaaatactaaaggagattatcatgatttaataaatatgtacttggttaggaatgttagttgtagttttttcatgtttaataagtgaaatttggaattaataaaaactaacttatatttatatttagtttgaactctcaattctcacaaacatgcataggttttaatgtggtctacaatgttaaatgcgtaatcagggtaatgattaaatgatgcatagataggtgtgacttataaattgcagacaaattaccagcaaatgcactaaattaaagaggaggaacgagatcctctaccacaactccctattcagaaaaactagctggttagcccgcacaattgcgcggctagcacccaaacaaaatcatatattcttttaatatgattttacttaaaatttattaaatagctatctcattgccttcaaactttgaaagaccaaatcttatcatcctcgtgtttctaattatatagtttttaaaagtcacaccagttgctactccttatgtcatctccttttttatttgcttactcgatctattactatttctattcattcttcttggaaccttttaaaattggattttatagtttttagagtttattgtcacattgggtttcgtttttataatttctagatgtcccgtcgaacattgacattatactcctctacggcctgtcactgtctcttctatttattgtcattgagattttaaaaatcaaagataattatcatttgggttcatttttactttctaaaagtcctgccaaaccatcagcagctttgccattgtactcctctacggctcgcccactgcctcccttctttattgtcattgagattttaaaatcgaacatgattatcattgtttttttttactttttaaaacttctgaacctttaaaaataggacttgtagttttattttttataatttttagaagtcccatcaaacgatgccactatgcccctctacagcccgtctgctgcctactctttattgtcactgtgattctaaaaatcgaacataactatcgttggaattcattttttttttattttctagaagtcccatcaatcgtcggcggctctgcaactatactcttatacaccccgtccgctgcttctcctttttattgtcactgagattttaaaaatcgaatatgattatcaatgtgtttttttttactttctagaagtcccggcaaccgccttacttgtttgctttacggcatgtctgacgtccctccttttaattgtcatcaggattctatttggtttttttattaacaatttttatatatcgtatcaaccgccaccactttagtcctttataggcctgttacttaattttatctcatcatgtgttttagatggtattttctttcaatagtctttatttttatcacaaatttaattatttacaaattgtattcctaattgaaatcttatttttccttttctaatttcacaattttttttataaaaaaattagttaataccgtattgtgttcttttaatgtttttattttttttattttcaatttcaattgtttcaaaattgtatttctacttgaactctcttttaatttttctaattttggttattattttatttttatttgaaattttaattaatcttgtattgggttcttatatggattcttcttttaatattacttatttttaattctgaatttcagctaattttcaattgtattcctacttgaactcttcttttattttcttttttctaatttcggatttttttttatttttattctgaattttaattaatctcgtattgggttcttatatggattcttcttttaatatttcttatttttaattccgaatttcagctatttttaaattgtattcctacttagactctcctttcctttttctaattttagattttattttatttttatttcgaattttgattaaactcctattgggttgttatatggaaacttctttcaatgttacttatttttaatttcgaatttcagctatttttaaatcgtatttctacttgtactcttctttttctccgattaatgtgggaatttctagcccccacagcgaacgtggtgcctcctttcaaagctgttttagtaatataactagttagatggcccgcgcaattgcgcggctagcacatatacaaaattatctatttttaatgtgattatacttaaaatttatcaaatacctatccctttgtcttagggctttgaaagaccgaaccttatcatttgtgggtttctaattttataaaatttttaaaagtcacaccagtccactacctcatagtccttttgtcaccctttatttatttactcgatcttccatgacttctattcattcttcttgaaacctttaaaaattggatcgtatatttttagagagtttattctcattgaattttatttttttataattttagaagtgccgtcaaacattaccactgtactcctctacggcccgcccgctgcctcccctctttattgtcagtgggatattaaaagtctaacatatttatcattggggttttatttcttactttcaagaagtcctgtcaactgtttgcggctttgctatactacttctctatagcccgctcgctacttcgcttcttgtttttattgaaattttaaaaatcgtgcataattgttattggggtttattttttttactcttcagagtggcttctccgtatctctcttattagtcatcatttatattttatttggggttttgtttatagttttatatgctcggttgccaccagcctactcctttactggcatggtacttctctctttattgtcatttgtcatcattgtgttatagatggacttttttttttgaaaattccgtatttttcattccgatgttttgttatttataaattatattcctaagttaaactctcataattattgtttttattttctaaatttattttattttttattctgaaatttttgttatttataaattatattcctagttaaactctcataattattgtttttattttcgaaatttattttattttttattctgaattttagttatttataaattatattcctacttgaagtattaattttcttttttttttctaatatcacaatttttttttattttgaatattagttaatgtcgtatagacagtacagtaagttgcaaagctccaaatttgatttcttttttcagtccaaatccatgttagtatcatagtatggaagcctatgtccgattggttttttttaaatctagaatccttatcgtattcaactggagttctattgatttatcaaccatactatcaatacatattaactcgatcgttacagtttagatctagtatgatctaatggttaatattttttcttcattaacatggtaatttttaaccttcggagcaaatgtgttggattttttttaagatgccttaatgatataacagatactctctccgaaaaaaaactaatcctggttttaaacctggacatatgggtttttgctggacgaagggagtagatagagagatttttagtggatggattttgatctagttacgcagcttaggacagtcagattgagcgtcaacgacttatgcttggccgataggcacaatgagcacacttatatctggtaaactgagatccaattttttatggtggtacactgtattgaggacaggctacttggatccagctcattcacgtcttgtatttctcatcttttagtaaaggacgcatactgtatccggtgaattgatctctaattttttaagttccttcagcattgcagagcatctagatgtaacctttttcaagaatgcatgttcttttgctggagattctgtacttatgtgattgcttttgttattggttggtatttattgggacttgattgaaagccatagttggaatcggacaccaatttatacctggacatatttattttgcttagaaggtgacatgacatactttacctcaggtacacgtatttgttccaattctaaataaagaacgcaaaatcaaaacttatatgcatattccctataagtctacatatcccgttagatttaatatacaactctaaaattttatttctataagaaccattaagtatattttgatttatatacaattcttagtttctatttttataagatccagattttatatacaactcccaacttctatttttatagatataattgtatttcatatacaactgtataaatcaatatataccgttataatccggacccaccatgatcaaacggttaagattttttttctttttctctttttttctccgattaatgtgggaatttctagcctccacaacgaacgttgtgccttcttttaaggctgttttaataatataatagatagattggcggctcgtcgattcgttttttttttataaaaaattttcctctaccacagcaactgctaagtcggcagaggtaaacagcgacgggttacattgaattgctacaatgagacgccatgcaatttccttgccacagtaatgcctctacaatgagctatagactatacagtgcctgcgtgtaatgctgcagacgatcccagtagtcctctaatccatcttggctacgggcaattatattcacgacggctttcttatctaacactgactggcgaacgaacaatgtgcgcacaacgtttggatcggcatgatgaacagaatattcacgcgtcacgcatggatgcatgcaaacaatgaaacaatcctcaccaagggaccccgacccatctgctgcgcctgggcacatctcacgtgcggagctgcagtctcctcacgggtactgtcagtgatcggccatcacgcagaccccggatctcacgcacgttaagttcatgatgcaaattgcacaaattggtactaaaacttctagctaaaccacggcggtttaggtgttaattatgtgtgctgctaactaattatcaataagctgactgcataactggacggaaagcccagtgaacaaacaacaaagctctgaatcgccatatgtggcgccatgtcatgttgtggtcacatgatcggggacaaaatgtgtctagaattggcatctagtagctgctgcctgaaatgatgaatcactatccgagcaagtcgattatgactgcgcgcgtggtttgcatgggtaaaattagcagggccatatgatgtttcaccttttaattacggatttgctaaatattatccgatatgaagttgagataaatataggacatgcggctagtagggcggaaagaagcgggtttgctgtgaatatcagatgggtgagttgatattggactattgaatattgatccgatggataaaaaattgactgagatgggaatgtgttttcttgctattggtgcacatgcagtccctttttatttattcaacatacatattgattacttttaaactgttaataatacagatataaaaaaaattagcagcagcaatttgattggttgtttactttcttcattcattttactacagcttatcgactaccatggtcattgctttattttaatttttcagaaacgtttcgtgttcaaatgaaactagcaacgtataatagtatagtaccagttggcaagtactgtaccaagtagctatagtaactactattagcgagatgcacaattttctggcagctgacagctaaaccaaagcacaatggagttcaagggaaagctacctgcgtcagcgattgcgtttgtatgcatactcctacgtccaaacacgcaacataacctgcaaaaacaagcatgagagtcggtacacctcccacgttttagcatgttctgaatgcagcttaccctagtaggtttcaacatatatacttcctccgtttgatattataagtcgttttaatttttttaacttattttttaaaagtttaatcaagtttataaacatttccaatcaaaccaacatattattagaatatattcaatgttagatttaattaaactaacttgatattttggatgctgttaaattttcttataagtttaatcaaattaaaaaggtgatactatgaaaaaaaatcaaagtgacttattataatatgaaacgggggagtaaataaaaccggcactaggaacaaattaactaggcatgacagaaaatccaagcaaggaaggaatagttcggtagtagtagtacgctagtttgctcggtcgcgaaaataaattacgcgtagatcgttgaggaggaaaggaatggcgaatcgacgacaagggagaattgggcaagtcaacttctgcatggaatgtgccaatctggcttggctttgccgtgcaagatcccgctcgtgttagggggtgtttgggagagaggggctaaactctctctcaaacatcccctctctcaaaagcataagtcatagcctctctcttctaaacacccctttaattattttttcgggtgtctggaccaatcggcgaacaggcgcttctccgattgggcatttgccgcattggagagcgctcgaccttgagcagagcagagcagcactgtgcctcggtggctcggtacgttggtgcgtgtgatcggtaagccgcgcgtgcagagtgcagacaggcgtggccgcgtggcgtcgccgacggccggtgtttcttttcccagccgccccggcactgacgccaagccgaagccggggccggccggcgcgccccaggtttccgctgcgtcacttcatcagtagttcagaactgtattagttaaccaggtttatttatggccgggagttgctgcgagatggaatcccaaacagatccggatcagtgcaaggcaataatcaatctacctcaattgtcttttgcagtcgcattcatagattagaaaatgcggcgtattcgctgtagaactctgacatcacctgtggctgaggatataacacgacattacgcgcgaatataatcaatgatgatatctatagctagtaaatcattatgcctaaacaataactatcaccaaatctgcaattttattcttgcattatctgaaaagttaatccgacgttgcattatctagtattaggtctccaatctcgtggaaatcttgatccgtgtcttctcattttcgtaattattttgtattgtttttctttctttgaagcattcaacaatatgattgaaccatgtcatggggatctggaggattgaacacgcaatgatattctactcctggattttctttgtgattttagaattccactttagaaacaactggaaaagaagccctaacttgttgatctgtccaattccaccacagtcttctcaaaggctcgtgacaacaaggagtacttcgttatggtcaaatctttattagttttctgttcctttgttgttgcttgttagggacagtgaggcgctccattaatttggttatgcttccattcgtgcaaaggtgctttgagaagatttaagtggcacccacttagcagggtaatgaaaattcacatcgaagattaaacttaagagtttcgatataaatttcataatattccgacatagtaatagtcacttcaaaacctacccctatcccaaaacataagtttttttaatcgctactgaacacacccaagatactaattgtaacgtcccgcctctcccaagccgggcccgcttacatctgacagctttcataggccacagactaccctcacaaagcaacacaagtgtcgttgctgcttgcagccattccgaaccagcgacagtaatcgctactgaatacacccaagataagatactaatagtaacgtcccgcctctcccaggccgggcccgcttgcaaccattccgaacctccgaaccagcgatagtaatcgctactgaacacacccaagatactccctccgtttcgaaatgtttgacaccggtgaatttttagcacatgtttgaccattcgtcttattcaaaaacttttgtgaaatatgttaaattatatgcctacgtaaaaatatatttatcaatgaatcaaatgataggaaaagaattaataattacttaaattttttgaataagacgaacggtcaaacatgtactaaaaagtcaacggcgtcaaacatttcgaaacagagggagtactaaattttaacgtcccgcctctcctaggccgggcctgctcagaacctctgaaccagcgacagtaatcgctactgaacacacccaagatactaaattgtaacgtcccgactctcccaggcctaaccagcgacagtaatcgcaaaccaacacaagtcttttctgcacactttgtcctcacttgtgcgcactcgggaacaatgtcaccggtcgggaaattgttcccaaattgtaacgtcccgactctcccaagcctgaccagcgacagtaatcgcaaaccaacacaagtcttttctgcacactttgtcctcactcatgcgcactcgggaaattgttcccgagtgccaggccttccgaaaattgtaacgtcccgactctcccagacccgaccagcgacagtaatcgcaaaccaacacaagtcttttctgcacactttgtcctcactcgtgcgcactcgggaacaatgtcaccgatcgggaaattgttcccaaattgtaacgtcccgactctcccaggcctgaccagcgacagtaatcgcaaaccaacacaagtcttttctgcacactttgtcctcactcgtgcgcactcgggaaattgttcccgagtgccaggccttccgaaccagcgacagtaatcgctactgaacacacccaagtcttttctgcacactttgtcctcactcgtgtgcactcgggaaatccaggccttacgaaccaacgacagtaatcgctactgaacacacccaagtcttttctgcacactttgtcctcactcgtgcgcactcgggaaatccaggccttacgaaccagcgacagtaatcgctactgaacacatccaagtcttttctacacactttgtcctcacttgtgcgcactcgggaacaatttcccgatcggtcacctatcccgaaattactccacgccgcactcgggaacaatttcccgatcggtcacctatgcacgcttaacctcagagttctttctagatcagcttccggaaaaaaagttgcaacttattgatatgagtattctattaatactattaagccttagtccggcatgtcacattaatactctatacagtaatattatttgtgcccaatgaataaagattaaagagtgagcaccacgtgagccacgcgaaacggcccaaaccagcggctcacacacaccttatccatgcaccgttttccgatgtgatgtacctttaaccgagaaagcacgacctcatcagaaatcctaatcagttaaaaataaagctgaaatttaaattttcaaacttaattttaagattaattttaagataattttgatgtagtttctttttagtattagctttgaagtcataaaaatacatatataaaatttttacctataaattcatttttatatgagcaaacgatggcactctacactgtataccattgtttcatatcagcacttcacaaaacttcgtggtactctccccgtccaacagtatatgcccatttttagaaattaagaaattaacgaaaggacaagtcatgcaaaaaaaaaagaaaaacaaactactagtaagaaagttggtatgagaaaaataaactaataaacgttggtaggtgagacaaaataatactataaaagtcaataagtatggaataaagtactgtatcagaattttaaaatatcttatattttaagataaattaaaaagtaaaatcccttatattaagagagagtatatacatatttctttttctccttcaaggaaggaaaataacacatcattgaacgacagaatgagtaaccaaaaccatttttgaaggcactcctggtaaaacataggacaaaaaattgtaatactagtatagtacaaagagcatgaacggatatgaacaaaaaagtttcagaactggttgtccctttcttctgacctgactttgccacaatccggcgaagccgccatcagaagttagtagaacattcgacaagttacgactagtttcactttgatccgtataagaactcaaggggatttcaactccatccgttatggtcaatcaagaacatcttctagatcgaagtcaatagtccaacagaggcatctctgtcggaagaccccagatcaaagtttgccatctggccaactaatcctccagcgacggttaactgttatccctgctccaccatgtctgaccaaactttattctcccttcctctactctatatcgagattcatttagaatgtttctcattttagtataatgttgatttattttagaacggagagagtactctctctcgagattcatttagaatgtttctcattttagtataatgttggtttattttagaacggagagagtactctctccaaaagtgcaggagcagcacgtaacgtacccataccattctagtcgtgtattgatgattgattgcttgcttgctgtgagtatttttgtcacgaggatcaggtgaaacaattaaaaacacaacggccaaaaagacaatggccaccatgtgttatacacagtacacattcgcacttgcaaatcatggaacatgattagttacaggacgatccagtagttatagtactacggagtagtatcaacaatcaagcaagtagtttgtgaattgtgaccatcaaacagattcgtgtagtacaggttgaaatgaactgctcgccggcgtcgcagcggagtagtgcgggtcgtcgctactcacgagcgtgtgccacttccccgtcgttgtcgccacctacttctacctgcgcggattcccgtcccgaagtgacaatttccccgtgaaatccccccctatccacaagggtaaggcccgtgcagccgccgccaccgcctcctcgcacctcgtttcttccaccaccctcgcgcggcggcggccgtctgccgtctgccaatccgcccgcccagaaaagccgcctcgttccgttgtctcagcgcgtttgaccagcgatctactatccccccttccccctcctcctcccacgcctcacacactgacacacatatgggcataaatatgcctccgttgggagagatgccaacacgacacaccagctagtagtgtgcgggtttgggagaggtgcgtgtgcgccctgagctgctgctgccgcccggccgccacccgtgacccgcgccatggcggcggtggtggacttcctggacctgcgggcggcggcgccgttcgtggtggccgcgctggcgttctacttcctggtcgagcagctgtcctaccaccgcaagaagggcccgctgcctggcccgccgctcgtcgtgccgttcgtcggcagcgtcgcgcatatgatccgcgacccgaccgggttctgggacgcgcaggcggcgcgcgccaggaagtccggcgcggggctcgccgccgacttcctgatcggccggttcgtcgttttcatccgcgactccgagctgtcccaccgggtcttcgccaacgttcgccccgacgcgttccacctcatcggccacccgttcggcaagaagctcttcggcgaccacaacctcatctacatgttcggcgaggaccacaaggacctccgccgccggatcgcgcccaacttcacgccgcgcgcgctctccacctacgccgccatccagcagcgcgtcatcctctcccacctccggcggtggctcgaccggagcgccgccaacggcggcaaggccgagccgattcgggtgccctgccgcgacatgaatctcgagacctcgcagacggtgttcgcggggccgtacctcaccaaggaggcgagggagaagttcgagagggactacaatttcttcaatgtcggcctcatggccctccccgttgacctgccggggttcgcattccggagcgcgaggctgggcgtggcgcggctggtgcgcacgctcggcgagtgcgcgcgggcgagcaaggcgcggatgcgcgccggcggcgaaccagagtgcctcgtcgacttctggatgcaggagacggtgcgggagatcgacgaggccaaggcagcggggaagccgcctccggcgcacaccgacgacgaggagctcgggggcttcctgttcgacttcctcttcgcggcgcaggacgcgtccacctcctccctctgctgggccgtgtccgcgctggactcccacccggacgtgctcgcaggcgtgcgcgccgaggtggcctccctctggtccccggagtccggcgagcccatcaccgccgagaagatcgcggagatgaagtacactcaggccgtagctcgcgaggtggtccggcaccggccaccggcgacgctggtgccgcacatcgccggcgaggagttccagctgacggagtggtacacgatccccaagggcaccatcgtgttcccgtcggtgtacgagtcgtcgttccaggggttccccgagccggacacgttcgacccggagcgcttcttctcggaggcacggagggaggacgtggtgtacaagcgcaacttcctcgcgttcggcgccgggccgcaccagtgcgtcgggcagcggtacgcgctcaaccacctcgtcctattcatggcgctcttcgtctccgtcgtggacttccggcgagaccggacggagggctgcgacgagccggtgtacatgccgaccatcgtgccgagggacagctgcaccgtgtacctcaagcagcgatgcgccaagttcccatctttctgagctggtttcccttgtcctcttgctctgctcctcttcccgtgcatcgcataatttttcttcttctccatttttcttttcaatctggtggatcgtgtcgcagctgtgatgcattgttgatttgtaggttttgatgtttggtccattcaattatttttgttggtaattgggttcagttggggtttggactcagctttgggtcccagccggctaggggatgatacgaacactacatctggggttgttggccacatgtgtgggtcttctggtttggttggttggcatgtctcaggaaattggtggtatttggaatggatttgctcgattgttttggcaactaaaatgtgagcagttgcacgctacttctgttcatttatgaatgtaaggcgctcgatttggattgagtgagcgttggctcgtgccagcgcagctgccaatgcgtatattcaccttctttttgtttctacgaaaaccgtcggcgaggcctctttttttttttttccagttattacatagtttatgcctaaatttagtttttattggactaagtccaaattcaaatatagatgttggttttcatgagacgaagagagtagctactactacactttgcctactagtagctagttaacggaagaagaagaggagagatttttctcctttagaaaggaagcttttttcttttcatttgagtaaaattccttttattcttctatttctatccggttagtattcatcatttccgcacaactgtttcataacaggacaacagactcatgcatactgtctggctttgaaagcgatagcctatccaaaatacgatggaaggagtactattgatggtagtataattaaattctaaccatagattttcttgggtatttaaatactttatgtaaaactttgctagggtaattttatgttaatataacataaaaatctaaaaagattgtagcaatattgccttttatttcaattttagcccttcaaaacttatactacctatattggtaggtttaatataatagaatcactttcattggataaaaacagggattgggaaccaacaaatatagatggccaaatgggccgtccggcatggcacggcccgacctacggcccaatacgactcgggtccgcctgaaggcacgatagtccatcgtgcttctccacagaataagtctatttttcatccctcaactctgtgggttgtgtccatatggttggaaaataagtctattttgtgttcctcttctcattaggccttgccttatatggttatttaagtctattttgcatccctatactatttttcttcaatcgtgccatgccgggccggcccaccgtaccgagggtgcagccctgtcacgacctggccgtcgggctgaggcggcacgggcacgaccctagtcgggccgtgccgtgcttgcgccggccgggccgcggacctcgggtgccaacagagtttataacccccctcccccccccaaacaacgcctcccccctcgcaagtaaaataaggttgtgtttcggaggagggattgggaacccttcttcctggcacgtaaagcagagttgaattaacatatgattaattaagtattagttaaaaaaacttgttcaatatgatattttaaagcaattttattgtagattatttttagaaagacacacatgttagcaatttaggaaacgtgcgcgtgaaaaacgagaggatagaagttacgaacaaactaaggtgtgcttgatatggtgttaagcatctatttgtactagatgatgccccgcgctttgctgcgggatatatgttagataatagagaaatgatgaaatgatttagattgaaatgttatgaaatgatttaacaatgatgatttagcatgtgcatgtttagttttagaatgaaataaattgtggatataattactatatggttgcatgttgagctttgtgtgtttaatgggttgatgtggtatgtttgcatgtaggttttaggatgctaataaatattatgcttatatgttgacctttatgtgtttagtgcgcattaactttatagaaagaagatattactagatgatatgtctgtgcgtttccatgggatcgaaaaaaaaatctttattgtctattatatacctacaattgtcttattactaagctattttttgccattagttttgatgcctgctgagctagcaagaggcacatattatccgcatcattaaggccctgtttctttcagcttgtgattattataatccagattattgggagtaagctgaaagaaacagataacttattgaagtagcttattataatctggaggccagcttattataatctgataagctcatttaggtgagctttttccagattattggatgaaaaattacccaccatgccacccactccctttttagacttgcaaatctaggaaagaaagaactaaccacttattatactacatattataacaatctagcttatagtaatctgacttaaataatctagattataataatctcaagctgaaaaaaacatggcctaagctagcccacacaaccgatgttgattttccatctgattaaccatctccttttgtgttgtatttttatataatagaatagaaaaccatcccgcctttgctcaagcgagctacaaccaattattacaccaaatcactcagaatgagtgcaactcaaagaaacttaaaaatcaaaattcttccaaacatgaagcgaacacaaactcataaacgccaacacaagataaacaatatacaattaatgaataccatttgtgaatctccatccaaaattgacaaaaaaactgcataactgtcgtctcaagattatgatatgcagacttcacaagcttgtagttttcatcacacttttgtagttgtgcccaggaccggaaccaatatattgctgaaaagaacctgcatatagaaaatatatggtgatttatcaaaaacaatatcatttctatttaaccatagagccctatatatagcagatgctcctataaaaataagtttgctgattttttctatcaatccccacaagctaattttgaaagatatgagatataataagtggaaggtataaaccagaagaaaactgaatagctctctaaagaaattttgtaaagtggcacttcttaaaaagacgttgaatagtctcaatttttctatctcctccattctcaatcgccgtcagcaccagcagctgacctcctcaagcaccgccagcctcttgcccttcttcagtcttggtccagctctctcctctagcacgatatacccatgtccccttcctcgtcctagttggcaagcagaaaccatgcaacgtgaacctccgacgcacgaagcgacctcaccaccttggcacaagtggggtttggaggttggtgcaatgcggcggcagttcgtgcttggagaatgtcgctggtgaggggcttggcttcttgttggaccggaggaggcgaatagctggggcattgtcggccgtgggccgtgccagcccgtgtgatgactgaagaaggcgctggcgaggggattggctacgtattggtgtcacgtatccgaggaggatttggatcgtctgccttcaccctgtgaaggcacggtcgtgcagtcatcgcttattcaccgtccatacaattcaacggctcacgtgtcacgcgcacttaactgctgttgcaatcagtccatggcagcccgacaagacacactgatgagttaatccgatgaggcccctcgtcgctgctgccaccgccgccgccgtcgatgccaacgatggcagtgactagctagctcggagctcgtctgcttgtacgcacacgccgtcaccagccatcgtttgggcccaactttttttttgttcctcatttttcggggccaaagtaccaaatttgctaagtttatttctttgttcaactgttgatggtactgaagacatattttagctatggagattgtagtttctagtgcgttgcttttgttcttgttaatcctttttgatttacgatctctattctctatctcttttgatttacgatgtggcttactctctattgtagttagtaatgaatgatgttgtttgaaacttatgaattgtctgatggaatgcatactttacttgctaaatagttgaatcgaatgcatgctttgctctgctctgctcattgtaataatgttccaaaatccaaattccgggcagcaagcatgctgcatcactgccgattgatacatccagtcctagcaggaagatggaatggcaaagcttccatatgaagcccaagacggcggcggtggcagcgcgtggcgaaagacgagctccagctattcgccggcggcagcgatggcggcactacaagtctaccaaactgactctgaagtctggagaacgtgcctcttgttgagctgacataggtctctatgcccgggagccgttggattgcatggacggtggataagtgatgactgcacgcccgtgcctccacaggatgaagtcagacgatccaaatccattcgaggaagatggttttggcgtgcaaagagcgaaatcgctaaaaagcaatcagtcgcgcggctcccctcctgcgcggcgcggccacgtggcacgcgcggagagggggccgcggtggaacggcgcgggagcgccatgtgcgcacgtttctcttttttttctttttttttctttcggtttttctttttgttttttctggtttttttttctctgatttggcgtttctcttttttctttcggtttttctttttgattttggctggtttttttctggtttatttcagttttaaactcatacatatataaattttgtattcgtatgtatataaagtttatatacgtacaactttgtatacgtacaaatacaaagtttgtatacgtggcttttttttgtttttttcttggttttcagtttttaaaatatgtatgtatttacgtatataaagtttgtatacgcgtatacaaagtttgtatatgtggttttttttgtttgttcttcgttttcggtttttaaatatgtatgtatttatgtatacaaagtttttatacgcatatataaagtttgtatacaacagtgtagtagtagtactagtagtatagtagtagtaacagtgtagtagtactatcagtagtagtatatgagtagaagtagtaggtgtactaatacgagtatacatcggactgaccgtgcgggcggccgtccgttagtagtcccctgcaaagagggctaagagcatctccagtagagacctcaaatccaacctctaatcaaattttgagagttaagataaaaaaaaaactagatccagcaggaaccctactactagagccctaaagtgaggaggccctcaaatcctccccccaaggccccagtcctggggactccgagcacagcccccatcgtccttttttttggcgcggaacaattttgcttcgcgcgttttattgttactcccgcgcggctgcgacgagggatcttctccagcgaccaccgacgaactcccagcacctccgccaaaactgccccaaaaggtaagacttttccataactttgttgcctgtcgtccacaatgccgtcggcggctgtccatgcgcatgcccggtcgccgacctcccgccatccgccggccgtcgcgtgctctccgagaccacccgcgcgcacgtcgcccacctgcacggcgtctgcccccatgctggcctctgcccgctcgtatttccagttttcactggccggagcctgtacgccgccgctgccccattgatttttctggaaaaaaaacttgaagtaggtcatgtggtgcggtggttgagtagtacagtagcagtcaattttctgaataactcgttcttgactacaattggacatgcatgtggtgctagatggttctcgtctggtggagactgatttgtttttaatttttttttgagaattgcagtggactgtcagccaggagaatctaattttatcaactagtagatatcactgtacttatagtagcactgcattgtgtagcactgtacaattgttgcaatggatcgattagaaccatatacatatatgtaacgctccgcttttcgtgaggcgttaaaaaactaattcggtaaaatcctaatttcgaaaattttcgttctttgtgtgcgagtctaagtcgtgccaagatctcatttcaaatcccgttgatccctctcatcgaaatcaaaatcctccacctcaaatttctcttccgattcgagtctctgaaatcaagttctgaaattcaaatccttcctctaaatcctcgccaaatacttctacgaatccagaactattcagatcccgcctcgaatcctttccttgactccaccctatgttcccgaaaacaaatacccaagtattccttttgaatcctttccatgacttctccttgaatcccccttgatacatccctaaaccctcgagttcgaatatcaaatttgaatttgagtccaaaccctaaaatctctccaattctatccaaatcagttttctctgtaaaagtctactttacctccctgtatttttggatggaccgatttccctcccccggctcatctcccctcccagcccatcatcttaccccccctcgcacgtgcgttgcacgcatgcgagccgagagagagctctctcgctctctcgattctttctctctcccgtcttcgctctctctctgctctatcccctcccggcgccgattcccgccgtcgccgcccaaaacccgccaccgccttcgctctttcccgcgctcgcccgcgcgtggcagaccgcccggtcgccgccgcatcagccctggccgcctgcgccgcacagccgcccatgccgccctgccgctcgcccccaccctgtgcgcgcgtgcgtccaagacgtggaggcagcgcgtctctctgcctcacgcgctctcctctccctctcccacctcctttttcccaaaccggcatggtaaagccccccctttccaccgtcctcccttctctttttccctcccaagcaacgacgccatgcctccactccttggccgctagcgctcggaggcagagacgcagacgccagcgccggctcgccacccccaccttgaccgcgccagcccgcgctaatcctcccgctcccgcggttcgattttccgacgctcgatccaccgccttcgccgcccaacgcatccacaccgtcgccgccttcgcactgcccacgaaaccgccgctgccgcccgtgaacaccagcagagctccctgttcccccacctttttccttttgcccgacaccgccggcgtcatcacctgtcgccgccttggctgcacgcgtcgatgaccgccagctcgctctccttgaccgccaatgtcggttccccctcccaaaccgcctcttttccatctataaagcccgggccgagcctccctatcttattctctctcggcatctctcttccaccgccatcgtgcctttgttgccgccttgcagctgccgacctcgcctcccttcgctgtcgcgcgtgctggtgaagccggcgtgtgcgcgaggagccgaagaggactccggccacccttcttcttccccttccccggcccaaggccggagagctcgccccgcgccgtcgactgcccatcactgcccgcccggctcggtagtgcctcctcccgttccccttcctcgctctccctcgtccccgctagcttgcgtggtagctcggtagccctgccgaacgcgcgtagacgccgccccaaggaccgccgccacccggcgtggccccaccgccattgccgcccacccccggaggccgcctctcgtcgccggacctccacggcgccgctcagacccatccgaccccggaaatgagttccttgaacaccggagatgcttccgccgcctttaattgagtcctcgtcgcccctcagtgatttcccctttctctcgccgccggccgccactgtcgaattccaccgccgtcgaactccctccggcgaatccgagccgttggctcgctccttctcgacgccctcgtcactccggtgtgctccccgaagaccaaatccgtcgcgcttgctccggtgaacacggccgccgtccgccgtccatctcggcctccccttcttcctcctcccgccggcccgcgtggctgccacgtaggcgccacgtcggcgccacctcggctttgaccgggccaagccggtcagccgtcccctccctccgtcttccctcccgtgcgcgcagtccacggaaagccgtgcggctgcatgtgggcccgccgccatccgtccaaccggtgcaccgctcctaagccatgcgcacccgaaacccgtgcgccgcacctcgcgtgcgcccatcccaccgtgggccgtgccaccgacaagcgggccccacccgggaccccgcgcggtggaatcggtccaccgggccgtctctctctcccccgcgccccctctgttgggccgcctcctcgcgcccgcgcccggcccaatggctcggccgcgccgtgcttatcccttgggccatacccgagcctcccaaagaagtctaaattacatccctccacccttttctttttcagggatttaataaatccttttttttttccttcctttgtcccataaatcaattccttattcccaaaattccacaaaccatttcctttggtcccgcgtgacagtgactatcaataatatttttgagaatattatttctataaattccataaaccatttctcctattccagaaactccaattaaacttccaaaattcatatcacccaattcgcaactccgattgactccgttcaacttccaatattcccataaaattgagatctatttaatggcactactaattagtctaaataggatctttcttttggtcttttgtttaggttttcagttgtttgcgtatagttgcggttatcggattttcgtcgatcgcgtgttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcgtgccaaaccgacggacctacccagtagtcgcactaatttccgtaggttgtactaccctgtttccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacaccggggcggggtcggttggagccaaaccgggttcctggtaatgcaagaacgagaagcttgctgaattaccgatcgaggtggttggagtttgatttgtgaacgcctaaaatggcctatgattatgtgaggatttgatccttctatgtggcatgaggtatccctgggtcggcttgggaaaggctttgtcgcgaacctctgacaccggccagtgtctggagtaagttcgtgtcttgtgggtaaagtgtacccctctacagaggttaactaactgttcgaacaaccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgtgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattaccaattgagttgttgaaaagcatctcttaaagtcgaattgagatgcaagtctctcttcggcccaaacttagaaagaaataaatcacttagtgatttcaaaatgccttcaaataaaagatttgtaaaacaaccttgcctctcctccaagcttgcatcaaacacctaagttcccgtgacttgctgagtacgaaagtactcacccttgctctatataaatatatatatatagttcctccgccctgaagagaagataaagtgaagagaagattagggtttcgtcctggttcccagccgtcgcctgtggtgttgggtgttagttcgttggttccgctgctgctgctgttgttggtgtttcctcatccgtgtcgtcggttgcattctcgggttgttctgagctgcaacctaagttaaggtaaataagtcctctatttattttaaggattgctatgattcatatttgtcaccgtgggaactagcactatgtcctgggactggtaccgagatcgcggtttcgtaggaaacggttcacgccgttttccctacgacacgctcctgtcaggtgccgttgtacggcggtatcagattggggtgtgacaatatatatgcaggagtatgtggtattgtactagtacgatatcactgcttttcatagattgagtgttgcatagtgtatatgggtatactctgttggatacgtgtgcatatgctctaaattttcttattaattttatgatcctgtgatggcagtgttttttacatggacttctacgacgacgacgacgacgacaatctcattaccgaatggtgggatcaagaggagttatctgacgatgatgactactacattgtagctgctcttcttacggacatagagcataagaggaccaaaagaaagcgtcgtggttcagtcccagctcgtgagataattcatagggacaggtttgctggcaatttgcgcatagtggctgattattttgcagatcctcctgtatataatgcaaaattatttaggaggaggttcagaatgtcaagggagctcttcttgcgcatcgtggctagtgtggaggctcacgatgactacttcaggcagagaccgaatgcaatgggtcttctcggtgctactgcactacagaaggtgtatggtgcaattcgcatgcttgcatatgatattccagccgatagtcttgatgaagtcgtgaggatttcagagagcaccatgatagaagcttttaagcactttgtcaaggctgtggtagatgtgttttctgatcagtaattgagggcaccaactgctgaggacactgtgaagcatctaggcccccggtgttaattttggtaattaatgacaagcactaattgtggactaaccgttgtctttgagttatacatttttaagttaggtccacgtcatatgtgcgcatagatgattatcgatggattaaaattgacggtgcaaagcaaagggaaagaagacggtaaaactagcgctttaatttagaattgatcgaggtgtagggcgatcaaatttgctagtttaattttagtttcgccgtactattaagaggggtaatgacctagcaaagagatgattttaatttccacattaggtcattgcattttcatttgtgctctctttttcatttcacacacattcactaattcactgggttcggcctgaccagggacggtcagactggccacatagtggcggtctgaccggcgtgccctggccggttagaccagctacatagtggcggtctgaccggcggcactttcccggtcagaccggccccctggaggccgagatgatgctgctcgggatggccgatacggagccgacggagccgtagtcggtcagaccgagctgatggtggtctgaccgagccgaggccggtctgaccggccgccccatgccggtctgaccggctaggccgatggggccctctgacagggctacaacggctagttttctagccgttgcagagtagcacggtctgaccggccacatacctccggtcataccggtagagcacaaagttgggggatttcgcccccaacggctagttttggtgggtgggagtataaatactcccccaccagcagcaagggggctctcttggcacccaattcaattgcatacactccttgcacctctctcacactcacttgagctttgtgttcatccatctagtgtgttagagggttgtttagccaagagtcaagtgcatttgcttccattgtagatctagtgtggcacttgatcatctccacaccgggtcattgcttgttactcttggaggttgccgcctcctagacggcttgtggaggagttgcccggtgacctctccgagaagattgtggaggaggcccggcgccggtttgtgagtggtttggagttcaccaccttcggagtgaaggaagaactatcccgagtgatcgaggcttgggtagtcctctccgtgggccggctcccgccttgcccaccccttgacgaagggggcgtgcggtggcttcgtggttgagcggtggagttgggcttgcctcaacggggagtaggaaaccggcgagttctcgaacctcggtgaaaaatctcttgtctcattgtctcatttgattgtcgcatttacatttgtgcaatttacatttctagagacacacttgagatcatatcaccctaggattgcaaaacattgacataggagcgtgatttactttcctagatatataattgagccactatcaccctaggtttgcaaaacataatttagttgcttagttagagttcaccctcaccaagcctagcaacttaggttagatttgattaggtgttatttagttttaaatcgcctattcatcccccctctagtcgacatctcgatcctacacactgcaaggttgttggctataaacactccaagggggttcccagggatgctaggttctattgactgtatgcattggaggtggaagaattgcccaacaggctggaaaggacaatactcagggcatgtggatgggccaaccatgattcttgaagctgttgcatctaaagatttgtggatttggcattccttctttggactaccaggttttcttaatgatatcaatgtactacagagatcaccactctttcaaaggcttacatcagggacagctccagagttggagtttatggtgaatggaaagaaatacaccattggttactatcttgctgatggcatatacccttctcgggccacttttgtgaagaccatttccaatccacaaggtaataagagaatacattatgcaaaagttcaagaaggagtgagaaaggatgttgaaagaacatttggtgttctacaagcccgctttgcaatggtcagaggccctgctagattttgggatacagagaccctatggtacataatgacagcttgtgtaattatgcacaacatgatcattgaaaatgagcgagatgaagatgtagactttgactaagatcaggaggacagtgaggtgttgaggaaggaggaatagcaacgacgtaataaacatgtgttagagaagtttctaaagatacataaagaaattgaagaccggcaggtacatgagcaacttcgagatgatcttgtggaacatttgtgggcgcttcatggtgctcggtagttcaatttttgcattttctatcatgtattgggttatgttcaatatttgcttgtaggacatatcattttcatgtttgaaatttttgaactcaaatttgaattgtggtgtttgaaattgcaaatttgaatatggttgaattccacgcgctagaattatttatgtttcaattattgtgtgttaaactggatataaatataaattctatactaaaataaaagaaaaaaagaaataggggctaagatatggaggctactgctagacataaagacatatttaggatcctaaagcattgggggcagctcccatttaatctttggggactctaaagtaggggctactactggagatgctgtaaggcgcgcgactgttgcatgccatatatggaggtctcagccgacggcgacgacgaggggttggctgcatcaaccgcgaaaaatggagaagcaatggcgacgacggtgataagctgtggcattattgagaaagatggttgggaaaagagagtgttttctaaaatttgaagagcaacaagtgtttccctcacatagtggagtcggcatgaaggtgagagcaagtttaatagtatagctcactactagctctaaatcatctttagccaatgtaataaccaattcatacaatagttgcttactatactattaatatctggtcccacatgtcatacacgaattatgtcttggagtccgtgctgtagctggctacatatctgtagcccgctgcttttctctcttttcatttatctctttaaaatatatttgtagttggcttatagcctgctattgtacctgctctgatagagggggactcacgcccaccactgttagctccttttatggtcttgttgggaagacatacttgtcacattgtagctaaccagcaactgcaactagtcaacagtagctactcccaccgtcccaaaaaaaaaacccaatcctgggtttgaatctgaatatagtgtatgtctgggattgggttttttttttttttggacggagggagtacaacttatataggtgttgaagccagcaagtgtagggagcactagttcgtgtgcaaccgaacggattggctgtacagcacagccagaaagttgtaaaaattggagtaccgagtagagtagagatatgagattatagacatctcaagttttgtgtgttgtgggcttgtggcctgagttccgagtggggtggtagtgaatatggacctggcgggtcaatttcactggacatggtcttataggtgctttgcaaggaacacaccgacctggccttttcggcctagcccaaccagccttgcagcatactccgttcgtttccacttaaaaaagtggattaagttctggatattcatgtcacgcttttcaaactactaaacagtacgtttcgtgtgaaaactttctatatgaactaattcatttttcaagtttgcaataattaaaactcaattaatcacacgttattatcatcttatttttacgtgaaacacttaatctcgtcatcttcatcttcagagattcaaacaccaccattgcacccttattatatactgctactacgctacacaatgttttctatctcacatcaaaattcaagttagattataatttgtccggtatgtgtatctttatcttctaaagccagaggttccgctggaattcaattggtccacatggcatattaaatctgcgagcgagttgatgaatgcgagtttctacgttaaaaaaatcttcacatttttttctaattactatcattagcattaactagaggagttagttatgcgcgaaagtatgcgtcgctggtgcgcacacgccagctagctttccccgttcattcgtgctagcttcccctgttcattcgcccgcacagaaacaggcagaatgcataataagaaactaaaaatagcgtaaaacttaacagttgaaaaagagaaaaagaaagaaagaagtgggttttttttttaaaataaaaatccttagacaaatacttatagccccaccggttgcctaaacagaatatgtcaaagccaaaatttaaattttaaaacataattttgaatgattataagatactgtcaatgtagtttctttttcagcattggtttttaa

SEQ ID NO: 50030 - DNA, 26703 bp, Oryza sativa
cgattgagacggatggattagattgctaccgattgagacggagggagtaatccatgttaagtccaaacacaaatcaacaaaagaaaaactaagtgacatacatattattccatccatcccaaattgatcattacctaagcaatgctgagatcaagggcatcaaaatgttcaacgttctgaaattaatcctcgttgatcaaggtgctccgtcgcttcatattcaacataaattaattcacggtttgaatgttgcatgtgattgcaccagagaaattaatcttggctagttacatctatacggttgcatgcagggcattcaactatgcacatttacactttacacaaataaaagaatacacactttattaatgatgattatttcaggaagaccttaaaattcttaggtgatgaacaaattgaaatgaagggagtataaaacaatggaccaaactttgtttcacctcaaactgtctttttggaatactccctccgtcccaaaatataagaatttttagtatagtgccaagtcaaccatttttaactttgtaaattaatagaaataaaatcaaacatgtaaaattgatattattagatttatcattaatcaaaatattataatatgcaactctttttatttaaaatattttatttttatagatattgttggtcaaaataacatctcaaagactgtgtcgaagtccaaaaatgcttatattttgggacggagggagtatttattttatactagatttttaggaatatgcaaaactttcaggttttttatgaaatcactgcaatttgagaaatattactcccccctcccctctaaaagcatcggtaatcatttgtcaaagttaaacagcatagaaccaacagaactgatggtaagcccttaatcggaaatgctaaaattatgttgacagaaaatacaacctcaaatcttgcaaattttagatcactggatatgctggatgtgcttcatgattcgtgctcttcttctcaaactccggcgatcacctcttcttctccggcgttggtgaacccaaactccgacagagggccgacgaattagggtcccggggtgaggtgggggtgggagggggggagggaggggaggggaaggaggggagttcaccggctttagagggatggccatgggaggtggcagcccggcggtgggcggctgatcgggcgggcggcgaggcggcggcaccgccgccaaagccgtggggtcgggagcaagcggcgggccggtgtaggaggcgggggcaaagcggaaaaagtgataggaggaggcgaccggtggtggcttcccgccgccggcgacggggtagatgacggacagctcgccgccgtcggcttgaggcaaaggagaggagagggagggggagggggagggggctagcctggggggcctcgccggcactgttgacacctttcggccagccggcgaggccgggcggcgcccggggggggggaagcactgaggagcggcggcgtgaggaatcgggagaggagagaggatttttagggtttggttgtctgcacgaatcttaaagcaatcgggtggtctaaaatttgcaagatttgtaagggggttttttgtcaaatgatctttagacagtccctaaattaatatcctactttgattcggtcgtctttagtacgtttctccataggaattaataatctaactcatgtagtcagaaaataactaactcacgcaagaattatataaaaaaatctttgtactaaatgaactctaaataatatgcatatgtactattaaactaactggcacgcaaagtggcgtcccgattttctatttgcttccaacgctgaatgtacgtatctgtcagatcttccaatagcaatggatgttgagagaccagaaacacatgtaaataggccctttgggagtttaggttgagagacgagaaaaatactagggcaatccatttgagagagagctttgagccaaaagcaccccacgcactagccggaccggcgaaatggtggactcgctgctatacgggctcctagacctgcgcatggcggcgccattgcttgcagctgccgtggcgttgtacgtccttgtcgagcagctgtcctaccaccgcaagaaagggtccctgccagggccgccgctcgtcgtgccgttcatcggcagcgccacgcacatgatccgcgacccgaccgggttctgggaaatgcaggctgctcgcgctagaaagtccggcgttgggttcaccgccgacttcctggccggcaagttcacgatcttcatccgcgactcggagttgtccaaccgcgtcttcgcgaacgtccgccccgacgccttcttcgtcatcggccacccgttcggcaagaagctcttcggcgaccacaacctcatctacctgttcggcgacgaccacaaggacctgcgccgccgtatggcgaccaacttcacgccgcgcgcgctctccacctacgccgccatccagcagcgcggcatcgtctcccacctccggcggtggctcgaccggagcgccgccaacggcggcaaggccgagccgatacgggtgccctgccgcgacatgaacctcgagacctcgcagacggtgttcgcggggccgtacctcaccgaggaggcgagggagaggttcaagagcgactacaatctcttcaatgtaggcctcttggccttccccgttgacctgccggggctcgcgttccggcgtgcgaggcaagccgtggcgaggctggtgcgcatgctccgcgattgcgcgagggagagcaaggcgcggatgcgcgccggcggtgagccagagtgcctcgtggactactggatgcaggagacggtgcgggagatcgacgaggccaaggcggcggggctgccgccgccggcgcacatctccgacgacgaggagatcgggggcttcctcttcgacttcctcttcgcggcgcagacgcgtccacctcctccctctgctgggccgtgtccgcgctggactcccacccggacgtgctcgcccgcgtgcgcgccgaggtggcctccctctggtcccccgactccggcgagcccatcaccgccgataagatcgccgaaatgaagtacacaaaggctgttgctcgcgaggtggtccggcaccgcccaccggcgacgctgatgccacacatcgccttgcagaacttccagctgacggaatcgtacacgatccctaagggcaccctggtgctcccgtcgatgtacgagtcgtcgtttcaggggttccatgaccccgacgcgttcgacccggagcgcttcttctcggaggcgcggagggaggacgtggtgtacaagcgcaacttcctcgcgttcggcgccggcccgcaccagtgcgtcggtcagcggtacgcgctcaaccacctcgtcatcttcatggcgctcttcgtctccctcgtcgacttccggcgtgagaggacggagggctgcgacgtgccggtgtacatgccgaccatggtgccgagggacggctgcgtcgtctacctcaagcagcgctgagtcaagttgccgtcgttctgatcaagctggtttcccgtcatcttctcgtgttccgctctgtttctccgctcctctcgatccatgcacggctctaccccaccacctcgcctgcatggctgcatgggcgttccacatcgctgcatgggcttgggcatcccctatcttgttcattaatattggtcaaacaatcatctcccataaccattccatcttctctttaatttgcttaatatattaaaattgcacaccagtgtagttgcgggtggcacgtgtgcgtttgcatgcactgtgtaggtggtcttttgcatcaagcggtctgtgtcttgcgtgtcgtccttgtatgcgtaacagtgtaataacgtgctgcttgtatgaatattgtaatttgtggtatatttcgtttgttagcacgcgctccatgtatgctacttcctccgtttcagaatgtaagtcattttagcatttttcatattcatattgatgttaatgaatctagacattaacatcaatatgaatatgtttagattcattaacattaatatgaatgtgaaaaattctaaaattacttacattatattgtgaaacagagggagtatatagtttcatttgttagcacgcgctccacgtatgttatccacatggatgtcgaaaactatcaacgcattttatatgaaagaaatattagaatgctacctagcgataggggcgatcagattctgattccctccctccacctggtttccttttttggcaccgtattactttcctattttagtaaatttatacacctaaagtttgtacacctcaagtttacacatctccacaattttttttttaaaaataaaaagttagaaaaatttaggtatataaatactatatataaaaaaaattgaattcaaattcaaatttgaattgggtatgtaaactcttaacttataaactttggatcattaaacttttggtgtataaactttagatgtatagaaatactatatatataaaatatttgaattcaaattcaaatttgaaacgggtatataaacttttgacttataaactttaggtctataaactttagatgtatagaaatactatatataaaaaaatatttgaattcaaattcaaatttgaatcggatatataaacttttgacttataaacttttggtctctaaactttagatgtgtaaacttgaggtgtataaactttaggtgcataaatttactaaaataggaaagtaatacggtgccaaaaaaggaaaccaggtggaggaagggagggaggagggggtcgctacccccatcgccaggcgatcgatcgcccattaggcgtaccccatgcgagtttctaattatgtatgcttcatccattacgggattgttaaaattatggcgtcacacttttcactgagtcacttttttttcctgtacgattttctctctcctatatatataaaagtatatttctatatctcatagctagtcttttaagtaaacaataaattacttttgatcctaattttcttatacattatatatttgaaaaattaaaataaaatattgaaacttatacggtgtaattacgtaagtgtaaataatttacagtataaaaatgatttaactatttttttctgaaaaatatggcgacataaatatagctattccaatctattattcaccactagaaatctccatgttccatgttgtttagttgtttcctgttagtgtatacaaagtccatgcaaaaaatattgttccctatagtttttatatatgtagggaacaaagggtggaagggcctaccatgctcctagtggcttgaagagttctggatttcctttttttcaatcaaagttggttagctggtttgtgatgcagaataatatgtacaaacatgcaagtttaaatttaatatgcacttgaaaaaacaaaaataacaaaataggtattggagaatagaaacataaatgtttatatctctttaagtgtacattaaatttgtagttgtatgtttcttgaaaaaaatatagttgtatgtaatgcgtatgtaactatggtggaaattatgacatgccataggacaactgaattggcagttgagctaggagcgataaaagtaataattgaaactgatactatgaagtggtgaggatggtggctcagtcagaactaaaccgctctatctgtgggactaggatccatgagctcaagtctaggttacgtgtcttccacgagtcgaagataatctcggttcggtgctcagtaagtatagtagcacatacttcctctatcaaaaaaactcaacctagaagaagatgaatctggacattacatcccctcctaggttgagtttctttgggacggagggagtaggcttgtaaaagaaggtttttcttctagttgctttacaacctgggtctctatttccctgggttttgttttatccttccttaaggatgattgtaagaatgaaatgtggcttgaatagagttattatcagttcctctaaaaaaatatcatcaaatatattaagtttatttatatcacatgcgtatatctatgtgttgtcacccttccgcctcacttgtggctggaccatgccccatccacatccctgatgtctactgtccaccaggatctcccactcttcaacgttcttatatattctatcatcccatagtgtatttcttgcattatcctttcaattttgatttaacaaaagatatgatttggttgatgataatgactcttgtattatagaaagactgagatgttattttattaatgtgctaaacaagcaagctaactcctgtattacaaaaaaaaagatatattttctattatgcgctaaaagtccattaaacttcgtataaacgctcctaagccgactcgtgttatcctacaaacgcttctaaccaccatgtggcgctataacaaattagagaaaatactgaaaattctcaggaaaaaggaaaatctccaacaattgatttttacttaaatttggtccaatattctaaaccgtcatattagattatattaaactacatcctaatcgcaccttccctcctccgctatggagataatttactatttgccatcattccaaaatgcacatacccaaatgctactctcccaaatttttattctcatttacaactttactgtgcacccaaattacattgagccattcatttttctaaaaaaaaatatgtctattacatcatatttgtaattagagttggttgccaactactgaattggtaattacaaatattcgtactgtagcattgaactgttatatataattacatttcttcatgcatatatgtctgtactaatattatgcaggcattgaatatataataccaaaaccaaattgacttgattcgagaaggtactatacaatggcagctatatgatggtcttatagagaagtctatccaaattcagaatggttgtacttggtggtttgctacagtacagtacctctcaatccatttttgggttgtagagttccattacctagatagggcaatgagattgtttggaagaaaacaattaattccaccaccacttccacatggtgagactgagctccgcaagctgcacaaaccgaaacttattggaggaaaatatgtttttggaataaattccacgccaagtatgtacaataataatgatgaggctgaacaatgaatggatcaagaagatttatagtactagaatatgtctcatccagttctagattagttttttatgggacggagggagtaaattgctaaatatgctttgcgaggctatagatggccatatgacccgaggtctgcggccaggcccaaggcacgccattttggcctggcccaagcacggcatggcccgactggggtcgtgcccttttcagcccggcttgacagtcgagctatgcctgggctgcaccctcggcacggtgggccggctcgacacaacacgatcgaataaaaatagtatagggatggaaaatagacttaagtaaccatgtaaggcaaggcccaaagcgaagaggaatacaaaatagacttattttccagccatatagacatagcccacatagttgagggatgaaaaatagacttattctgtggagaagcacgacgggctatcgtgccttcgggccagcccggcactgcccgagtcgtattgagccatgcctgggccgtgtgtgcagcccgtgggctagcacgactgtaagttcaagtgccttaatttggtttcggtgattaatgacaaatctaattatatgagactaatgtttttatgagtctttctttgactagtcttatttggatatgaaagtaaaaatgataggaggcatgtattaaacttcacatattctaacttggtctctcttgtggatccaaaatatagtgtgagctccctcattaatcttgattgattatgtgcatatgcattccttcatatctatatgtatgcacatcttgagggggagcttattctatattttgttcattataagatctctaccttaatttgaaattatctttcatctcatctctttgtattgtttatatcggattattatctatcacaaaagagagaaaagattgaaagatcttggattaaacaatttgtgtaattgttactttggtgatagatgataaaccgatgtttatgggattaacctctcttttacataagttttcaacaaggttatttcccgataatgagatgtggtagatatgcattatttggtgatggaccttaatcatgacaaggatgaaattcatggagattaagcgatatgtatcacttcttatctcctactttttgataggttcatatatatgatttccatgttattgttatataagtgtgagactaatgtttacttgagtcttatcttatttagtctcctttacattgagaacatggagatcatgaaggtatgtgtttttttgtttatcttcatcattactacatatgccttctctatgtgtataggataaacccccattggttcttctttacttatgcatacacttgtctctcttgtatatttctttgtatgcatatacttagggggagcaaatcctatacatttattgtgcatgttttagatccatgttgttcacatattatttatatcggatctttgcacttgagcttgcatacgagtatatgacacttgtgatgttaatgaatactcaacaaacatatccatatctttcatatgcaaccggttggtcatcaagtgaaggatgagaaccgatttgttgagactaatgttctcctttgagatgtgaaaaggaataggtcccactacgatgaggctaatgaatgacaccatgggttaatggtcaccaagccaaggacatcgtcatgttggcaagaatgaagtcaagcttgtgatgagaataaagtcttgacaaaggatggtaaagacctcggcataaacatggttcaaccggatggtaacaagtgttgatcttggctcaagcattgaccccaagttggatggcgcaaggcaaaggtataatggagctaagagtgttttcttagtcctttcccggtcttggtgtttgctgtagaccggatttgctagatagacgccgtactatcaagaggggtctatgaagtgagcatgtggatgatcttgcgccatattagttcatatgcatgtaggtgcatttggtgggcttgtctagccaagtgtggtgagtattcttaagtcctaaacaaagagagatgtgggcaaatcctataggtttgggtagcctcatgtagttatgtccggtggagtatcctttggagtgtgagccctttctccctgagaaaagttgtgtttcttggatggattgttcatgggttggatagccctttgaataagctttccataaagtccaagaacgccaaattccgagacccgagtcaagagatatcgtcgttttactaacggtcggttgagctgaaaagtgacctgcggtctgaccgtgggccttaggccggtctaactgggcctgttagccggtctgaccggtgtggtaagaccggtctgaccggcctcactggtctgttgcactggtctggtttttggtggcgatacagagccgcaaccggtcagaccgagccgacggcggtctgaccgagccgtggacgatctgaccggccactacactgcggtcagaccggccaggttgagtgggctcaatgattgccctgtaacggctagttttctagccgttacaaagtagtccggtttgaccggcctcacaacggcggtctgaccggcagagcacaaagttggggagttcggttccaatggctagtgttgatggttaggggtatatatacccactccccagtagcaagggtaagattttggcactccattgcattatcttgaacccttgcaagagctctcacacccttgggcacttagtttatttagtgaggtgttagagagtgagttaagccaatccaagtgcattgcttcattgttgtagctagtgtggcacttgatcatcctcggcaagcatcctagacttgttactcttggaggttgccacctcctaaacggcttgtggaggtgttgtccggtgacctctccgagagattgtggaggaggcccggcgccgtttgtgagtagtttggagttcaccacctccggagtgaaggaaaaactaccctagtgatcgaggcttgggtagtcctctccgtgggccggctctcaccttgcccaccccttgacgaagggggcgtgcggtggcttcgtggttgagcggtggagttgggctcgcctcaacggggactaagaaactggtgagtttccgaacctcggtgaaaaattccttgtctcttgtctcatttatttgttacatttacatttgtgcaatttacattcatggagacatatttgagcccatatcacctaggtttgtaaaacttaacttagttgcttagttaaccttgcacctcaccttgcctagcaacgtaggttagttttgttgaagtgccattaagttttaaaaccgcctattcacccccctctagtcggcctccttgatcctacaacgactcggcccaatgtgtaggtcgggccgtgccaacagcatgatgggatgtcgtgccttcgggctggcccagcacggcccaagtcttattgggccatgcctgggccgtgtgtgcagcccgtggggtggcacgacacggcccgacgtgtaggtcgggccgtgccggcccgactaacctcggcccaagcacggccgagcctgggccgtgccgtgctgggcagctgttgatagaaaacacgaggcctgggagatctgcttaacttcaatgcaggtccaaagctcgccttcgaatatatgagcgtgctagttgatttgatcctgtaatcaacaggaaatagagacaaagaattcatggttaaatctataaatgatagccgatcggctaggtgccgatgacatatcatttatctttgagccgatgtcatatataaatcgatcggcggttataaatagatagtaaggaactaaatctatttgatcggctgtagatattaacgatatatagttcttacattaatatatacttaaattaagtgattgggatagatcggtcaccatgccgagacagtataaatcacttagatcgaaatacatattaataacagaattatatatttttatagcatagccgatcagatagatctagcatgtatcggctaatactccgatactactttatataaagatatcaaaacaaatataatataccaaacaaaagcttaatatacttaaatgcaataagatcttgacataaagggcggatttaacatgtcattgaagcacatagatcgaatatggttaaatcagataagatcggctgaaactccgatactaccctaatcggcaaccaaaggacatgctagagattgatattctaagcacgacttaatagatcaaactcaactgatgcagcattaagtatgaaaagaagaacaatatctagacaatcaagccgctgggtgtttcataaagtggtagttatcttatataatctaggacaatgtcgctatttaacctaatcggctgtcttctattaacagatgttagccgattgtaggttagatgatgatattgccaaaggttatgtaagatatatgataacttgacaaattatatagacaagattagagtgtcataaagatggaagcactaatctcgagaacacaagtcatcataacaagttttacctcttgttaaagatcgaaaccaatgcagctcaacccgaaagcaagaactcgtcgaaacaaaactaaagcaaaaaggtgacgatgcgccgaaattgtattaaacatgtgtgttaaaaattacatagggctcagagtctatctatacccgagaattacaagatatgtctataccggacacgatcactatctctaacaaactctaagataacataagtctttacggcagacttttgcccaaacatatctctaaggaagttacataaaacatcctaattaatagatacaattgccttctcaggactctatccatgtgcggcaatcatcttgaagcacctcaattcaacccaatgtcatacactaaattatactatcagaatcggctgcatcgggtcacctagtccgactcagacccagccgatcctaatcgtagccgatctggacttcagccgattcttgctctgttcttggatcaatctccgccttcgactccaccttgatctaatccccttttccgatactgatattaccaaatttggtcattaacagcagcccatttggccatctatacgcaaggctagactaccaaccaacgttgatgaaataccatcttagatgatcaccgattatgcttcctaagcaagatatttgaccatccgcctgcccatccacgcactgcccatcctccctccacccatccacgtgccactcgcacggccgccgccctcccgccatctgcctgcacccccgccctaatcggtaccaaatgggactactactagagttgaagacctttttaaggtcttaaaagaatttagggcagcctctatttagctttgaggggctctaaaatagaggttagtacgtattggagatgctctaaatcactagtagccatcatttcagctggcacatagtgtttcgtatctttcataatcaatgtggcaatagtatctgaaacggggaattctgttgaaagcacaactttgatggtacacattactttaatcaatgtggcacacatgctgtttttatatatataaatgcaacattacttgctgtgcaccaaaactcatctacatggcttaggcccctatgctatgcgggcataatatttttttttgtacttttcttcgttccaatttggatacgtaatgaacctcctgatacaaccttagttgtagaatttcaatagggcagaataatataagaaagcagagattgaaggaaatttaactaatctgaagaaactgttaccgcaaaaatagaaattcttaggcactgttacctcattaaaaaccatatgtttaacactaaaaaggaggatggctgtggcaagcatgccacgaggaactgatgaagttttggttggatcttaacaacagatatttgctttatttttttgacaggtcaacgggaggcgaaatgcccacctgacatatattatgtcaaacagacttacgcaagagctattcactttatgatatgattgagctattcactttatgatatgattatgtgaccaaagcacatcaaattatttatttttttgaacgaatcaccacttagaatgtgccttcgttgaatagagtgggagagaaaactttgaactaatttatccactagtaattgtatgggcattgcaaagatatattttacctcgaaaaccaaattcccggttgattctatcactaattcactctgccactccagatgtgtgaagagagcaaaggggcatcggccgtgccacgagaacatgaatgatgagggggaatcgggaaggccggccactacggatgacatgatcactgatggacttggtttcaggtaatctctgagaaaatggcggttgcacctagacttgatgcgagggtcccaagggagttgcagaagcgtagctaaccaacggtgagcttagattctacaaaggttgatcgagaaggaagagcgactgccatacttggccacaatgctatagagccaaccaaggaatagaaccaagatctgagcccccctctaagtcttgcgagaataccacgagagacgaaggatggaaagccacgcaaggtcgaagtggccaggctatgagatcaggagctgtgggtgtccccgatgccgaccaacgcgatgaagagggaggtcacaagagaagacatggtgttgggtcaaccacgtcgtacgctcttccgcgtgacgtccatggctagacgatatccataatagcgttcgtatctggacgccatccaaaacagcgtccttactagttttataactctttactctcaattattacttttttaatttcagaattgttaattattatgaataaaagaattggtcaatcctttacaaatatgtgtagtaccagtaaacgagcatagcaacacgagattgttaatgggcgatcgatcgcccctagcacgccccctctcctccacgtggtttacttttttggcactgcattactttcatattttaggaaatttatacacctaaagtttatacacatcaagtttacacatctaaagtttagagacccaaagtttataaattaaaagtttatatattcgattcaaatttgaatttgaattcaaatatttttttatatatagtatttctatacatctaaagtttatacacctaaagtttatagacccaaagtttataagccaaaagtttacatacccgattcaaatttgaatttgaattatatccgattcaaatttgaatttgaattcaaatatttgttatatatagtatttctatacatctaaagtttatacaccaaaagtttatagacccaaagtttataagtcaaaagtttacatacccgattcaaatttgaatttgaattcaaatattagtttatagacctgaagtttataagttaaaagtttacatacccatttcaaatttgaatttgaattcaaattttttatatagtatttctatacataaattttttcaactttgtgttttctagtttttaaaaaatttatgatgtagtaggaagagaagaaggagaggaggaaggaagagagtagtgtatagggggatggggggcgatcgcctagggcggtcacccgcccattagccggccccataacaacatatgtacggtagagctatgttaaggaaatgaagttttctcctatgctgagagagataaacttcttcatactcgagatatacctctttatgcaagttgccaaagctaaaatttacacgttgaaagtaggattggaatctcatcttatctgtgttcttgactttttgttccgtttttagaggtgtttgtattatgtgtaagctatactagccaggaggtatagacttacctcctaatgaccagaaagatctcgataatgctaaccataaatttgtcctcagatatatatctctaaggatgagaaaaaaaaatctctaggaaacatatcaaaagatgagcttaattaccagggcctgcatgccattgagaatttgagattgctagtccattgtagataaaggaaattcaaccactaaatacaaggtagttcaggccttcagtattaattgaagcatacaggcatcacttaaaccgaattaagccagcactagcgtagatacgatacgtgcatcccattccacacgaaaacacttgatgatgccactgaagaaaaggagcactgtatgaacggccctggcttctctgatgctccggcaacaattcaacaactccgcaaagaacagcctacatcaccacggcaatctaatccggccttccgccacaccatccaatcagagcaagtcacacgagaagaaagatatatataacaaaacaaaattattttcggttttgctaaatttttggcgacacattttctggttgattacagtcgcttgttgagccattggatcggtcataggattcatgctagcatacttaataacgcgtaactagttatgcttcataggttacaggtcgctaattagcggtctactggagaactttgctactatttttttgttcactgcatgcactcgatcaagtatgagtatttgtaccgaccagcgaaacacatatgtaattaaagtataaatatgtaattagtatatattagtagtatatttagacagtagttacaccctacttacacaccacttacatatgtaattagtatgtaattttgtgacttacatatataattttaatacttatatatgtaattttgggacttacattgtaaatacactaaaattacatatgtaatttagtgacttacaatgtaaatacatgccgactaacttttagtgaaaaatatggtgctataaatatagctactcccattatttttccttccatacattttccgcaaaacaaacagagacccggccggtgtcattatccacctgtgcccagcagtgacatggccttctagcatccgtctgtaccatgaagactgtatttatatggcgatggctctcgggctccggactgtgaagaaaccaagcgggtgaagaggaggacgaagcacattgtgccgcacagttagagaggatcggtcgtattcaggttgacatcctttatcataatagcactattattacagtcattgacatatagggtaataaaagaatgaaacccatatgttagtgattgtaatggtagtgacattatggtagaggatcaatcctcacccgtcatattcgtatcgtctctgttaaaatattttatgtggtttaacgctagtcaataataagggggagttgggaatttgtcccatcaccttatttctcattttgatttacttttatcttacctttttattactattaaatttatagttgtgtgtcttatgacaaaagctggagatgtaacccatttctattatctaaaaatattcgtatcgtctctgttgtggttgtggttgtgggctcgattagcaaagaagcctttggaaacagagcccacagctcaaggtcatatgaaatagaaaacaggaaagcgatctacttgggcatgaagctgagaacacaaacatagtataggtaacccgagttgtgagtgaagggcagacggacgaccgacttatatatgaaacagacgacggaaacctctttagttatagtagagacagagatataatgtgcaaattaatataaatgatcctcctcctataaaaatcctataaaagtaacatgagtagagttattacctaccagttaagggatctgaacctgtaaaaaaaatactgtctcccatctcttttatctcaatcttgcgtatatcctaattccaacaattatcattctttataaataatgtctacgggtatagcccgtcgacagtgacgaacatgtaaaaacactatcatgacagagtgtatgcttcggactcgaaaacaccaagcgaagcagggtgaggacataattacttttagtattttactagcaaaatgacaatatgatgtaacggatgaaatcaattttaattttacatacatacatcaaacatgcacgttggtagattagtcgaaagcaatgacacattaactaccacatggtgagtgcataaggagcagaaatttaccatctctcactaaatcgattagtccataattagccataagtgttacagtaatctatatgtgttaacaacggattaattaggctcaaaagattcgtttcgtggtttccaggcgagttatgaaattagtttcttcattcgtctctaaaatccttttcaacatccggtcaaacatccgatgtgatacctaaaatttttttttcgcgaactaaacaggccctaagaatggtgggactaattccactgtccctcgtgcacccaaaacttgctggttgcacaaccaccgccctcctcacgacacgtgccatcttttttaccctcttacaaaacttaatctataagagcaggtacaatagcaggctataagccagctataaacatattttaaaaagataaaagaagagagagaagagcagcgggctacagatctatagccagctacagcacggactccaagacgtaatgtgtgtatgatatgtaggaccatatattaataatatagtaagcaactattatatgaattgactattacattggctatatatgatttggagctagtaattgactatactattaaacttgctctaactagatattgacaaaactataaccagaatgagaccttgtcagtaccttggtcctagacgctgacacctttgacaaacaatataaaagaatggtagatccaactgaatattgaaagtgtaccataaatgacgtttggaaaaaaaaaacaaagaggttacggacggcaaatgagattcgaacccaaaatcctattagataaggagcaacttaccattgagttacttaatacacctagttaagaaacaacctaccttccttttgatttgtaccatactcaccaaggttcatggcgctgatatattggatcacagcgtcaagacccatggcgttgaggtagagtttcaattttggtaatagtttttgtcaatgcatatttataaaacaagttttgtgaaaggataggagtggaagaagtttgaaaattgctcgccactcccaaatacgcaaccatgaagtaatccaatggcgttgacccctctcactacttccaaaataatcactcccaaaataatcaccaacttccacatccacccctccaagcgcctccgcccttccttcggcatccctttcctcctccgcatccagactctcacgtgagtaggcaccgccgtgccaaaacctgtcgcaatgcatgcctcaccggcaaaccgagtccagtgttaagctacaagcctacaacctccaacagtccaatattgatccctagtccgtattcacacgggaatatccgtccttagggttttggtgctggccattagtctagcttcaggccggtggcactagaaaattggaggagcttcttgtcgaggagacgtggctaaaggtgtccctcaaggaactccgcaaagttagaagtgtaatctgaagctcgtaatcacgactgtaacacggactcgtaattgatacaaacgcaaacatagtcataaacaattgtacactgtgtatttggtactcattcaagaatctatacatgtaagcaattagaattaagtagcatcctcccagaaaatgcatatagcaaggagaataaattaattgataatcattatatcctctactaaaataggacacatgaacagaagtaagagaaaacccaaaaagaaaatctggaaggtgagatattgggtaaacaaacaagtatcgtatcgttcatccaggaattacaaccaaataatatagagtatatttttactgtatcctaagttgagtatgattcattgatttcgatccaaaggcttagattttattataatacatcagaaatagtatgtgtagtagtagaaattgtaagagggggaaaaaaaggaaataagtcttctaatcttcttcccgatttctgctactgctcaccggtttttcgcacaccatggcatcttcgtcctcacgattcagcatggcacgacttcattctcatgatccctgtagcttccagcgactttgtttgtcaccacgattcacgaaacatgatcccggctgccggtagccctcaagccatgtgttcctgatcctgactccctgaacagcatcgacaaggatcgatcacaggcaattttgtcatcttgtgtttctaggggctaaaagaaggacatgctgcacggcagcttggcggatgtgcagcttcggcaactgcacatgcagttttgcttttgggactagggaagctgcttagattctaacttttttccaacaaactttcaattttttcgttacattcaacttttctatacttacaaacttttgacttttccatcacatcgttttaattttttcaaacttctaattttgacgtggaactaaacacaacatagatgaagacatacaattcaattttggggttcgtccacatatttggggcacatttcaagaaaattgttctttgaatagcttcaagatgtatcagaatagaactgaacttgatgatctaccattcgtaaacagaaatttaattggtgctgaatattttaggacatgttatcaggataaacaaaagcgatcaaccaacgtttcgaattggggaactgtggctaaattagcgatgccttttcttctctttctcgtgttgctcaggcgtgggttgcttcccagaccggcttgtttgttgctcacgaggcgcgcggataatcgcgaaggccaatgctagtatgcatgactaaaatagtctaacggccatggaaattaacggttagatttaactcatactactctactgccatataggagtactccaatagtggaaggtaccgtagaagtgcacataatatacgcagtttagcatggcagttgttccaccacaatctgcaatattatttgagtttactgaaccatatataggtggtgttgggattcagggactaaactttagtctttgtcacatcggatgtttaacattaattagaagtattaaatatagactacttacaaaactaatagcatgaataagagctaattcgcatgacaaattttttaaacctaattaatctataattagcacatgtttactgtagcatcacataggctaatcatggattaattaggctcaatagattcgtctcgcgaattagtccagagttataaaataggttttatcagtagtctatgtttaatacttctaattagtgtccaaccattcaatgatgtgacaaggactaaaaatttttagtcccatccaaaaacaaccccatattacacctttcgtctcaaaatatagtaatgatgggatgagacctatcttagaactacgaatctggacatgaggcatgtccagattcatagtgttaggatgagttaggttgctacattttgggacggaggtagtatttgagacttgctctggtcaaataaaaagtacctcaagataccagtacttcacgctaccaaattgtttccgatagttatgtttagctagacaggatggacattgttagatccaaccatccgaaacaatacggtaccggtacctcgaggtactttctgttggacaggagcaaatttcatattatttgggtttgctcaattcctaaaaacagttcaagtcgaacgactagcatgaggtcgatctagtatagtgggccactgtatcggtttaaaacctggatgagatggtttgcggctagctagttatggtcggcttacttaggtgttggctcgataagattgaaggtggcttgaattgtgttgtctcgggttgaaatccctcactcacatcccctcccggtgaagctttatatttataccctcatatacccttatttaagtaaaagtaaagagacaaatgtagattttgaatcgttttaatcagtgacagatttatgtgtaggttgtggggtcagcccagcgttttcactatcatccagtgagtcttaaattttctatataaatctattcaaatctgcataaatgacctcaccaaaatatgaagtaataataattaaccccaccgagtaaatttcctagcttcgccactggttttagtaggaaccaaatagaactatgtctttctttcatcatctcctcccggctttacatatgtttgggtttgttttcatataggagtcagtgatatatggtattccgtcgaggtaagtatacgtctaactacatattaagttcaaactcaatctacaccagggtttgaaatttcggttcgaaatttcgccccccaccgaaatgctcacatctcacccgaaaattttgttttttgcaatattttgtgaatttggtcaaatttattcaaaatcagtcaaattttcaaaaaaaaaatcgtacaaaaaaaattcggaaaattcggttctttcgcccacctgtggtagaaatcttagtttcgaaattttaaaccctgaactacacattaaggggggaaatctaagaatagactcaagattttatggaacaagtcaagtaattgaaacgatttccccccctataaatacgctctttgttgagagtccagaagagcataagtgagacagtctgagcaagagctcgagccttcagtatcccacgcactatgggaaccagaactaacccgcccggctcaatggtggagtcatttcacggcctggtcgtggtagacctccgcacggcggcgccattgctggctacagctgtggcgttgtacatcctcatagagcagttgtcataccaccgcaagaaggggtccatgccagggccgccgctcgtcgtcgtgccattcctcggcagcgtcacgcacttgttccgcgacccggtcggattctgggacttgcaagcgacgcgtgctagcaagtccggcgctgggctcaccgcggactttctcttcggccggcttatggtcttcatccgtgactcggagctgtcccgccgcgtgttcgccaacgtccgcgccgacgccttccaccttgtcggacacccgttcggcaagaaactcttcggcgaccacaacctcatctacatggtcggaaaggagcacaaggacctgcgccgccggatcgcgcccaacttcacgccgcgcgcgctatccacctatgctgtcatccagcagcgtgtcatcctctcccacctccggcggtggatcgaccggagcgttgctaacggcggtaaggccgagcccatacgggtgccctgccgcgacatgaacctcgagacatcgcagacggtgttcgtcgggccgtacctcaccgtggagacgagggagaggttcgatagggattacaacctcttcaaccacggtttcataaccttgcccatcgacctgccagggtccgcgttccggcgcgcgaggcttgccgtaccgcggctgaagcatattctcgaggactgtgcacgtcagagcaagcagcgcatgcgcggcggcggcgagccggagtgccttgtggactacttgatgcaggagacggttcgtgagatcgacgaggccgcggcggcggggctgccgccgccaccgcacaccagtgacatggagaccgggaacctcttgtttgacttcctcttcgcggctcaggacgcgtccacctcctccctatgctgggccgtgtccgcgctggactcccacccggacgtgctcgcccgcgtccgagctgaggtggccgctctctggtcgccggagtcaggcgagcccatcactgccgagatgatgacggagatgaagtacacccaggcggtggcgcgcgaagttgtccggtactggcctccaggcccggtggtgccgcacatcgccggcgaggcgttccagctgacggagcagtacactatacccaagggcaccatagtgttcccgtcggtgtacgagtcgtcgttccaagggttccccgacgctggcacgttcgacccggagcgcttcttctcggaggcgcggagggaggacgtggtgtacaagcgcaacttcctcgcgttcggcgccggcccgcaccaatgcgtcgggcagcgctacgcgctcaaccacctcgtcattttcatggctctcttggcgtctctcatcgacttccggcgtgagaggacggagggctgcgacgtgccggtgtacatgccgaccatcgtgccgagagacggctgcgtcgtgcacctcaagcagcggtgcgccaagttaccatcgttctgagctggttattttccgtcacccatcaatttctccacggctgcacctccactgcatgtgcgttccctgtactgttcacgggtgtattctaaattctcaaggaaatatcgatatcctttatttgtatgtcatataaatggttacaaaataaaactaaaaacacaacaagttaaattaacatatgagaaaaccattctacaaatatacaagttaaaatttaacttttacaagttaaaaaaaaaactatgaacgtatattcacacttaaatttatttttttcgttgcaattggttgaagttaaatttgatcttgtatatttttatgaagtgatttatcacatattaatctatcttgttgatttttttttctaatcatttgaattatatgcaaacaacgaggaatatcctcttaatagtttaaaatattttccctattgttcactatttggacaatcatgtcatgaccacttcgtcttctctattgtttgctatattaaaattgcaagccgatgtagttgcaccttgcacatgcatgtgcgtgtattaggtggtgtttcgcgtcaagcgcttattgtcttgcgtgtccatgtttgtatacggttgaatgatttaaccgtataaataaagggatggctgagattaaggcaaattcatcggtggagttggccgcaactctatgggatctgcacctatcttttaggtgtgtgaattacaaactattaggaggatcacaaattcacaactgcaatcccgaaatattggggcagccgaaattcagaggattttattacttctttaccatatttttttttcaaatctaccccttcgctaattctactactcaagctacatgtgtagtacaactgattgtagagtccgtcagatgaaattcatagatggcggatggccatccctggctccaagggtacataaaaaatgctctatacttaatttagatacgttaagtagggtatggacggacgtacgattgcacgtagaagcaaataacgatttaatttgaaaattaggagtaggagggcgtagtatgtacatacacgaaagatttttttcgttttttttctttggtgaatagtactcaatccatttcatattataaatcgttttgacttttttcttaattaatcaaatcatttaagtttgatcaaatttatagaaaaatagagtagtatttcaacgcaaaacaaaatgtattatcaaaatatataaaatattgctatttttttatatactagaaaaatattaaaatgacttatagtatgaaacggatgaagtagtatgtatttatacgtaaataaacaggattttttaatagctttttccatatttctggtgaatagtacgtacacatacatatgttttctctggtatatagtagtacgtatttatgcgtaccagggtttacgattccgagatgaccttccactctgagctttggcggtatgacggttttcgtgaaatccgatagaaaaccggtaggtttcaaacaaattttgtaaaccaaaatttgaatactaattccctgagtttatcgatatgctcgcgaaaacctgtcggctttagcgatattccgagcgaaatcaagtgcacaaccacatcgcctctctattatattatctaggctaagtactaagtgggcctactatatggaatttggcacaggaaagtgtttttcttttttaaaccgttattcttttcttttctactgtaaagttcaagaaatacacggaatataccatttcttttggaaaatttatacccaatggattttgttttttttttattttttatcaattcaaattcgaatttgaatgaaacccttcaaaattacagacggtttctactttcgagccacctcgaaatcttggttttcgtcggatctgttaaccctgatgcgtacatgcgagattatttttcctagtttttttccggttagtagtacatacgtttttttttctctcatagcgcacgggagattagatgggaggaccaatcatctttttgttcgttttttcggtgagtggtaaagtacttacgtacgtacgtactaactattcaggacagacttttttattcattcccaggttacgtgtgatctaacctaatgttttaacttatctaaacgaatgtaatggattaaaataatgagtttattgattaaattgaaaaccaagggttatatataattttcttttctattgtaatttggaaggttttctctaatttattaaagcgacggatgacagaataagagagtttgtaggattgctatgtagtcgtttgatatttttcctagtgaaactttattaagtttgatcaagtttatagaaaaatttaacatctaaaatataaaattagttttattaaatctaacattgaatatagtttgatgatatgtttgttttgtattgagaatagtagtatatttttctataaatttggttaaacttgaagaagtttgaccagaaaaaagatcaaacgacttataatatgatatggaaaaagtagtgatttaggagcgtttgtgacaaaataatagatggatttttttggttctctctctggtgaatagttgtacatatctattatcttattaaagtaataaaaaaggagcctccacgttcgctctcacggcttaaaaattctcatattaatcgaagaaaaataaaaacatagtccatatagaaatacaatttagaaatagctgaaattcgaaattaaaaaaaataatgaatattgtaagaggagactagagtacatatagaaatataattaaaaaataaaagaaattcggaattaaaaataaggaatagtagaagaaaagcatagagtccatataggaatttagaatgtactaaaaggaataaaattaataaaattaaaattagagcttagagtccatatagaaatacaatttacaaacaactaaaattcaaaataaaaaaaatagcaagaagagactagagtccatataggaatacaatttagaagaaactaaaattcgaaattaaaaaaataaagaatattgaaagatgagtttagagtttacatagaaatacaattagaaataatgagaattcagaattagaaataaataatattgaagagaagcctagagtctatatagaaatacaatttacaaataatgaaagttcgaaaaaaaagaaatattggaaga

SEQ ID NO: 50031 - DNA, 970 bp, Oryza sativa
accttttttctgcttggagtaattaatcatgtttttaatgcattcatattgtttggattctcagacctgctgattctgcccttgtactctggccttccgcggggagatcaagtaagtgatcatcagtagttttgtagtgtgaaatctgttgtgtttactgcttagctattcttctctggcattttaggacctcatttttactccaacttcaaaaggtaaaaggaaggttgtgatatcaacaaacattgctgagacgtcattaactctagaggtaatgcatatgtatatgtatgctaacaaattccatggtggttgttactaactgctctcaatgtcgtgcagggcgtggtgtatgttgttgatagtgggttttccaagcagaagtgttacaatccggtgctttctatttatactcaattatatggtccactgttcttctagatatactacacttctacaatttggctaccctagatatatctatactcttgttccttttcatagaacctttttagtaaacttttttctaatctttcttgtatatttcttggtttagtccttttcctgtctataacttgcatccttttggcctagatttctgatatcgagagtttagttgtcgcaccaatatccaaggcatccgcaagacaaagagcaggccgagctggaagggtgcgaccaggaaagtgctttaggtctgttggacagttttctcattgaagtttgtgtttttattgatagttcccttatagtgatttgtatctatcctcttctagcggcaattatatttggtcagttatgctggtgttgtgtttttattattatattataaaatgttccatgattctatttacctgagtctgtgttttctggatgacttgctgaatactttgagctattattttatctactattttctttgtatgtttcaatccttcatcttgaatattttatgaataaatctgcattc

SEQ ID NO: 50032 - DNA, 8985 bp, Oryza sativa
  unsure (1)..(8985): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagagtcccatgatgacacagacgagcagtatgatgagcacctccgatgagaagtcccatgtcaggttcctgatgtagatgagcgccaagaacacgcccaagcacagcgtgttgttcatggtcacaccaccatatacctgcaaacaaagaatcaaacgcttagaatcagtaacatttttgtgtagatttagaaactagaaacggtttaggaagaataactgcttctataatgtacctcagagaaagtaagggaactggtccgtagcttcttcctgctagcgaagatgatggcagacacagcctcgctggagttggtcgccagcgggagggcgatgaacgaaatgaagaaggatgggatgtgcgaggcgttggagaagttgtggacagcatcaacaagcgggtctgcgaatgcagcagcaatggcactgccgagaagcaggagtcccacggctttggtgatgcaccagccagggttctcaacgctctcaactgtctcgtcagatctgtccaccagaaggtcgtgttcctgccttgttctctgcagaattcagacattttttcagcacttaaatctctagacgtctgagtcacattcctatatctgaatcttttcgtgtatcgcctgtctaagttatgctacttgatatagattttcagaaactaaagcactagaggaaggaaaatatataccgcatggtaatcagtgatgaacttattggaataggcaccactggtagggacgctgcgcttggcctcattaagccatctcttcatccccgagacaaactctgcctcctcgacgatatcattgcctgacgtgtcaaagtcatccatgatcttgtcaacagcgtcattcttgtcaaagtcaacctcctcaaagttgataccaatgataagtgcatgaagctcagcacgggacagggtttggctctcatccatgtcaatcttgtggaacaacctgcgtgtgaggatatacaaggttcatgtcaagttcacgagctttctgttggcatatcaagagaatcaaaatgtctaagcacccacttttttatgacatcttcattgggtgtgccatcctcattaagcagccgcccgagcgcttccatttgggcatgcctgaggattccggagatcacatgcttgtgttttgcgtatgcaagcttcctcttctgaatccatggctggaaaacctgatgcaaaacgcagaacctaacagtcaaaatctagagacaagagtttccaatctatgccatcgtttcaggaggctcaagtgtccttaaacataattgtgcttacctgataaaggcaataggcaagcacaagcgagaatgatacgataagtgccagcaagacagctaggcgctgtccgtggtgggtcttcaacattttggggaattgagcaatgataaagggaataacagaaatccccatgatccgagctgcatagctggtttggacatcagttgaaataccagtgcctgcaaaagaaaatttgtgcatcttacattcaatatatacagaaccagtaggtcaaagcagtgtaaaggtaaggttaacatagtggtggcttgtggtttttaacatgttaaccagaacctccaaattgaatgcatccttacaaagaagcagacaaagatcagtgtttgtaatttaaactccattctactttaggatttagatgtaacaggatcaacaattatcagaaagactacattaataacaatgttaaatacaagaaggcaatttaccagtcaagctgaagcccttgttgttctgtaaatcaactgcaacgccatttggaccaatgtcacacttgccaacaacaacacaggttccccacagaagggtgagaagaaagacggtcgaaccagcaagcaaccccattccaatcaggacctgactttgtgcggtctctctactcccggacagaccagacactgttaatgtgacagaacaaagagatcagaactctaattggatatagttggatattcagagcagtaaaaggtgagtagcttcatgattgtagcatatgtaccaggagaaatctgttttgagcaatatggatatgcaaaatgtcaaaatctgcatcataccataatacaagatcggtggtcaaaatcagagaactggtttttataggagtaaatattctttttattaatggcacagaagaacattgatgtttagacttaagagtggcagagccagaaacgctaaaaaaaatggttgaagagggccaacagtgctagttttttcaaagtatgccaaagctacagtaaatttagtgtgaaattagaatccatgggggaggacacacgcctgtctccgccctaggtaagactggtaaggtggaaaacaaatactaatagagcaaaatttctagaataatgagttgatcaaatgtagcattatcatataaaaaaggtgtaccagcatccacatttaagtctataggcaagtcctacatcggtagaatacatatttcatttcagatctcattgcgatcaatgaaccatgtgcagccatgctatcatagtaaagtgtagccaaatcagtattgtgttctttttaatgaatgagtacctgaaaatgagcagatagctacaaatttcactaatattagagcaatattgcctattatctatggagaattagaatctttatggcacacgaaaggatttaacgaagagggtttcctcttataaaagtttatgaatcttagagagtagttaaaaaaaacgttaatcactatttcctatgtcgcaaaataagtttatttttcactcatcccacatgtaccaacacaaaataaaaaagactaggatactcccactatatcaaatcccaacataattattacttgtactattttatttttttgctcgctctggtctgcattgcacggtttttcttttctcaaatcaaattccggcagagctcctgccgtcagtttcctcaaaaaaaaaacataattattacctactttatctacttacatttatttcctatttttacaaactccgatgcaatgatttcttaaagataaatttatattgggatagacgggaggagccaaaaatgaacttattgtacaacggaaggagtacttcagtactactacgtcacaaatgtttaccgtgatagttcaagcatgtgattagtatgatctgctattttcacgtgacaagatcggcaacggtcttgaaagaaagacggaaccgaaaaagcataatttctggaaagctaaactccaacggtccaaccactctatccagttgcacaacatgttgcctttcaatgtgttcagttaaactacaataatttggttgcatacaattttacaaatatataatttggaactttggatgtaaaattctatgagtaaaatatcaaatctatgccctattaatttcctctgaggacaaaccatcgtatttgctacgtacaagaatagtacaagataatgcaacacagtaaaagtgcatatcaaagcaagtcgatcacttgatcacatccactaatcagataggtgcaacgcacaaagaaatattccatacaaaaagggtcaattatgcaagaacgtaataatgaaaagtaaacagaaaaggggaaaggtcaaaatgacaggacaagcactggtggaactttatcatgctagcttatctgacacatttcagagaaaaagcagagctcagtagaactaattcctcgaataagcaggaggttaatcaaaaggcatatatactttgctagagcttatactctgtttttcttttcttttgaaatagtagaacatactctggttcagtcacaagactaacagaaactttagatctgaagcaaaccaagaacagacaaatctctaaatttacggatatgagttacttttttacccttcataaacacgcaagattttaccagtgctaattccaagaaaaactttgcatcctcgaatgttaaaaaattcaaaagtttcactataaaatccaaaagtcttactgctagagtgagtgagaagaaagcctgaataagtcctaaacctcaaccagagagtaggcaaccgatcgaatacttgtcggttcatcaaagaacagaagaggctaacgaaggaaacaaaccgaaatacgagctcaccgaggacgaggagcgcgtcggggagggcgccgaggatggggaggaggaggccgccgacgaggccgggccccatgatctcgagcagcagctcactgccggccgacaggaaggtggccgccttgtacatgaggaacccatacgcgagcaccaggaacaggttcccgagcacggtggtggtgcaggggaggaacccgtacgactgctcgcacttctcctccggggcggcggccggcggcgaggaggcggaggcggagttggaggtggtgaggcgtatcacggctgacacggggttggagaggagggaggtggcggacgccgaggccggcgagccgtcggagatgaggcgtccgtacgcggcggcggccaggaggaagaggaggagcgggacgagcgggaaggagcggcggcgagtcgccattgcgggaggcggccggaggcgaggggcttctcgggtagggatgggtttggtgcgcgtagctttatatagtgcgatctgtgcgatatttgatttatgtatttctttccttaattaatttagtaggagtactactagtttataatatagtaatatttttttgtgtgtgtgtggatcaacggcaaggagaggctgtctggctgaagagccggatccaatgatcatatgtacgccttggttaaagtggttcgttatacattccttacctagcgatctgtacgctttaacctttccaactagagtaaattccctttgtactcctgaaaactcacttaattccttttatatctctgaaatttacccgatcccttctatacccctgaaattttaatttgattccttgtatgccctcaccgttacattttccatcatttcactgttacgtttggttgcaaatgtcatttttacccttgatgctttaggtttaaatataagcttcaaaaacaattgaaaattttatttgagtgcacagtatgtgtattttataaaactaatgggactaaataattagtgcagaaaattttgacataaattttgaaaataaaataaatgtaataaattaaattttttatttgaaattttaataggacaatggatttttttatcaggagcattcataaaaaaaatgttgtgaacatgggtagtcctatctttatatgaatgcccctcatttttatgacttcttttaaaaaaataaatacgtatttttctatttcattatctaaaaatattttttgggataaataatacatcgcacaacaaactcataactataatagtctcatgcgagaagcttttatatttttaataatgtaattcatgaatttctttcttcatccaagggtataatagtcatttttatagaaaatacacggtcaactgacgggaagggtatgcaagggatcaaaatcaaattttaggggtacacaaggaagtaagcaaaattcaagggtatagaagggattaggtaaaatttcaggggtatataagggattttctcttccaagtaaccacactcaaacaatcaaactatgacatgttatacatacgcgtataaaaactatggaaggtgcgaaaccatattttggcctattgtgtgcagaaattaccatgagcttaaacattgaaaaattgtgaacaaggcaaatctataatttgaggtttcacaaaagaaaaaaaactagaattttaaaataatgctttggtgcgagcacctgatactacgagagaggaatgtgtggatctttttctctttcgccctcaatctcatcaatccctttctgcatggacgactaggaattcgtgggtggctagtagcttggagttgtggtaggggagagcacctatgcccctattgtagagttatggcgaccaatcacgtataacggtgattagctcgacgttaattcttttcttaagctagtattgagagtcaccagtttcgtggtggcgggttttttctttttttcctgattgtagcatttcagggttgtaattttatttttttaatgctacattaaaatgaaatctcacacctatcttgtgtggttcgtttcaaagagaaaaaaaaatacacgcatcatgtcagccatttctccgctatcttttctctctcttcacctctgatcccttctctcttctctctccagtcttcatccctattctggcaaggttgctcatgcggctacaacacataactataacgacggtggcaataactactagtgacgagcttgaggtggctattgcagctatgatgacgagcttctcacaaagtagtgcctatgacaatgatgagcaatggcggcagtcgcaagttggggcatgcggatgccccgatctggtacttgtgaagcttggggctaccggattcgatggtagtatcacttagggatgctcgatccgacatcagtgaaactcttgagacgctagactagtggtgatggagcttgggaggttcctcctttgtaatacgtgcctagcaataattccctgcaggctgaatggataaaaaaaaagccattcattatccaagcaatataaggcaatcaaacacacccttaatacttttatgatgagcacaggaacttagaatatatgttcaagaaatttgttcctcagctctccggaggatagatcctgaatttcgttttaagagtccatttggctcaataatgtgcataaacgatgcaaaaattatggctcggccgcatacgtggccataactggcaaagagattagctttctaaatcaaactgtgggacccgctgatttattttgatgtttgtttgagatctttggatggaccgtggaggatccagagttcacactgctgccacatataattttttagaatcagatcctaatttctcattcccaaataaaccgaaagttcagctctttgagctcagaaattgatatatcgtcttgctcttctcttttcttgcgaggatagctttggcatttggtcatttaagtcctactatccttagcttcgttgctatataaaagcacagtggtacatgatcgtgactcggtgatgccaacaggcaacaagttatacgacaataacatggcgattttcaatgctttttttttctttctgaagaccgtgtcaccgtgtgtaaagcctgaccccgctggatgtttgacaaaacaagtgcttatagatctgcttatgcactgcattagcaactggatgcagactgcttgtataagctacgaattgcttttataaaaaataaaaaactaggatggtcatgcaacccaccaacaattggtcgagatggacaaataaaaaacaaaggcaaatcgctcttgcaagtgcaaatttttaaacggaggcaactaaaatctactcctatatttcaattaagactctgttcttccctcttctttctcaactcatatctctctcttttctttttttttgttacgtacgcttttcaaactgataaacaatacgatttttttgcaaagttttctatagaaaagttgcttccgaaaatcatattaatctatttttcaagtttttaggctacacttaattaatcacgtgttaataagcaacaccgttttctatgggagtacttttcaggtcactcatgttccagctgattggcgctgcatgtgtccgcacagtaggcaccttgtttctataattaataatttggagtgatctgatcctgaggaatagatctaccactctcatccaacagatcagcaggttcatcagttattttattattattattattaaacttattttttagatcttaacttgtgccgttagtccaggacaatccagtgctccatccatccatccatgtgctatttcaaatctatttacaaataggcgagttatgtatgccatcttagcaaaacacaagtaaattcccaatcccgttggttattcttttcaaaaaatggattgttgttttttttcattatattttttttgaacaattaaaataaaactccctctaaaacatatgttgtttaaaacagttgaattgacctgcgcttagtagaatttgtgtgccaaaaacgacaattaatattcaccggaggaagtaactcgtctatgtaccaactaaagatattcacaaccatatttatgaaaatcaagctttaaatcccaataggtagacttaaggctttgttcgctactcttggttcccaactctcctatctcgttttccgtgcgcacgtttttcaaaccgttaaatggtgcgttttttaaaaaaattatatatgaaagttgtttaaaaaaatcatattgatctattttttaaaaaaaaatagctaatacttaattaatcacgcgctaatggaccactccatttttcgtgcgcattgtttgggttgggaaacagacctaacgaacgcagccacctacaaccccctaccacactttcggcatttccccggattaaaagagaagggcgaagcttagtaccaggatccaataaccctggtgtcctctatatgaaaccccttattacaagaaaagataaaatcatgagaattcacaagtagtgtatggtgagcacggttcaattcctcgtctacgcccccaaagagtttgttagtgcaaaagggttttctaaggctggcatttggttgc

SEQ ID NO: 50033 - DNA, 1937 bp, Oryza sativa
aactagtctgtcactcgcagctttatgaaagataagctatacgctggcaatccaaaagaaactactcggattattgatcgctacaataagtagcgttggatccgcggaatacacgcgtaacacgaataagaatcccgtgttattatcctgtcttgtgcaattgttactattattgaaagttgtttatgacagtcggcaccagctgctggccagtagccagttcgtccattgtgacttttgcaccattataaatatcaactgtaaaacatagtggtcagtcatcactacgatgatgagatttagtttggttggttttgctgaaacattctctatgcgatcaccgtaaaaagactactccgtattaatctatatccgcagtcatggtctcatggaccatgaagtccactttaatagcgagttggtttgcagcggacatcaattctactaatcagtttccctaaaaaaaaatctactaatgagtttgctttatctgatatgcttacgtttgtcctatttttgtactaaccaccccttaaaattccgaatacgacaacataacaagcaagatcagcacccacaggttattacaataaaatactttttcaggaatgagatctagtggctctcttttgcctttagtcttgtcggccaaattcatcgattcgtgccgtaatcacgagataattccaggtggtcttaatcagaatggtttagttagttccttaacgcgggtcttacgcgccaatcccgacaggtgcagggtccatagctccatcaaaccacataattcctatatgacctgtggcatgtttatcagcagaaaacgtggcttctctttccttgccgttcccatcacaggacgaaaaagtgtacctctggcaagtcgatctcaaaagtacagatggctcaggtgagcccattctggtggccacggctgtgttttaaggtctgttagggaagcttccggctactgcaatttctcttaaaatcagaagctccctaaataatctagcttttggtatagttctgacaagctgtggttatagaatctaaaaaataaactaaaaaccagaagctgaaaaagctttttctagattctcgaaagttggctaccaaacagccgcttgttagaattttaagttcccaaaacatgcccttaatgtggttcaaactgagaataatgaagacaagcttcctcttattcttcttctcttttttttgcaggtgaataaaacatatttgcatacttaactggcatatggctggtttacagcctgcacattgcacaaaataaaatttttaaaaggttataatcgtacccaaaattgtatacataactaaaaggattccattaaccacctgcccatgcacattgcgaagaattccattttaaaaaatcttaccagagaaaaaaatcatgcagcagcaaaagaaacagttgggagtgaattttaagtgtaaacacgatatcagcttcaactcattttgagtaaagacgtgggaatttaagacagtaaactgaataaaattaatgctgatatgaaggacttattagttgagctacctctggtaagccattgaaatgtgaaaacaaacaacaataatttatgagtaaagtaaagcttttatatttgtattactcatggtttaaaaatcaaagtttaaaaatatactacgataaaaaaaaacctaaaattagctataaaatcaagttttaaaatttggctacagccagcaaacagacgatcctatgatctacgttcctgtcacaccactaatcacaatatttatccaaagatgagaaatgacccgcatcgacaggaccctttttttcaacttatcgattctagtaccctatcataaaagggatgtctccaaatcctattcagcccaaccaatctaatccgtacatcaaattatttgcttcaagcatgttt

SEQ ID NO: 50034 - DNA, 2219 bp, Oryza sativa
aaagggctagccaaaatggtctggggaagtccttcaacctttggaggccccactataagcatagcaagaccactaagttaaagaacaaacaatagaattatgtgtgtactgtgtagatgaggtaaaaaagttactttcaatgtcttttcatcctttgcccagctcctttccaaaaagaggtattctgcaaaccacatggaccagccaataacctgcaaaatgcaatcacaacattgagcatgtctgcatgcaatcaaaaccgctaagtactatatcagaagatagataactgaatgcttcgcatgtctgtgtgtctgcatcactgagatactagtgcacattacattaggttatggatctccagtaattacaaagaactgaacccgataggctgcttctccatcagatttctagcaaaagcagaacacatcttttctgatcttagttgatggacatcaaattttcttcaagattgcttcataccattccattccacattgtacagcttccataaaagttggttgcacgcatattttcatgtgtaacagagagtttgaacaactatagctatgttaccagaaacacaatgtatgttctactactagttcttagacattttgggtactgaacatttaactgccaacctactctgctacttattgctacaacctgaatgacatccacttgactgaatacaaagttcaagcatatcaattttagccacccttagattaatatacttagcggttggagtggtggaatctcaagtgtaacatatcatctaacggtattatatcaaatttgcttcaaacaaattcaccatcaacaatcatagagctctgatgagaaggaacatatgacataataatgcaatatgttatcttatcataattttagtcccaagagcaagtttaatattttattaccttctttacattttttttcaataatagctttatgcacataacttaaaagtcagcggcactagtctataagggactgaactgcaaaacaaatgttccagtaaaatgtacatgagctagctaactcactggaaggaatttcgatgatttcttcataacagcaagtgtacttccaaggcatcctgagcgctgaccacatgacaaaaaaaagttttggatgatttattatatattacagacaaatctgtatatactgaacttctaacaaaatattgcagtgtaactgatgtttcaacaactagagaatgagacctgtgccaaaatccacccaataagccaatcgatatcgctccgatgatttgatatgacaagtgcatgctcattccctacaaagattcttcagataagtttgtaacaaaataaatgacatggtgaacattgtaagcactatcaactgtgctataaaactgattcctcacccattgccttgtaagtttcgtcatcagcatgcagttgtatctgcagaacatgggttgaaattattttaggggaaaggcgaaatggcaaaaattaaaattgtttgcttcattaacatcaaatcaaacatttaatcttaagcagaatgctcaagtggcaagccggtaaattctattgtaatctgaattgctgtacacatggatcattcgcataatgtacagttagttaattagccaccagaatttgattgattatgctgtactctaattttactgccataatgaagagaaaaatgcagttggatttcaattttagctccacgggccaaattcaatcacaacagtggcagtattaacatggctgtttttccagactcacagcatatgcagctaaaccctataaaaaaaatgtccaggcatgaggcgtccagaaccatcaaaagagagagtccacattcaaacttttctcactgctcacaactcaaataatgagctctattaaattgtaacatgcacggcatacacataaatgcaataacagttaatttctgatctgaaggttctggttgccgattcggttatactgtcctaatgtgacaaaaggaagctatttcacacggatgatttgcattgcacaacggttccaaaataaactttagaacattgcgtgtacatcaaatgtgggtattttaacattttagcagaacaggtaaatcttgatacgaagtgcatatcagaaagatgctttgtcactgaccatatcaacataccttaactcctgccccccaatccacaagccagaccagctgaagccacagca

SEQ ID NO: 50035 - DNA, 38932 bp, Oryza sativa
  unsure (1)..(38932): unsure at all n locations
gtacaaaattaacccagaaatcctagctacaataatttagtaatccaagaaagaggctacaaacaatcgacgaaatgatttgcgcaaacagaatacaaaaaaaagaaaaagaaaccaaatctcgcgccacggccgcatcagatcgcctgagatacacaagggaagaacagaaaagaaaagatttcgccaccaatctagctgaggattcgggcgcacctggatggcgttgatgatgaggccggagaggaggaagaggaggccgagcgggagcacgacgagcacgagtgggaccgccatggcccctgccgccctgccctgccctcacttccaatctcgcggggccgagatgcgaagaggaggcaacgggccgaggtggctggatgctcacccccgagggagcgccctctcctcgtcctcctcctccggcggcggcggcggaggcggcggcgaatccaccggcgacgagaagagacgagacgaggaggaagaggtgaggtggggtgttggatttggagattttatagggggttggatggaaaaagacgcagtgaagcgtgtgcgcccatggttccccctcaccaggagaagaagaggatggatggtgtgacacctcggataatgattgctttttttcttcccaattttttcgaagctactcttacaatggtgtttgagatagatttaacttaatatgatgattgatgatgaaataaaggtatgaaaaactagaaaccctattagtataattaattatgttttcgttattaaaaaaaattaaaattagatttatacggtattccctccatttcaggttataagacattttaagtttggtcaaaattaaattatttcaagtttgactaagtttatagataaatatagtaatatttagagtgaatttcagaaaccccgggttttggggcacctataacacaaaacctcaggtattacgatttgttttaaagaaccctaagttttgggtcaaaatgtttcaagaaaccacatgtttaagcttatatcatcgtttttggctaatatatttatgcataataattacaaaaataataatacgagatatttttgagtatatataaatgttagcctcattttaatgaatataggtcattggtagtatgtttgtttatacctgtaaataataggttaatgtgttattattaatgaggttatgttgcgtttttatcatttgtgcaactcaagagtgagaaaaagataaattacataggatgggatgtgtttttgaaacctactaatgtaaacatatactaaataatcatatataatatttaaattatgagtatttgagtaaatatggggtctcttgaaatattttgctccaaaacatggggtttcttgaaacaaatagtagaacttggggttttgtgttacgagcacctcaaaacctggggttttgtgaaattcactttaatatttatactactaaattagtttcatcaaattaataatagaatatattttcataacaaatttgtcttgggttgaaaatgttattacttttttctacaaacttatcaaacttaaaacagtttgactttaaccaaaatcaaaatgtcttataacctaaaacggagggagtattttaaattaacttctatataaaaagattttgcacgaaatacaccatttagcaattaaaaaatatgctaacggaaccgaggtataatttatatatgaatttatatcttaatcagaaacggatggggaaatatgcaccagtaaataaaatcatacatcttgtgtatattgtgcatcttcggttataaatcatatcgtgcatcttgtgtattcagaaaatattgcaattgtaaataatagagtgcatctcgtatatttaaataagggtttacaatatcgtttggccagtaaaattcgagacccggcaagacatcgatttttcttcagtaacccttgggcatagttcgatacattttgaaagaaaatcaacaaattttgaaccaatagcccgaaatgcactgcaagacctgaatttcgagcaatatctcgtgaaattgtgaacctgaatcaaaccaatttatttaattaaatactatccagaaaaagtgggcgagtggtatgagaacatgagaaactttgtggtagcaagtgtgagaaacatgttacgttacactcgttgtatggttggaaaaaggaaagcagcaaatggattagtgtttcccacaatttggtcaaacaattctcagatgagacgtctaaaactctcaaatttgcgggcatcgttcgtttaggggtgatgggggagattggctctcgtttttcgcgcgcacgcttttcaaactactaaacggtgtgttttttgcaaaaaatttctataggaaagttgctttaaaaaatcatattaatccatttttaaaatttaaaatagttaatactcaattaatcatgagctaatggctcacctcgttttacgtatcttcccaatctcctcaatccccttctcctcaaacactccgctgcgttctttcggggagatagggggattgtccctcgttttccgcgcgcacgcttttcaaactactatacggtgcgtttttcgcaaaaattttctataggaaagttactttaaaaaatcatattaatccatttttgaagtttaaaatagttaatactcaattaatcatgcgctaatggctcacctcgttttacgtatctttccaatcttctctatttccttctcctcaaacacagccttagtaatcaaagacaccgttacgtgttatgctaatcattgggtttccaagcaaacttacgtgtaagctgatctacgatgtgaaaacgacactaacagaaagcaaaatacaagcaacatatatactgcagtttctcaactttactagttcacctttttaaacgttatttgcatgatgtcagtatttttagttttgcctcgcaaaaaaaaagtttctttagttttgttttagttatacatatgttacatttagttgtgagtaagatataaaagtggcattacaatggacaagaagaccacatgatacgcttggatcataataaaaaacaatattaacttgagctcacatgaagaacacctctagaatgtgttccctgttgacagtgagtctttttctccgattcatatgcatatactccctccgtttatttaatatatgatgccttaacttttatcctaacatttgactattcgttttactaaaataaagtatataggtattatttattttgttatgacttatgttatcatcaaataaatttcaatatgactgtttttttatacatacacgtttaaataagataaatgatctaatgccatgctaaaaactaacgtcgtcgtctgtaaaaataataatagtatatatcattggttaaaacagttcatatgaagtacattttctcacatcagtaacatgctagaggatttcagattcttttttttaccaagataaaagaaaaacagttgtcaaagtacatgaatgcccaagggggaacaatgctattagtcatcacctatgtagaggacaaaaaggttgcttttagatgtgagtgaatttaatgtcgcttttatctctccataaattaggtgtaggtatttgttggtgagcccaaaaattgagctgctaggagtatctactttggcatctcacattaaaatcacacaaggtgaattaaacaaggttctttgtgcaaatgttccttgaatgtggcatttgcaaaagggctctcatgcacgtttgttgctatcaatcagtatcaggtggttcaactaagagcttactgattgtgtcaaccaaggtcatattccaagacatgacctaccaaagatgttccattaatcagtgaatcactatttgatggtgtcatagaactgaggtttaaccaccactttgacttttacgatatgtttgatggcaacggaaactagagaaatacaaagaatgttttgtaggtttggcttttattttcttttttttattggaggcttttttttctagaacatggtttcttttttttttaaggttgttcttttactttgaaaagtgcgatgatggaggaggataactgtacctttacattactactatttcagtatgtaccaatatattataatgggccaggtccatatgggctaagaaatggtgattaataaggatataaagtattcgatatgatggttatgttacacggagcgtagtgtacaaatgcgttgtgcgcggtgagaggagggttgaaaggagaacgaaggtctgacacagagataatcatcatttgatggtaccatacactatatcataattgtggatggatccataattaacccaaatctcaaaccaactgaaaagaattaatccctagtacatagtaaagaaaaaatattcatcctaatgagcctctggtcatatactttatgcaacgatccaaatagccttgaggttcgggtccacccctagtcatagcagcatagtttttgggttcaaagttcaaatgttggggccgtgtttagttgcaaaagttttcttcgaacttccatcttttccatcacatcaaaacttttctacacacaaaatttcaatttttccatcacattgtttcaatttcaacccaactttcaattttgatgtgaactaaacacacctccaatctcctaacttcaagcacatcaatcttgaaatgctgcatacttgcattgacaaatttgtttatctttaaacatgtgcgaaataatcaaacacaacggacctcatcttttcgcatatacttgtgtttatcaaccaaaatttaaatttttaaccttaaatttgaagctgattttatctttttatcaaggcttattttttagcttttatttttatatcgctaaggacgcgtaaataaaaattttattctctcacctgaccggtggggtcccacctgtcagcctcacatccctccaggccgttactacccccatcatcaccaccaccaccactccactcctctcccctccttatccccttcgtctcccgcctccgctcccccgcgcggccacggcggccatggccaccacctccacctcgtcgctgctgcctctcctcccctccaggaccccgaccccgacccctcgccgccgcctcccgttcgccgccgccgccgccgccgcagcggcgccacctcgccccttcctcgtctcctcccctccgcctccgcccgcgccccgcgcccgcctcgcccgccgcgccgcagcggggggcctgtacggtggtggtggtggggaggaagagggagacggggaggatggggagatggaggaggagtattatgatgatggggacgaggagggggattgggaggatgatgatgcggaggagggggaggagatggacgtcgaggcgatggaggaggaggccctcggcgccgtcgccgacctctccgagcggctcagccgcgagctccgcatcggtgagtggggggtttcagcttcgattcgctacctccgacatggccaggaaagtaggaaactagttagtgcttgtgaagagatagtagcatttagcctaaagtgcataatctagtgtagtagaacaatcctgtgtggaattttgagtcaatccgtagttccgtactctggtcgtggcggggatgttcgtataagatcagatggatatgctgcttgttgatgatgaactgattgttgtgccgagaatcatgatgatgcagatcaattgatactttgccttggagcatgatgtatgagtttgggaattgcagttccctgtatttctatatttgaaagtttagttgttagtgcctagcgtcgcaaagtttttcaagtacagtatttcttcggttttctcctttagaagcctgttacatacttacattgactttgtttagttcatgggctaaatgcgttgtgtcttcagatgacgatgttcgggataaaagaagaatcatcagggataagacatcagcatctaaacatgtaattatatcttcgtattcttgtaaattgtaaccctagttgacaggctggttaagaaagtgcaaatgtaaacaacttctattttctttactattgggtccgtgattcagataccggataatcttcttccaagggtggcaataattggaaggcccaatgttggtaaatctgcattattcaatcgtcttgttggggtaagctatttacagctacaaatattacttgagcgaagagtcagcattgtgtgtaatttttagctgaatgcagaggctgctatggtgtattgaattctggtgtctcacagggcaacagggctattgttgttgatgaacctggtgtgactagagatcgtttgtatggacgatcttactggggggatcgagagtttatggttattgacactgggggagtgattactctatcaaaatctcaagcaggtgtgatggaagagcttgctattacaactactgttggtatggatgggattcctcttgcctctagagaagctgctattgctaggatgccatcaatgattgaaaagcaagcagttgctgctgttgacgaagcagctgtgatactattcatcgtggatggtcaggcaggttcagacaattaccctttttttaatttgatcatttcattttctggattcttctgttatatttggtagttctgatttttagcaacactttctactgcaatagttttttcaggaatacacaaaagttttgcgtatcattgcctttctactgtaatatgaaggaatcaattttagcacctggtcctgccaagtgatggactgttgattacatactaaaatccaccacatttacaattgctccaataatgtcttgtagtatggtagtttttgtacatgtggtaaacaaaggcatctagagaaaaatattagatattcctgttagcatgtttcttgtctcattctctttgtgtgatttctgtctgaatcttctattgggtattgaagcattccttttccaacttctgcatgctgatctattaaactttttaagcttctggttattttctacctggaagcagacttacgtatatggattcttatttaacctagctcatacgtagaaagattgaatgtgtgtttatagttgctagatttgataaacctcctggtgctgaaatttttgttttgtctagtgcctttgttgcttcatgcccctgactaagttcattcttacatggatttgcattacttgtagctgtaattccctattgttgtttttcggtactgttgattgaattagtgttatgtagtgtcttatctaacggaatgggtatcaaaaatctttcaggatggccttgtggcagctgatatagaaattgctgattggttacgtcgcaactactctgacaagcatattatacttgctgtaaacaagtgcgagtctccacggaaagggcaaatgcaagctttagatttttggtcattagggtaagttcaacacgcagtgaccccttgctgtaattacacaacactcagttcatttgcaattaataaatattaaatgatgttctgttgatttttctttttttacattttacgtacagtttgtattaggtctgacatattcttgtgctgattaaatgtgagaggccacagacttgatgatattaggtaaaaacgttactaaagcccattgttagatgcgaaatataaataatggacaactagtttctgagcttttagtggttccacatgcaagatctctaaactcatttcactagcatcgctacaagttaaatgtgcttttagtatacataatctgcattctgcaatgctttacttgtgctctgactctgaaacaacccaatttgttaacgattacctcatttcttttattgttcaccactcaacttcataagaacagaatgcctattggctgctcaactcatcgttctgttgcttccttctagattttctcctctgccaatatctgccattactggcactggaactggagagctccttgatatggtgtgttcagagctaagtaattttgaggtactgaacttgcttagtttgcccagaggccagggaatgtttaattgtgtatgtctatatgcatgcttgatacccttttctgtttatggttggtaatggaatcattattataattttttgttgcaacactaaaatgttactcttggctgcggaaacaactcaagtattgcttctgacaaatggatatgctaacttagtggaatatttcactctctttcctccagtcctacaaacctagatgaatactgctagaaacacgtggtgtggtgacaccttgttatatccagcctacccattgagcttctagatccagaaccttgaatcataagttgtggtgtttgtcttttcagtagttctttaaaatagccttctcctttccaattttgattcatatatggaaatattttgtccattacctcacaaaatgttttacaggaactggatggagttgaagaagatggaaactatattcctgctattgccattgtcggaagacctaatgtcgggaaaagtagtattctcaatgctttagttggagaagatagaactattgtgagccctgttagtgggacaacccgtgatgccatagataccgagttcaccacagaagatgggcaggtttgttcagaatgcttatgaaagtttaagtgaccaagagcagcatcattatttcattattgaccctagctatgtccacttttcatgcatctttcatctttgtagcaaaacacaatttgaattggaagaaagaaatttacatctcataggaaagtaattctaatttgctgatattgcaatatgctgcagaagtacaaactcattgacaccgctggcatccgacgaagggcagcagttgcttctgctggcagcacaacggaaacactttcagtaaaacgtgcatttcgtgcaatccgccggtctgatgtggttgcccttgttgttgaagcaatggcctgcattacggagcaggtatctctaccccatcacatgcacatgtgcacccccaaacaattcaaagagatgttgtcttaccaatcttttctaacatggtgaatttctgtggtaccaaggactataaaatagcagaaagaattgagaaagaaggaaaagcatgtgtaattgttgtgaacaaatgggacacaatcccaaacaagaaccatcagagtacaacatattatgagcaagatgtaagagagaagcttcgcatactcgactgggctcctattgtttattgttctgcaacacatggcagcagcgttgacaagttaatcccttaactttattttttactccgcaataagcatttggtacttcactactatagcatttgatggtttaagctaggctatttgtagcttgtcggtgttattgtctattttcctgcataccagacctgaaatttaagctgatgtcattaaggcattaactaatgtttcatgctgaatcttcatgttcctctgttatctcccaatttcttgtaatccaactaattgcattgcatgtaggagattgttaacttcactagatatgtttttctgtattggcattgtaattattctttatacacaaatattcctcaggataatttctgctgctgcactagttgaaaaggaaaggtctagaagacttggtacgtctattcttaatcaagttgttagagaagctatagcattcaaaccaccaccacgaacaagaggtggtaaaagaggtcgtgtttattacacaacacaggtagcttctaacttcttattgaaccattctgtttattcctcttaagccaacaagtttatggtctcacctttcaagtaagtcgtaaaggtcactagcgttctcttgatctctactacaactaaattttcacttccttgtatgtcaagtgaagtccttaaatcaaatacagctccttaattcatttttaagtatctgaagatatatgattgattgaaactggatcccttaaagaagtatttcaaagtcagcaaaggatccactggttacccacttcaaagtatatttgatacactcactgtcctaagatagagtagtaatatgcattctgcaatattatcagggccctttgaaatccgtactgcttttagatttgtaaagttcaccttggggaaatgttttcatgctttccttttattttcgcaccaaaggaagcttattcttaacctgcaggctgccattcgtccgccaacgtttgttttctttgttaacgatgcaaaacttttccccgagacattccgtcgttacatggaaaagaagcttcgctctgatgctggattcccaggaacccctattcgtttattgtggcgtagcaggaagagaccagataaaaaaggtgagtcgatatcaaagtgcccacttgcataatctcaatgattttaactgaataatttttctactatcatacctgcatgcatagaattagaaaagattattttgtgattgaatcattgaaacagacagaacgacaatgctagataagtgaaaaaacacagaaggaacaaatattgtgctatcagcaagagagatttttgcagtcccattatatttgatttcaccaatttctatgatatatgtaggtgtaccgtgcacatgataggttaaggaccttggtccttgtattagaacaaatataatgctaatatctgctgaggcttgtagcatcaaggtagttgaccaaagtaataagaatacaaaatatcatgtgatgatagaacatatagaaaaactatttaattgatctgggtatatccaacaccgctatgaatttcatattaggagtaatgttttgtgctctaccatacctgctgttataagtcatatgatgatgaggttaaatagaattgtcatactaattactccatctgttcttggcaggtaaatctgcagacaacagcttgcagagctcagtaatcccaagcagaatggcgttagccacatgagttacacatgcttttcctttcttgagagcggaaaaagggagagaatacagaatgctttgcctgcattttttcccaagaggtcaagactgccggtaaaaaaagagtacaaattgtatatgtagtggacgagtactaggactggaggtcatctactaggtgttgtgactacatggtgctagtataagttctgtatccttggatgtctaggannnnnnnnnnnnnnnnnnnnnnnnnnntctgacatttgcttgtgccttggacgaatactgaatagtactctctccgtttcaatttcaggttataagaagttttgactttgatcaaaatcaaactacttgactaaatttatatacaaatatagtaatatttataataccaaattagttttattaaataataattgaatatattttcataataaatttttcttgggttgaaaatgttattatcttttactacaaaattagtcaaacgtaaagcagtttaactttgaccaaagtcaaaatgttttgtaacctaaaatggagatagtagtatattgcgtaccggaatttgccacatcggtgcctccacatttttttaacgtctcgcaacaatgcaaagttcatattcatattgatagagtaagaaaaaaagaaaaataacccacacccatgcaccgacagctccaacccaacaaacctaggagaaaaggctagcaccgaactggttgtcgctatgcatgaccagtcgctgctaggccaacaaaggaactatatccgagaatgtccaaaatctaaccctaacaactgacaccaagcccactctagccacctcttgagattgagggagagagggggtgagagagaatgttggaatgctttcccccctagcccttcgtcatgtccaccttgcataagctagagcgccgacacaaggggacatgcatctagagcaagcttacaccagttgtctggaaggattcggcaaggggctgcctagataatgtctccaaggagaggagcaaaggatacaccgctgtcgtcgtccattaaagtctcaaagagagccgagactgggttttcactcggcagccccactggaggtgaaggggcggcacgataacgccctcaaaaggtagagacgttagggtttagaaattcatttcaattgatttaatttacctttttatttggaaatatttaaatattcacctcgaatactccagtgaccgcttcgtgcaccataccgaccgcctcgacatctcgaacgatccagctcagctcaatctcccgaggtaacgcatggcgcctcgttctccccgaaattacgcctactcgtattagagcaaggtcaatagtgcagcccactactagctccaaatcgtctatagccaatgtaatagccaattcatataatagttgcttactgtactattaatatctggtcccacatgtcatacacacattacgtcttggagtccgtgctgcagctggctacaaatctgtagcccgctcctcttctctctcttcctttatctctttaaaatatgtttatagctggcttatagcctgctattgtacctgctcttactactcctacgattcttttgaccaaatattttccaccgtccgttggaattgcagtcactgacaccctgaccccacacgcacccttacccctcctgtatatataccccctctcgatttcaccatacgttcccctccccctccctttcactttccccatctcctaacaccacggcgaagatgcaccgtctccgccgccggccgaccggagagcacggcaccttctccgccgcgcttgcccgccggtggctgccgcggaagacctgttcctttctccggcggacggcgggcgggccttccgcgccgtcgacccgtccatagctccgcctccgtgatggcttgtcgtgtcgccggcggcggcggcggcggcgggggtggggtttcctccgccgcttcgtctcggtggcgaggccgacggcccattggggcccaatggggaaggcccatcccccgtggcggcttcccggccacgccaacgccttcttcttctgatgaactctccctggcaactggggcccgcaccgactcgcccaacggtctcccccaattttcgcctctcccgcctctcctctcttccaactccgacgagcggggccaacgccgatcgccgcgccggagcagggctagggttccggccaccgccaccgccagaacggtgcgtcgcgtcccgtccccatccttcttctgcttgctttccccccgttgtgttgcgctgtgtttttgattccgttgttcttgttgattttcttgcaggaatggggggttcgttcggatggttggagtttctcttatcgacctcgcacccgtgcgaggatgatgcggcggaggagcttcccgtcgagccgccggtggcggcgatggatgccgcccatgacggccgcgatgaggtgcggggagaagtcccctccgagccgtcggaagtactcgctggagaggaggaggcggcgatggatgccgcccatgacggccgaggcgaggtccggggagaggtcaccttcgagcgggcgatcggtgcctcctcccgtgcgggttacgaaggcatcaagctgggggaggagccctccctcaaaccggcgatggtgggcgcgcccgagattaagatgatcgagatagcagaggcctcctctgttgcccagtgggacttgttggcggggacggaggattgcagccctgagattaacccgaagattgtcgacctccagcagcagcagcaggaggcctctctccttcctgatgaggtcatctctgaggcagacgcgtcaatcttggcgcagtattcatcggtgacaaagaaagacgatgatgctgagttcttgatttgtcggccaaactttggttttgttacacgaccacagcaacacactcccaagaaacggcaccccaagaacaagcgggctatggggattaacttggtaagatgtttaaagccaacactatttgtatctgtctgccttctttttggacatggaatttatactgatttcattattgatgtttcaggctaagtcttcttgttcttactgttttcacttatatcttgtattccagataatttttcttgatggagattgttgtatttagtagatatatgttattctgtcttgatggagattgtcaactttcatagacatgttattctgttttgatggagattgtcaacattaatagacatgttattatgtctagatggttattattaactttaatatacatgttatttagtgtaggcattttttttaatatttatttttgttttctctgttttcttaggttactctacaatctacatgtctaacagccattgataatttatattgtcattgtgttttaattaaattgatattttgtggtattgtgttttgtagtggttaatctttaattgttaattcatttctttcttcatctctgatctagtatgaattatcaatggtgtaagcaagatttgtgctgtaagcctaattgattttttccttaacaccagacttaactaagatattagctttatatttttcaatgcgattcgtgtttttgctctatatcttaactaatatagatggtggctctgaaataaaactaacacaagacaatcttgtaacaaatatagttcgtgcatgctttgccatattattgtagggattaaattccatcagagcttttactggttgattaatactgtcaatagtattgtatataaacagtgaagattaaggcaagtaggcaactgattttgttgatttaaattcactgagctttgcttttctgatgtttatatgtgctgccttgtgcccatgtctttttgctagtcctggacactgcttgctttggcacaatgcattcatacggcccaatggtgcagtcatacctttcccttgttgttaggcttagttcttaatccctcaacgtttgttgtacaggtttcgagccaaataaatgtttgcttgttgaatatgccttgaataattttgtactattattaaataatgagtcatcttttggttaatctgcgtttgtttgtattagatgtgtttgtacatattattgatattcagttattgcgtccaaaaacatgatattcagttaatctgaatttatttggttcatctgttttactatgggattgattaccattcatcgtgaaactaatgtttgatcttttgtttttcagttggatcgagagggaaatatctgcagtgatgataagcttccaagtcagggttgcttggttggtgaatacaataatcttttgctgcagttgtatcagctgctgttcgatttaaaagagctaatggagctttgtggccaagctgataagatccagagtgaggtgttccttaaaaaggcaatgaaaaaagcttgcagagattctgatgatgctgttgcagacatagtgtttcaggccctaaaggtagatggtttcattctgaggctattaaggtatctgaagagccaattcaatttttgccggacccaggcatggaagataaggaatgagatattgagaattggtggtacacccatcaatgatccactttccaaagattctccttgaactttttgcttctgggcccttgaaccacctccaatatgggacgttgttctagaatcattgagacatatgctcctgattaccacatattttgcactttggcttgtggtggtcgtaattgttttgtgctaaatgtaatcctctaacaggctgaatgtgaaacggtcagctgtggtactgtatatagacatgtatccaatctgaaatgctttgtatggttgtatacctggatggacatatgcatcctatggatagctggtgcccagctgtggcaatatgctcgttgtatatgaattagcacagagagtggtgaatatgaaacttcctgttcttgttgatatttcactttatgttttaaattctcggcatcactgcttgtgaaattgttgaaattgtcctggttattcttggattataaatatctgatgacttttttgtttctgtttctatttttctataattttgaaatgtaataagccttcggatatttttttaagggccctcttaatttgtaaagtcttctgtattttgtgatcataacaaatttcttgttcgcggatcggacaagttgtccaatctttttcaactcgatgcattgatgtcagtatgtttggttgtggacagacaccgtttcggattggatatcatccgacaaccttggtcttcagtgcccgtgtctcgtttgctttatttgtttcggacgtccctgtcgcttcgactccgattctgttaacttcaagcgtgaaggccctatataatgaatgcacttgttcgcttctctctctccctctctgtcaaaccaagatcgacgctctggttgctttgttaagtctgcacagggaagagaaaattgtacgagttaactgatttgggcaatggaaacctcaggctctgacgagatgcagcagggcgtaaaggttgatacgactcgggtcatagagaacactgctagcaccgtcgacagcgagacgcccgtagagcaaaagaggagaaagaaggtggaaacggagtatgtcctcggtgggaaggatctagagtttatcttgtcatacgaggacgatgaacttgagacatttgatgaggatatgctcaaggaccaggcaatggtccggcaacagattgagaattttggctatggtttcctccatagctggagggaagttatctgcactgatagtgaagaagaagatgaccccgtgtccgatgatgatgatgatgatgaacaagatgacttcttcaccaatgatgatgatgatgaccagcaaaatgtcgaccaaatggataagaacatgtatgctgaggcctgaggggctaaaaagctaaaaacgatcacaatttgtacttttcttacaatatatattgcatgtcttaacttagttattcaattgattcatacctaaaaaaaataaattgatttattgtcgtatatataactagatctgatttatttctagatatattttgttcttcatattattaaaacttggtgattctttactttttctcctaatttataacaatattggatatttatctgttggataaattctcctgccatcttcccctgaaaaaaaatatatgttggataaattagtttatagcatctactaatcctaatttgctatagatagcatcgaaaggtttggctcactttaatagtaccaaaagttggaggcgcctataaatcgggcgcccgatttttttatcaaaagtttcgaaaccctagctccccgatagcgacggcggcgccgggcatgcctcctcgtcggttgcggctccacccacttcaggaggagaggagagagaagagagggggtgaaaataatattaggagagtagaggaggtgaaaaaaaattgaagtgctaagagggaaaagagagaggaaggaagaaaaaaatgtggataattggggtattttcgtaagtgaaaatatgctcatttttacatgtggcctcttaagaggtccgtttgcgaaaataaattttaaatacgggtctcttaaggagtcgtttatgaaaatagagatcattatttagacccgatcaattacggttcgcttgcaacttattagggtttatgtacggaaaaatcgtttctacaatagtgaatttttaattttaaaaataaagcatacttattttaaatctaaacggtaacagtacggtttgaaaattccagctcacgtcgactgtatatctgcgtttactcggtctcacatccgacggaattgattccgatcacaaatcaattgtttaatcctgttctattgagctaatcagattctggtttggttaggtatcctgattctgttaagttaagccaacctgattctgttttgtttagatctaaagatggtctaatatatactacctgcataatcagttcctgctaatctcaaaagcaagaaccgtgactactccagactccagcctagcgagaagagagaaagagagagacagactcagaacagtgacaatttcagatttgcaagaagagacagcaggagtaagccaaccgattaatcgatggaaacattcagctgctccgaaaaattgcagcttgatgcagacgttgatactttggttgtcgaaatcacagccaccgtcgtacacaacgggctagccacgaaggtgatcgagaaagaagaggagaacttgaaaaagaaaagaaaatgtgtgaagaagatgcatggtggagtttgtcattgatggtgatgacttggagtttaccttatcatatgaggaagatgaacttagcttccttttcgagaaaagcaatgagctcatgctaaaggatcaagaaatgttccagcggcagatcgagaattttggctatgcctttatccatggtgtgaaggaagtcatcctcaccgatgatcgatgaggacgaggaaggatgcgatatcttaagtgacgacgacgaagatatctccatcgccagacaccctaactaggacgatttaaacaccatggatgtgacaactgacaaatactcattgatgaatacaagttagttctgcatgagaatgcagctagtgatctgtttctaatatactactccgtttagttccactgatttggtattttgcatcggttcttcgtttaatgtgcttcctgctcccacctcatcgcctcaggatgcagctagtttaggctgtgcttagttcctcggtcaaaaattttttaagtacacaaacacacatttgaaatattaaacgtagactaataacaaaacaaattatagattccgtatgtaaactgcgagatgaatttattaagtctaattaatttatcattagcgaatgtttactatagcatcatattgtcaaatcatgacgtaattaggctcaaaagattaatctcgcaatttatatgcaaactgtgcaattggttttttttatccacatttaatgctctatccatgtatcaaacatttgatgtgacggagtttttggaagttttgaaataaactaaacactgccttagtatattttcttaatttgtaccactaaacctattagtattatttaatttggagataattaattaagacggacaaaaacaattcggggaacaattgttggtatataaaaatagtaaagcaaaaggtgttattaagccctactgattggtggggccgtaaaaaatgtgggggggggtccaaaaataacaattttttatacagatgcttatatcatccacacgtaaaaataaaaaaaaaattccctggaacagaagagccttatctggaaaaatagtgctatacggatattctgctcttttctgtttatggttgctgatgaaattgtttcaataaataggtattataaggatatcatgataatttaatttttttttgagaattacacagtataacgcagacactcacaacgcgcgcacttagatcacccctatgaacacacgcacgcaaaccctacccctatgagcatcttcgaagactgggccgggaaatcctggagagattaacgaagtcaccgcaggcgcctcgctgtcgacgggtacgtcgcctaccactgaaagcacaacgcctctttgaagactgggccggcaaatcctggagagattaacaaagtcaccacagacgcctcgctgtcgacgggtacgtcgcctaccactgaaagcacaacgccgatatatatatcctagaaaattcactcccatggtgagtcgaaaccaggacctcaggtgctactaagactcttgtaaccactaggctatttttttaggttaactggacacatgccattacaaattgcctatttagaaaaacaccattactatccatcgaatcagtcggatgccactctgctcttctacaattggaaccgtaccactccgtcatgggttgacagaaaccgtgacggaatgacttggttccaattttagaatagtagagtagcatctaaccgattagtaatagtaatgatttgattttgcttttctccaatcctacaaaactgggaagcattgttctgcttagataatctacactgatgtgacaatttaacgccgtttgtgtaagttattaaaactggtcttttttttttcagttgggaaaagatggaaaggactgtagtcctgtgaaattcaaaaacaggatgactttgttaccgagttaaacaatcatttgataactgtttaccagacagcactcaagattagagaaatgattgaattgtgtgagttttacgcaaatatgtcaaactccaagaggaatgccattcctgcaaagatgctgaagaatgctcactgtcaggaagattttggtgtccttgatttaattgaccaggcgcagaaaaatgacaagtttttttttgctaacattgctgtgaaattgaagtgtttgctgggacgtctttgtactgcaggttacaaactccggctgataataatcaaaaacaatggcaggcctatcaatgatccaatgtcattagattctgctagctaggtagctccttatgattggaagtagtcctgggaatgctcttcagctttgatttggaatagaaaacaatgatagatgctcagtctccttccttaaagacctgtgagatcttcatattttctatttccctcttgtgtgtacaatcttctctttgtgttggtacttctgtttttaggtgcaacagatgtttgatgaccagtgcaatttgtattcgattttgtgtaaagctgcttttaggtgtagtgccattgtctattgttgcttgcctggtaccttgtgaattcttggtacagtatgatgatgagaaaataccagtataatcatttctggccttgaagatatatttgtttctgagtacttgtagtagtagaactctatgttgtgctgggatgtttggtgttcctaacttcgttgtgtagagctcgtgttaaattggtgtattctcctggtcatgtgttcagatcagtttgtggattcatattcaatcggtgaattgatataggcttcagactatatattcaaatcggattatgcttcggacttcgttttttctgttccactgttcctccgaattatgtcgtactggtgagaaagatcgattaaattagttagtagtggattaatttaattccgattctgttcaacccagtctcaagttctttatactactactacttattgctttctggtcgctgccccctgaaagcaagatcgacgcgagcgtacgtcacaaacgacttgcgagaagataaactgcaggagcttagctgctcgatcgatcaatgggagcatcgttctcctacggacaaacgcaacgggtcaccgagaataataatgccgctgcctccaccgtcgtcgccgtcgtcgatgcgccgggtaggggcggatccgatgtgagttccccctcccaatcaattctagatccgccccagacaccaggtctggagcggggcaggggcggatccaacgtgagttctccctcccaatcaattctagatccgccccaggcaccagatctggagcggaacaagaggaagaaggtgaagaagatggtggagcgtgttatcgatggtggggatctagacttggtcttatcgtacgagaacgacgaagaatgtttgttaaatgagagcatgctcgaggatcaggaaacattccgtcaccaaatcgagaatttgggctatgcgttcatccatgtcatgagggaagtcatcctaaccgatgatgaggatcaagaggaaggcgaaattgtcacctatgctgaggaggaagatgatattgttaccgatgatgatgatgaggatgattagtaattaagcaacgaggaaggggctaacaacatgattgaaaagggttcagaaggctaaaaaataacaagtgatcgagtaaagcatctatgcattttagttacacacttacactacccgtttcatattataagtcgttttgatttttttttctcgttaaatttatttaagtttgatcaagtttataatttttttaacaatatctataatgttaaattagtttcattagatgtaacattgaatataatttgctaatatatttattttgtgttaaaaatattactatttttttacaaacttatttaaactttagtttaaatagggaaaaaattcaaaatgatttataatataaaaaaatggattagtatattttcagttagttcttcaattgatttgctatatggtggtgtcgagtgtgatagtgaaatcatgggtgcaagattacttcattcatttatcagcgttcaaatcccgatattcatccccaggtaaaccccatatataagattactgtaggcattcttgattggtccataggttaaagttatgtactccctctgtttcaaaatatttgacaccgttgactttttagcacgtgtttgactgttcgtgttattaaaaaaaatcatgaaatatgtaaaactatatgtgtacatgaaagtatatttaacaatgaatcaaatgatatgaaaagaataaataattacttaatttttttaaataagacgaatggtcaaacacgtactaaaaagtcaacggtgtcaaaacattttgaaacggagggagtatatatacttctattcattatcttaaaaaaatatatacttgtgaaaaaggaaagattcagttattacggtatgcaaaattccccaccttgtcatttggcgtgctttctgctcccgccttcgacgtcacatatcacgatgcgcttgcgagactgaacaaattaagctggagtactatattatcatgttgtttgctgcacgagatcagatagatgcaccgcttcatcgatctgtttcgatgaatcgcgcgccgatcgagacgttgcccgatctccctcgtgtgcaaatttcagctcaagcactgcaaatccagtttgcgaattgcctgaaaaatttgcaaattgagctcaaacactccgtgtatagttcttcaaattgatttgcgctggcacgtaagatgtttatattccccagcccgcttccgtcgttcatttgacgtattccttgctcccgcctccgacgccaccgtacatcgcacggttgttgatgtaccggatgcatgaatggcttggtcgctctccctctctccatttcaacccaactgcgtgaactaaacttaatttgagcgcgtcagatatcaagctcctacttgatatcgagccggttagcggcaaggcgttggcgtggtggccgcgcgttgaaggtgtacagttagtggtggccactgttttcagaatgcaacggcaacacgagaaggcagattacaggcacaagtccaaccttgttgggccagcaacggcgatgcctacatacactgctttcccattggggcgtttttacgtgaactttctcaaccatgccacctggatacaagaacttctccgaggaattacttgcatgtttcctcgtcgatcggctggatgactacttcgctagaaagaacaagatacatgacaagcgcgtgaaaccaatcctggagttggtaaaaaaaaccaatcctggagttggtaaaaaaaaccaatcctggagttggtaaaaaaaaccaatcctggaggagcagagaggatttgcaaggagtacaaggaggaaggctatgccgagtactggatcaccgacgacgaggacgaagcagccactcgagctccggcgccgggacggaggaggggtcgacgaggggtcatgaataagaagcataccggaggaactaagaatctttaagtgaataatagaacaaagtttagagatatctgtgcactcgatgcaggtttgagagcttcttatgtagtactcccttgcattttaatgtatgatgtcattgatttttttatcaacatttgaccattcatcttatttaaaaattttatgtaattatcatttattttattgtgatttgatttattatcaaatgttctttaagcatgacataaatatttttatatttgcacaaaattttgaataaaacgaatggtcaaacgttggtaaaaaaatcaatggtgtcatatatcaaaatacggagggagtaacaaacatctggtgatcatctagttaaaaggtagcccgcatctcccaagtgttgttttcgttgtgctatgttggatggttagctagtataactaagtgcagtagttaagtgcttttacggttcttgagagttccgatactttatagtgtaaaatttggtatctaccgagagatactaaatttgcgctcaaaattttggcacttcttaatatctcttaggaactataaatatttcgcagtagttaattcaatttgcgctcaaaattttggcacttcttaatatctcctagtaactataaaatctttcgagtagttaaatctctaatcattgagaaaatttaatttgtgcccttaaaaatttgctcaatcccttatgtgtccatcaaattttgcctcatatcttacacgccatcgagttttcatcttgatcttctctgtactcattttgctggttgaccagcaatttttttttcaaaatgtaacatgatctaagttgaaaaaagtcattgtaaaaagcaaaggggatagaattatttaaccacaaatttgaaaaaaaacacaaaattgttaaataaatttcagatcaaccttgatgaacttcgttgaacattttcaacaaaatttaaacctaaataataaatttaaacttcgctgaaacaatttggtaccgtgaggtacggtatctcgagatactttttgatgtactggggcatatctcttccctacactaactaatgccaacacatcatgattaatcatcatatctttctaacgcttcctcctcctgacaggttcttcttcacggcgactccattgcggaaccttctccggctaggggagcagcaactcgagcaggaactttattgtctttgtcgtcgtcgtcgtcgtcgatgtcgacctcgtactcggcatagcctttggtgaagtactgcctgaggatcccctcccgttcaccccggatttcgttctgcatctttatccagaaagccttgtcctcttctcggctgtcgtcgatcgccttgagttcatcgatgtagtcttgaggacaattcgcgaggtcgtcgccgaggatctcaatgatactcggcatgttgtcgtagtcgggcatctcctcttccttgtacgtgatgcagttgttgatctgcgcttgggtaaaccgcaccatcttcgtcttcgccttcttcttcttcttcttcttctccatcaccggcgccttgccttcatcggaggtaaccggcgccggcgccggaatttgtccgtcactttttttccccgagggagcttcatcggaaggatccatcgttgtcgatggaatttggctttgatcacatgttcccttggatgtgctcgccattgtatttcacatgttcccttggatataggctcttaatttttatggaagcaccgggtcgatcagaaataggtaggattcgggatcacctcgtagttcaggttcagcaggagtccatgagatgcgcgactcatgttcgactctgactcttcttctttcatggtggatttgccgtacgtagttcgtgcgtacggatccggccctatggcagccagcacgcgcggccgtcgtggttgacgccagcggcgccgggacgctcgagctcgctcctaacggagatgactaacccatctctctcgtttttcgtgcgcacgcttttcaaatttctaaacggcgtgatttatacaaaaagtttatatatgaaagttgttttagaaaaacatattaatccaatttttttaaaaaagttaatgcttaattaatcatacaataatataagcttcgttctgcgtgtcgggaggagtcccgaaggtaatttgacatgctgccatgcatatgcaccaactacaaatttagctagtagatccgggtcctcctgtgcacgcgcgcttgtctaccgcgtcgtgcggtggtgtggcggcggtgcgacgcgcgcagccggaagcgcggcgatgcacgcggcgcgaatgtcgtcggtgccgtggtcggtgccgagcgcgcccgcctgcgccgagggccacttcacccatatcctacgccgataattgctcggctatttatagtgtagtcttaaaactactcaaagtgataaaatatttttaaaaacaacctattaagtagcattttattcttgtcattttaatgggtggcgttttgtcgaaaccacgtgaaaaaagagtgccatattgtcctttttctccaatgtttggtatgccgggcagccgggcacactcacagtcacagacggcatcgaatccggaacctattcggttcggagtcggatacaaaacaaacgggtccgacgattcgcggaagcgattccgaaaccgagttattgttggagttgcgcttgcgctgcctatatatattccggcatctacccgaacccgataactctatcgcaatcgggtcttgggcctcaatcgagaggagactcaggggaacaattcatcaggggcgcagctggccttgccttcgtgggcttaggattagatgccgcaccttttttcattcagatgttgtgatctgatgcgatgttgtatcattattatcatacaaatgacttagctctttcggttcggtttcaatggtgacggaatttcaggcgtcggggtgatggatttctccaagatagaatttagtgaggcgaagcggattttggcggcggcgctactaacctccgacgacgaagatagcaagcctccgacgacgatggagaagaggaagacgaagatggtgcgctttacccaacagcagatcaagaactgcatggcgttcagtgcggacatatccgacgacgacgacgaggaatccctgcccaagctctcggaggtgctcagcaaggatatcctcgatcgggtgccgcccgaggttcttgacagcttgatagagttcgagaacacccggggagagcgcaaggctagatgggagaagctacgggacgatcttcatgaggaacgggatgctatcctcaaacaatactacacgaaaggctacgccgagtacgaggtctatgatgacgaagatgatgatgaagatgaagataataaagttcctgctcgagttgctccccctggccgccgcagaaggttccgcaatggggtagccgtgaagaagaatcggtcaggaggaaacattagaaagatataaactgaatgatcatgttcagtgttggtccatatccatcttagttgtagtgtagggggaattatagtttctccttcatttatcagtataataataacagctgtgctactctgtggtttgactatagttctcttttagattcctgctatggtttgattctagtcgtgctatgtttttatcttggtcagcattgatctatcatcatggttcagggaacctgaaagtgacctagactgaagtcacagatcagtagttttgttgactgctctccctgagataatttcagtagtagttctgttgactgcttttttttggacacctgaaaaatgttaggttataatttggaaccccttgcaaaaagctcgcctgaaatatgttaggcctaatttaaagaagctaagctgatctctgttgacatgttttctcctacattattcagagttgcatgataaggattccaatggactaaactttttgacattgtcatatgagaatggcaccctgttaccatctgtttctccaaatgccaatgcaactaggatcaacaccggaaatgaatgagtcaggcaggcagtgtgcttgagacaatcagacataatattttcagtttagcttcgcatacattgagttggttcccccataattaatataccaggtcttagttggtccccatagagtagttatcacttactggtatggtgcccgtgcgttgcgatgggacaataaaaatatatgcacacggggtaaaattatgttaaatagtttgagagtacgtatattgtacacgatccctatcacatatctcccctataaatacattgccattgtcataaatcatcaccaattcacgacaaacaggatcgcgattgccctttttctttcctgttcacttccttttgaaagcaaaacacaaggaaccatgatcagctccaagaagcaagctcagtttcctaataagtggcactgaatgggtgccatcaactccattgctgactacttatgttcacttgtaacaatcttctggacaccataaaaaatcatgacatagtcaacaatcttctgttcaccaattcacgacaaacaggactttatcttatcatacgaggacgatgaacttgagacatttgacgaggatatgctcatgtaccaggcaatgatccggcaacagattgagaattttggctatggtttcctccatagctggagggaagttatccacactgatagtgaagatcgaagaagatgaccccgtgtccgatgatgatgaggaggaggaagatgacttcttcaccaatgatgatgatgaccagcaaaatgacgaccaaatggctaagagtatatatcattggttacttctatactataagtaaacaggtgggtgctttcatttgaatacgaataattagacatagctacattatctgcttctatcgttcgtgtcctccaaagaactgatcagaatagtagtagcacacgctgagttgcaggtaatttcaggaaggaaaaaaaaaaaccttgggtcagaccaccgttgtcactgtggggtaaactccagaagacagagaaagctaaagatatgtcctaggtatgttttctctaggaaactagtactttaaacatgaggtagacgtaggagataataacatcaaaaccaatagcacttattatattatttagttgtatctggtagaagaataacaaactattgctagagttgacaacttttttcttccttaggaacggatttaaccgatttgcatcctattaaatctttaggcttatagaaatgatatagccaagctatatcatgacaaacggtgataatctacggcttgaggcgcctgataaaacgtgtattttatattgaaaaggatgttttcgttcagatattgtgttagtattttaacagtgttgctgctaatgctgatctgttatgctaaacaagaaatattaaaccaaaaactgataattgagattgagttccataatccaacacaggaagatactacgacaactagtaggtaaatcttaaaaaaaaaaaaaaagaacgactcgactgctaatcagcgaagtgtatcagcacatcgcttagtagctaattcagcttgttaacttttcctccattgatggaaacacccggtcgaaaccttctttgaccaggatgaggagcagggaaatcttcagcgcctgcaggagaggattcttggtcgccagcaggtaaggtttcttctccatcagcttcaccagaaggtaaggtttttctccatctttacctgcagatcgattcttcatcttcacctgcagcttcgtagcctttctgataagcgtctttctccacatagcctttctcatagtactgtttcagaacattgtctctcgctctcatatgccttgattcaatccggtttatatcacggatgatcttagcaaagtattcatccatatgatccccaaccttaaccatcctcctcacgaaactccacggtttggtaccggatgtggctatcaatctcggcttgagacatcaactccttcttcgtcgccgtcgtcttcttctttttcccttccgacgaactgcctgccatggtcgtcggctttttcccttccttctctgctgctgatgccgccgttgctttcttcttgccttgatcggaagagcttgacatgatcgctggctcgcaaatccagatgacaggaagcgcaccctgcgatcgattgtcgtgtgatttggttatgaaaaaacctgacctcgatacatctgctgcatatttattggttggtagctccagttcacaatcggagtcggaacctgcccctgccgatattcccaaccggaatcggcagagcttcagctgcccaaatctagtttagtttagggtctggattaggcatgactaatttttaggaccaagtttgggtatcggttggagacttgttttaaacttaaaattccaaaattagatttttaggaacatgtttggatatctcttggagatctctaggtgacatcatttattattgtaaattaattttctagaccctaaaagtactcaaaattgtgtctcatccagcctagattcgaagaataaatgtctcatctaatcctaagttggtatatactcctattttggaacggagggaatatatatttaatttttgggtgtaatttatgttatcctcctggtcctagttttgaaataatgttttgatcaccttaatctttcaatgttctatactgtattattgctcaattgattggagcatttgtaatagtacaatctcaggcagcacggaaacatcctaatatgcgtgcctttgaacaaggtctaagcacgtcatgagcaagaaaaaaaattgtgagctagcaccttatattactcagaagcatgccatagaatcaagctgcaaaaatattacacaactagaagatgagaagatgtcagtgagggctttttactgattatcatcgtccacagatgtgattgcaatctccatcttctctttcctcaagctgtctgcaagcttcaatggccgaagttcaatggtggctgctctcacgaaaccatcctctgcattgtccaagctgcgttcaatcaccatgcttgaggtactcatagctaaaacaagggacagacatttgcacaaactcatagctaaatagatttgaggccaccgagtgcttctgtgctaaagaaatacgagtaactttatatggtatgtttgctaatatcaagtgtttgttaataggaaaaagtaagctacattctgtctctagcacaactaggatccattttattggaaaacatcagaccaggctagataaagctacgaactgagcaacatagtactcatgcatgctaatgtgacagaagcagtatgcatggaatgaggtgatcatgactaatgacactgattgacaagtatgtacttaaattgaaaaggtagtaccttgcaatccaagcagaggtcgtttatcaggccttttacttgtgaaattaccccagcaatttgaagtctgacaactcccgaacagaaaaggcctcaaattttggaccaatcaagttcagagcacacataaggttgcaactcacaattgttaatccttgctctgcagaaagttaaccacaaaagatggtttgacacgatctgctcgatgaggtacaagaacattcatcacagccttcttgtttaattcaccaccaactgcaacatttgtaagcacaaacataccctgaagagaggaaacagaaaggccaatgactaactatgatttttgcattctttttttcagataataaatagtatcacagttaagaagcatgcatccgtatgaaaacaaaaaaaaaaatacactgttttattggaaatatttccctttttgccctccatagtttaaaaacacatatgaaaaaaaaaagtatagataaggtaagtcagtatactgtagtttaaggaatactgacctgtatgcacactcctaaggcatatgtgcattactcagctgtcttgaaatagcatttaaaatcatgccatcttcaccaataacataattaatggtgtccacatatccttcaacaaaattttgctgctgctgctgcacctcttcaccctactatttcaccattcgctcaaacgctcatgtgaatctatctgaaagtgccaagacaacatccttgacctcatgtattttgcgacaagggcagtgacggtaacaagctcaccgccactgctgagctgcttgacatgagaatctgtgctgcattgttccccacagcagcacagcatctgtgcccacacctggcagatcatctctagcgtgccagtgccatcagcaggcgagtcttgccggtcgatgaggaatgcaccaagcgagcatcctcccctcaacatcttgtccccaagtctattagtatttgtacaagttaatttaaacttcggtttagagctattcgtcctcaatgcatctgcgttaagttgtagcaagtggagcacatcctcagctgtgctgtacctcaggtgacgagtgatagcatagcacagcacaagataatcattgcggctggcatcgggaggcagcatgtggggacgtgatgcaagcaggaaaagcatgtgattggacagcgcctgagccgtttccataaggtcagcagctgaacctgaaccatcgactacctctggttgctcctctccagcagctgaacttgagccattggcaacctctccttgctccccttcagcagctgaaactgaaccaccgacggcctttgcttgatcctcttcagcagttgaacttgaaccactggcagcctctgcttgcccttcttcagcagctgaacctgaaccaccggtggccgctgcttgctcctcttcagcagctgaacctgaaccactggtggcctctgcttgcttcttctcctgatccttgtaccagcacaggtagatctcagtggcgatgtgccagatgaggatcctctgctccatcttggactcagcaacccaggctgggtccctgtacaatcctctgctttcaaattcctcctgaccccattgcttcgccttcatggtctccagcagcagctgcttggtacacgccgagatggggatgggcaggcccgagtaagccaacctgttccaccagtcctcgactcccatccacctcgcaatcttgctgcatcggctggccctgctgtgcacgcacaactgaatcaggttgagctgccccatggagcgtgaccagctgcgcctcctcctccaatatgccgcacggaccagccggcggagacaggcgggtatgtgagcaagaaaattacacacattacttccttccgatcccttctttaccaggagtgcacatgtccagctcgagaacatggccctcaaaagtgacatagtctccaggatgacggctccaacaaagaggacatatgtaacaatgacatctgctctgctgtaaccattcagcttatgctgatgatgatttccccagactagtagtatattaaacagaaagaatgcaacggtggtggccagagacgaaagcactcggatgcaaaggccataccaagtgtgtgtaatctcagacttggtgtagaagacgtcgtggaggagggagagttgcatctcagccaccttgtacaactcgtcctccccttgcaatcgtgatccttcattcatggggccacacaaaaacagacgaggtaatggccccttaaacctatccttggcaaaatccaacaataggtgagcatttaatagcaaggtttctgctggatccaagcgacgtatgaatgactcaggcaccatttgagaaaatcttcttctcgctatatcactctcgtactttccagttgggctactaccggcacatctgagcgcccagacacgctccccatacttggcaacacctaccattaacatgaggatggtggctgacaggagaagcaaggtccggctgtcgccaacaatgactatggaggacccatagatgacataggcagctgcggccacctgcacaacaagcgtctgcaggtggcgcagccacagccggttgtcctcgatggcgtaggcagtgattttgtcctgcccaccaaggtgcagcagcaggaacggtgcccagagtgccaacagctcatgctctggtgacctgctggtaacagagaggtggccaagcacgtagatcgctgtcccgtcggccagcatgtatgcggaccatataaaggcccttagcacgccagagtcaatgtaccggcggaattctgccaagatgaggagtgtgacttggaccatgaggctgagaagcaccagtgcttggagagcccattctttccatgcagcgctcacagcctctgctcctgccatcgatttctccaccttaacatctgaaatgtatacaccaatcgattgacataagtcaaaactacataatatttctttttagtttatcaacactatcaaacctaattctgatggcaatctcaagttctaaactcagcatccaagcccaagcagaataatgacagctgagggggtgtgcttccattctgttggactttcccttgttccgtatcacatgttccgggttgttgtttctttaattgtggttgtgtacatctttattatgcagagaggttgtgagtaaacttttgtgtggttgtacttgtattagctagctgtaataatgagagtaataaagctcccttttccacaaaaaaaaaaaactactatcattataattgttgtaaaagcagactcataccctatttcagcctaagcattcacattgccatgagaacttctattagaatcattgtaattaaggctattgtgtacatccaaagaagccactgagaatgcatcagactctttaggggttgtgtgcttaaagaatttgtgattgacttcccaaacacttttctcttatacgtcagttgtttcattgctattatttcagttttcatttgcttcattcttaccatcacctgaggccctgagctggctcatggcatatatggcaagccaaatacatactgtattcaggatatataaacataataagtgatattagagccaaggcaatgtcaatctgatttacaaaagaattagcaatgcatcaggtgccacaaattcaggaacagccttaaacaatgtggccaagcagaaaaacttgatagcaatgaagtcgtattaagtgagagctacaaaaatctcccagtttttttggctactgatgtgataaatgaatcttgtgttgcatgtacttatgtgaagttgtatgttgatctagttgggaagcgcatgcggaaatctccgtcttttaacagcatgattattatctatgcaccacaattaaaatttatcggacatgcatttttctaacaagggtaatttggatgaaatacctcctgcagtaaacacatattacacagaagctagctatgtgaatagagaaacttacacacgataactgaatgggtggagaagtgatcgatgataatcttcagtttgacagacaagttatatatggtcagggattagccagtttgatatgtttgaggggatgaatgcaattcatgcatagttaagtgccacacacaaatatatcaacatgcatgcaaaatctgatgcaatgcctcccagagggttaaggaatcaagaaaagatgtcattcatctgatacctgcccagcagcaagtaaaggataaaagtaaactattctcctttttttccccaaaaagaaagtggagtataagagtcaaatcactaacgctgtatcactttataacgatgcctcattttccttttcatctacaataatatatggttaacatcacatcacaacccctctaaaagaggacctagaactgaactcgtataatctcattattttcccatctaattctccctaacctccattgctccacttacacatgggcccacaagtttttttctcaccaaacaacaaagaaaatagttgcatagattccaggaaacttggtcctgacatctcccgcggtcctgcggcatatgctaggttcaaaactccaggaaaaaaaaaacagacctccagtacatgttttgaagttgccatgggtagccataagcattaagatcccatagactgtgatgttaattgaatcatcaatctacagatatttaagacctcgctggaacccatgattctcaaggcatatgaatagaaaaggattagagtgctccaactcctacggagcgttgaaaacatagaagaactgcacaacaaatagctgtttgaatagagcacatgaaaaacacaagaatcatataagagaggccatcaacttacttctttggtcagatgaatcgggctatcgagctttgtttcgttggtagaatgaataccgatgggatgatctagtcttttttgtttggttggtagtatgaatatcggattgtaccaccccttcccacagttgttgagcttatgattaattatccatccatttgacagtgacacaagcaaattgcggtcatatcagaaacgaaattatgcaccgaggttggtgatcttatgacttattatccatccatttgacagtgacacaagcttcacattccagtcaatgaacatattagaaacatgttaaataagaaatcatccatttaacacaaggttcacagtcacagacaccctttttttttttttaccaaccatcgattcgtctacaagactacagcaacaaatgcaaccaatccttctcccatctatccattataccatccatccacgaaccaagtcagggccgcaaagggataatcgattaccttgggcggtcgtggggagaattttcagaatataacacccaatacgcactgcttataggatttgtcacctaattcatactactttcagaatacaccactagagtacgaattttcttcgttccgtaacactccgtccatccaaagacgcccgtcgtcagttcatccatctctcgccgtttgcccgcacgaatctggccgccggcgagctcgtcctcccccacgccggcgagctcgtcctccccacactagcgagctcctcctcccgcacgcatctggcgagctagctcgtgtcgtccccgagctcagccgccgccgcaccgggctgccgccaccgcgccccgagccagcgccggtccaacctccgccgccggagctcgaagccctctgccctccaccgctgctcccctctcctccggccctccaccgcgtgcgccgatggcggcgacggacgagcgacggcggggccgacgcgggtgacgacggacgagcaacggcggggctgacgcgggcagcgacggaccggcgacgccggagctgacacgggcacgagcggcggtggactgacaacggtggcgccgggaggacggaggactgacgctaggggacggagtgtcacggaacgaagaaaattcgcactctagtggtgtattctgaaagtagtgtgaattgggtgacaaatcctggaagcagtgtgtattgggtgttatattctgaaaattctcggtcgtgggagagcgaaggagggttcgccggcggccggagatgcgtcctccgatgccggcgcgcggaggtgcggcgtcgggcaggcggtgagtgaggacgatggccgggcgcgcctattggatctatcatctacgccgccgttttttccgaccttctccggcgagccgacgagataatgacagctctgctccattggtcaacgagtcaacggatttcggttgtgacttgtgagtactactatggtccatccataaaaaaaaatttggtatattttgactttccaatttaagctttgactaataattaaccgcaagtataatggcatactagtataaattaactataagcacacatagatgagataagaaaagaataaaaaagaaagtgggctgcagatttctatccagctacaatttcaaaatgttgtgtgtataagaggtgagaccatatattaataatatagtatatatttatatgcaactattgtatgaatgcgctattaaattagctatagatgattctcttagttaacgctatcgaaatttaaaataatgttaggatcgttcgttttatttaaaaaatttatgtaattaaaatatattttattggtagttgtttaatcataaaaatagtttaagcatgatttatatttcatatatttaaaaaataattgaataaaatgaataggcaaacgtgtatttaaaagtcaacagcgttaattattaaaataaaaaacggagggagtatttaggttttatcattattattggattcatgttagaaattacgttcttgtgactgattttgtaaatgtaggcaaaattaaaatacatcaaagcttttttacggtcaaatctttttacatcagaatacaaactatattaatgataagctttgttttctaaaagtcaaaatatgccctatatctttgaacagaaggagtacctccctttacaatatttgcacaagtactgcctatttatgaaatttgaccactcatcttctttataaaatattttataatcaactaaaagcgcagcattagagaagtgtgtttatatcgtaagtattataggttgcaataccctacccgcaccacaaccaacaccccaaagccatcgtccacgacatcgtcgtcctcgccgccgccaccatcatcgacatgcaccacctcgtcgtcctcctcttcctctctgcactcgtttttgtcgtcgatgtcgaccacctccccatcgtcttcgtcgtcatcatatacctcaacctcttctctgtcgtcgttgtgcacatggttaaggcggccaacatcatcggggtcaaggagaagggattgtccctcctcgtcttcttcggcgatgacactattcctttgttcacctgcgtcatcatgtcactggaatcctgtactctgacaggtggccacatgtatagctttgtcgggagttttacttttacctgttggactcaataatagtaggtacaatagtaggctataagccagctataaacacatttcgaggagataaaagaggagggagaaagccagcaggctacagatttatagtcttatagctagctgcagcacggactccaaggtgcatgtgtgtatgacaggggagaccagatattaattatgaagta

SEQ ID NO: 50036 - DNA, 23862 bp, Oryza sativa
attaacatatatatgaatgtgtgcaatgctagaaagtcttataatatgaaacggaggaactatatgtttataggtaactgttatatgagttggctattaagttgactatagatgatttggagcccgcagttggctatactattaaacttgctctaaccaatggcaatcggaacgtacaggatcatataactagcatacgcaaaaaaaaaaaagaaacccctggtatttactaaattattttttgtgtaagaaaattaaattttgacaatgccataaattaaatctttgggtaatgccactagatctctgaccaaatttgacttgacaaaatttggcttgacatggcacgttgtggctttagaatctttgggtcaagcatgcatgtcgtgagcaataagattttttttcgtcgacgtgcataaaataatttaccaaaaaagcgcgcgcgcatacgcatacatacatacatacatacatatatatatatatatatacatacatatatatatatatatatatatatatatatatatatatatatatatatatatatatatatatatatatatatacatatatatatacatacatatatatatacatacatatatatatacatacatatatatatatatatatatgtatatatatatatatacacatacatacttcttcgtgttatattataagtctttttaattattttcctaatcaaacttctttacatttaactaagtttataaaaaatatagtagtatttttaacacaaaacaaacatatcatcgaaatatattcaatgctgattgctagaataataaaatatattcttaaaatgttacttatttttcattaaacttagtcaaacttaacaaagtttaatctctttgttaatcagaaaaagtcaaagcgacttataacatactcccttcatccacaaaaattacacatattacttttgacaccaagaccaaggagaaattaaattaccttggatgctacaaaatcaagaagtaaataaaagcatgcaaccaatgagtatttagatgacttcttgagttctaataaaacatttaatttatctcttcatttaagtcttaaatgcataaaaactataaataggaacaacttatttggaaaaactcaaatgtgaaataggtgaaacttttgtggatggagggagtaaaataggagtatgtataattaggctaaggctgaaaaatataggtactactatcaactttcagaaactaaattttggttacttataaggccacacgacgagagcaagattgtgatcaggaatacccagaagcatgtcaagagtagtatctttattgagaagcaaaagcaagcggcaaaaccattacacactgcttgctgggcaccgtcccatggccgaacgtgaaaaacatagcccaagagagtagtacaatttacagcagcagtagcatatctccctcaattatacactcaccactcatcgtcacagcacaagcactaggtttttggtcatgctaaggaatgaaatttctccagagctagcacctaaaacctttttccgtttcggaggaaatcagctcaggttttctgacgtggcatggttacaacaaggtttcttgcttgtttctgcaagagaaaccagtcatggtcctcatggagttcaccaaatttacaatgacaggcttggaggcgacgagaagatgtcggtgaaggcttttttttactggatgatcattgttcacagttcatggcgcggattgctgatgcgaagagatcaatcttccatcttctctttgctcaagcagtgtttgattctgcaagcttcaatggcccgaggtgcaatggcggctgctcacatgaaaccatcgtcggcattgtccaagcagtgttcaagcaccatgcgtactctaagctgcacaagggacaccttgggatgttagtttaagcacaaaccaaggtttgtaaggttcaagaacatatgccgacaaatgctaaccaactaccagacatgtttgtcatcttgcattatttttgttttattggttttaatcaacatccttatatataaacccatttgaggccatcgagtgcttgtgtgcttagaattttgcaggagtagattttaactatttgttttcctatagagtatttcaatatgtgtaaatttgctaatgtcaaatgcttgttcatagcaaaggtaaaatgacattttctttgcccaatcaagaatatacaatttagtgggcaacatcaggctaggctagataaagctacgaaccgacaacaaaagtactcatgcatgctaatgtgacaggagcagcaaggatgggtggaccataaatatctaacagcagcaatgaagtaatcatgacgctgattgacaatcgtgtgttttttcaagctcaataaataaaagaacaaagaggtaccttgcaatccaagcagggatcatttatcatgccttttacttgtgaaattaccccagcattttggagtctgacaactcgaacagaagaggcctcacattttggataaatcaagttcagaacacaccacaaggttgcaactctcaattgtttgtccttgctcagcagaaagttaactataaaagattgtttgacacgatctgctcgacgaggtacaagaatattcatcacagcctccttgtttaattcgcccccagctgcaacatttgcaagcacaaacataccctgaagagaggtaacagaaatgccaatgattaactatgataataaatagtatcccgataaagaatgtgaaactaaaattacacggttttgtcagacaagatgttccttttgcccaattttaaataaggtaactcagtataatgtagtttaggaaatactgacctgtatgcatactcctggggcaggtgcattattcagttgtcttgaaatagcatttaaaatcatgccatcttcaccaatgacataattaaaagagttcacatatccatcaacaagattgtgcaccagtgccaaagtttgttcctggacaaaatgttcagaatctgcaagaaatgttgcattagcagtgtggctgattcagcaatgacctaatatcatagctgcacatttagacttaccacatatgaggcttgaaagagtagataaagttagttccttgagaataaagtctttatcctttggattcaaaaggaacataatattcctaagagcccacacagcttttaatctcaatgttggatccatagacttggacaaatgaacaagctgggagacagccccagattgaagaagaatcgatttcctgggtgttaaattcacagcaatattgcaaatagcaccaagggcagcaacctgtaataccattttgtgaacacagacatttagtagatattctacaaagtcccaagggattaaagacctaaaataatgacgtttcacaatcataatatagctaatgtagtgtcccttaagtggaaaggttgctcaaataaaatgagtccatggtaggtatgaacgaccaaaagagtttctcctaagttaacatcttactttttaagtcactaatacagttgattacttagtgatatgtaggtttacaatctaacacgaaaacagttagtacaacatgatgctttagaagaattacagtagagcccatgatgggcagaaagaaggtaaaattgcagagaaatcaggaaaggaggaagctgccatgcttccaagattttcctttcaaaaacccattgaccaaccctctacaaagaaggaaggcaattccaagcagtgtttcaaaatttgttttttgaaaatttcttggacatggacagatagtcgcttactggtcaaatctgaccaagttagaactataactcgacttgattgaattgctcaagacctttttattccaaacaacatataccaccaagtacttgccagatcatgtaaaaaaagaagccctaatctattagaatcatgcgctgtccagcaggagctggccagttccttgtggtttctgaaaccatgctttcaattacagattcattgccccttaaaaatgatactgaaggttgcttcacaattttacattacctgaactgacatagacgagtcatacaaaagctggactagtggggcaataaatgtatcacaggataatttcccagcactaagtacctgaaattaaacatatcaactcaaatcatgtaagatgaacacataacgctgaatatacataaggagtatgtgtcttaccttggatgacctagagatattcttaagacatgaacatgctgcaacacggatatcaacagaagcatgcttcagtgcatcaaggattaaggtagatgcctgttacataattaatttgttagtcacaaatgtttgatcaactgacaatcataaaatccacctttttcatgctactacacgccaggagcccatggagtcagtatattttcttgtcacaagttgcttaacaataacagtagatgaactctacaaaattttactcaaagggcaaagagcagcaatgatcaatataccattcaaagtcctgcacgtacctgaactgacataagttgagatcttgattcttccaattttgagcaaagttcagctaaagcaagcaatatggtcactgcacgccttgactccaacgaatttgctataagatggttgcttaacttctgaactgcgtttgttgagagtgcttgcttctgcagttccacactgtctttgatcaaggttgtcaatgccaatggagcatcatctcctacatgaccaggttcctcgatgagctcaagtaagaccaggatcaacttggttttaatttgtctgtcttgaaagtgacagggagaagcatggctaagcgcaatcaagcacaaacaagcaagtagtcttgtgcgtgggctccgatcatgtattaatgcaactattgagcgcaaagcttttccatggtccagcagtgcaaatcttgaagcaacttcccagttatttcttatgattgcagtcaaagaatctaagcaagcatcccgtagattcatggagcctccaaaatggttaacaagtctctgcggaactccagcagcacatagtgctaattgttctgtagtgctatcacaagagtgagatataatattggcagcaagctctgtgacattttcattctcgctgttcaaaagggtaagaagaaattccatgtttttctcattattgttgacatcaaactttggagctagtttcgattgataaatcattctcagagcacgtgcactagcatcaacaacctgtaatcagaatataacctcgggtcagatcatattattattattattattcatagtatgcattaatggttataaacaattcaatataacatgaaaataatcagaatatcagatagcaccaaaacaccatgtttcaatgaagagggtgcttggatatgaactcttatgcattcatgtattgttacaagttcaactgtacaaactagatgcttaagatagcatttagttattataaatgtttccaaaacagaatgttaaagcgaagcccagaagctagctggttaatccaaagcagcgagtatccctgctttgaataactgtatattgtggcctttcctggttatttatgtccttaatatgaatgtgcaatcttttttcaaatatcaatactagacaagataaggagcaaaataacaactggcaaatcattttttcagataaattggcatcccactatcactgttctaaaaggccccaggcatcaccatactggttagcacctaatatttgtttagcctgactagtcagtgtaggaactagacaccaccctgctgcatgtatatgcctaacgccttttagaacagtgctatagcaaatcttgaaagaattaatgcctgacaactcgacaagagtggttagggaaggatgttagagatgggacaatagagagctaccaaagtagcttgacttgtttcatctctttttcttgtttcaacccatctaccatgttttgccccctttctaattgtcacttctgtaacacaaacagctgccctatgcctcatcatcacttcctccaccttgaagatgcaacaaagggagagactgaagggaggcgacaagcaacatggggaaggaggcagtgggatgtgggatgtggtggtaatagtggctaccttgtttggtcagtaagaattgaatagggagggatggaagaggtagagctataactagtaattggggcataaaggcacaatgagcatatggtttgaggtatgcatggctgtatcttcaaaatactggagctgatctgggagtagctgacaacaatgtaagtatacctccccgaagttgtacattgacttgtcaccatatccttatgcaatatgtacttctataccatgtacttctataccagtaaagttgctaggagatatacctgggtaaccaaattttgagctacaacctatgcaagttacgagttaagtccatgtggattgtgttaggatgatacaactatcttttctagctcatacaaagaaggctttagtgattcaggatattcggtgttatggaagaatcacaagtttgaattgcctcatgactttgtttagtgttaagatttcttccttaaagtttccttcaactgtcaatttcaaatctcaaataaaaagggcacccacatcctacctggcaatcaagaacttccagttacacagcaaaccaataaggatttcagcacaaaatttccctaccaagaaaccattgcacaaaacatcacactactgccaaactcttagttcaagcatatagtatgagctacagttttaccatgacccagaggaagctatttaaacatcttatttcatgcttacatctgtaaagccaattcagttatcagttcagacaaattcatcatgaaactaacacgaaacagacaactttccagcacattcatccccaccactacacctaaccattgacccactaccaaactctgcacatttcaagcataaattgaacaataccttcagtactttaatcaaaaaaattaaaataaaatagagagaaaaggacattaaaaaagaaaaggaaaaagaaatgacaaccaccagtacctctcatcttagctaaaccgacagattagcctatagttcagatcaaataattcccctcattccaagcaaaacccaaaccaccaatcatgatccccctagtacaaatttctttccaaccaattcacaaagcaactatcgaattaccacatttattttcatattcttactcacctctaaaccttatttaccaaacacattgatgacacagtaaaaaaaaatgcattcatggcaaattggactagtaagcaaatactcttcacatcgcaccagtaaatttttctcaccctaaattacaatatcagcagtaaagaaaaatcgttaaccaatctaatcactaattcttcatagtatcaattcagttgccatccaacttttcctgttcccaaattgcaaacataacccaaattctacaccatatgattcccaagaaatcaagcaagaaccagttgcttgctgtctgcttagttccgagcaagtctcctctacgcaacagatcttctcccagacgaataattaatccacaaaaaaggaaaacaaatttctgctaggcgagaacaaaagatttcacgcccgatacaaatcggaaatccatagaagtgagcaagcaagcgaagcaagagaccggctaccttctcgtcggggtgggcgaggagccgcgtcaggtgggccacggccccggcggcgagcacggccgcacgccgtcgtcgacgccgcacgcgaagctcccaacggcggcggcggcctgcacgagcgcggctggggaggccccgggccctgcgagcgccgccacgacggcgggcacggcgcgcaggcggaggtactggagcttcttggtccggttcccgatgatctggttcttgatctcccgcagcgtgcgcacccgctcgtgctccccctcctcctcccctcctccgccgcctccgccgcggccgcggccccgccaccgacgggtcgccccccggcggcggcggccagcctcgccgtcagctcctccggcctcgtgcccatgcagtaggacgcggtcggcgacggcggcgaggccgaggccgccgcctcctccggccgcgcaccgccgctcgccgtggccggcatctggtgggggagggtgggcgagaggtgtttgatttatttctcctcttttttttttgtatttttcgagcgattttttcctctttggttggtatttttatagagggagagattgagaaagaaattggcttgggttggaagccctaagccaatgggataacgccacgtggagtaaatatttcattattttgtactccctccattttacggtttacgacgttttgactttggacaaaatcaaattactctaaatgtaatagtatttttaacctaagataaatatattataaaaatttattcaattatatatttaatgaaactctgctagtgttgtaaatattactatttttttctacaaaattaatcaaacttagagtagtttgaatttgaccaaagtcagaacgtcgtataacctgaaacggagggagtatctctttacaaggaataattaacgttttaaaaactttggctggtaatgattaacaaattagcattagtgtgagctagtgtgtatgtgaagttgttacaggtggttaaataatttgggcagatttagggccaaatattttcctcttatagattataaattattgtgggcacgctttcgaaacttgtaaacgggatgttttttttatgaaaaagatttaaaagtgattagagtatttttaaaacagctttttaagtttgaagtagttcattcatcgttttgtagccctcagatgtcatcagaaaattagaaaatcaaactagaccttattgcagagttttctttttaaagtgttttgtttgttagaatttttctccaaaggcggctgcaatttgtactccttttttgagaaacaaattgagaggtgttgacgtatgcgaatttttatgtatttttctacagtatttttctcagtattgacagctatatgcatgattggatgatgagtctcacatgtggttttaaactcttaatcttcatgctcccattgtctgtatctgcagtcactgtcatcctgacccaagcaaaaacaaactaacctagaaaaattatagcacaacccattttatttgtgaataaataatcctacatgacagattgcacttgatagtgactgcagagaagggaatacttcaaatacacatgggtttttttaagctacatgtaaattttctttacaaaatttctacaaacaacgatatcagtcgtttgatttatttagatggaagttataccaaatctagatgaactcacacatgcctcgtcagagttagtaagaattcagtaaaaaaaaaaacttgtattcatgtaaggctatgtttagttcaaactaaaattggaacgatgtgataaaaaagttagaagtttgtgtgtatacgaaagttttgatgtgatggaaaagataaaagtttaaaaaattattttggaactaaacacggcgtaagtaatccaaattcttgatttcaaggtacagcttcaggtttgatgacaaccatgagcctcctatctatccattttgccaaaagcaagatgtcggcagagaaagggtcccacatggagatgcactgacgctgaaagcctattctactatgtgcctttttctatattagccttgcaatatcaacattttttttcatggaaagatcttgcaagaaatccaggcaaccatgtgtgtgacatgctggactgtttctagtaaacaatgatcatttgatcctgattactggtctgaagaaaatgacagttgaaaaaaaaggccaaaatatcttactgccctgatttatagcgaagggaatcacagacggataaaaggttagtacggtcaattaactattaactaggtatcagtaaaccttggtcataaggcaaaagaaactactgctattaaatagggatcgaaaactattcccattatctgaaaagatggctttagaaaaccgatccgttttcatggaaaccgttagttggttttcataatgtgttgatagaaagtcgtcgtttttttactagttttattggttttcggtaaaccagtaagaacggtttttattttcaaaacaaaaaaaataaatcctagtgagaactgaacaagcaacttataaaagttacttccccttgaactatgcctgaagctgacagctcgatcaactcaaatccttttatcttttttaaaggaaaatggcaggagctctgcctatctcaaatccaaaattcaggtgcaagtctgcaagtacagcggtaatatcattcataatggcttcttgggtcacactaactccaattcatcacatttttgttaactgagttcacattaaggcccagtgtcctcggaaaaaagacggacaaattatttttgcgtgcaggttgcaattgaacaaacaacaaagaacatatttctgaaaaggctgaacttatgcgggcaacaaagttaggtctggtttagttcccaactttttattcaaacttccaactctttcatcacatcgaaacttttctacacacataaacttctaacttttccatcacatcgttccaatttcaattaaacttccaattttaacgagaactaaacacatccttaatgtaagaagcaagtttaacaagaatcatctgtcaccaattcaccatctccatagtcgagactcgacaaagtaatctctgcaggatgcagaaaatcattggaagaacaataacaacagagggaaatatatgacagtgtttcataacagaacaagcaatgcgtatttactttagcttagctcaccttttacctttcaacctttaaattatgtgtttggctttctataaaagccaggcctgaaggcctctgatctaaaaagtacctttaaattatacagaaatatatcatatctcaatgtacgcaatcattcaccaaaagatggtcacgaagaaactagtccaggtgcattggattgatcaacatttgccatatcattcttcagcttcttttggattttctccccaatttcagttgctcttaaaatgtgcaatttttctcagggcgtgtactttttaaatgaatgaaaaagaatgaatttctactcttgaattttcgcaaaaactttctacatatgaatttcttaaaaaatgttttaaatccatttttcaactttataatagttaaaattcatttatttctactcttgaataataatcataaaattattaatttattgagcccttcagctatatgactgtacatatgaccaaacatatggatcaaaattcacacattccatggtacatcaatcatagtatgagcttatactaaaaaagctctacaaaaaatgcctctttatggaagcaatcaagagcctcaccagcctttgcttgagagacaggatgcccaaaaatccagaataatatggattcaatgtaaagctgtctggtagataaccattaaatcatgggattcaatgttgttgtagacatgtgcataatacagcttctggttctaatcgttctttcgctttcatggggaaaaggctgatgaacacatcacacgaattgtagctacctaaaccacacgatgtcaaactgccaatgatgcaaaagaatgaaggatatgtcccaattaatttagtggctgagtgctccatgtagcatactaattgtatactccctctgtactcataaatgaagtcgttttggacagcgacacggtctccaaaacacaattttgacttcttgtttctataaatatatttattgaaaagtgatatatatatacttttatgaaagtatttttcaagacaaatctattcatataatttttacattttcaaactcaataactcgagagttattcatgatttatattttcaaggtttgacttaaacattgtcataaacgattttctttacgagtacggagagaggacatgatttatgattaaagtctgttgaaatcaatcatttggaacatgctattatatgttttttttaacttactcagacttctctgtaatttttttctggttccatcactgacaatgatttatttgctagccagtagggtccggacacgtgtcatattaactggatatgcttatctcggagcatgttgagctgctgaccaggacaaattctttctagtaagctttgtcatcttctttttctcccatctgaatgaaagcgttgtcgcttttggggctttctgcatcatataatgttcacctgcaggtttgctgatctgtaggatttctcattttgtttgtgtctgcttgacaaatgacagccaaaatttattagtgattactccttttgcctcaaaagaaattagtgattgctcttttttttcctacaatgaagtacataatgtctaaaatttcagcatccatgttgtttttgataggtcagcattcatgtgttacctaacgtgaaaaggaaatcatggactgatagtccttgcatgaaagatggcagcattcgtctgtaaaacatattcggttcagaaattccatatgccatatgttagcttatgtccaattgtgaaattttatgcaatcattgggacaccattaaatttcattacgacaaaactttgaccaacaattattctattataacatattttttgtgaagcaaaattgatgtgattggattaattttcaaaagtacttttatatgattatacttttgtgtccataatatattagagaaatgtagggactaacatgggataaacaaaaatattcgaaggattttatacctctgaatgtatggacggagaaaaaaaaaactctgtttttagccccttctcgctgcttggagtctgtttttagccgccgtagtttctctatgcttaagtttttttttcttattttgctttttcttccttcccctagcataagccagtctggttgattgcgtggtgtaactaaaactctttttcttctaatatattaacgtgcaatttttttgcgcgttcgcgaaaaaaaaaccctactatctcagtagattcattactcgaaccagattgtaaactgtgaaattcggttcgatatgaatgaattctgcaaaattacatgaaaacccattcatctatgggccttctgttgctctcttcaacaactgtatgggcccaagcccaaaactgcccatgggctacaaacgaaggcccaatttggcctatacgatccacacctgaagcaacaagaaccagaggagacgacggtggcggcggctggggagagagaggagaggagaggagagagaggggaggagaggtagaggaggcgagagctcgatggcgtcgtcgctggggaggctcaaatcctccatctttgacaaggaggagaggaagatgtatttgcttttctgcccaatccccgtcccatctcattctgttcctgcaccaaagtttccccctttctttcggatttgtgtgtggcacgaatcgattagaaacctttgttttttctagcttcacatttcttgacgctgatgctgtcaaagtgtgattttgaaggggtatttctgtgctccgttatgtgttgggggtcagtgcgaataggggaagtgatgatgtcgatgaaccctaactttgttggttgcaatctttgcttcgagataggagttaagttaggctgatttgccactcaagggcaatggaatattagatagatgcactgctttttgttagttcgctcgctttatttttcatctgatggatatggattggttgtggatgcaggcaataccaatcgcacattcgggggcttaatgcgtatgatcgacacaagaagttcatgaaggattatggtatgattctttgctggcttcttttccacctcttaagcatttcttgattgttttaaaattttattgggagatctagggctactttcagttcagatttcattggaacaaaatataatgatagtggaatggtaatgtcatgataatatattacagttaatagcactgttttaggaaaatggcacattttaaagttttgcttctgcctttcttcacaatagtcagacaaatggtggttagcttgcactccgatattctggcacaactcccgttatcccagttcaatttgatttttgattcctgatgccaatgcatggaacggatggatcagaaagttgtcctttcacagtgtaaaggaaattgagacgctggcatataacgagttaattatttgctctgtctcagtttccaaaagcaactggatgacgaacagtcccctctactgtagaaagaattgggggctaccttcatccatacatgggctatgcttattgatatataacttcccacctagctttggatgaaacttattctgggtatgcatcttttccatatgggagttgatggtctgatatgccataccagtgacccaatctgttgaacaatgctgtcattgactagcagttcatcttccaactatactatgaatattatagatcagtttaaaatcattataaaagtcaagtgacttggattctattgcttgtgttagtaaagtacaaggaagcttttgttttagatatgtaagtggaaactactatgataaatgaagaaccagaatgtagcctcaccacagcatcctttatcgtggatgtataaataattgtggattggagatcatgttcatgtttacaaaattattgtttcattgattggctctggcattttattggtatctccctcttttcttgatattataagttcccactgaaaaaacaatgtgctgtgaacagttcagttttatggccatgacaagaatgtggataatcgtgcacccatcaagactgataaagatacactgcgagaaggatataggtaagaaacaagtccaataccctttgttatttatttatggtggaatgtgtgtccatgctttatgaaatactcctaaatccttttctttaattatttatccatataaaggttcatactttctgaggaagacgatgtggattctacttgggagaagaggctggtcaaacgttactatgacaagctttttaaagagtatcctttttggtggtgtgttccttacattcttttcattaagggtacagtgtatatttcttcagaaattttctgtaacatgttctgatttgtggagctgaggtgatttggcaagttcatcccattttattctgagcaatactgcaaatgtattgaagactgaagagcttgatataatagactaattgggtatgaactgtagatattatctcacaaactcattagcgtgtctgaaaagataagagttgcagtataaattgtaagatactatgagtgaaattttctcatcaaagaggtagacataacgcatatgtatatggttattctcataggcataactcgtatttactgttgtccgctgcatcagtatatgtctttgagagaatattgcaagttcgttccaaacaaatatagtgcttaacgggttatttcctaagagaaactatttacatgatatgcataaagtttcttgtatttatgccttaaatagttgggccaatattatctgtcagtcagtctcctatagaaacagcatgttttgaagttctgtagtacctattttagaagatgggaacatgaaggatgagagagaaccaggattgctatgtttgatttgaagcacttaagttctgctcctatctttataatctatctatattaaccaagagatgtagtccttgcaccttgaacttgttttgctggctgttttactgttcttgtaatgttcttgaaacttaaatttattgtgcctaggatccttaatttgatacagatactgcattgctgatatgtcccagtacaaaagaggcaaggtatggtgatacaattctatagcaataagccaatagttgttacagtatttatttgtgtcatttactggatacaatgatctcttgaatgatattcttgctgttttttctcctcattgctattaatgcaatagaaaagacgaaaaatgctcctagtatgatttatatctgtaacattgaggatttcaattaaaagaaagaaaagaataatacgaattgttgatttcgtatccgtaatattaagtttgcgtgagcagcatcgacaaagtgatcattcttgtttttggtcatggagttgcattatagtatcaattattgttgcacagagcagcaaaatcactagcacaaccatacttttatatatgttaatgtctgacaggcacacacttgatagtggggacgctaagaaatcctatttacttggttcgttactgaataatatctaagtatcctttagaatttagaacagcactaacaaggatatgctgctcatagatattagaggttttttttaattgataaaaccatcggttttattcttggaagttgagtgcacattctaaggatctcatttatttcagattggattgagatggagaactgaaaaggaggtgatatctggaaaaggtatttccctttataattccatgtgttttcaggtgcactaaactgtcgcaaaatgctaaatgtagtctatacattttttttttcaaatgtgtgctctgttttactaattttcttattggtagatgtgatattcattacatgttgtcttttgcagggcagtttctctgtggcaacaggatttgtgatgagaaaaatggacttggtagttatgaggtatgctcttggtcctttctatcttgtcactgatgctacaatgcatagatccttttgttcattaaagaactccttttctgctatagataactctcccccttgttttcaggtgaacttttcttatattgaagcaggggagcagaaacaagcactagtgaaactggtagcttgccagaggttagttaatccactacttcattttgggattatgtaacccagttgatccactatttcttttcttgtatttatcttgctgatcttggtattcatacattttgcatcccaactattttgctctggcccatcctctctctagtcttctcttgccatttttgttcaaccaaatattcaattgattattgattgttgtacattatgaaagatgtgcagaaaagcttgcttataagaggcaaaaggagaaggaaagagagaaggaaaaagagatttctcgtgaaaaggaaatggagttaaaagaaagggacaagaggaaaaggtacctcttttccccaatagttctttttcctaactttcttggacatttctgttcaaaccttttaccccaggatttttgttacctgactttcttttacatttctgttgaaactgtagagaacgtgagggaagtgaagaaactgaagatacatcggaggatgaatcaactgagaaatatagtagaagaaaaaaaggtaaaaatgattgcattattacctggaacagtggatcttttttcgtgtttatgaagtcaaacactaccagtatgtagtagtttactttattttcgtcggaatttaaactgtcaaaacttttgtatattattaacaagaaaaattattctatgcaaaatcctgcagatcgcaaacgatcatcaagaaaatcgagcaacaatgatgaaggcttcgaggagttccttgaaggcatgttcccttgatctggcctttatgtcaaaatcatcatcagaaggggaagcggcacctgtttaatcttccatgacatgttaatactgaacgtgattaattgtaactttgtatatgatggtgtattactgctagttgttccatttctagcctctaggtctcttgtgagttctgagatgtgagaactgccaggtgttgtctaactaatgaatttgtcaccacctgctcttaatctgtgatagcttgaagcaccttgaatgttatttatatgtggatattgtgtgttataaatatgcaaatatcagagtattaactagtttttttttcttatgcatggtaccgcccctttgtaagataatcctggcttaaccaaataatgtcagaggcattttgttacacaggtgaccaacctattgtgttcaggttaataatgttgctgatgcctcacaatatagctgggaatttcagaggagcaaattgatagtttctaaattgctacctaaatcattcttattctcatgcatttctgaagatacagtagcttgagaatttcacaagttacacttcacaagcattaaattcatgagttcccatttactattcctctcttctaaccacatccacaatgagaaatctagttcaattttaaaaataatctccagttgcagaaacagatcaacaggttgatcatgaaatctctgcttctgatcaccagttcaccactgtttttgtcttgaccaatgttttaagatcagcggtggaaaattggccttcccttaaatcgctgaactaatgtaaaactaatcttccatgacgactattcgtttgccctcgtgcagctgtttttcacacaataataagtcacaagtgttgaaagaaacaacttcatatcgtgccaattcaactcaagaggatatgtattaataactgaacatgagttcattcacttgaacatcaaaaagaaatagcaaggataactaattgtttatttaatctatcaaagctagttcaattgctttaagaatagctcaatgaaaatcagaaacatggctttccatgaacagagcactgatgacatacctgatggttctttaaaattggggcaatattcaacaataatgtcgctacatgttaggccttcaggaatggagtgcagaattggacagccagacaaacacattatctgtagaaaaggtaggttctccaaccattctggcaaaatctccaatttgttgcagttatcaattttcaagctggcgagagaggaaagatgctgcaaaccctgtgggaggcatgacaattcatgacaaccacatatctccaacttcttgaggcgatcaagagcctgtagaccctcacagcctgaagaagcatgcaactcttcacagaaagaaattgaaagattttcgaggctcttctctacacctctcagaccttccttcgagctgtacaacatcttattattcatccacaaaatcaatttttcaatcgatggaaactccatatgcagtgctctcaattttgggcactgaatgatgacaagttctgcaagacgaggaaacagattcatcctagatgactgttcccagacttcaaggctagtcatgaatgagagaatcagcttctccaatgaaggaaatgtaccgttctgaccatagaaattatcgtcaatacaactgatattctcaactcggcttatctccacttcctcgcaaaaaaaaaaaaactcggcttatctccacaatcttcagacatggcagtagcccaagtggaggtaaagcattttcacatgatctcagattaaccaaccttatctcaaccagagatgtgagatatggctcagtgcttgttatccaagatggaaatgcatgtccttcatacgcaacaatctccaaagttttcaggcactggttaggttggagggtttcaagtacttcatgatctattctactggcatttccagcatccatattccacctcaacatcaatgtctcgagcttttctttctcttgaagttttgccattcttgcatcttcagtgtctgaaaccttttcaaggttcactagtgataggctgtgtttagttcagcgcaaagtttgaaaaatgactaaaattagagatgatgtgactgaaaagttgtgtgtgtatgacacgttgatgtgatggaaaaggacggaagtttagatccaaactttggatctaaatacagccatagtctattgaggtctagcagtgattgaagctctgacattgcactactaccaatgttggggacaaagtaaccaagcaatgtgtgaagatgtgtaagttggcccatagcatgaggcattgctgtgagtgagtagcaattgagaacatttaggtactgaagctccttcattttactcttctttgtaggcaacgtgacaagatagtgacatccttcaaggtctagcttatgtaattgcacaagcttacatatgttctcatgcagtttccgtatcttttaacctaggtggggatttggcatttgttgttctaggtatatctaatcttgattaggttggtttttatgggacggtgggagtagaagatgaggcctggagtgtggtacttaatgtaagtggcggttgggaactcattgtctacgcacggaaaatagaacggtccattatcacgtgattaagtaagttttagctattttttttccaaaaatggatcactatgatttttttaagaacctttcgtatagaaactttttacaaaaaatacactgtttagcagtttgaaaagcgtgcgcacggaaaacgagagaggagagttgtgaactcccctcttacgaacagagccttaatgtagactagtagagatggaaaagacagtaagggtgtgtttagttcacgctaaaattgaaagtttgattgaaattggaacgatatgatggaaaagttggaagtttgtgtgtgtaggaaagttttgatgtgatggaaaagttagaagttcgaagaaaaagtttagaaccaaactcggcctaaggtgtcaaataaaaaagaacggagccttaatgtgaactagtagagatggaaaagatagtatggcgtcaaataacaaacagagagagcatttaatgtagactagtggtactcgtaccctagagatctaggttccattctttagagatctaggttccatttttttctaagggtgtgtttagttcacgtcaaaattgaaagttttgttgaaattagaacgatataacggaaaagttggaagtttgtgtgtgtaggaaagttttgatgtgatggaaaagttggaagtttgaagaaaaatttgtaactaaactcggcctaattaagatacaaaatttgcttcagttttcattagcacacatttcaaactgctaaatagttttttttttcaaaaactttctatgcaggagttgctttagaatattaaataaatccatcttttatgtttcaaataattaaaactgaattaactatgtgctattacctttcttgttttgtgtgtctgctcttaatcttaatcttgagtagactcaaacgctggtctcttatgagttctaagaagttgagaatcggcaatgctatttgcgttgcaccatggaatactccttccattctttaataaacaaatatataatggttttctagatttgttatactaatttaaataacatataatcctaaatttgtttttttaaacgcatagatcgtacgtttcacggatataattctaattttttttaaacgcatagatcgtacatttcacgggatgtcgctatagtatatctgcaggactgcgaggaccacgtcctattttaggagagaaacgcacaccaacccagatctacgacatactatagtcgtgcggccagccgcactactggagcccggcaatgagacaacgattagctggcaaagcaagttggccagtggcaatgagacaacgattagctggcaaagcaagttggccagtggtttctttttttaaaaaaaaaataattaaaggttagtcgacagaacttgctccgtcctaagataaataaacatacaccgtgtttagttcaaaagtttttccttcaaatttctaacttttccattacatcaaaactttcctacacatacaaactttcaacttttccatcacatcgttcaaatttcaactaaacttcaaattttggtgtgcactaaatacagccatagtactgaatttagcatattctatcattatgaatctagatggatttatttatttagagcaaatttaatagtagagctcactataagttataaatttattgtagagctaacatatatgatatgctacctataagattaactctattttttctctgctctctctttccctcactatgcattttcgtaaagaatgtgtacagctagttcctccatttcattgatcattatataaccaaaaattggatattctaaattgatcatcatatgaccatggtctactcatttgacgtgcaacattattgtatctatgcatgcaaatttagtatgcgcgcatgtatgcatatagacatttagaagtagttaaacccttgtttcttgtgcaaatggggagttaaaagtatgcatgtttcttaattcttccccaccacatactcatgtattaaataaaatacatggcagtttaagttttttttctgccttggtaagaaagcttactgtgtgtttggttcccggtcaaggttggatggaatatggcggtccatactttattggatatggcaatccggtttttttgtttggtggagtgaatatggcgatccaattggttgtaaggatgaatgtggatttggtgatccattttttttagttgggggagtaggatggatgagtggttgcaatcaccctttcattagtagtggtaagtatacccccttgaaattcaatgaacccaaaataataccaatctactaaaaaaatctaaatagaaactaaaaattagaatgaaataaaaggaggaaaggagaaaaacggaaaaaaaaataaaaaaaaatgtcctcttcgtcggccgcccctcgcctcctctctcaccgccgccgccctgcctcctctctcgccggctgctgtcctgtctcctctagatttggtcatcctcgtcgtcatcatcattgtctcctacccaaccggtcgtcggcacaccccatctcctccagatccagttgtcatcgtcctggtcatcgtcgtcatcggcagcggcaacgacgcaccctcttctagctgccgccgcctctggctctcgggctcgctgccgcctcttgcctttgggctcgccgcagcttccttctttccacgctgaccgccgagctcgcatggtgagaggggtgacacgacctacgatactcactcgccccgctcgcctgggtacttgggtggctgcatctgggcaaatcggccggatccctccatctggcatctgggaggaaaattcccctccgtgccgtcctatcccactcccgcccaccaactaaacaaccacaaaaaatgggccgccatgtcctatccacccaaatacctccatccgaacacacccttatatatgatgatcaatatggaacggaggtagtacatgagaaccaacacttctcaatttttgttatctcttttccatataaatatatatatattgtctgtaacttatactcctcctattccagtttgatcatcagctaagatttttgagatctttccaaaatgatcatcatttaacaaatatatctttatttatttatataaagagtaaattagcatcattgaatgcgctgcatacaactaaccaagattaattactattggtggtacaactacatgcaatattaaaaatttaatgcaatccatgggatacattactagtgtagtatcttaaccgatgtgaattaattacataatgatttagttgtttttgatctctgtgttttttcttagggcaggtacaatagcaggctataaaccagctgcaaacatattttaagaagataaatgaggagagagaagggtagcgggctacagatttgtagccagctgtagcacggactccaagacgcagtgtgtatgattggtgggact

SEQ ID NO: 50037 - DNA, 14871 bp, Oryza sativa
ccggtagtgggctacactattaaacttgctgacgataaagaactcatttattttcactatttactaaatattattttatttactagtcctttatattggaatgagtcactagtcaaatgttttggcaattcctcgtgggcggatgatgcaatagaattttgaatcagctttttgatctttggttatccttcatgctcagcaagtttaatagtatagcctactaccggctccaattcatctatagccaatctaatagccaattcatacaatagttacttactatactattaatatatggtcccacctgtcatacacacattgcgtcttggagtccgtgttgcagctggctatagatctatagcctgttgctcttctctcttattgtttatcttattaaaatatatttatagctggctaatagcatgttattgtacctgctctatgtgattagtcaaaatgggatggatggagtgttattatctttcctcctagtgatggaaggagcaaccttgaattaaatgctccaataacaatcactgtccggttcgctttatttaggttcacccggtttttcgaatatggtgctgccataaagttacggttgtttagcataagagcaagtttaatagtatacgccaactactggtttcaatttatctatagctaatctaatagcttatttatagaactaggaaggtggcccgcgcggatgcgcgggcattatattattgaaagataagattattgtttgttcgttataaattaagggcaaactaatgtttggataatgttattttataataatttaagggttctatttttcttaaagtatcttaaaaaaccattcacaaacttttgaataggagatggattaagtacttatgacttttaaatcatgttttttttctcaagtaaataagaaactattggaagttaattattatacaatccatttatagagcaagatacttaaaattcttatgattaaatcatctcatgaagacgcatgatatagtaagaacgggaggaaaacgcatgcatggaaaaaaaagaaagggaaaaatgaaaaaaagggagaggaagcatacgtactcacgtacgtaggtgcgtacctatgccaaggcggagaggtggaacctcgtagtatttcgtttgttctaagatcaatttaatctaatggtttataatattggacacaccgatttaagtgaaaatcaaataatagatattttgctttttttcttagaatttttaatagttgctttaatttattagagcaccacgtggcagtttgagagcattttaagaaattttaaaggacttaacacatgtaattagaatattaactacataatatatatatgcatggggcatatggtattatttattccagcttcgtccatgtttatatacatgtagagagaaattaattatgtggctaattatgtggctagcaagccattagatgtctaattaatagcaattaattttgacacctatttacagttatatagtagctcttacatatttatcttacgactttgattatccgttgatccccaatttactgatcactatgactcgcatgaaaaaaacatgtactacttaggatttagaatagcttatttatatgatagttatttgagggtacaaatgaatgaattgacttctaaaaagctaaaatgttgtttaaaaaagacatcatttagaaacttggaaagcgtgcaaacgaaaacccaaactatggaattgggaaaaaaagagggttaaactctcttatagtatgcttgtcttagtaaaagttctattgatattcgttaatattatgcccatatttataacataatgatttctttcacctgtacgaacaaatagtacaaaatccaaatatgacataacacaatacattataattattctataatcaactcttagtttcaggttaaacagagctaagtgttggaaaaaattcaacccgcggtgcttaattcttctctcacggcatcacacctttaattttctttacatgttattaataaaattaatcaactccatatatgacttgatatgtggcaaagtggtagcgtagcggcggtcgtaatcaccttagatgccttagacacgacgctttgtcacgcgtgcaaaaggcaaaaagtgcagacgtgcattgtgtagcgggccaaaaaagagaacttcgaacgctttatttataagaaaacaatagatccgatgatttaaataatgggtccaccggttctagtgtaagtataaattagttattatagattttaaatttttaatttaatgggtacataatataatagtgtagactttattttgaaacaatgcattattggagaataatagtccaatgtaataaaaaataaatccagtgatttaaataatgagtccatcagcttaaatgcacgtataaattagttaatatagatcttaaattgtttatttgataggtacacaatataattgtgtaaactttatttttaaatagtgcattattggaaaataatagcacaaagtaatgagtacaccggtttaagtggaaattatcttacattattaattttatgggtaacatataatggtctaaattttattttttaaaattgtagagctaatttagttacatgcaagttgtacgatggtagattctctatttgtaaaattatgattatttaaaaaatatatatccattatataaatagaaaaaagaagaaaaaaaaggaaaaaataagcgaaagaagcgtacgtacacatacgtatgtatacaatataatgtgtgaactttattttaaaatagtgcattatttaaaaataatagtacaaagtaatgagtacaccggtttaaatggaaattatattacattattaatttaatgggtaacatataatggtgtaaattttattttcaaaaattgtagagataatttagttacctctaagttgtatgatggtagattctttgtttgtaaaatataattatttaaaaaatatatatctattatataaatagaaaaagaaaaaaaggaaaaaaagaattgaaagaagaagcgtacgcatgaattatgattatttaaatatatatatatatatatatatatatatatatatatatatatatatatatatatatatatatatatatatctattatataaatggaaaaaagaagaaaaaataaaaaataaaagagaaaggaaagaagaagcgtacgtacttatataaatggaaaaaagaagaaaaaatgaaaaaaaaagagaaaggaaagaagaagcgtacgttcatggtacgtatatatgatatatctagggaggaggaggacttttagtatataactaggaaggtggcccgcgcggatgcgcgggcattatattattgaaagataagattattgtttgtttgaaaattttgtctcataaattaagggcaaactaatgtttggataatgttattttataataatttaagggttctatttttcttaaagtatgttaaaaaaaccattcacaaacttttgagtaggagatggattaaatacttatgacttttgaatcatgttttttttttctcgagtaaataagaaactattggaagttaattattatacaatccatttatagagcaagatacttaaaattcttatgattaaatcatcacatgaagatgaatgatatagtaagaacgggaggaaagcgcatgcatggaaaaaaaagaaaggcaaaaatgaaaaaaagggagaggaagcatacgtacccacgtacgtaggtgcgtacctatgccctgggaggagaggtggaacctcgtagtatttcgtttgttctaagatcaatttaatctaatggtttataatattggacacaccgatttaagtgaaaatcaaataatagatatttttcttttttttcttagaatttttaatagttgctttaatttattagagcaccacgtggcagtttgagagcattttaagaaattttaaaggacttaacacatgtaattagaatattgaccacataatatatatatgcatggggcaaatggtattatttattccagcttcgtccatgtttatatacatgtagagagaaattaattatgtggctagcaagccattagatgtctaattaatagcaattaattttgacacctatttacagttattcatagtatctcttacatatttatcttacgactttgattatctgttgatccccaatttactgatcaccatgactcgcatgaaaaaaacatgtactacttaggatttagaatagcttatttatatgatagttatttgagagtacaaacaaatgaattgacttctaaaaagctaaactgttgtttaaaaaagatactatttagaaacttggaaagcatgcaaacgaaaacccaaactatggaattgggaaaaaaagagggttaaactctcttatagcatgcttgtcttagtaaaagttctattgatattcgttaatattatacccacatttataacataatgatttctttcacctggacgaacaaatagtacaaaatccaaatatgacataacacaatacattataattattctataatcaactcttagtttcaggttaaacagagctaagtgttggaaaaaattcaacccgcggtgcttaattcttccctcacggcatcacacctttaattttctttacatgttatctattatatactaaaagtatatgaagcttccttaaaacgctctcaaaccgccacgtggcgctctaataaattagagaaaattctagaaaatctgaaaaaaaagaaaaacatctatccctcgattttcacttaaatcggtgggtccaatattataaaccgttagattagatttatctcaaaacaactcctctgttccattccatatataggtacgttactgcttgcatgcgatctgttaaagggggtgcatgcacgtacataacctttttttccaaggtacgtgactattctttctctttttttccggtatataattgagataataataataatagtactaataataataatactactaataataataattagtgataataaattttgaataaaagtcactttacaaatatagaatataccagcatacaaatctttacaagtgaacataaataaattagctctacaatatttgaaaataaagtttacaccattatattatattatgtacccattattttagattattttgtaacaaaaatatttgtccatcgatattcacttaaatcggtcctaagtcgctacatgccacccctacaaatgctcctaagctaccatgtggcgctctgataaataaataatagaaattctacaaaagcaaaatatctaacccttaaaatattcacttaaattagtgggtccgatattataaacccttggattaacgtacaacggccccagctctcccataagtccgtacatatgaagtaagtacgtacgcacgtgcgaaaccgctcacccttatcacgtccatatttctctcctttccttttataattctaaggataattgaaataacattcattattaaaaacaaacaattataactttgcaaacctagactgcatcatcataaacgtatataatgtttgaagaaagtttactgcattatattctttacacatctatctatatattatatactgaaaatccattaaacaaaataattcaacaccaattaataaaattaatcaactccatatatgacttgatatgtggcaaagtggtagcgtagcggcggtcgtaatcaccttagatgccttagacacgacgctttgtcacgcgtgcaaatggcaaaaagtgcagacgtgcattgtgtagcgggccaaaaaagagaacttcgaacgctttatttataagaaaacaatagatccggtgatttaaataataggtccactggttctagtgtaagtgtaaattagttaatatagattttaaatttttaatttaatgggtatataatataatagtgtagactttattttgaaactatgcattattggagactaatagtccaatgtaataaaaaataaatccagtgatttaaataatgagtccatcagcttaaatgcacgtataaattagttaatatagatcttaaattgtttatttgataggtacacaatataattgtgtaaactttatttttaaataatgcattattggaaaataatagcacaaagtaatgagtacaccggtttaagtggaaattatcttacattataaattttatgggtaacatataatggtctaaattttattctttaaaattgtagagctaatttagttacatgcaagttgtacgatggtagattctctatttgtaaaattatgattatttaaaaaatatatatccaatatataaatagaaaaaagaagaaaaaaagggaaaaaataagcgaaagaagcgtacgtacacatacgtatacgtatgtatacaatataatgtgtgaactttattttaaaatagtgtattatttaaaaataatagtataaagtaatgagtacaccggtttaaatggaaattatattacattattaatttaatggtgtaaattttattttcaaaaattgtagagctaatttaattatctatgagttgtatgatggtagattctctgtttgtaaaattatgattatttaaaaaatatatatccattatataaatggaaaaaagaaaaaaataagcgaaagaagcgtacgtataactgtgtaaactttattttaaaatagtgtattatttaaacataacagtacaaagtaacaaagtaatgagtacaccagtttaaatcaaaattatcttacattattattaatttaatgggtaacagataatggtgtaaattttattttcaaaaattgtagagataatttagttacctctaagttgcatgatggtagattctttgtttgtaaaatataattatttaaaaaatatatatctattatataaatggaaaaagaaaaaaaggaaaaaaagaattgaaagaagaagcgtacgcatgaattatgattatttaaaaaaatatatatatctattatataaatggaaaaaagaagaaaaaatgaaaaaaaaaaagagaaaggaaagaagaagcgtacgttcatggtcgtatatatctagggaggaggagaggtggggcccatagtatttggtttggtttatgttaagatcaatttcatctaacggtgtataatattggacccaccaatttaagtgaaaattaaggggtagatgttttgcttttttcttagaatttctaggattttctctaatttattagagcgccacgtggcaacttgagagcgtttgcaggaagtttaatggacttttagtatataatagatagatagatagatagatagttacatactacacttttaatatctggtcgcacatgtcatacacacaatgtgtcttgcagttcgtgctacagttggctgcaaatctgtaacccgcgctctcctctctttttatttatcttcttaaaatatatttggagctgacttatagcctgctgttatacatgctctaagagaaactatagattatccccgatgatggacagaatcacaggaggttcactagcagcttagcttgggagattgaagcccacaaggtggatagaggatttttttggaggcggagatgaacctgaggcggctatgggaggtgtggggggagtgggagatccgcgtgctcgtcctgtccagcctgtccctgcaggtcttcctcctcttcaccggcggcctgcgcaagcgcaaagccgcttggtggctgcgcatgccgctctggctcgcctacctcctcgccgactacatcgccatctacgcgctgggcaacctttccaagaagcagaagctctgcgacggctcattcgatggcgagatgcacctcctcgtcttctgggcccctttcctcatccttcatctcggggggcaggacaccatcaccgccttcgccgtggaggacaacgagctctggctgcgtcacttcctgagcctgctgtcgcaggtcgcgttagccgggtacgtctactggaagtcgcggcccagcatgcggctcatgtccccggcgataatcatgttcgtcgccggcgtcaccaagtacggcgagcggacgctggcgctcagggcggcgagcatggactgccttcgcagctccatggtcacgcagccggatccgggcccgaactacgccaaattcgtggaggagtgccagtcgaggacggagtccggactggtcgccaagatcgtcatcgtgcaggagcggcctccagatgacgaggaccatgtcgaagtcaagcgagaggagtacggcgacctggtgtacagtgcgcacaggttctttcacaccttccgccgcctcttcgtcgacctcatcctcagcttccaggaccgcatcgacagcctcgccttcttccggaggttggagatggagcaggcgtacaaggtggtggagatcgagctggtgctcatgtacgagtgcctccactccaaggcactcgtgattcatggtcttctcggccgcagcctacgcttgttcagcctcgccgcgccggtcgtgtcgctcgtgctcttcacccgcgcgttgggcgacatgcgagaaggctacaaccaggttgacatcaacatctccttcgtcctcctgggaggagccatcttcttggagacatacgcgatcctactgatcttcatctcctcctggacctacaccgacatgcgcggcagagaagcgctccggcccgtggcggcggcggtgttttggctgatcgccctattccagccggagaagaggcctaggtggtcgaacaagatatctcagtacaacctgatcagctattgtgtcaaggacaagtcccgtcggtacaagaaacccatggagtggctggagtggaggtggaacttccgcgtgaagacgatgtgggacagctggaggtacaagacgagcatcggcgtgtcggagctgctgaagagccacatcttcgaacagctcaagagcaaagcaagcagcatcagcaaggaccccaagagctaccggaaggctggcgagcaccgtggccagtgggcgctccagcgcaagggcctctaccagaagctgggctggagcgtcgactgcgagtttgacgagagcatcctcctctggcacatcgccacagacctctgcttctacgccaatcatccggcggacaaagatgatgacggatgctgcagctgctcctcgtcgtccaagtgtctccgttgcctctgcagctccagctcgggctatcctgatgccgaggctcgagggcgtgactcgaataagctggcgacgatgagcagggagatatcaaactacatgctgttcctgcttgtcatgcgcccgttcatgatgacggccagcatcgggcagatccgcttcggcgacacctgctcggaggccaagaacttcttccggcgagacgacgaggagatcggggacgaggagcggtgtgccaagaggctcacgaaggtggacacgtcgattgcagagccgcgggacgtgaagggggacaggagcaagtcggtgctcttccaggcgtgcaaactcgtgagacagctcaacgagctggagggcatcacggaggagaggaggtggaggctcattgctggcgtgtgggtggagatgctatgctacgcggccggcaagtgcagcggcaatgcccacgcgaggcagctcagccagggaggcgagatgctcaccgtggtgtggctgctcatggcgcatttcggaatgggagaccagtatagggtggagtctggccacgccagggccaagcttattgttcatcataatcatagtaccatgtaggcctgtttggtccattttctctgttcagccatccaccatggccagcagccgcaggatatgctttgagattcgaacgtacacgtaactgccccgctcgtatcactttctgctggcgccccagaatacatgccgtgggtcccaccgaactctgtataggttttttttttttttgagaagactgtatagggtcttggttttttgtttcttccccaatccccaacccccggatccaccgcctccggctagcaggttgaggtggggcgcatcgatctgtccgcgtgttggcggacgccagcgagccgaggagaaacaatctactttgtcccgccaggagcaccatttgttggcgtaagcacgacattgcattatattttcgcccgtgttgcctggaacatgtgtaattctcagaaaagaaaataccaagttcgaggaatatttaaacacggctaattgcaacttaattcatgtggagcaaccaagacaaaagcgccaagtatatatcagtgtccactaggctgtgttccttggtcaaggtttccaatgatgcgttcaatgagtcgtgtttatatgtataaatctaatgatgcattcaatctagtttatatctgcaatgtcatgatttatttatggaataaattaaatcattatgtacttataatttcaacaggaaaaatgtaggattctaatagaaatgcaagtgcaaaacagatgattgcaaaacaaatgaaaaacccagaaatgaccatctgattaaaccaccggaaaaccaagaatcagatgagataaactcaaaggaaagtttccaagaagctgaagcgcttactaaattttcttcaaaatctctgtggttttatttagaaaatagggtaggaaaaataatatcccacctttcaaagggtaatattgtatcctaactatccattcttcacacttcatttaatcctagccattcatctatttttctttcctaatccaattgccaaacacaccttataggattgtctattttacaggaattttaaaaggtacgataggattcaatcatttgttttaaggggtttcatagaaatttttttctataggattagaattcttcaaatttcttatgtttttccttcatatcaaatgaccctacttgttgaagggtttcgtctgtgttgtaagttgtaattaaattccatcgggatttcgtaggtccgtgcaaacagagtaaaaggggataaaagcttttcagcagcttcgccgctgcagccgctttcctccggccgcattcgcttctctcttttccgccagccgccaccagaaaagcttcgtccacgagatcatgacgatcactgtcttcgtgggcggacgggaggggcatcggctcggtaaccggcgtgacggacgtggtcaaataacagatcatatgcatatgtggttaattacattgatgcatgcaattgggataattaaattaatgtaaaacacctaaacattcacgcatgcatgttatgggtttaattaccgagaatgctgcaaatctctatatacgatttcagggtccgatcccgagcctcagatagggccacgtggcatcaagcgttgcgctccattcgaattctcgatggagaatgtgccacgtattcccaccaatcccaggaccgttagatggtacatcaacggtgaaaaatcgtctggatgagttatttacaaaacgtaagatctaatcatctggaagattggaagagtccggagtattggacatgaatccagaaaaaaaaaatcgcaagaaaaatataaattcctatctcctactcaccgtgcctccgccctgcctctatccacatcgccagcacctgcatcggctgatgagcagggggtgatggcggctcgatctacacagcctgctttgcctagacatgcgtcgccttaggggggaggcgagaagcggcggtcgcggcggtgcaggagctcctgcggcacgtcggcgacggcgacgacgatggcgttctcaatcacgtcgtagattctgcgtggagtcagcggcccctcagaaaagctcgcgccaccgttccagctggttggccagagtcgcctcggccacggccacgcccacccgctcccctctgcccccaactccgatttcttgcgcttgcgccgccgaaggccgctcccgttgggcaccggacccgccacgcgcgcgctcctcctgatggccgccgtattctcctctccgctcgcatggtggtggcctcgtgggaatcgaatggataatggagtaatacagggattagtttgcctcttcttcctacggtagtagtagacgaatagcagcatactccctccgtcaaaaaaaaaaaaaaaaaaaaccctggtttccatgcctaacgtttgaccgtctgtcttatttaaaaaaaattaaaaaaaaaattaaaaagacaagtcacacataaaatattaatcatgttttatcatctaacaataataaaaatatgaattataaaaaaatttcatataagagaacagttaaagttggacacgtaaatccagggtttgccatttttttatacggagggagtatggtctgcatttttttaagcctatcccttctcaaacgctgccttcagcatctggctggcaggtggcaggtagatacgctttaatcgatcggtgccgtgcggtgcgcgacttgtggggtaacctatcagtttgacgcaggtaaaaataaaaaataaaaaataaaataacgaatgcagacttttatgtagcgttaggagttcccataaaaaaattttataccttgtcataccgaacatttagatacatgtatgaagtattgaacataaaaaaactaattatgcagtttgcgtgtaaattgcgatatgcattttttaagcctaattagtccatcatttgacgatgtagtgctacagtaaacatttgctaataacagattaattagacttaataaatttatctcacagtttataggcggaatctataatttgttttattattagtctacatttaatattttaaatatgtgtctgtatatccgatacgacgtaccaaccctttacaaccgagatataaacacccctttaattaccgcggcgtgataggttcacgaacacaagaagcgcaaaaatcttgccatcttacgtgcatcatagatagatcgaaaacaagcaataaagcacaatgtggtgaacgagtcatgttggatggattatttttatttctcttttttactaattcctccgtttcacaatataagactttttattattgtccacatatatatagatgttaataatctatacacatacatgtgtctagattcattaacatatagatacatatgttttacattgtgaaacggagggagtaatttaactgctcgttgtaaggctacattaaaacgagacaaatacataaaataaaagtcaaatatgagatatccctatatgactagatatgcgttcgatagtgtcaaaaggccagaaaaaaaatcccacgttttctatgcacatgctatccgaactgataaacaatatgttatttttataaaattctgttaaaaatttactctaaaaaaatattaatccatttttagttcaaataactactatctccatcccatattagttatcgctttgagtttttattcgtaatgtttaatcattcgtcttatttaaaaaaaatttggaattactatttattttatttgtgacttgttttattataaaaatgctttaaatataacttatccttttttatatttttactaatgtgaagtgggccctcagggtgtctacgtagttaattttctcatcaatggtttctaaggtaaaaaaaaatcagagaaatattaattaagaaaataaaaggactgaaatagaaagctgaaatacaaaatctaccataggtacaataaggctactgttaattactgtggcttgtacaaccttattctatatgttctatatctagaacaaggactaaaatagagagctgaaacatatgttctatatgtagcttattctacatggaatttttttttatttggccactcgtaaaagttacttccgttggaacatactagctacaaagagagcacaccaaccaacatgtttattttttccgaagagccggttcatgcgttcttgaagaattattaattatatcaacgacttgcacataaatgtttacataattgctctactaaaacattcaacatactagaattaatattttctacttgtcccattatgtagaaaagttctcttttgagatattattttgagacggctcttgcctactcgaagaatcgttaattatatcgaagagcactgcatgtgaaacatttacataattggcccattaaaacgttcatcaagctggagctttttttttagtttccatttatatgtttgtcgggaaataaacattttcagaattgtttccaaatagaagtatcacaaataccagctattatcgttgcttggttcatttaggatataagaaattaaaattctttcaaataactctacaacatttataaatcctaaatgaaaaatataaatattcataggttattgttaagttgttgcgccaaaggcgcgtctattttctagtcggacatctatggatgggtacgcctaataggcgatcgatagccatggggatggggtagcaatcagattcgctccccgcctcccccctccctccacctggtttcctttttttttcaccgcattatttgtctattttagtaaatttatacaactaaagtttatacttctaaagtttacacatctaaagtttagagaccaaaagtttataagtcaaaagtttatatatccgattcaaatttgaatttgaattcaaatatttttttatatatagtatttctgtacatttaaagtttatacacctaaagtttatagacctaaagtttataagtcaaaagtttatatacccgtttcatatttgaatttgaattcgaattcaaatat

SEQ ID NO: 50038 - DNA, 1125 bp, Oryza sativa
aaacttgacttatgcagcactaagtataaaaagaaacacaatatctagataatcaagccgttgactgatttttagggtggtagatgccttatctaatctaatatagtaaaacaatttagccaataccggcagtaaccctaaagcgagagacaaccgataaagctaaattaagatactaagactagattaagacatatgataaatagccagacaaatatatcaaccaaaccagagcaatccaagaggtcgaatgtaccgatgcagccttgaacaacgccgacgtagacgatacaattgcctgggccagtggaacattggacttaccccttcgttagagatcgaaaacccccgcattaggtgccaagtcccgccggacgataaaataaagtagaaaaggtaaaaggtggcgatacgctgaattgtaattgatcgtggagatagtttacaataaccccgggtgtacatatttatactcatagggatatactagtccttgtaggacaagaaagaaactttcctaaaaataaaaagaaaactaacaaactattcctaattaatagataacttgccatgctgtatcctccttgaacttggtcacttctagataagcttcctttaatagattaatttccttaaccaaatatagcagaaatccgactattggcgatgtgataattctcttagggcttaccaaatttcaatcttaacacacggttgtattcgttttttattaaatctttacaatattatgttaaaagaaaaacatgtgtttcaaacctttaaaactcaatgtttcatactgttgatgcgaaaaacacacactggcctgaaagatctacttaacttctgtgcaggtccaaaatcttgcttttagatttgtgagcgtgccaattgatttgatcctacaatcaacaagaaagaaagacaagaaaaccgcggttaaatccataaacgatagccgatcggctaattgccgatgacatatcatttatcatcaagccgatgtcatattgggatcgattgacagtcatgaataaataagattagactaaatctactcgatcggctatagatattaacgacatataaccaggggcggacgtgcccattaggcggcatggggcg

SEQ ID NO: 50039 - DNA, 5740 bp, Oryza sativa
ctcctgctctgtgccaacgcaacgccgtcgctgtcagcccgtcaccgtcgtcgccttacgtttggtccggccgtcccgctccctggcctggccggtagtccgcagcacaggcacaacagcagctagcaggctgcaggctagcgcctagacgcctggcgccaacgagtcagcgacctcaggggtaagccggtaggggcagcagtagcagttggaccattttaatcaaatcatcctcttccttggaccattttattgtagtcaagtaacaagcaaatttgtttgttcctcttgcaaatgatctgttcttgctgtctagatcagttaatcatctgtttaggttaatggaaatagtaggtactcctagttaacactgttctactgtgaaaatggaaagcatgcgcagttacttgcatattatttatttgtcctactgcattttttggtgtatgatgaatttatatatgatgcaaatattatttctttgttataaaatggtttttttgcctcaaatatatttttatgcgattacggcataaatacggtctttataaagcgaacattttcgccccatcttatttttaatcctgcgtccgccattgatataacccttccttcgatgtatatttaaactaagtgattacgatagatcggtcgccatgccgagacagtataaatcacttaaatcgaaatatacattaaagcaggggttatatagacgatcagacagatctagcatgtatcggttaatactccgatactactttagactaagatattaaaataagcaaaatatattaaacaagaagcctaatataccttaatgcgacaagatcttaatataaatgacagatctagcatatcaattaaacatataaaacataaagtagctaaatcaggtaagatcggctgaaaacccgatgctatctctctcgataatcataaaacaagccagatatcacaattatggatattactcaacagatcgaacccaactgatgtaacattaagcataaagataaatataaaatctaggcaagatgatgaaaacctctaagagatgatagatacacgatataatctagattaataacgaaacataactctatcgactactttctaatagtacaaaccagccgatgacaagttatatagcgcaactaatagagattacaaaacgcatatgataactcgacgaattatataaacaagattagagtgtcataaagatggaagcactaatcctgagaacgcaagccgtcatgataagtttacctctagttgaagatcgtaatcgatgcagcttaacccgaaaagcaagaactcgtcgaaatagaacgaaagtgaaaagggtggtgatgcgccgaaagttttattgaactgttgttgtaaattgcatgggttcgggtgatatttatacccaagatacatgatatgtccttgccggacacgactcttatctctaacaaactctaagatacacataaggctttgcggctgactcttgcctaaacatatctctaaggaaactattcaaaatatcctaactaatagatacaattgactatctgagagcttatctccatcatgacaatccttgtgtagcacgttaaagcagtttcataactgcctctagcaaaatcggccttatcggctgtatcggccatatcggctgtcctctgtctgatccatctcagccgatgcagtatccagccgatgcacattccgttcttcgaatctaactctttgccgaatccactttgattccaatgccgaacctggttcatatcttaccaaatttggtcgttaacacatacgcgataatgatatgtttcaatgcatgtcttgagcgtgtttcacaaaattcctaaaactactgccactactctctctcctctctcttcacctcgtccatgcatacatgcatgtattttaacgagcttcaaaatgatttttctcttaaattaattatccgatcacaccgttgtattcattgtaattaaatctttacaacaagatatcgcatgactatattgcgatgaaagaaaaatatatgtttcaaaccattaacactagtttcatatgtgatagcggcatgtttcaacgtgtattcaccatgtttcataggatttttaaagatttcaattgctaattttttgtttcaccatatataacttgatgtttcactcgttggttaattgaaacatttgaccgaccgaattatttttttggcatctggcgcccgatgggaagattcttcctttaattacagtaaatcatgaattagggattgattacaatcatgcatgtttccgccgtgaccatgtttgcgcgacgacgacagacgacagctaggagcattgggtcggacatgattctgctctaccggtgtccaactaaacccattaccatccctaattaggatatcatttgtgttatataaaacgtaaaatctaaatcgagaacgctctcaatttagtcacagtgagcgaccctatcatccaatcagccgttgtccagatatgtctcgaagaatcttactttactatagtactaattgatcaagcaagtagaacaaatattcctatcatctatgcttcaaataaaattttcttttaaattactcattcgatttacaatccgattacaccgttgtgttcgtaacaattaaatctttacaacaagatctcacatgattatattttaataaaaaaccacaaattacttttataatatatctaaattacttttagatttcactaagttacttcttaaatatataaaagtaaattgaataaagttttaaagtaattaacatatattatatttttgttataagttacttttatattatatttttgttataagttttaaagtaattatttttaggttatattgaattacttttatatgtctaagaagtaacttagtgaaatctaaaagtaatttagatatattacaaaagtaatttatattttttcatcaaaatataatcatgtgagatcttgttataaagattaaattgttacgaacacgacggtgtaatcggattgtagatcggatgagtagtttaagagaaaattgtatttgaagtgtaagtggatagtgtttattatagatggagtggtagccagctaccactagcgctaaacaatagcgctaaacaacacgatgcacgctaaaaaacagagggagtatgcaaatagcagctgtgtagcgtagggcctgttttggggaggttatagcaggtgcagcttctcacgaaatcttcagctttcccaaacagtttagattatcacctagattctaagaatttgtaattgtagaatcttcagcttcaccaaatagtttagatagaattcagaaaataaaagttagaagcaaaaaaaaatccagccttttagattctcatagtctggctaccgaccaacaaattctcgtaaccttaaactttctaaacaagacggtaaactagtttcaaagcaaggctttgcttttttctaaagaaaaaaaaaggaaagaaaattgagaaacaattaaacaacacaaagttattacgattatttgatacaaatgatatcccatggtaagtgaaagtacaagcaagaaataacatacgcgacaacttgacgatcgaccgaatgtctgcaaataacaaaccagtaaacagtcgacgatcgaccgaatgtctgcaaataacaaaccagtaaaagtttatataggctcgtagcaatagaatccgtgctagctcctgccttcttgatgatgtgacaagctgttcatagacatgtagagttcgtaaggaacaattcacagtttgcaagtacatatataggtacaaagatacagcaatcgataggtaggcatatgaatacagaatacataagattttatttataccttgtgtaatgcttatgcctgtgaactgtgatatcatggcctcatggggcgtccagctggctgctactagctggcatttcgtttctctctggatagccataactgtggaaagtataggtccctgacggatatgattctctcctggtcatggatactgttcagctgacttatttttaccacatggagaacttgaagacttcccaacgaaccatttggaatctcaagttcatccactccatcaatttcatgtagtaaaagtgtcctcaagttggcaaaactgttaattgcttgaaataccagcttggagatgccactgatattatggaggcggagcgattcaaggttacacaaatttgtagatagtaggacgagcgaatcatcccttagcttgcacaagcttaactccagaactttaatctgtttagatttgaaaataggatattggaatgtctgctcagccaacccgcccctgataacaagtttttcaagactagtaggattcagggtttcaaagtcaagagactcctcgtccacacgacttgcactgacatgcaaactagaaagacaggaaagcttcgacaatgaagaaaacaatgttttgctggatcggccttctccaataacaacagatagagtagttaactgggtcagcttctccacatgcttctcaaaggtatcacttgcctgcactgtctcgagagtccgcaattctttcaggtagttcacagttttcggggctttcacagctcggtatatgtctgggccttggccatccaatgtgtcagcagaaagatgcctcaatcttatgagtttgcctatccaacttggcagttcatttattctgctccccctgaggtccaaagtttgcaggttgtagagattggccatggaagatggaaggcatcgtatttgtgattttcgcaagccaagatatcgcaaattaaacagctggtagccaatacctctgggcaattcttcaagtggagattcttgcagtttcagaacagtaagatacttaagtttggctgtcagtgatgccggtaaggacttcaaatttgcagcagcatttctgctggccataagagtccgaaggtacggaaaatctactaatgcaccaatatcttcagggttttccgagataaataggcagcggacattggtatccatctctgctagtttaccaccatggcagatagctccaaattcttccttttgagagatagatacagccagctcatgcaccacaataggcatcctgcaacttgctactctaccttgttcgtccacatctacaacctgcagaaatccccagtggattagctcctttatatagcgctcaccaatttcctccacttgcaatgatccctggttctcgatgaaaccctctgcagcccataaccggacaagactctcaggcaacaggagaaaaccagccggaaaagtactacaatacaaaaggcagttcttgagatgcattggaaggttcttgtaactgagatatagtactttttgcacattgttcaggcttgacttgcttttttgaatatcttcaatttgttgagccatttcactccagactgactctgttttttgctttgagctgagcaatgctccaatagaaacaattgcttggggaagaaaattgcacaagccaataatcttcaaagttacttcacggagttctatagggcagtcacttggtcttccaaaagcctttgtacagaagatatcaaaactgtcattaggatgtaaacaagtaagcttcatgaattccttggggactctcgccgagggtcttacaggttccagcgaactagatggtgtttgggactgtgactccact

SEQ ID NO: 50040 - DNA, 5294 bp, Oryza sativa
ggaggcatcttgccggaactgtaggagacgacgaccggcttcgagcgataagaaaatcaatagggaggacggaggaggtagccagtggcggcggcggcgtcttcgaggcagctgctgcggcgcgtgtggcgacttgctactcgcgagcgaacagacgagggtgacgagagtgttgcagttgcctaaatatgtactccgtcgtatttttacattttgcttacatggtttaatcatttatttattttattaaaaatatttagaattattatttatttttttattcacttttttatccaacgtactttaaacacaattttttgttttttgtgttttatatttgagcaaattttttaataagacgagtgtttgttttttaaattttatatttgaacaatttttttctagtaagacgagtggtcaaacggtgtaaataaaatattaaaaaaatctcttatattttggagtagagagagtatgtactacctccctatcagaatataataatatgggatgggatgagactcatctcagaataatttatctggatatgtttagaataggcctcattttatcctacgtggttatattttgggacggagggagtaagctcgtttttcttgctgcttcttttagtgtgctctaactgctctctctttttcgtcgtcgtgacttttttaagtcaattagtttataggaaaatataggccgagtatatttccaatttttttaaaaaaaactttctacttttttatcacatcaaaactttcctacacacgtaaacgtctaacttttccatcacatcgttccaattttaactaaactttcaatttttgcgtaaactaaacacacccatagtagcttttttaacacaaaacaaatatattatcaaaatatattcaatagcatattagatgttagtaaatttatttacaaatttaatcaaacctaacaaagtttaaatagaaaaaaattaaaataacttataatatgaaacataggaagtagcttatagtctatattgtacttgttgtaattatgcctcgttcttttcagcaaattcaacatgcaactttctttttttaagcacgcttctcaaactattaaatatttgagtagaatttttctacatagaagttccttaaaatcaaataaaacaatttttcaaatctttagtaattaatactcacttaatcatgtgttaataacatgtctcatttcgtaagaaaaaaactaacaggatcaaatttataatggaggtgactaatatttatgtagtctatcaataaattaagaggggtctcgtatgtataataggttgtttctaatacataaccgttaactgctctaacactttcatatttttattgaaacttacgtagagattttcctttgtatgaggggtgtttttttctcttctccatcttaccgttcaggccacgttctaaactctaactattcaacttcctcgttttccataagcgcggttctcagaacgttaaacggtgtatttttttgaaaagaatttatataaaagtttctttaaaatatcaaatgaatctaattttcaaatatttaataattaataattaattaatcatgtgttaattgtttgctctggtttccgtgccggttaaaatctcaattcctatgcagaaacgaacgaagcctagtcctaaatgatacttcctccgtcccaaaatataaacatttttaacacagtgacaagtcaaacatttttaactttgactattaatagcaaaaagataaaaaacatcaatcattttatcattaaacaaactatcataatatacaactttttatttaaaacatattactatatatatatatatatatattgtatattgtattgatcaaagtagtatatcggaaactatgtcagggtctaaaactgcttatattttaggatgaaagaagcatcccgtatcttgtgtttacatgtatcactttatccagcatccacctcatgaactgccaggggcggagccaccgcctggctagcccaggcagcctgcctgagctcgctggcaaaaacttcattaaattttaatattgttgaataaattaatgatgtaatttttattaaaaatgatagttatagtgaagtttgctcgggctaaaaaatatttctacttgcgccactgcgacgcggcaaatttactgtcgtcagcgctgtaagtctgtaacacaactaaccatgtgttctagtagttttgaagtttcaactccctcgttttccagaaatttcaaaatttgccatcgaatacgcacggttttcaggacatgccatctaattcgcactactttcagaatacatcattgggacgcgaatcttcttcattctacgccactccgtccgccgacgtcagtcctcctcgtcgtccgtccgtctgccgccacctgcgccccgtccatccgccggcgccgccgcgttcttgttcgtccgccggcgccacccacgcgccaccgccctcctcatgctcggcgtcctctgccactcgctgtcgctcatgcagtcatgctcaggtacgcgtcacctccggcgagcacgccatcgtctccggcgacgccgccctcgacctgtcgtgtgcctgcagcatcgtcatgctcatcgcctacctcttcttccaactcaagacgcatcgccagctgtttgagccccaacaggttcgtgattgatcgatccgatgcatgtcctgtacgttcgatccatccaaccaaatggtaatcaggttgaggatgatttagtgatcgctcaagatgatgagccagtactgggatgatgacgatgatgcgcgcgggggcatacgaattggatgccggtgtcgttgaggatgctgacaccggcggaggcgaagttggcgcagacaagcaggttctcgcctcggaggtcggggctcaggtaaggcagcgcgggcatgtgagtcaggaagtcgatcccgtacggcggcgccgctcgcatccgtccgccggcgccgcccgcgtccccgtccgcccgccccgccatcgcccactacccctcttcaccgaatctcgcgcgtctcgccgaggagcaccatcgcgcctccacggggaagatggctgtgtcggcctcctcgacctactcgacgacgacctccaccacgagctcctcaactagggcgattttgtccaggcggcgtgtcgggtgttcgctcgcagtggccgcgttgagcaggccgtcgccgcggcggcggatggacggggactgacgcagctgtcgtcagaggtgccggcggacggacggggacgtgggtgcgcggcgctggcggatggacaggaacgcggcggcaccggcggatggacggggacgcgggcggcggcaaacggacggacgacgacgaggaccgacgtcggcggacggagtggcgtagaatgaagaaaattcgcgtcccaatggcgtattctgaaagtattgcgaattagatggcatatcctaaaaaccgtgcgtattcgatggcaaattctgaaaattctcctcgttttctatcaagcttccaaaactgctaataaaacgttttgttttcaaaaacctttcatataggcctggtttaattccccaaatttttttccccaaaatatcacatcgaatatttggacacatacatatagggcaaaaaaatatagattaaaaaactaattacaacgttaggggagaaatcacgaaacaaatcttttaagtctaattagtccatgattaggctcaaaagattcgtctcgtcgtttccaagcgagttatgaaattggtttttccattcgtgtccgaaatactctttcaacattcggtcaaacatccgatgtgacactcaaaagttttctttttacgaactaaacagggccatagaaatttcttaaaaatcaaataaacatatttttcaaatagcatccctacaaacactcatagatcgtcacatggtgttctaataaatcttagaaattctaagaaaaatttaagacatttagccatcggttatcatttaatttggtggatccattgttttcaactattagacctattaaaaagttgtgaattcaatttatctctaaacaacaagtacggtatgtatgtcgtcgctgatgtgatgcacgcacttggtattggaataattaactatttaccactcttacaagtggtaattaaatatttgccattagactcacatatcataaaactgcgagtagcaaatttttaattaccacattttaaaagtggaaaaaagttaaattaatgaccacttggtatcgtccccgacacgagcgtaagccacccaagtgactcaaaactgcaagcctagtctaatttgcaaatggatggtaaagatacatgttgcaaactgaaaatatatgcttaggttgggaacccttctcttcgacatgcaaaacgaaactcgtattattacatgattaactgttttttaacaatggattaatataattttttaaaacaacttacatatagaaagttttttataaatcacacaatttagtagtttgaaaagcgtgtgcgcggaaaacgaaagaggtgggttgagaaaagggggaagaacacagccttagtcttggggtctgtttggttggggactaatattgccacacattttttactaaggtagctaagcttagtcttgccacacttttgtggcaaataaaatgacaaattaagcttaggcaatgtttggcaagaaaatatagtgtatgatatgtgggccaggtggctaagagttaggcaaaatagacttgtgacaagaaccaaacactatctattaaaactttggcttgcctaaggttaggtgtagtaaatttagttgccaaccaaacaggcccttagtcttagttcaatgtatcactttggtcactttaaatgctcaaaaagtgaatgttactctaaagagtcttaaaaaaaatttgtccccaaaggagggccgtgctggggccaccccgtgtcagagcaggtacaatagcgggctattagccagctataaacatattttaatgagataaaagatgagagagaagagcagcgggctacagatctgtagccaactacagcacagactccaagacgcaatgtgtatatgacaggtgggaccatatgttaatagtatagtaagcaactattgtatgaattggctattagatcggctatagataatttggagctagtagtgggctatactattaaacttgttctcacgggagcatgacctcgccaaaagcaacttgctagacgtgcctccacggcgtaagagcaggtacaa

SEQ ID NO: 50041 - DNA, 1100 bp, Oryza sativa
ttatgatttattggatgaatctgagatgacctgtgatgtatttgatttgtgtgtaattttttaggatttgtgatgtatttgacctatgatgtatttgatttgtgtataattttttaggatttgtgatatatttgatttgtgtgtatatgtaaatttaagatttgtgatgttactttatttttgatgtggatttgggatgttactttcatttggggatatgcttctcacttgatttgggagaaaatagatatgcttcctacttgatttgggagaaaattaaaaaaaaaaagaaaaaggaccgtctggaattgccgctattctctctttactcccggttggtgttaccaaccgggactaaaaagagggatctttagtcccggttggtaaagatccatctttagtcccggtaaaaatagcgatctttagtcccggattcgtagtcccggttgaaaaaccgggactatagggggttatgattcgggagtaaaaagtacttctctaccagtgcttgctctaacggggaagtaccctcagatgagccatactcaatccaaaacttgcactcccgaacaagttgaaggaaccacagccatcaagtcgaaggcccgatctctccaatgcatgccttgacttaggctatgtgtagttccccaaaaaaaatttacaccatatcacagaatatttgaacatctacatgaagtattatataaagactaaaaaaattactaattatacagattataagatgaatgttttgagcctaattacttcataatttgacaatatggtgctacagtaaacatttgctaatgatagattaattatgcttaataaattcgtctcgcggtttattggcggattctgtaattaattttattattattatccgaacaacctatgtaacaccttatataatacccgatatgacatgctaacattttacatgcgtgaataaacacccccttacaccctcgcctcgaagcagctcgtttcataggggtgagccgtgagcgattgttgcagaagaatcgcgccttcttgcatcttgcaaagtccgtccttgttcgctttttctgccggggttcgtatcctctgccttt

SEQ ID NO: 50042 - DNA, 1935 bp, Oryza sativa
ctaataattattttaaacatgaaaaatatagaaatatgattttttttataaaagggtaacttttctaaagattttttaatgtaaaaacacgccgacatgtgggtgaaaaatgatggacgtttcctttatttgtccctttgtcgaatgcaaccttagaacaagtacaatataaagcaataagctagctattgacaaagaaggagagagaagaaaagtggactacatataaatatttaggtgcagtatgagctccaagatagtatgtgagaagtaaccacccctcatgcaagtggtaatttcttcacaaactctaagaaaagaatggtgtggtttggatgcaaattgaaaccaatatgctacatcttaattaattagttgatgatgtgaataaatttgaggtcgtaatcacccctgctataaaacttgcttataaaatttgctcttagagcaaagataatagactaatagtgggctataaacttatgtggagaatagagatttaaaaaaaacagtgttggctttcaagtaaaatctagctctacacatgcttcaaggtaaagaaatagagagacaatcttatagtcaacttataagctctaatataagcagctttagttatctctactattaatctctggctcttttatatatgtgtattaatttgttacaggcccaattggccaggctcagtataccatgcgtggcaaagccgcgcgctttttctagtccaatcttaagtttttatattttgggaaaaatgtactatatgaaataagaatggtctaaatatcttttatttaatggggtggactaaaagcataagtaggaaaaagattgaaagaaattctgaatggtgaatgattgtggagagaataataatactagtagtctacaaaatgtaattattctcagataagtttgagtgctaaataatacttatagtgagatgaaggtagtattaacgtggactcatgtttagagctctttaaatctaggattttatttatttattgagtggttgcacgtaggatacgaattattaaatttcaatcatatttttcatcaatccagtggttctcagtactcctatttttatttcttattatgggaattgctaactgtctgttgttgacagaaaattgatggttaaatcttgcacttgttaaaccgttggatgtgttcgggatcgtgctagccgttcgatacaccgtgatttctgagaaaaagagaaaagcaacgcacaaggagggatcgatcctgtgatctcatcctatttatacaagttacagtatatgctaggtacatatgtaattataatacaattatacaattatagtgtaattatgaaaattatattgtaattgtattgcagtaacatttgatagatttttaggatacttttcagtcccttttcttatataaaaggttgacagatattacaagaaataaacttactatttatacattacaaaattatatgaaaaaaatattcaaaccatgataaaaataaagaaaaaaggtatataccaacaaaattacatgtaaaataccacttcaattttaggtatatgaatatgcaatcttatgtgaataaaaatttacaaactttcgagcacataaagatttagcattgccccgagaagaaaagcacctctattcatgtgcagtcatatgggagctcgtgatcacatcgatacatgagctcgtgatcacatcgatacatgtgctgtgacatgtaagctcttgatctctgctttgcacaaaagggagaatattgtactattggttgatattgtacttctattcatgtgcagtcatgtgggagctcgtgatcacatcgatacatgtgctgggacatgtgatctcttgacctgctttgcacgaaagggagtatattgtactatttggtgatattgtacctctattcatgtgcag

SEQ ID NO: 50043 - DNA, 3041 bp, Oryza sativa
tggctcggctcagttagggaaacaagctaaaacttgagctcggctcgtttcctagctcgagccagctggagctggcttgcaagccttcctgttaaaacatctcttcatatatattttgtaattattaacaaaaaagcaagagcaaatcatcgacatgtaaaattaaataagtttatatattcaattcttcaaaatcttaatgataaatttaaagttgataaataataactccatgaaaagcaaaataatcgatataaacacatgatggtctaggttcgcgagccaaaataagcggctcgcgagccagctcgggctcggctcatttcaacaacgagctaaataagaggcttggacttggctcgtctggcttacgagccgagccaagccaaccaagctcgagccaagcccaagctgagctcatgaatccgagcttttttttccacccctattgaggtggccgaaatctgtgagacagacaggtggaccatatatttatactgaaaagttaaccactatatgagtaagcttagagataggctataaaaatctatacagtaagcagttggctgtattattggccttgctctgaataaacataggttagggcaagtactataagcctctacatgttgctcctaaagatgtcacataggattaggtgatgatatgaaggagagaagttagaagagagagaatgtgccagcctcatacaagaggcaacctccacacaatctttaagaaaatataagacgatgtgagaattaataaaccaatattgaagtttgtgtattagatgtgatatgttgtatttgttacctattaattaatagaacttgcccttaagtagtagtgctactatcaaaatgatagaaacatgcatgttaaaaatattgtacaaatgatgtgcagttgttgacgtaaaatctaaaagaacagacggaagcgtgtgagttctgcttagctttagtataggtcctatggatttcagaatgtgttagttagtttgatcatacaactaacaagataaaatacagatagattagattaaaatgacccgttggctatttcggtctatatggaattgtgggcctaaccgaaaccaataagattcaggtcaacggctatataactgatagagtttgttattcatactatatattttcctcatttctcttactcgttcaaaaatcgtacacacaactaaagaaaattttaatcatatatacaatttttcacacggttttatatattaataaaatttatgcatgtcttatgtataatgaaacataatactaaaaccattttatatttctactacattcatactataatatttcttgagtcctaacatacatagtacctaaaaattctaaacttctcacatactaaactatttatatgtaatatatgcacactacattaattattacttatccaacacttaatattttcatctaatacataaatcatcgctaaatctatacttcataataattaaagtactaaaatttacctctattttcttcgacttatatccctcttggcttggaccattacctcttcatttcttctctcttcctcaagctcttctcttctcttttttatggcatgagcacctcgtctggtgcaaactctcttctccttatatggcgtgaggtgagcaagaaagaggaacgaaaagagtgacgttttcaccgtgcttgattgctcaaagtttgagagcattgtattgacagcgcggattcctactctgtgcagcgcaactgtgctgcggtacgggcctagctcaattcaagagtattcagatgaatacccaagatttttagataaaaaatacaatatgaggtatatatttcgtatctgttttagatgaaactatcatcagaatggccagttttcagttagatcaatgtacttagctttaattaacaatggttacattgacagaaataagttaatttggaaacttaagatgccgcttaagatcaagatctttatgtggtatttgcttaagggagttgtgttaaccaaggataatttagcaagacgaaatttgaatggtaatttaagatgttgcttttgtacgaaaaatgagtatatccaacatttgttcattgaatgtcattttgcaaagtttatttggagagcagttcagttttcttttggtttatatattcctactagcatatctcatatttttgatgatcggctttagggagttgtaaacaaaaagagtaaactgatacttgttggagcttctgtcttgtgttgggctttgtggttgagtagaaatgatagggtttttgacaaatcacctacaattacttatatgcaggttattttcaaggcaatatattggcttcgtctgtgggcacagttacaaaagtatgatgaagatgaagaattcctaattgttgtgtgtcgtatgcttgaaacgacggttatacaactgtttgtcaatcatggatggagatttaccaatacactgaaataatgttattttatctttattggtttccttttaattttaattttggttggtgtgtttgctttcatttggactgcactcttacagagtgctagtttgtaataattggctgtaactcttttgagtaaaggtcgggatgttatttcattccattattaaaaaaatatattttgtatctgtgcagagaaataaagaaaataaatactattgatcaaaagaagcctaacaagaaagcctagcacactggctccctcatcccacctgtcttatcttctcattatgtaggcccaatagcccaaaagaaggggcaaagtcaacctagaccaccactggtcgctgttggttgttccaacttccaagtcgcaacatgtccctccgtcttgctcatcaacgcaacgccgcgctgccgtcgtgcacgcgcagatgtggagtagcccgcggcgtgccgacgcctatcgaggcctcaccctcaacaggtcgcggacgcccttccctcgctcggtcaaaccctctctctctctctctcgtcatatggcccgccccacgcctccgg

SEQ ID NO: 50044 - DNA, 6677 bp, Oryza sativa
tagattgtactacatatgttttttcataaagtatatcccaataaatcaagaaaattgctgaaaatcttgacgcaagttctaattcaataagcagtactaaaatatcatactgttgatcatacataccaaatattatgcttgtgttgtaaaacttttttttttacccctttccatttcgaatacctaatttcaaaatcctaggtccgcccctggcggtaccgcatggatgccacgggaccgacatggtcccgccctccaccacgttgccgcacacccaggccgcagcattgacgcggtgccgcaattctggcctacgggaccaaagcggtgccgcacgctcatcttacgtgaacgacccagccgactgtctcgcgtggctacgccgcaattacgtagcgctcccgcgtgcccatcatgccgtaaagagatatatttgtgcaaatctttcccatacatatatataaatgcaaaatcttaaaaaaagttatattttcaatctattatattattaaacagctttaaaatgaggcaccacgttcgctgtgggggactaaaatttcccatattaaccagagaaaaagaaaatgagagttcaagtaaaaatacaatttaaaaatagctgaaattcagaattaaaaataagcaatattgagagaagagtcaatataaaaacccgatacgagattaatcaaaatttagaataaaaataaaataaaatccaaaattagaaaagaaaaggagagtccatgtaggaatacaatttaaaaataactgaaattcggaattaaaaatcaggaatattaagagaagagtcgatataagaacctaatacgagattaattaatattcagaatctctatctctatctctactacttaaaataagaggttcttccgtcgtccgtaaaaaaaaaggggcgaaaaaaatcagtctaatccaaaacaaaaataagaggtgcttccgtcgtccgtaaaaaaacgggcgaaaaaaatctgtctgatccaaaacaaaacgggcgaaaaaaacggacgaaaaaaaccgggtgaaaaaaaaagaaaaaccaaatctgtccgatcaaaaaagggaaaaaaaaggaaaagaaaaacgaacccgattccaaggtaaaaaaagggcgaaaagaaataaaaaaggaatctgtccaattcctaaaaaagggcgaaaaaaaccaggtgaaaaaaagaccagcaaaaaaaaatgaatctgcgtggacgcggtaaaaaaagagcgaaagaaataaaaaacaaatatgtctgattccaaaaaaaaaaagaattatatgtgacgcggtaaaaaaaattgaatcctattatatttgacacggtactatatatctctatcttatctatatctactacttaaaaatttaaaatgtttctgttgtccgtaataatgaaaaaagggcgaaaaaacattagaacaaataaaagaaagttcgattcaatttacttccgtcgtccgtgaaaatcttatcttatcttaatctcaatctttccgaggggacgagcggtgccctccgtcctcacccgcgggatgaaacgccagccaaagcaaaaaaaaaacgaaattgagcaaagggataaactagattgaagtttccaaaattaaaagagggtaaacgatattgaaactcccctaactcgtaaagagggaataaaatagattgaaatttcccgacaaaattctctaaattcgaagaactctaatttcgggtaagaaccataagagtcaaatccaaatcaattaagttaagggttcgggttacttaccggatttgaagccccagagctcaccggagctttccaggaagcggcaccgccgcaccttcacctcctcgcagtcgtgtcgggttccctgcgcgcacgctgtcctggagcacccctccaccatcctttgctgaagacgggaagcgtcagcttggcgtcacccctaccgtcgacgaggtccaggctgctcggtgctcgtcgccgtttgcacgcccacctagccggaccgccgacgtcgtggcacggttttgcgtcccccagccggcgaagcaggagccgctcggcggtcgtcgctgcacgcgcgcaccagcttgccggaccaccgtcattccactcgctcgtcgccggagagaaatgggatcatgagagggatttgggagctagggttttgcccctctccccggtcggtgcttcattcggcgcggggacgattggagccgtccattagatcggacggcttagattcgcccagcgtcgggccgtcgccgccattgattatgctacgcccaatgggccgcggaagtgcatcggaccgtccccgcatatgtaggtcgcgcttagctgctcagcttgtgggccgtcgaattgactcaactcgccaaagatgggcaagcccaagtttgggccggcttgggaaggcttgggccgaaagcaaatttgatcaaacaatgtggctcacatttttcaaattaaagtccgtcggataaactgctaagtaggctcaaaaaataaatctaaaactaaatcctaaatcctatgctaattgatcaaattagactcggttctacctatttgttaatatatcaaattatacttgatttttacagatttgaggttttcaaggtgtcacaccatcaaacggtgtttttcccgttgcaacacacgggcactattgctagtaaaaataaaaataaaatccaaaattagcaacaaaaaaaaaagaagagttcaagtaggaatacaatttaaaattaaccgaaattcggaattaaaaataagcaatattgaaagaagaatccatataagaacccaacacaagattaattaaaattcagaatgaaaaataaaataatatccaaaattagaaaaactaaaagagagttcaagtaggaatacaatttttaaacaacttaaattcaaaaataaaaaaaataaattatgaaattagaaaaataaaaaagatttcaattaggaatacaataaataactaaaaattggtgataaaaaataaagactattgaaaaaaaaagatcatctaaaacacatgacgagataaattaagtaacaggtctataaagaagtagagtggtggcggttgatacgacatacaaaaactattaataaaacacaaaatagaatcctaatgacgattaaaaggaggaacgacaggcagaccgtgaagctaacgggcaaggcggttgctgggacttctagaaattaaaaataaataaatcccattgataataatattcgatatttaaaatctcaatggcaatcaaaaggagaagcagcagacggggtgtataggagtgtagttgcagagccgctgacggttggcgagacttctagaaaataaaaaataaaaaatgaattctaatgataattatgttcgacttttagaatcccaatgacaataaagagtaggcggcggatgggtcgtggaggagtatagtggcatcgtttgacgggacttataaaaattataaaaaataaaacccaacaagacaataaactctaaaaactataaggaccaatttttaaaggttcggaactttcaaaaaataaaaaaacccaatgataatcatgttcgattttaaaatcttggtgacaataaagaaggaaggcagcaggtgagccacaaaggagtacaatggcaaagccgctgacggtttggcgggacttctataaagtaaaaaatgaacccgaacgataattatgttttatttttaaaatcccaatgacaataaagagaaaagacagtggacgggccatagaggagtataatggcagcgtttgacgggacttctagaaattataaaaatgaaacccaacaaaacattaaactctaaaaactacaaaattcaatttttaaaggtttcagggagaataaatagaaatagtggtagattgagcaagcaaataaagaagcatatgacagaagtaaagggtagcaactggtgtgacttttaaaaactatataattagaaatatagggatgataagatttggattttcaaaatcttaagacaacgacatagatatttaataaattttaagtaaaatcatactaaaaaaatatatgattttgtttgggtgctagccgcagaattgcgcggaccacccagctagttttttaaaagtcaccttgcatggcttaacttacacaccggcagttctctctaaaaaaacacaccggcttaactatgtttttgcttttatccctcttccacaatttcaggacaaacatcaggcgcagttggttcttcagactgtgcagaagcagcattactggtttcagcatccttcgtccatactttattgttgtctagcggccaattagctactcctgagcagtgctgagcttcgacaaactccagcattggatacagttcacgcaattcctcccaacaaaactgcagatccttgaggcatctcaagcgcagcacctctactttgcactccccattctgaatttccagactatgcaacttcccaccagtaaaatacagtttctttaaactgtcagaactaatcgtcccaaattgtctcgacgggaagcagtagagatccagctttgaaagattagagggaagaacaaggttaaattttgcagcatctgattcgtcggcagcatctcgtggagataccattccccatgtaatcttcagtgatgcgagactggcaaaattggcaagcactttcagctcatcttctgcacgcttcagtttcttgctaacactgatgctaagtttgcgaaggttgctcaagcttaccaactcgcccagattgcaggtgtttcttttgttagagtttactaccaaaaaccctttgaggacttggagctgagacatcttgttgaatccctcgggcatatcaacgagcaggtagcactcggagacatccagatactggagcttctgcagcttggtgatctcctttgccagcacctgcagatcgtggcacgccctgagatccaacacgaccagctcggccagttctccaatggcagccgggatggccataattctcgatatgcctctcaagctgaggtacctcaggttcttgcacgccccgatccccttgaggtggtggtcgtcgatcagctcgatgtggctcttccttggataggcaatctggtcgactgggtcagccacccgccactgcccgagctgcaccgtgccgagttgcgatctgtaggtgaaccacgcggtgctcagcttgacatagctctggccaacgttgtagatcgtggagagctgcgggtggaacctggagccctggagcagcccgccatcgtgcaggcatgcgcggtgcgtcctagagaaatcgttgtttgaggcggaggcgccattgccatccggatcaatctccaagaacgcgctgctccttgcaacggccacgagcatcctgcggatccacgggtgcacggtgcacgcgtgggcggtgtcgcagtgcccccggcggcggactgtgcgcacgaaccgcaagtcgacgagctgctggaacaactcattgccgtcctccaaggatgacacgaacttttcgccgatccaccagtggatgaggagccgcttttttatgacggcgccctcggggaaggctgcaaggcagaggaggcaatgcctcaactgctcatccataccgtgcacggctcgccgcaggtgcgccatctgctcgccgtcacggacacatctccttatccctgccatcgtcggcgcagaagccgaatcctccacatcccttcctctgtccggagatggttcctcttgtatctttatcttataggatcctgagattgcctccctgatgatgccaatctgtactccgacaccggcgagcttcggctggagcgtggagatctcgccgccggcggcgagggaattgagtacgtcgtcgacgagctcctcgatggggtcgaagaggtggacgatgcgcctctcattctcgcccatcttgacaaagatagcttggagttctctcatcatgtcacggatgctgtcgagctgagcgaggtcggagctgctctcagcgccgcggaagctcttggcgtcgccgatgacctgcaggctggagaggagaggggtgaggatgccgtcgtcgatgtacttggagaagaggatgcatccaccttcaccttcagcttcagcttcaggagtggacatggtggatgcctctacaactactctacttgtgttgctcttctctttcctcgtaccattaccagagtactagactttccccgatcggtagagatctccgggaggggtaagattgtaatttgcacaaaaaaactagaaaccctaacaatgcgtcgtgcttaattgggccgcggctattgggccgacagtcgtgggagactgcgagtggagggaggccctggcgcgggaaaagtacacgcaaggtccctcaacttgttagccagatacaaaatcgttcctcaaccgcaaaactggacatccggcgtcccccaacttacaaaaccggtcacaataggtcccttggcggttttgaccccggttttatcccacgtggtggctgactcagcgtgggatccacgtggccccacatgtagtaagccatgtcatcacctctctctatctttcctctccctctctctctctcacttatctcctctcggcaagctgggcgggccaggctgtgggtggggaggtc

SEQ ID NO: 50045 - DNA, 3877 bp, Oryza sativa
  unsure (1)..(3877): unsure at all n locations
gccaagccgacgccgacgcgttcctcctgcctcgtcgccaccgcctagctgacgagctcgctagcctccccgcgcctccgccggccgcgcgtgtggctccagctcggccgccgcggtcacccgccgcttctcgtcggtgagcacggaaaggaagctgatgccgccgccttgctcccctgagccaacgccgacgcattcgtcacgcctcgacgccgacgccggcctccccatgcctccccgccgtcgtcaccgcgttcctcccgcctcgccgccggatttggacttgggaggagctcaccggcctccccgcgccaccgccgattccgcctccgccggccgcgcgtgtggctccagctccgccgccgctcctcctctccgccgcgccgaccctcttccccaccgcgtcggtgacgtcgccgccgccgccgccgcaccggctctcctctccgcatcagctatgatggccgcagccgcgtgccaccatagctgaccgcacgagggggacggggaggccggcgagctcgcaccggcctgagctcgcgcgccgccacccgagagccgttgtcgccggccgcaccacccttcggccgcacgctgcctcctgtgcgagagcagagagcgagaggaaaggagagaaatagagaaagagagaaagagtgctgacgtggcttactgacatgtggggtccacgtgggtctcacgctgagtcagccgccacgtgggacaaaaccagggtgaaaaccaccgagggacctattatgaccggttttgtaagttgggggacgccggatgtccggttttgcggttgagggacgattttgtatctggctaacaagttgagggaccttgcgtgtacttttcccccctggcgcggtcgggtcgccgtcgccgtgttcggcgggtgaagtgtcggccgcggctgcaggcagagggaggcgctggcaccgccgccgtcgagcaagtagaggcctaaatttcatgggccctagcccgtcgcccctctcgtttcggcccaggaacgaccctgatgctctgccatctcatctaatagtttaggacaggaggtatcgaaaacaacaaattaaatgcaaaaccgggcaaatacattttctcagtttgcaactttgcatacaaccaactaatttttgacggacaggtggattgagggtcgctcggtgggctcctcctcttgcagtgcttccttatcttcgggctttgggtacggtcgcctctatcctcgtgggcaactcctaggtaggggacatccgtgacgctctcaccgtaccagtcatctcccaattcctgatgctctaggatgcagtgctccctatccagctctcgccaggcatgacggatcgtcttgtttggcgttggatcagtgaccagcgttattcggcccgctcagcctaccaggttttcttccttgggcaacactccttagcttgcgtcgatgtgctctggcatgcaaaaggccctgctaaatgcaagctcttcctctggttggcgtttcagtagcgttgctggatggctgaccttctgcaaaagctaggtatcgatagtcatttggtctgccccgtctacgctcaagatcctgagacagcgaaccacattatccttgattgtgtgttcgctcagtaggtctagcatcttgtgttgtctattcctggttaggctaccccacttcgtcccgtggtgactcgctccaagcttggtagccgacctctagggcctgtctgcctgagtatcttcaagtgagcttcgactccgtagttcttctggtctcttggcagttgtgaaaagagtggaattctagggttttcaactcctttctcagtctctgtggttctcgagtccatcctccaggaagaccgtctgtggtcttctgctagcaccgcggcctttggggacttgttgggagcgtagtggggctctgccaccaccctccctctctataggagcaacgtttctctagtagtagtttcctgtctttagcaatccttttgtattttctcttttttccttgtcctctggcaatggacatccagccgattgcgttgtgtaacgaaaactttgctttcttctaatatattgaaaaaaattaaaaaaaaagctgatggaaaatatgatccctgcctccctgggatttgccatattacaatcaaggttcatacagtaaagataaaccatcctaactcacaattctaagctctaaacatcaacataatagagtactgcacatcatctagacagaatttatgtagtagccgccatgcaattccactccagttcaaagacatttgcagggcattctctagcatcaagtccagcagtgttctccccgcaaaaaaaaaaaaaaaaaaaaaaagtccagcagtgttctgtcctgtgtggcaagttttccactgcacaagcaagtgagcaaccactgttgccaacgcaaagtatccctgtctgtttccccagaacatagaccgtctggttcaggagttggcggccggcgggagtcgacgagggcggcgaagagttgccggcggtcggccaccgtcgcctcctctggagcggcggtcgtctggagttaacaaagtcggctggaggctgctgttcggcgcccgtagccggccacggcgacggcgaggtgaggcgcgctgctctgcacgagctgcctccgagcgacagatctcgatcctccctagtgtggatctaggggcaaaaacgtccacaaacttatcagagaaaaggaggggaaagtgcatttcgcagctctggcggcatagttgagcacttgagtggtaaaattgagctagctctttctcctcctcctcctcttcctcttcttattcttgttttctgatgttcttttcatttcctgattattaccttctcgagttcccaccagatcggacggagtggcggcgttgtacctgtcgtagagaagaagcgaacggtgggcggccgcaggatgtcggagctggaggtgtatagcttgctgcagaagatggcggcgatgagggacggcggcgactggccggccggtgcggagttggagttgcaggagttgtacaccgtcctcgagaaggtgcagcgcaagatggctcacgcggagccgctggtcgtcgtcgacagcggcaactccgcccgcgccgcctactccctcttcctcgcagaccttcgccgcgtcacgttcaccgtcgaccaagccctcgatagctactccgccagcgcccgccgctccccgttcatgcaccgcgtgcgttcggtggctctgatggggatggcggcatatggtgttttcgcgtttctctcggcccgttcgtcttccctgctgcaggaaaagcttttgccgcagccgctagagctgcgccccaagatcgccagaaagttggaagaggccgtgaaggacgtgaggatgcttctccgcctcttcagtacctacgtcgccgatctcctgccgccgccggagcaccagcagccagagcctggtctcggcgctgaccccgacgatacgtggtctcttgccgatcaaaaagaagccaacctccttgtcaaaggaagagaacaggacagatgtaaggtacggcagatcctcgaacatcctggaacgaaagtggtcgtaattgtaggaatggccggggccgggaagacgaagctcaccaggcatctgctgtgcgaaatgtgtagtgctactacgcatggcttcaactactctctttgggttacagtgtcccaagatttcaatccagaatggatttatcggcaggtgatgtctaagctgagcgatcaattgaaggcaggcgaagatgctgnnnnnnnnnnnnnnnnnnnnnnnnnnnnnnnnnnnnnnnnnnnnnnnnnnnnnnnnnnnnnnnnnnnnnnnnnn

SEQ ID NO: 50046 - DNA, 846 bp, Oryza sativa
attagattaactataaatgaattagagctaatagtgggctatactattaaacttgctctaaggacatggccaacggtggccataccccatcttggaagtgggcccaaccacacgaggccctcaatcccctaagagcaggtacaatagcaggctataagccagctataaatacattttaagaagataaaagataagagagaaggacagcgagctatagatttgtagccagctatagtatggactccaaagtgcatatgtgtatgacagatgttatcagatattaactatgtagtatatgtttataggtaactattgtatgaattggctattaagttgactatagatgatttagagccggtggttggctacactattaaacttcactggtggagaaatgatctttgctgggtcgacccaaaaccacaataatcccagttccaaaaagaaccgggactaaaaatgatctttagtcccggttgaaaaccccagaggcattgtatgatctttagtcccggttagtaacaccaaccgggactaaaaattatctttagtcccggttcatcccctgtcagattgatgtcagggggccgagcatctttagttccggttggtaacaccaaccggaactaaagatcaccactttagttccggttgggaacaccaaccggacaaaagatcaaaccgatctttactcccggttgaaaacaccaaccggaactaaaattcgaagcgtggtatataatccatatcccttatcctctcctcaacagatcgaatctctcccttctttccctccctcctccgcttcctccatcctcatcccgatccatcccctccacctcctcc

SEQ ID NO: 50047 - DNA, 743 bp, Oryza sativa
tccttatatgcgaatacgggacagtgccacataggcacaacccccgcatcgcaagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactaggtaggtccgtcgatttggcacgcaaaccgaggccaagcaagttaagtgtgtgattataataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataactgcaactatacgcaaacaatcgaaaacctaaacaaaagacaaaaagaaagatcctatttagactaattagtagtgccattaaatagatctcaatttacggaattattggaagttgaacggagtcaatcggaagagcggttgggaagatatgaattttggaagtttaattggaatttctggaagacgagaaatggtttatggaatttatagaaataatattctcaagaatattattgacagtcactgacgtgcgggaccaaaggaaaatgattcatggaa

SEQ ID NO: 50048 - DNA, 704 bp, Oryza sativa
ccattgctcacatcatggatgaacaagaagatatcgagatcaagtactccaagtgctggaatctgattcggccacctactacactgctgacttcaaacggccaccgatctgcatacgacctccgttttcagcccgtgagtacttgatggaaagctctcggagcctctttccaacggatccagcctcatccccgaattccatctcgtgtggccggaatcacaggcacaaggtgctgcgtcacctataatgggcctatgggcttgtaacttcatttgggaccccagctcaggtggggcccatgtggggtgcgccccaaccaggtgaagcacgcccctaggcatccctaggtcatcctcccacccctatatatagctaggtaccccttcagggtttattgggttttgtttagatgaaagtttagccattgctacttccttgcagcgcgcgtgtcggctagaccatccgtctgcttgtattcgaaaccccaacttatcgtgtgtattcattcctatttgcaattcagattacttttatcttgttcttgcttgtttcttcgatttgcttacaggaataaggttgatctgcaccggcaagatcaacaacccacggagaggtgtatcgatcgcaaaggcgcaacacaacgtcttgtacggttgtagtcggatctcaacgtttctcccaaatcgtagttatctcaactcacc

SEQ ID NO: 50049 - DNA, 792 bp, Oryza sativa
ttgttggttggactgaatattttctttggctacatgaagatcgttgttgagttattatagttgtcgaaagatggcaccccagacaccaataatgcacattaatatgtagtgataggctatagaagacaaccaaagtaacataatagtaggaggtagagaaacaaggtgcatagctcaatatgtgaaaaaagaattgagaagtacatggccgtcgaatgattgtgtgtgtgcaccattgtgtgccaactggaagattccatcttcttaacatgttggacaattcatcctatgcttctaggcatgggatgcatcaggaattattcaacagccttagattggacccttcgctacagcttggcgttgctctgcttgactaagagcaacttcaacccgagcctcatccctagatccccatcatccgttgcaggacgcagctccagtagatggatgtggcttggaagctccctccctctctccatgactaggaccttccgtggcgtcgtgcatagaggtttgtgaggtggcggatccgaagtctgtggcggggccgacggatggagacgtgcaggccagcggtggcgtagaggcatgcagtatcgtcgttggagccttggaggcttgcaaggcggcgactcatatgcaaatgacgatggagggatttttacatttccttgtttttcctagataagtgctaatgactaacaagaagttgtacttgaagaagggcatttaggtcatttcatgttagtactaaacttgcattgggaatttagggatgggtttttttgtgag

SEQ ID NO: 50050 - DNA, 3097 bp, Oryza sativa
atctgataattccggtgcagaacatgcagcagaggccgtcaacccaaaataacgaggtttatgaccataaagaacttcaaatggagtagtacccagcgaagagtggaaagatgtattataccaatattccgcgagggctaaccaacggctccattgtgaaggactagcatgcacaaagcatctcaaaaaggttttgagacactgattcatcctttcagtttgcctatcggattgtggatggtaagaggaactcattctcaactgagtgcctgcaagtctgaacaaagtagtccacaggttactagtgaagatacggtcctgatcagagatgatagcctcaggcaatccatgtaatcgatgaatgtgttgcatatatgcctcagcaacctccaaagttgtaaatgggtgtgccaaagccacaaagtgtgcatacttcgagaatttatccaccactaccaagatgcaattaaaggtagaagaccgaggcaaaccttcaatgaagtctaaagagacaatttgccaagattgctctggaaccggtaatggctgcaacatcccaggatacttcacatgctctcctttggcctgttgacatatggtacaatgttgaatgaacttcactacatcagatcgcagaccaatccaagcaaataactgtttaatcctttgataagtcatagtaatgccagaatgtcccccaatggcagctgtatgcaagtttgctaaaatctttcgctggacaataggattatttcctatccacattttatccttaaaatagagaagaccatttttcaaagtgaaatctgggattgcagaattattgatacataaggtttgaaccttactaagagagtcagagtcctgggcatagccttcaatcacttcttgagtccattctggaatacaaactgagagagctgacagcaccacagtttctttatcaggataccgagacaaggcatcagctgcactattttcagaacctttcttatagagaattttgtactgaagaccaagcagtttggtgaggctttgtgttgccaaggtgtagtgagacgctgttcatctaagaaagccaagctgcggtggtcagtacgaattgaaaactcggcatgttgcaagtacggtctccaatgatcgattgctagcataattgccaaactttccttctcataagtggacaatcccaaatgtcgaggacccaacgccttactaaggaaagccacaggatgatttctttgcattaaaactgcacctattcccttatccgatgcatcagtttcaaccacaaaaggaatagagaaatctggcagtgcaaggaccggtgccgacacaagtgtgtgcttaagggtgaggaaagcttcattagtcattgaggtccaagcaaacaactgacctttacgcaaaagattagtaagaggcttactgatgatgccgaaattcttgacaaatttgcggtagtaccctgccaagcccagaaaactgcgcaactccttgaccgattgcggtgtaggccaatctctaactgctgcaattttgtcagtttctgtggccactccatttggaccaatgctatgccccaagtacgataacttttgttgggcaaatgagcatttactctgtttaaccttcaaaccatgtttgttcagaatctgaaaaactgcccgaagatgatggatatgatcttctagagttctgctgtagatcaatatgtcatcgacaaaaaccaacacacaacgtcgaagtaatgttgacaggatgctattcattattccctgaaatgttgctggtgcactggtcagtccgaacggtagcactctaaactcgaagtgcccatggtgagtacggaaggcagtcttatgctcatcctctactttcattctgatttgatgatatacagcgcgtaaatctaactttgtaaaccattgtgcacctgacagttcatccaacaactcatcaattattggcaaagggcatttgttcttcactgtgatggcgtttaggtgtctgtaatccacacaaaaatgccaagatccgtctttcttcttcactagtaagactggagaggcaaagggactagtgttgtgttgtatgatgccattttgcaacatttcagtgacctgagcttctatttcatcctttttgtgccggtgtgtaacgatatggtctcacattgatcggttgtgccccaggtagcaatggtatagagtgatcaaagggtcttgtgggaggtaacccttttggttcagcaaaaactgtagtaaactcctgcattagttcctgtacaggaactggaatggtctcaggctcaacatcatccgtgattgaacaaagttgaaccatatgtgccacagccttgcgttgttggaactgttgcatttcatttgccgaaagaattttgcaatgagccaattctgaatgcaccccttgcagtgtgacggtagttccctgcaagcttaaagtgatagttttcagagaccaatccactgacattggactgtgtttcattagccaatccattcccaagatcatgtcatagctggttataggtaaaacccttagagttgtctgaaatttatgaccctgcacttgccattcacagtttggaataattgctccacaacacaatgtctctccattcgccactcggactgacaaccttctagagagaggctgtattcctgtcaatccttcagctatctgtgaactaatgaagctgacagaactgccggaatccactaaaaccaataactccttaccctgtaattgccccaacattcgcatggttccatctggttcagtcccttgtactgcttgtaaggaaatggccataagttccctagtcaaagaaccattctgtccagcattctctgattcaacatgactgtcttcttctaagaacagacatagtaactcttgtaccacattcaattgcactgatgaagcacacttatgatttggagaccacttctcagcacagacataacacaacccttgagctcgccgataagatttcagagcagacactttttcagttaggcttgtcggactgcgaacagtatctgaactgcgtctctcatctgcacgattactg

SEQ ID NO: 50051 - DNA, 704 bp, Oryza sativa
  unsure (1)..(704): unsure at all n locations
tcatctgaacgtggtggcctgcagcccatttgcttcctccttcggctgcggcgagttgggtggaagtcggcggcgtcggaaaccgcgccgccttcgcctccgatggagtcggcagcagcggcgccttcctttcctcacccgtcgatgggactcaaggggaagacgcagccggtgcagattgctgagatttgccgacgaggtcgagttactgacgaagttcgctgacttcctcgcgcaacccctgaattgctgattccacttgaggtctccatccactcactcccgcatccaacttcaccacggctgcttgtgtctcgcnctgcttggtgttgagcgatgcgagggattcctggatgtcgccgaggattttgccgaagtccagattctgcttttccatcgcctccacttgcaattgcaacctagatgtatagcgtggcttctccaggatgattgctctgataccaaattgttacgtctctgaagaatttgtgccacaacaagggaagaaattgaggatttagggagagaattgagagtttggggaagaacagctaagaacaggtagaggcagcaatagaacagggagagatttgaattgatttccgaatatttgtttctacaatgtttgattcgttctcttccctgccggtctcttatagcgatgagctatggacctctctccctccctgtggcccagcccaatt

SEQ ID NO: 50052 - DNA, 8611 bp, Oryza sativa
  unsure (1)..(8611): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggaaatcttgctatatatactttttgagtaattttttttttgcagggacacttttttttagtcattgacgtgtgggatctggtttattggaagaaaatcttgtcacatctatagctacaaccaaatggttgtcaaggtgatcaaacttaactaaccttagaagtggcagattgtgaatggcaaccaaacacctctataaatacgatcatctcatttggaaaaatcacaaaataaaatatattaagactttaaaatggagacagtaccgtttaagtaatttcgcagcggtatacttatagacaacacaccacctgttaaaaaaatgaattaaaagtacattttatgaacacaattttgcatcgcgtaaataatattacaacagagtaatggcggttcaaaaccttatattatcctaacagagagaaatagagatagtacataggaagatcacggataggggagaaaactagaatttttttagaaataatattattttaataaaaaaattataaaaataggagctgatcagctaaaatcgcaagtttaatatcctgtcgaacaaccgcagttcgacaggttcgatagggtagttggtccataaaaaaaaagtacatgaacagtgctacgcattgttcggcaggggcatatcgaacttacaaagttcgatatgtcccgcatgaacaatattgcacagtgcttgttctccttttttttaaaaaaatatcacctgttgaacaaccgcagtttgtttgatatgggcccccgttaaactgcggttgttcgacaggatgctaaacttgtgattttcaacttctatttttataatttttcattaaaataatattattgctaaaaaaatcagaaaactaagccacatatgttgtttatagtatataatcaattgagcaggtgggcagaacgagcgattagtcgcatgcatgaaaaccatactcatgcagtccaagcaacgacgaacacacaattaagcagacacgccatcaaattaacaacaactcgatcgatctctagctagcttatttatacctggccactctcgcatctccctttcgatcgagcgagcgagcgatggggaggtcgtcggcgtgctgcgacaaggcggcggtgaagccgaagcgcggggcatggacggcggaggacgacgagcggctgcggtcgtacatccagcagcacggcaccggcggcaactggatggcctccgccgctgcggcaagagctgccgcctccgctggctcaactacctccgccccggcatccgccacggcgccttctccgaccacgacgaccgcctcatcctcgccctccacgccgccgtcggcaccaggccggtcctcctcctcgccgcccaccagctgcacgttgctagcaccagtagcggcggcatgcacgtcggagtcggagaagaaggacgcggctacgacgacgtcttcgccgccggtcattcgttgtagtcgacggcagctacgagcggcggcgcaacggagctcgacgagatcttccgttccaccggcacgagcggcggcgattgttcatcatcagctcagaatcggagcacggacgacgcgctgatgatgatgatgaatggcacaaccaccaaaaccagctacaatatttgcaaggcaaattacaaactggtgtgcagcagcagcaacttgtatttggcatgccttactggtgataattaatgtaatcgtacattgatttacagttgagatgttttgattaagttttctcttgttaattttcttaaaccacctggcatgcatacgcattgtatgttttatgcatatgcactagttaataaactgttaattaatgtaggtgtttaatactacataatacttttatatatgtgtcctatatatagtgatgagatgaaatgaaccccctggaccatgcatgattatactctgctgttctcttttgatggttggttcatttctctgaaatttatttattgggtagttcaggataagggtaactactgaagtaaaggtcattgtcaaagtgtctcgctagctgcggtggttcacttcgttgcaacctcaagtttattcgtacgaacgtacggtatgttgagagatcaaaccatcaatagattagagacccaacagttaactgatcatttcttcgttagactctatgattattgagatcccagattagctctaagaattcatgcaggcaacaagtaaagtacctatctgtgacgaaatatgatactgaagacctggaagctagctgctctgtccagaaattctagtgtacagatcaccgctgacatcaacaagatcagtcatcctttacacttggaaagttgaagtcgatcgatcgattgaaaattggaacagattttgatgactggtcgcagcatcactaatctgctgacgtcaatgactctgcccttgtggttcaaaacttcaaactgtactacacttatgtcaaattcaaacacaaaccagttttccgcaaggttcaaataccgcgggagcagcctggtgagaaaaaccaaagctgcaggctaactgccctgacctgatcatcacaagtaatgtgtggaataatacagtgcccagaccataagttgcagcagcaaaaacaccacccaaactgtgtacaagcactctgaaaatgttctgcttatgttacagatcaactcttaaaagcatatgctttgagggaggcaacaaaaagttcttgcttatttccctgttcaaagcactggcagcagtcaaaaatcagatttcttttaagagtaaattgcatcgtcggtacacgaacttatcaggtgggtgcaatctagtgcacaaacttgtaaaatattcattttgatgcacgaatttgtgtggtgcgtgcgggagaagtcaaaaaggacatgactaatgttattgacttagaggctgattaggatactatgttaacatatatatgaggaggatgccattagacatacacctattcaataaaatatagaataggatttagtgaatgtagaaaaagattaaaaaaatcgagcactgatataagggttagaaacatatgaaattcatcatttcaatgatgaaggataaagtagagactaaatttataaatattgcatgttttataataatcactgcacgtatgcacgtcacatcctaatcaacatcaactttataaaattaacattgccaaattattttggttctcgttcgcacgaactaggcaagttcatatactgaaacgagcattttataagtttatatactaaattgcacccacctaacaagtttgtgtaccaccaatgcaatttactcttcttttaatcttttcaagaaacagtagagcctaaagagatggagtactccatacaaagaggaaggaaacaccaccaaggacaaaagaaaatattcactgaaatcagcatgcaccagatttgtgatgcacagcacaaaggataatcccctgagctcttttgatgacaaagactgatggtggctgtaaagtttgatggggaatatgcctcccaacagctacagatatgtatagattgcagcccaacgctaaatctcaagaactgccaccaaatacaaaatgatggcacatgctttttgacaaatatggattaaattaaaaaaatgtgcagtccaggacaagctctaagctaacaggcatggaaatttcagttttacattctcagatgagttgaagttagaagaggagggtaattgagttgcagagtagctgaggttaccaaagaaacaagtttaaatttcatgtaacagaatgacctagcactacaacaatatctgcatggcaaaggcttgaatatactgattaactagcatgtcctagagtcactagcttggaaatcaaacggatcaaaacaacaaaattgcttttcaggtatcctgatgctctctcaatgtatgttgtatgatgtatgtggctgtacattttcatcgctgaacaggctgatgaaggggttagtagttagatatcctattctattctgacaaacctcttttctgcaatctgacaaggaaagtaatcgacttcacagcatgccgaagacggctaactgggagtccattcagtgttgggtgagacaactccgctctgggttcctcgaagctttcttttccattcgacttatcagagctacacccttgttcctcatcgctcccgacagtctgaattttctccaagggtatatcttcagtgtcgtggaactgacaataggcagaatgaagccggtggtgaatttcatccattcttcctgaccgttcgtcttccctgtccatgtcaattaaatcctgtacaatcaaaatgcagtagtcaatcacccacgagcaaaaatctctaccagtcaccacaatgatagaatgtggagaccatggggttattttttaatttgttgtccacttaagtccatcactatacactatgatggaactaatacgaacctgtgctggggtagttctgaataatgggagaagtcgatttctgcaatactgattgaataacagagtgaggatgataagaggtatggtgaagcctgcagctactggtgattctttcaggccaaatacaccaaggcagataatctgtgtgagcacgagagagaatatcactgcgttgtgtgcgattggccagtacaaaccccctgtgtcatatcttgtgcggtaaacattgagcaactgaaaacaccacgaatagaatatcattagcatggggaaataatagggttgaagaatgaagctaagaaataagaaatactatttcagtaaacattttttacaagaacatgcaattttctttccaaatttaattgcatgaaacagtgcgagctactcaacaaatataatggtgcagtaaggttcatgtaaaaaatgttcaccaccacggttacaatttgcaacataataaaatattcattgatgaagatattcatatttgagaataaaaatatgttatgaacatataatactccaagtagaaatgaagaggttcctcacctgattgcggtacacgatgtaaccaaggaagaagtacactaacagaaaaggtaagatcaaaggtgccagtacagagcatgtgaagcccagtagtccgaacagcaaaacttttggcacttctgtgtgatatgggaatgagggaacaaactctgtgtcttctggcatacgtagaatatatttcctcacaaagttccatattaaaccaaataattgcataagttcagatgataaactggcccatcctgatgtcagaacataggtgataaagaaggtagcctgaaaatatttacagaatagcagagagaagttaagaaaaaaactaagggacaaaaacagtatctttttggagaaacctttcatcatgtactccaaactattcatatcttctgaagcacaaagacaaaaaggtgtttggacaatatttacctggacaggtatagctctagcaagctggacagggatgtcctttgggcttgataacacattcaattggcttatgacagtaccagatagtacatttccaaagaatatgttccaaacagtgaagtacagcactttacagcaagcactcctcttcctttcactgtgagatataggcccctctaatgtagaaaataatatcattatcggtgcaacggcatataaaaatatttgcagtatgacactgggaaggtacccagttacaagctggctcatgtatttcctgcacacgaaagagtactcagtagatgctgcatagaaatgaatagaagcccgtatttctacattaaatattgcctcagcaacacaagagaaaaggaaacatcaaactgtgttcctttacacatttgaattgactaactgcagaacatgttaaattaattggtctaatcacaagaatagggcctcacttttaaaatatatatatatacatgagatacgattcgcactacaaataagaacaagctttgtaataacaagagattggttccattttaacatgtatacttacttctccagtatccccttcaggaaaggaagcctctgctgcaactgctctagctgagatagtccttgtataaatgtcactggtatcagaaagaataacataaaaacaattgaaccaaggagcgtagctattcggcgaatccaaagctgcttataaggtagccaaagatttgaccaatacacatcatctggttctggagctagatcagtaacccatttcatagggttagatgtttggagtatttctgaggcaacaagagcagcataccgagttctgaaatatacaaaagcagctgcacattcctggtacaattcaacagttaaagttactggttttatactgactaattgacgaactaccagtaaaagagctaatatttgtgagattacaagttcaacctgatcatctagtttcaagctggaatcttgaaggtcagatttcccctgattctgctcaagcccagttgccaacagctggaaagaattagatgaggctccgcacagacagcaccggtatgaaattgctcgacacctctgatcaatagtgctgtctgtaaaatgtttgaatttcctgtatgccttcttagcaccagtctgccagaatatgactagaattgttacacaataagaagaaagtgaaataaaaatatgcaaagccataaattcaattcaaggaaccggagattaatgaacactactctatataaaagcacagagctgagaatcaaattagtgggaagaatgtgataggttttgcttgtttcccccagtgattacccaactacaagatagtagacccaaaattaatatcaaatgacaacaactatcaaggccgtcttttaaaattcccaataaacaatcagcaatattctttattacaatatgttcaaatttatatgcagctcatcccttcgagtgcagattttaccattatcttctgaacttttccaactttgtaaacaacttgatggaacaggtagcttgatccatggtacttggtgaagaaatcatcaatagcattactgcatgattctttggtttcctttggtattccacgaacaaggacagtaaaatggcttggattgggcattgcacaagtaagatgacggagcctcagcctagcaatgtgcttgtactcctaaattatcagacaaataatgttatatcaaatctactcctcaatatgaggaatgagaatgtttcaattactcctaagagaaaaaggccttacaagatataggagaatgcaagctactcctgatattatgtacaaggctacacaatggacccaaagcctgcaatgcaaccggcatataaatcatatctttctcaaaaaaaaaaaaaaaaagaagaaattattgattctatgaaagtacttttgatgacaaatctattttcacatgtctttttttttttgcatttattagtgatttgattgcacacattctaaaatgtcgtctatttgagagcggagggagttctctaaatgccagcactcaagaggcgtaaatgtcatgtagaacattggttaaactaccctgtagtaaaactacaagaagtttctcatctcaccatcttgatctcactttcacattcccaattgtaaagatatccaatgattctgaaggaatccgaacatgatgtatatcttgcccaaagtagttcagtggtagaattccaaacacacacagaatggcagctagagagaagatgcgtaagctgttgaaaaacaaatgtattagcatgtaaatttggatagaggtaaaaaataaggaatataaatctttaaataaaagacaggggatgtgctactgtgcattacaacaagtcaggaacttatgctttatacagctacaaattttcttctccttctgattcatgcccatattgaagtttaaaaactcagcaatcagataccaccttctaataatatataaacaatacagggaagtaaaaatacctgaatactagaattctattgaaaacaacagcatctagcccagcagcagccaagatctcttcctcggtacactgcagggcttttactatccagccagtagatggtacaaatctctccaagataaaagcttctcggagccgattatgctcctcggcaatcctcctcccaaagtagaccctgacattggctggctgcttcctcagaacagaatagagcgatataaacagcacagaaagagcgatattgatgccagcagaggtcagaagtccgctgattttcattccttcctagcaagtgcgtggcgcgct

SEQ ID NO: 50053 - DNA, 8313 bp, Oryza sativa
agataataagtagtaattaattggctaaaacaaaaagtagtggtagcatgtagaacactccagatgcaatgtcatgtgcccaaatgacatgagggctgcttatatattattctactaccaagtggagtagttaattaaaaagaagaacacgatgcaagaggcgtcaacatcgttggctgcaaggctgcaaatagaggaatccaagctgtctgaacaggttgggtttagattcgatggttggaaccggtgtttgcgtgtgagcatccgcatcaccacaacaccacgcgacagaaagcggattgcctgcaaactgcaactctacctgaccctgcaggcttagtatagaaaccaagcagaaaattactactacatcgcattaaccgcgactcctcccccattaacagattaaccgcaaccgcagcaagagaaggaacagaatccaactccgaaatcgatggacaaagaacggggattaacaactgaaatttctgtctaaaccaacgcgtagtaaatccgacgaactaaaacgaacaagtagagaagacgaaggaggaggcgagattaacttgcctccaagtcgaccgcccgctcgccggcgcaacacagcaaccgccgccgcctcggtggagccctgcgccgccattaagtgaaaccccaatagaatgagaaggaaatcaaccaacgaagcagcacaaagcagcaaaaaaaaaaaaggcagcaggagagcagattaccacggcgacgaggagtgggagtgggttaaattaagcgcggccgcggcggcggcaatggcggggagatgcggactggattggagcagacgagacgaggcgaggcgagaggaggaagaagaagaaggggatgatgaatccaaactttttcctctctctctctctcgctttttcgatttggtttcgattttggtttggttttgatttgggtttggagagagtacgagacgagagtggaagggaagaagcccccaggagttattgcaaaatcaaatacggagtactacagtgtcctttaagttttctttttcttttttttcctccgaggaataaaggattggtgcattttactactcctatcaattttttttaaaaaaaattaaaattgagatgagaaaaaggagatgccacgtaaggtgggcagtggagaacgtggtgggggtggattggtcccaacagtggggcccacacgcacgccgtgatgacacgtggttctcaccgggccattggaatcagaggccaagcagtgtcttgtcatgcttggttaccaacaagtaaagcacacaattcatcacatcgatcgatcttgacatcaaattaatcaaagagcatgatttgattttttgtttatccagatcgtggccaaaaagtcccttgtaagttactcctatgcaattagcatctttatttgtgtttggatttgagttcggggagccttacggcatgcaccattcatccatttattcgtactaacattataagatttataaaaaaaaaagtcccttgtaagttactcctatgcaattagcatctatattcacaatgataaatactttcataatatataatccaaatattgttaacggtggggtttttttcctaattggaatgtatcatatcattttttttaaagttaccaaagatttgcttggatttattttttttcgccaaactttgataaatacaaaaaaaattctgtcataattttgataatattgtcaacttaccgaaataccaaaatttgtaaggtgtgttttagctacaatcttaacaactccctaagtgttaagttcctgtaaaaagtcaagctaacatccatatatataatatgaaagaggttaatacatagtatagtcacttatttacgtacgtggcagctgtctaaaccttaattaggcatcatcaatggaagggcacaggcaggtgagctaatccaagaccaattgatcaagccgaccaagacaaggacactttgcttttcttttccccatttttatggactttgacgtggctataagagaagaaaaatcagtgggcatgtgtgagattaccatctacgagtagtttccaccagaaattccttccatacatatatatatattatataaaatgcagatcgatcagcgtttcatccaaaaagatataatacatcggtttcttaatatttaacgccgttaacttttaacgtgatatttaactactcatgttattaaaaaaattatataaatattatttgttttattgtgacttttttcatcaaataaacttttacatatttacacaaaatatttgaataacatgaatgataaaacatcgtgcgaaaagtttacgctacgtgtagtataaaaaaaccgaggaaatatagaattgtggtacatattgagaaaattcggcagaagctgtctgtccaataataacaagacagtgatgacacacgacaaagatccaccacacatttcacatgcacgttgcgtacgtaccggccagccagcctaacatgcagcgtcatccacgagaaggagaaattctaaacaacacgtacgccagccaaatatacttgctgatgatctacaaattgcatgtcaatttctctaaaaaaaaaaagaaattgacatcatctgtcatccttccatcgatgatgctttgtgttgtctgagtggctaattgttaggatcagcctaactctttgttctcaaaatctgaatcgtaatagggtcgacgagggtcggtgttttaaactcggaataagatcactttgactccctcaactgaccaccaaatctaaatcgtatccctcaatcgcaataccagaaatcttgacccccgaacttacaaaaccagtgcaatttaactctctcggtggttttagagggtggttttgctgacgtggcgcatatgtggcagtgttgactcggtctttgtgccacgtggcattgacgtggcacttatgtggcactaaaataaaaatatatatgcggggcccatttttcattctcacaaaaaaaaaattcccgccgccaccgccgccgccggggaaggcggaaatggcgggggcggcggagggagggagagcgaaccctaccacgaggcgccaccagaggacggcgatcaacatatctcctcctccacggcatggcgtggtggcgcctcgccggagtgcgcggcggcgcgtaggcgtagcagctcagcttaggcttcgccctaactctcgatcccaatccccatgcggcgtctctacctctaccaatcaggtcaggctccgatccccattcgctcgtgctctcgtcggcgtggaacaacaggtgcaagaagctgggcaggctggccaagatgtccagcgccgacgtggaaggggccgagaaggtggaggaactccatctcgtgatggaagagtagctgcctagctagatgctgcatggctgattggtttcaagtaatttcatgggtcttttgttttttgagacagtccattttgctcagtttgatgtagtgatgttcatgcatggcgtgcaaagtctgaggacttctctcattttgctcagagagaattaatccattttgtgcagagtatgaggacttctcaagcaaatgattttaaccaaacattgcaaatgattttgtgcagagcctgccgccggctcatgtaagggcgggagagagagagaaataagggagagaggaggaagaagaagggtagtgagagagaggatgagatgtgggacctacatgttagtggatcccacaattttttttaatgacaaatgggcccacatattttttttcttttaatgtcacctaagcgccacgtcaatgtcacgtgggataaagaccaggtcaacattgccacgtgcgcggccacgtcagcgaaaccgccctccaaaaccaccaaaggagtcaaattgcaccggttttgtaagtttaggggtcaagatttctggtattgcggttgagggatacgatttagattcggtggtaaattgaggagtcaaagtgatcttattcctttaaactccgaactcctatggctatttcgtgcgctatctgtaggcttagatgggcctgagtgggaatgcgactctctcttctggttgggccagaacagtatcaatgacatacatgcggcccatatttattgggccggaacgggattgctacttcgtgcggtctgtatattatggagtcccccagtttatctcttctctacaattataaaaatcgaagatatttttgccggtactttgatacgttatttgagttggtttttaagttcgtttgcttttagaaatacagaaggagtcaaataagaaatctattttttttaaaaaaaactcgcatgttaatttgagatgaacagcctgctaactgcaacttattatgattttctaaaaatatacatatctaagcgaattcctatagtcaatttcaccttaaataaacataacaataataagattaaaatagttttcacctgttaaaacgcacggatattttttttatataagaagaagaagaattgaagaagaagaacggtgaaattttctttaccgccttcacccacgtgcaagccgaacggtgaaatttcctccgtccatatccgattccgtctccattaatccgtcctaattcatgcaatccatatcctcctcaaatagaatgcatgcagtagctagcgaatctcatattttaactcaattaaatttcccaagccagcaacgcaattaagctaagctagctacgcatggactgctgctcccagctgccgggcgaccttgtcgccgcgacatcctccgccgcctgccgctacgcagcctcgccgccgcgcgcgccgtttgccacgcctggcgtgccatcgtcgacgaacattccctcaccacgcaggcggtcgcgctcctcccaaaccatctccgcggcctcttcgtctgcctcaatgaatcgtgcctccatggcttcttcgcccgtccctcgccgccggccaccatccccggcatcgacctcgactacgacctggacgacgatgccaccatcgaagtccactgcaacggcctcctcttgctcgatcgccacatcgtcaacccggccacacgccagtggatgcgtctacctcctgtccccccgtacgcctcactgcccaacataatgtacggtgatcggggcctcgtcttcgacccagcagcgtcaccacactacgacgtcctctggatgccctacctgattcttcatcgactccctgctgcgtctctgtcggatcagtggccgccgtcgccgttcatcctgcacgtcttctcctccacgacggggcgatgggaggagaagtcgtttctccgggaaggcgacgccaccatgggcaccatggctgatgtatccttggcaagggtaccttaccactgcaagactcactccgtctacctccggggagcgctctacatgcattgccagaatgattgcgtcatcaagatcacacttaacgaccacaagtatcgggtcatcagattgcctggcgactctgcatcaaacagaaagactagggaccctttcctaggaaaatcaaaagacagagtgtgctacgtattggtcaccggtctaagtcgactccaaatttggctcctcaacgaaacttcttcttcttcttcttcttcttcttcatacgacgacaacgagtgggtgctcaagcatggtgttgacctagggccaataatacaaagctacccctgcaaccatggtcgtcagcaatggatatggcataatgctgacactaaacaagacaaaaccagggaattaccagctgtaaatgatatggaggaatttgaatgggctatcgataaggactctgatgacattattagtggtgccaatgaaagcatccaccataatggagaatacatctccgctgtactcggatttcatccttttaaagacatcgtcttcttgcacgatacaaatttaagagttgttgcatatgactacaacaaggcaaaggttcaagacttgggtatgatgttcctataccataatacagatagagtggtaagctcatttccatatacaccttgctggatacgtgatttgcctggaatgcactacggttgattttaatgtatatttatggatatatgcccacgttggacggagcggagtttgattgccctatagctttttcactcgtttatcatttgtaacaaagagtgatttatttgtttgattgtatatccggaagactggtccggtatattttgaaattgacaaagtaacccaatcccttcttcctataaagttatcccccactaagtgcaattaatctcctaaagctcaaacctcaatgttccacgtcatcattaatttacagccgttggatcggtagattacatcccattttagccgtcggatggaaaggctcagggttcacagcacgtgaggcccatgtcaccttcctcctcccatctcattctcatctcaccatcccacgcttttggactcccaaacgacgctgttgcctttcgtcaacccccacttctccttccccgccgccgccgctcgccgcccgcccgcccgcccgccatggatgaggagtacgacgtgatcgtgctggggacgggcctcatggagtgcatcctcagcggcctcctctccgtcgacggcctcaaggtacctctctcctacccaatccgattgatccgccgcctcccgtgctcggatcggtgcttgatccgtagaacggccttccgcccccttcatctcatctgggcttgacgcagccgcactcggatgagctgctgctggttgctttttttttttacctcgccatttgatcgctgcacagagatcgaagggagggcctgccatggccgctcaacgtactcccgccccctctccgccctccactgccttctacacatcggctcctccctctccactcccccgcttttgcacccaccaccgcatcccccgcccggagaccggcaacgacggagggttagcttcgacgagcgaccgaccacgagatatgatatgagttcatctgcgccttccctcacagcgtccacctgctgatcatcctccaaaacccggcggaatggtaaagccgcctacctcttgcgtccgcctgagggatgcagtcgctgaacatgtgttgctcatgtttgatcattggcatgctttgcgtgaagcttcctgattgtagcaattcgtttaatgcggtttcaaatcgaagtgatttaatatttttttcccatgttaattcgttttagagttcaaaccgaaacatcattttagagagatttttattttgtagtttatagaggattacaatgtttctgcatatataggtaaaacatgaatgcatttaaacaccattgtaaatttcccaatgacgaatggaatcatgagaatatatccaattttttcttctattgctggggcgaaagttaatattatagtaggttctcatgtttgggctgaagaccctgaacttgcctgggtcgatggagaagttgttaagatcaaaggcgaagaggccaagatccaagcaaccaatggaaagaaggtaagctgctaattcgtttttggccttcagtttgatgtactgctacttatgtttgtgctgtcaattcttttagatcattgcagctgctggtggagttgatgatatgacaaagctatcatacctccatgaaccaggagttctgcagaatttggcaaccagatatgaacttaatgaaatatatatatgttattctgcatggccatttactgtaaatatgccattgtttcagtcgtactgtatgacctataactttaacattttgacagacatatacgggaaacattctcattgccgtcaatcctttccaaagattgccatatttgtatgatccacatatgatgcaacagtacaagggagcaccatttggagagttaagtccacatgtttcgctatggcagatgttgcatacaggtaaagtaaatatgataggtggtatttgagtcatcagtgtttctaactttctactcctataaatcgtggatcatcctgctgtctttttacatgaaacagagcaatgattcatgaagggaaaagcaactctattcttgtgagtggtgagagcggcgtgggtaaaacagaaacaacaaaatgcttatgagatatcttgcctatttgggtggccgagctgctaccgagggaagaatagtagagcaacaagttctcgaagtaatgaatcgagttcttatttttggaaggccattgtattattaaattagttatattccaattgaatttttgctacatattctttttatgtctgca

SEQ ID NO: 50054 - DNA, 6403 bp, Oryza sativa
gtgcacccgatgccggcgttgttcaccagcacgtcgacgcgcccgtgctcggcgaggacgcgcgccacggcgccctcgacgctctcgtcggaggtgacgtcgagcgggaggtggtcggcgtcgaggccggcgaggtcgggcacgcggtcggggacgtcggtggcgacgacgcggcagccgagggaggcgaaggccttgcagtactcgtagccgatgccgccgttggcgcagccggtgatgagcaccaccggcatctcgggcttgtcgtcgtcgccatctccggcgtcattaggcggcgccatggattattagtgcggcaatgcaatgcacgtaattataattgcaacattgtgattggggtttccgtcaccaaggaatatgcaggagggatatgcggctgctcatggcgtcttccgcttggaattaatcgttttcgttgccgttcatgcatgctcgatccatttcgttgtgtgtatatgcttgtttatttaggatttcttttcaccgtctgtgtagcatgatttcgatcgccaaattaagtataaacgctctgcttctcttcactgaaaattcagtttagtctcttgttttactttaggcccattgttttggttttgggctctgctttctgaaacagtgctcttgtgtcttcaagcttcaatccagaattccagagacaaagcccagcatatgctccaagcttatataatactatcatgtagcttcagctaagttttctccattcagatgaagatttttacggtacaatctactggcagtatacaactagttttgttttctgaaggaaaaaaaaaaaacctactcctggaggctggaactatcaagattcagtctatgtctatctgcaggtagctagggttggtaatctgacttaagcgtacccaggttataacagaattcgattgctctgagaatacattagttattacttgcacaattggactgacgaatcttgcttacctgcttaatcagcatgtattaaaacgtctaaacagcggcagaatgggcaaaaaaagattcatgtgttcctttctgctgattagccatttgaaatgcttacaagccagtagcagcaactaaacaaaaagacacacgctagatgcaaccgtaactttgtaagtttctgtagaatgacatatgaatcacattactctgactaattcagagatttagaaacgtagtactaggatagggggcggctgcaaaccaaaaccatctctagaaagatttccggacatgattaactagtatagtcattttctgatggaaaatttgcccttcgatcgtcatcatcattatattatcatcatatcaccccgtttgtcactgtcacgcagtattttgaaaattgcatttgggaagatttctattttttttttggatggatctacttgtacggtattgtgcaagacaaaaatcagcaaggaagcttcattcttgattgagctgcctgttttgttgaacaagaccagtcaatattccgagcacactaaatgataatattagcagagagtgactagaatagaagtcataacaaaagatagagaataagaaaaagaattatatatgattatgcaggccaaatttatgacgatgttggaatagtcatttgcaatcagatgactgatatgcgactaacatacgtagcattaaaacacatatgtacatcatggccagataagtaagttttactagtaatttaaaattaaaaggacaaaaattctctaagatagcgttgtttttgcatgcataatattccaaagcattaaagaactgttggcgagagaactatccaatttctgattagttgctattttgtagttttcccggcaatttggtgctcctccttccgggtgtcagtagtggtcaatgttgatggtttggcatttttttgtggcctaccacggacatgagaaggattttccaactccttgatagctactgcttgcaataatcttttggaatttatcgagaaaattccttatatgatcctcatatataacacctaatcagtctataaactcaaatttggaataacaatttttcatataacacgcagatagctaaaaccatcgacggattaagcaagatgaagtcttcgattttcaaatagtttgttgcaaagttaatgcgtgattgggattcggaaacccacatgccacatgcttgactgttaagtctgtaactgacagacaggtaaacaattggcattctacagcttagatcagatgcctccttatatattttcgtaggttctgaactatgttttctttataatcacaaaattcgtaatcaaattacatgacagtactctgtcctaatatactccttttattattaattataaggtatattttgttttgttacaactaataatctctttactaatatattatttatgtaatgtaaaagtataaccataagtttttttagatgcgaatctaataacattaattttgtaaggaaaaatcctaatagaaagggagggagtagctaaaacttgtttcttcagaagagtaatttgaccctaaacttgtagtatatgggaagtcaagaacttgctttgactgttgtattgtgagctgtaagtctgtagtaactgatcggcacgaggttataggaggtttcatgtgtaaacaaaagcctctgccatttctatgaaaggtcaaatgtagtgccatcaacttggcatagttaattttggtttctactattatttcccccccccccctcaatggattcaagttttggatgtgttattcaaatcgatcacaaaccaaaccttccaaatggatatgttttgctcaaaaagaaaatccaaacaaccaccaaacacgagtatatagaacctaacccaagaatgaagccccatcttctagatgcaatataatgcatgcacgaacgaattaattcatcctgctttgatgatgttacacaatttttatagctagcagtcgtactgacgaacacattgccgccagttttgttgtactggatgacatgcgtgtgtttgtgttgaaaaacaccaaggcaaggaaagaacaaaccaatgacaaaaagaaaaatcagataaggatgcttgtgtatgtatatgatgtcaatctgtcgctgttgaacttgaagctcatctactctttaacgaattcatgctaatgtactgtacatccaccctttgcttgcaatctctgtatttctttgcttgcagcaatacatgatccattttattttatagctacgtacataggcgtatatgaatgaaattcagttagaaaaaccatgggaaattaaaataagtacatcagtgatcaatatcgtcttgcagttgggctgttggctaaaacaaatactactaacaaacaggaaagaaaagaaaaaggagaaaaggagatgaggtcacatgttccaatccgttagccttccgtgttccaagctacactaaactgtaaccgaaacaaattaaagagcataataagctccattttgaagggcacacacactacccacacgattggcatgcatccgtgcatgattcattcatgatccatctccatcaatttctccactgctaaaacccctctcatctcatctcatctcctatccttcttccaaaccaaccaactccctacttcttctactcctcgtcttcgttcgtcttcgtcttcttgtacaattaattcctcctctttctccgcccaagaaacccacaccaaaaacatcttcttcttcttctccgtgtcaaaacaaacactgtttctctctctctctctctctctctctttctctgtgttcagagccaagaagtctctgctctgcatgggtcaggaagaagcagcagccgcgccggccaccgtgatgttctcgtgggagcaggagctgggcgtgcccaagcagaagatggcttctgacgacgacatgcccgagagccccaggaaggcgccgccgccgccggcgcggcggctgtcggtgccgccgcctccggggcggatgctgatggcggggagcaagagcttctccaaggcccgggccgtccggccggaggacgacccgttcttggcggcgtacctggcctgcaccaagagcagcaacggcggcggcggtggcgttgcgcgggagagcaaggggcagaggcggtccagatgggccgggcttgggcttgggcttgggctcgggctctcttgcaagagctcaaatggagttgtggaggacagcatggtgaagatggccaaactgcctgaggttcatcctagggatgcttagtgatgatgatccagttaaatatattctcatcttctaccagtctaaaaaaatcatcttctgtctcaattctcttgtttgttttctttgatttgtttcttgatttggaatttttagtgatggtgatcaagacttgcttgcctgcttggtacttaggaattaattagaggtatagaggaaggcacatgtagatgtgtgcttgtttcatctttctttgcaaaatggagcatatcatttgtgcaggagattatcaagctcatctgtctataagttcaagattgtgtgtgacttgcatgctcttttctctctcgctctctctcttggtgaatggcgtccgtttttgtgtgaatggcaacttagcttgtcaaagacacagtttgaccaaggtttcctagaattaattccattgatgttttaatttgttcatattgaatggctgaatgtttagtgaatagagaattgctatggttgttcaacaaacgcaggttggtgtatgcatgcgccaccctaatacctgtagaaattaagataaaagattgtacttgtgttcccggaaatatatatagatgtcacccaaaagaaaaaaagaatcagatgtcgtcagatcccaagctgattatccgtgatattttgtgaaagcatccttagttcagtttttcttttcattttatttatttttttgagaaagcatcttcatcagtcaagttctctctctatagacgaaggtgccaaatcgcaatggatcgatgtttagtactcaccgagaaagagctgagctgatgaagttgaaatatatataaactcttctttttttatacgttctataattgattgatcaccgctgttaagtccagtccagatgtaaaaaggacattatttttttccaaaattttactccccagtcgctaaatatctgatgctattaactttttaaaatatgttgaccgttcgtcttatacataaacttttgtgaaaaatataaaactatacttacgtatacataaaaagtatatttaacaatgaatcaaatgatagaaaaagaattaataattacttaattttttttataagacgaacggttaaatatattttaaaaagacaaccgtgtcaaatatttaggaacggagggagtcggtactggggttcctagggggcgcgtgcgtgccggctgcttaactggcgcagccgcgcgcgtccccctgacgactagttcacgcgctgccgccggtaattatgataattagtgttaattactgtcattagcattatttttaaaatagtaacaacatacataattcataattcagttaccaatctttttagaaaagtaattgaaagttttaaatttgtagtcaaaagattttgaaatttgagttgaaagttttaaatttttatttcaaattttaaaattttgacatagaagttttcaagttgagttgaaagtttttgaaattgaagttgaaagttttcaaatttgagtcaaaagtttcaaaaattaagttgaaagtttttgaaatttgtcttgaaagtttgtaatttgatttgaaagtttcgaatttttagttgaaagtttttgaattttgagatgaaaattctaaaattgtgagttgaaaactttcaaatttgaatcgaaagttttcaaatgctgagtggaaagttttcaaattctgagttgaaaacttttaaatttgaatcaaaagttttcacatgctgagtggaaagttttcaaattctgagttgaaagttttcaaaattttcaatttaaaaattaaatcttttgttaaaaagtttagttaaatgttctaaccactgtatgcatgtatgtacgtgggttttccaattacaattagcacatactactaccaattgagtgtgttactattgaatcatcgttaatcatcgttgaaaaagtcattaggcccagcaggtgtagcgctcgttccgtcgtggcgcctagcggaaaaactatctcttaaaaaccctaattgcgaaatccgttcccttgcttgttgactagtgtccgtgccatctcagatctcaaatccccgatctgtcgccaagttcaatcccgaatccaaatccttcccaaatcaaatccctccgcaaaagtctatttgcctccctcggg

SEQ ID NO: 50055 - DNA, 3786 bp, Oryza sativa
  unsure (1)..(3786): unsure at all n locations
tcgcccgatctgccgtgagccgcgccgagccctccctcccgctcttgctgccattcccgccgatgccgccaaatcgccgcgccacccgcgcgcgcgcgccgtggtggccgaccggccagtcgccgccgctgtcagcacctgccgcgcctgccccgcgtctgccgcccgtgtcgccgctccactccaaaccagtccaccgtcatcgccgtcgtcatcgacccggccccgccaccgctaagcgctggcttccaagggacgaaggctgagccccgccccccctctgccgcatcgccccctctccctcctccttttccccgaagtggcaaggaggcaagccccctttctctccccctttttcccttttccctcccgctggcgtcatcctccccccctgtcgccgctttggccgcgaccgcggagcgctggctcgctcccttgaccgcccaaggtcggtttccaaaccaacatcgccgccctataaacccaagcgcctcccttcctctttcctctcccaatcttccccgtttctcgcccgcgccattgccgtccctctcgccaaccgttcgtcgtcgcgcgtgtcggaggagccgccacgagcgaggacgcggaaggggactccgggcgctcgtctccttcctcttccccggcccgaggctagagaaatcactcccgtgccagcggcctctcgtcactgcgccccatcacccctgcacggtagtgtctccctccgttctctctcctcgttccatcttctccccttagactcgggtagtagcacgagtagcctccccgtagctagctggcgccgccccgaccgttgccgccgcccgctgtgtgctcgccgccatcgccgcccgtgctccgtagcacccgctcgtcaccggcctcgctcgacgtagctccgcccaattcgacactagcaacggattcccgtagccgtgtagatgctctcgccgccgggaatcggcccctcatgacctcatcactgtttcccccttctcccaccgccggttgccgccgccgcaatccgccgccgtcgagcatcccccggcgaatccgagctgttggctcgtctcccctcgtcctgtgcgacatcccggtgtgctcgccttcgcctatatcgccatggttcgctccgccgctcgccgctgtcgttcgccgtctgttccggccggcgtcatcgtctacctcccgacggtccgcgtggcagccacgtaggcgccacgtcggcgccacctcggctgcgaccgggtcaagcagaccccggtccgccgcttccctccgccccctcgcgcgcgcggtccaccgcgagccgtgaggctgcgcgtgggcctgccgcaccgcgtnctccgcgaaccgcgcgcatgcgccgcatctcccttcccaaaccctagcacaccccgcgtgcacctcgctcacggtgagccgagtcaccgacaagcgggtcccacccaggaccacgcgggatggacccggcccaccggctctctctctcccctccccgcccgcgcgcgccttgggccgccttcttgggccggccggcccattaagctcggccgagccgcccctttctctcaggccgcgccctagccgcccgagtaaagtctaatttccctccctccttcttttcttttctttttcaaaaaggatttaaataaatccttttcctttagaccaaaaatccaataatcttagaaattcaatatcttcccaaccgtaagcccatttgactccgttcaacttccaaaactcctcaaatcttgagatctatctaatggcacgcctagaggtccataatagggctttattttcgccgtttgttgagttgtcccgtttcgcgtgtagtttcggagcctgaagacccgcagtgcgaggatttcgaggatcaagctcaagatctcgagtaaggcaagccacatttgaacatcttgaacctatatttgaatgtaattatgttacttgaaaaatattatgcattgataggattgcacttaatctgtttgccccgtctgcaaggcagaccggtgggcctacctaacttgttgcatctgatccttccattgttaattgttatatcatgtttccttgtaaccacctggtcacgcctcggtattcgtgcactccgtgcgagtatcgacggtcgcattcaaacttaaaatctgagaaacatcttgggtaaaacttgggttttacaaaagacttggaaaacccgacacctgggtcggtgcttgcgaactaaatgagtttccaaaatcgtggaccggggaacgtaccgggtgtacggtttcccgctcttgcacttaaggaccgtttccttggaatttcatccgaacataagacaagtgcgaccacatgggtggaatgggacacccctggctgagtaactagctaaacgggggagccatgatgccaagagacatgtggatttaacggggtggtgtcggggagaacccccgggtttcctggcacagtatggtctgggacctaatctggtgttggtctgggacccctctcgttggcatatggtgaacctgtgtcggctttcgaaatgccttgtcatgaaagccttaaggtctctagtcgtggccgttctgcacgcgctggatgatccgggttagtaatgtcgtgtgggtaaagtgtaccccctctgcagaggttattaaactgttcgaacagccgtgcccccggtcatgggcggatgtgaggtgattcctagcgtagttttgtttgactactgctttgtgaaatttgctgaggtggtttgggattgatgtttggaaaatctgcggctgatgggatcagccaggcccgggtggccgtttgaaagctgttggccgggtgccaatcttgatcaattcaaaagactgatatattgcacatactccgaccggacgagacgcactatctcatccgtgtcgtttgagaagcactcacttagttgtttcagacaagagtttaaataaaatcaattgcaaaaacaacagcctttccttgaagcctgcattaaacacttatttcccatggcttgctgagtactcctgtactcacccttgctctatataaataatccccccccagttgctgaagaagatgaagcggatcccgctgacgaggagttcttccaggagcaagtcagctacgatgagttttagggttttcggcctagttcccaagtcgcgcctgtgatgtttggtccaagtcttggtttccgcttcccttttgtaatgcagttgtaagctcgggatctgtccgcagcccaacataactatactcctactctataataaagagacctctgttgctgtgatattctgtcttcctgtgataccagcactgtttcctgggactggtatcgattaacaggttaatttggagcgtcacgggctagttccgctcgggactagttcgaggcgtgacagcaggcccatgtcagacacgaagttgaggcattgccgtcgcgaaacgctcgcgacttgctgatctcgcgcgtacgcgcgaattagcaatctcggtaggtactagtctttttttctgccataccctaattaagatggatgattatgagccgtccatcggatcaatcggattcctgtagtacgttgcaattgcaaaaggaataagttcacttcatgacccttaaaagtgatcgaaatctaaaccatgaccctaaactacaaaactggatatctcgacccccaaactcctaaaaccggtgcaattcgactccctgggcggttttgctgacgtggcgccacgtggcgctacgtggcaatatggaccgagtcg

SEQ ID NO: 50056 - DNA, 1864 bp, Oryza sativa
acgccacgtgtaacaaagactcggtcaatattgccacgtagatgccacgtggcgccacgtcagcaaaaccgcctctcaaaaccgcccagggagtcaaattgcaccggttttaggagtttgggggtcgagatatccggttttgtagtttagggtcatggtttagatttcgatcacatttgagggtcatgaagtgaacttattccattgcaaaaggagaagggctgggccggcttgttcatgggcctagtacggctgcgaaaaatacagggcggcccagaccatatatgggccaattggaccaatgtgttagctttcctcggatcagccttggactctcgattgaatcaaataatggaagtttttgaaagaacccatcgagctggttttatattatagaagaagtgagagaaactgtacagaagagaaggcaggggaggcgttcccagagaaactcttcctgcctgcactccctaaaaaaacaaaagcctaatctcttaacatatgataatacacttcactcccttgacacctgccatttcccacaaatgaagctcatctatgatcttgctatggaacaaactgatctcaatcgaaattcgatagagctttgtaaacgcgcgtcaacctgttaacagtgaaatttggtaatcggcaaagacgtcatcagcttagaatcattatcggctgcagcatctcggaatcagccgatgggagttatcaagtcgccaatagtcggattcctgctatattcggttaaggaaatcaatctactaaaggaagcttatccctaagtgaccgagtttaaagaggatgcggcatggcagtttatctattaattaggaatagtttgttagtttccttttatctttaggaaggtgtgtttagtgtccgataaggactttatgttttccttttatctttaggttagtttctttcttgtctgacaaggacttgtatcaacccatgggtataaatatgtacacccggggtctatgtaatctatctccacgatcaatacaattcggcgcatcgccaccttttaccttttctactttattttatcgtccggtggacttggcacttgacgcggggctgcatcggtgttcgatctccggcgaagggataagtccaatgttccgtcggtccaggcaattgtatcgcctacgtcggcgtcgttcaaggctgcatcagtacattcgacctcttgattactctggtttggataatatatttgcctagctatttatcatatgtctatgttaatctagtcctagcatctcaatttagctctatcggttgtctctcgctttagggtttccgccggtatcggctaaatcgccttgctatattagattagcctagacatctaccaccctgaaaatcagtcaacggcttgattgtctagatattgtgtttcttttcatacttagtgctgcatcagttaagtttgatctactaagtcgtgcttagaaccataatctctcgcttgctttttgactgccaataagggtttcatcggggtttcagccgatgagttatctggacgttgcatcggctcataaggattgcatatacatataagttggatttagccgatcgcaacatagatttcactgtttaatctaatcttgtagatttcatgacatcggacctctgtagcgcccgttccgtcgtggtgcctagcgggaaaattatctcttaaaaaccctagttgcgaaatttgtttctttgcttgttgtctagtgtccgtgccatctcaagatctcaatccccgatctatcgtcgagttcaattccgaatccaaatccttccaaatcaaattcctccgcaaaagtctattttgcctcccccggggtcgatgggc

SEQ ID NO: 50057 - DNA, 4172 bp, Oryza sativa
gtgggcccgctgcatccgcgtccaccgcgaaccgcgcgcgtgcaccgtgtccctcccccgcccgagagcatgagccgcgtactccctccgcacggtgagccgagccgctgacaagcgggtcccacccgggaccgcgcatggtgagcccggtccaccggctctctctctcctccctcccgcgcgcgtgcgtcttgggccgctctgggccactttcttgggccggccggcccgttaagctcggccgagccgccctttctctcgggccgcgccctagccgcccgagggaagtctatattccctccctctcccctgttcttttcttttcttttccaaaaaaaagggatttaattaaatccttttcctttagaccaaaaatccaataatcttagaaattcaatatctttccaaccgtaaatccgtttgactccgttcaaattccaaaatttctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagctccagatctcgagcaaggcaagccacctttgaacatcttgagccatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgcgcctcgatattcgtgcaccctgtgccagtatcgacggtcgccttcaaacttaaaatctgagtaacaacttgggtaaaactggagttttacaaaagacttggaaaacccaacacctgggtcggtgcttgtgaactaaatgaatttccaaaaccgcggaccggggaacgtaccgggtgtacggtttcccgctctcgcacttaaggaccgatttcttggaatttcatccaaacataagacaagtacgaccacatgggtggaatgggacacccctggctgagtaactagcttatcaggggagccttgatgccgagagacatgtggattcgccggggtggtgtcgaggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttatgaaaaaggggttcgatgtttgaaaaatcagcagctgacgggatcagctaggcccgggtggccgtttgtaaagtcgttggcccgggtggccgtttgaaaagctgttggccgggtgccaatcttgtttcaattctaaagactaatacattgcacatactccgaccggacgagatgcactgtctcatccgtgtcgtttgagaagcactcacctagttgtttttagaaaagagttcaaataaaatcaattgcaaaaacagccgcctttccttgaagcctgcattaaacacttatttccctggcttgctgagtactcccgtactcacccttgctctatataaataatcccccccagttgctgaagaagatgaagcggatcctgctgatgaggagttcttccaggagcaagccggctacgatgagttttagggtttcggcctagttcccaagtcgcgcatgtgttgattggtccaaatcctggcttccgtttcccttttgtaatgcagttgtgagctcgggatctgtccgcagcccaacatgactgtacctctactctataataaagagacccctgttgatgtgatattctgtctccctgtgataccagcactgtttcctttgactggtatcgattaacaggttaaattggagcgtcacgggctagttccggtcggtactagttcggggcgtgacaacctccagccgatgtatgctttaaccttcagatcagtgcttattatatattgtttctagccgattggtttctatcggattatattattgttattttattacatcttcatcagccgattgccttcatatcattatctacgttggacatatagccgattgcttaaatcctatcgctatcggctggtattagcatcggctattatcggctatcggctggaactactccatcggcttgtcagccgatcggctgtttggatctactatttgcatatcttgtcagttgcaggatcaaactgtctggccgctcgcatctaatcaagatttggacctgcacaggagctaaacagatctcccaggccggtgtgttctattttctcgtcaacacagattcttggtcccaccgcggctgcgctcctcccctgcacgctccgcggcatctttgtccagatcggcgtgccaactctcagcggcttcttcgcccgcccctcgccgtcggcagggacgaagacgacgaggccacccatccccggcgccctccacctggactacctcgacaccgacgaaatcgaaaaatcccttctcaccataatcgaccactgcaacggcctcatcctgctcgaccaccacgtcgtcaacccagccacccgccaatggacgcgccttctcccttactcgccgccggagtcgtcgccgccgggcagcgaaatcatcctcgacggctatcacgccctcgtctttgaccctcatcgtgtcgccgccgcactaccagttgttcttgatgccctacgtcctcggacgacgagccacggtgttttctccatgtcttcgccaatttgaaagttttcaaatcttgaattgaaagttttaaaattttgtgttgaaagttttcaaatttaagttgaaagtttttaaattttgagttgaaagttttaaattttgacttgaaagttttcaaatttgagttgaaagctttcaaatctggattgaaaattttaaatttgagttgaaagtttttcaaatttgagatgaaatattgaagttttcaaattttaacttcaaaaattcaaatttcgagttgaaagttttccattttgtgttaaaagttttcaaatttgagttgaaagttttcaaatctgcgttgaaagttttcaaatatagggtgaaagttaattttcaaaatttgacttgacgtatatatattttttaacctgttacttaaaaagatcgtgaaaaaattcatccgtgcttgattaagagaaaacacgaaaaaactaactcatgcgagtagaaatatactccaatccattcacacggtagcacacatgccggataatcgttggacacaggcctgggcctcacgtgggacgtggcttgccagaaagtgcgcgccgccagcgcgtatgcgcttagttttctcggaattataatggtatattttaaaacatgaaaatttataatggcatggatcaaattaaccccatctttaaacacagagcagagttagttatgtttgccagctctaacattgatttgcatacatttaggttcttcattgatgtttgtctgtctttcagatcaatgattttttttctttttggaagtggaagcttgttttcagatcaatgaattccaggttacttaattttccttccaattaaccaatggagtacttgactaaccaatggagtacttgaacaatattttaatactttttcccaattaactctgtaaccttgctgaatgatgcaactgccagagtcttcggtttcattttgacatggtctcctgctttgcctctaatattgttcatatcatagcacagtccataattaatgccatagtgaagggactttttaatcctggtatttttaatcgacgtagattagcattaataaaattaaaatatattaaaaatcggtccaggagagcaacgagagacggatcggccttagactcgctggctctgcctccctcgtccgacgacatacgtccacgtatgtatatactactcgtactcgtactagtatagcatat

SEQ ID NO: 50058 - DNA, 2542 bp, Oryza sativa
tagactacctcgacaccaatcaaatcgaaaaatcccttctcaccatagtcgaccactgcaacggcctcatcctgctcgaccaccatgtcgtcaacccagccacgcgccaatggacgcgccttcccccttacccgccagagtcgccgggcagcgacatcatcctcgacggctaccacgccctcgtctttgaccccgccatgtcgccgcactaccaggtgttcttgatgccctacgtcctccgacgagccacggtttcaggccagtggccgccttcgccattgctcctccatgtcttctcctcgaggacagagccagaggggagtacatgggggtggggaaggagatctaatgtccgggaaggggacgccacccatgggcacccatggataaggtgtgctcaagctcggggtgggaaccctttgacacctactccgtctacttccggggatcgctctacgtgcattgccaaaacaattgcgtcatcagaatcacaattgcaaatcacaggtataggattatcaaattgcctggcgattttgtgggaaatcaaaatattactgtcgatccttacttaggaaaatcccaagagggagtgtactatgcattggttattggtttatgtcgactccaaatttggttcctcaaggaatatcaatcatcatattcttcttattcgaattcatactgtggtggcatcaatggcgacggcggtggcatggagacgacgacgatggatcatgagcacgagtgggtgctcaagcatgacgcagacctagggccagtgctagcagcaggctacactctcaacgacggtggccagcaatggatatggcataacattgacaccaaaaagaaaaacaaggaatcactagtaaaggaagaggaattcgaatggaacgactctgatgatgaaaatggtagcgccggtgaagataggcagtacaaaggatacatctctcaagtatttggatttcatcctttcaaagagatcgttttcttgtacgacacagacactagagtggtagcctaccattataatagatcaaaggttcaagacttgggcgtactacaagtacgtgaacgagtgtcaaggtcattttcatacactccttgttggatgccggatttacctggaatgcacaattaacattttgatttgaaatacatcgacgctggagattaaacaccagctcgatcgtcggcttatcatttttgtaaacaaaacaacgtgttaacatacgagtggaatcatgctagctttgcagagtttgcaggtgtatggtacaggacgagatcaatcaatcgagcgtccaaggtggcatggggatatttgattacaaagaaaagtgttgctacatggtttgctaactgcatccaaaaactgcagctgattatggtagctgatacttgtagataagttagttaattgcatagcaagtagttctgctctatgtgcacgtgtggtcctatataagtacaatagtaatcgactagttagtcatctattactgcatgtcccactgttaattaccatatctctgattagattgtaaggtcgatactaacaacctgcaaattaaatgactgagcatgcaaagttagatgggtgtagggccatcagcaaatgaagctgcagtaattggtgttaacaaatacagtgactgtcctcatggcaaacatgtcataccagcaatttttttctgagcactattgacaaattgcatttggagtttatgcatgcatgggaaaaaaacagtgtttttcaatgtggcagttcatatacagaccagtgcaaattcagttcaccagcttgctagccacacatgtcaaaggatttcagacttgtagattttgaatatatttcagactcttgtgaaatgtcaatggtaaacagatttatctgatcccaactgcagctgcagatttctgcctgtaatgtagtatacacctcagtacctgcctgatattgtccagctgctccaaatctatactctgatgagatgaatcatgaatcccagttaagtggaccactcctcctccatttccataagaaaaacaggaaatttcagagcaccaatcagatgattcaggcaggaaaagttccagattcagatagagaaagttgcagatggggtcaggttaagtctagagtgttaattaagattgtatgatgttgtcactagctctgagatttcatgatcagatctaatcagagctcaagtattcctcgagcatctgaagaagtgtagctgtcataagaaaggaaacatgcaggagagtggagtatatactatatatgcacatgatacccaacatccaattggttactccagacctcaaatccaattgccatttgtttaacatgccagtatccacatgaaagagattaactactagtagcagcagcagagaccaaacacacaagtgcacatattaataagtaccctgaattaataatgctctatgaatcttgagaggattccatattagtgcacgtattgtacatttgatttgtcatttagcttcttcactttatcagagg

SEQ ID NO: 50059 - DNA, 2648 bp, Oryza sativa
agtcagaattgaattcttgaaatggcgaagcagagagatcagggcttacggtggccgacgccgagcatggaggacgattcgtcgtcggagttaatatcgaggtcgagtacggacatcgggctgagctgcctcgcacattcctcctcctcgtcgtcgtcgacgtcgcagcagcagcaatgtcgccggcgccggcgtggcgcagccggcggaagctctggcgggcgccgcaggagaagcagccggcgaggagagccctcctgacggcggcgccacagaagacggcggcgcccaagccccccaatgcgcggctcttgttgctgacggcggcgcggcggtggcagaaggcgagcaggcggcgcctgcatgcgtcggcgagggaagctccgccggcgaggaggaagggctcctgctgctcctggagcaggtccgagagcctcctgacgtagcagctctcgcccatgaattctctctctctcactctctcaatctgaagaagaagcagaattatatattctgtgtgaagaagaatcaggaatcaggatgaaaatggtggggtgtggatggcgacgggtgcgtatataaagctaagctcgacatggagacctctcttcgtcttcttgactgtctcgttggaaagcaaaaggaggcagcagcagctacaaacaactgcattaggctgggcctcacaagtgttatgtactcttcactcttcactgtataagtagaagtgttgtttgggcttttggatgaccaggatattaattaaactgttgtagtaggaaattaattagagcaagtttaatagtatagtccactgctaacttcaattcatctatagtcaatctaatagccaattcatataatagttgcttactatatatactatcaatatccggtcccacatgccatacacatattacgtcttagagttcgtgctacagctggctacaaatctgtagcccgctgctcttctctctctttcttttatctctttataatatgtttacagctggcttatagcctgctattgtacctgctcttagggaagcaagaaacacaaagtagatgctgtgtaattaattaagaaggtcccctccccagtaaggtaaggtaaggtagttgctgaatactgtagtgtggaagaagagaaaggtgtgtgtgagtcatgtggtgcttgctactctgcaaatctgcagtgcaatttgccggtgggaaatagatgaagaaaacaacactgctactactgctctactactagtactaaacagcaattaattaattaaaaagatttgattttgattcgtttgtggaggagtatatgaaagtgctagacgccaatggattgtggattcaggcgtggttgagctatcatcaggtggagtacaagaagacatgggaagagacaagcagaaagctccatagttgtagtactcctaaatgaaatgaaaacacatgttgagccgaagtgaggagaagatgtgagagagtgagctgattcactaaaaaccaaagccagcgatcatatttgccgtagtggcacgcagaatttgcagatgcagcagagcctgccgaattgtttgttaggccacgcccacgcagctccccttgttgcatccagacataagtatatggatgcatccagcagttctgtactcgtagttaattataattgtaccaccatgcttagcactagcagtgcaggtttgtgtcttgtttcatttgttcgtgtcccatgatattcaaaaccatgtcaaatcaaaattcagagctagtaatactccagtcaatattcagtcactttggtaagatattcattactagccttacaaccaacatcacagcagctgtagtagttgtagtcgtagtactcgtcatcttttggctgtagggctgagctgagagggggcagcttagcaaaaaggcctgcaagagatgggctccatggcagcttgcatcttgcactgcagcgccaacctttcccctccctctctctctcccactgatcactcagcaggaccatgcatgcatgatcagcgtcagttcatcgtcaggccattcatgcataattcattgatgcaatgaaaatcatgcaagcaaatgcatcaagaagagcagtggagtgtagtaccagtgcaaatgagtccttgcatgtccttccattgggtacctttctgctgtgcagcacagagttgttcattagctcaagaaaatggccacagcaacaccggttcagttgccaacgagtgtaaaagtggagacgaagttaggtgcatggttaatttacaacagtgtcaatacgcgtttttgataaatgttggcgtttgcagattcaaaatatttgaatttctctggcctgacattccaatcctgtgcaacaactgtatatattgctgttgtatatttcacccaaacaatgaatggatgaaacaaatgcatttgctgctacatcttgctctctattagccgatgacgagatggttcaatgcaaaaaaacgaccaggagtatcttttttatctcttcgatcactagcctcctcgccatcacttcacttctttctttctcgtcactgaatgaaagaaaagagtgttcaagaaagaaaagaagcgacgaaaggaggtgagaaagaaaccaaacgggctgcaggaat

SEQ ID NO: 50060 - DNA, 6680 bp, Oryza sativa
ttcctgcagcccattgtaaccacagctgctgcttttctttcctgcactgccagattgtcaccctgccttgggactgatgccatcttgcctcccttgtccttgttctctttcaacgcacatttcacctgcattttgttttttgttttgtttttctgaaacccagcaaacctgaactttcaaattcagtaatttagtagtatttgcacataaaaacatcatgcggcgtgcacgagatcttctgtcagtcatcaggctcagtaattcagtatgcaagtgtaatcttacaatactgagtagaagtaacattttcactacttcaagtctccaactatagtactgtagtatggcaaccaactagtcatcagcctctctgtaccaacatctttctttttccttttccttttatttgtttctaaaaaaacagagaacttttgagaaagctgctgggcctctcttgtgttggtatagagaggctgatcaaattggcctttatcgaacgggttaatggaccaaaatgcaaagcctctgctactgtaaaatctgcagcccatagctcacaggctaatgggccctgtataaattgtactccctctgagcgaactttctttttttgagaaaccctctgtaactaactgacactgttaacgatggccgcctatcactaattactttcagatggttatattaccataaatgaaagttgtattattatatatttataatgcaacacattacacacgtctttttttaagataatggaatatagcattttggtcttttttttaagataatggaatatagcattttggtcttagtacacacttctataatataagaagaagagaaaaaattatacatgcctacgtacaaaacaaccttgctcgtagctctcctagctcctcatgacaacattctaccaatgtgtttagcgccggccataccacaccaacctaactccttttagatacgattgagcatctggtgctgtcgtctccttttatctaaagattcttccattccttctagattttccaagcgatgagcaataagagagatctaagtcttttttttttgttttattacttctgggtcacttgtttcttatgtccaccaattcaagaggtttctactcttattctatttcaggatgaagtgtccttggcacaaccatgtgagaactccaaaccaaatttgcttcgagcaggcatttgaacgataggttttaagattccggaaacataactataagaaataattatttggccatcccttgatctgtaaccggtcagttgtccacaggtagtcaaagttttaacttaaataataccggtgtcgattattcgagaagcgaaggaataccagttggatatagttcagcggggtaacttagtccattcagtcatacaagttgaagaggacaatgatgcctcctgcaaattttgccaagttatttaagataaatttgtccacttcaggtgtatccatcacaaaaggcagcacagtaggacactgaaagaggatcaacaacgaatcgccatggtgtgatcctctctttttcctgaaggctccatccaaagctgtccaaacatctgttggatgcaaacacatccagctacagcaaagcacagtgattgtttcagattaatgtatctaccagcttgcatctgtagacacatactaccagaatccagaagtaacaactcaacgaacaaacgaaaagaagagaaagcaattagacatgttaattagctagtaggcttaggctcccaggatttctccatggaatcaaataaacaaattaaagtcagggcacgaagtaattaaaagtggcgagagcaacacaagcgccattagcaaacgagacgtaaaacacattgctagctcgaatcgatcgatcgatcgcgtttgtgctttcgacgtggcgatggtgactcgccaccagctcgatcaaattactgaaaaaaaaaatcttgttctaatacttccctctgttttaaaatgtttgacaccgttgactttttagcacatatttgatcgttcgtcttattaaaaattttttaaaatatgtaaaactatatgtgtacatgaaatatatgtgtacataaaagtatatttaacaatgaatcaaatgatatgaaaagaataaataattacttaaattttttaaataatacgaatggtcaaacacgtactaaaaaagtcaacggtgtcaaatattttgaaatggagggagtacatgtataaaagccagccgccattggctcactgtaactaatgttctgttcagcaatgaaaacgacattaattgtatagcatctgaccagctaattaagctttgatcaaccacgggtgattagctcagctcaactgaccgctagcttatgatcttctgctatcgattatactgtaaactctatgattgtgagtgagaagtccgtttctgatggatgcagagaatccgatggatctttgatcaaatggttcatttgtgtatatgcatctcatatatcactttcgcccatgcgatatgaaggaaaaaataatattaattaaccgacaagaatatgtgcaattcaaacatcaactttagtgatcaccaaactcaattccatctctgcttgctcgagagtgacaagtaccaaatacccccacaggatttgacagcacggaacgaaaagtaaaatggctgatttgattgatctcggagaaatttagcccggatagatcgatcaattggtgcactcaagttcatgtcatgacatatcaaatttcatcggcatgatatattgaattcgggacaattcgtcctccaagatcgagaaaaatgagcaactgatggtcgagcgatagtaatagagcgttcgttcatcgttagctttgctcgtccttgccaatttcatctcactgtgattattttttatctcagcaaaatgattgctacttttatctacagccattcgagttcatcagttcatccattcattcgagttggagaattcgtttaaccggcccaggtttgaccaagtcaaaaaagtcggcacgtgcatgcatgcgtccacgtgggatcgatcgcctacgcgatcaacgaggcgagcgcctgcatctcgaagccaccgccggcggcggcggcggagtagagctgccggagagctatgacgcggcgggcggcggcgaggcgaagcgcgagcttgccggcctcgtcgcggagttgcgcgttggtgagcgccacgagcgcggcgcgcgccctggcgccgcggaggcgcgcgacgaggtcgcggctggtggcgcggagcgcggaggccttggcccggagctcgtcgaggtgccgctgcttccgcgcgcgcgaccggcgcgccgactcgcggttcgagatcctccgccggagccgccgccgccgctcctcgtcggcctggtcgtcaccggccatcaccggctcatcagtagccgccgccgccgtcgtgtccggatgcgacggagacggcgccggagcagcttccggacatggtgcgccgaagccaatgtcggcgaggaaggcctcgagggcggtgtctgagtcggaggggaaggggaggccggccatggcagtggaggtgagaggggcagaatggtaattagcaaccaaagagagggggtcgagtggaaggagagggaaaagggagggaacaagtgaaggaagggcccattttatagccgtcgattcgattcaacccagtgggtttgtggggcccactagtggttttctgacgtggcagccaactttgtttgctcttccttccagtcccctctgttgaagctttggaaaaagcttcatttcatatcatagacagacaggtggattgtcgtcgcatataactttgcaagtatactatgtccactcgcattgacgatttgccaaattttgtagaaagtggtaataatcagcgaatatatatatattctgttttccttttcattgccgtggtttttgatccattgcaaagttacaagttactgcttttaattaatccaactaggaaggtagcccgcgcaatacgcgggcatatgtattggcttgttaaaaacaggtatggcaaattaattttaaattagaagtaagatgttttttccatttgcttttttctttcagtgagctgagtcgaatgatttggttcttttttttttcaatttgagtcaaaatcacgcgctctctccctcgtgaacgaaacatatatgcggagtacatgcggctgactcatggatggcatcatcaagcaatggaggatagaatcatcttgaagtttttaagtaggttaagattaatattagatctaatgattgtaaatattaaaaaaaatcaatggttagattattttaaatataattcctgtgattttttataatttattagagggtcgcatgtcatttaggagcagtcacatgtcatttaggagcattggtatgattgccgcgtggcgatttaggagcgtttataggatctaaatttaatatttgtttaatatgttgtttaaaaatttgctcttaaacatttatattagaagtttgagctatgtatatggatctcgaattatgtatttaattatatatagcacaataattcaaaaaatgagaaaaaaattaacttgagatttacgatcatttagaaatccaattattaatttttgatagattgagtcttagctaaaaaatagaagttagcttaagaaatagaaaaggaggggagagttaggagggttatgtgcgcacgcacgtatggatgtggcggtgagggtgcaggtaccagattttcttttcaaatgaagatcgtatggttaaaattaatgggttcatcaacttttataaaattagaatttttatgatttttattaatttgttagctagaagattaaaaaaaggaaggaaggaaagagggagggagggatgtacgtaccgcgagaagaggtggcccaagaggagggggcggtggagatgggttttgggatttttctaataagtagaatattgggtccaccgtattaagtgaaaatcgagggttagatgttttgcttttttcttgtaatttcttcgatttctctaatttgttagagtgtcatgtggcaacttagaagcgtttgtaggaagtttaatagacttagctagataataggaaggggaagaggagaggagagcactgagcttttcggagagggaagggtccatcgatttaaataaaactcatggtcatatgcttttttttttctcaaaatttttatgttttttttaatttattatatgtgaaatgtgtagacatagagatgttgtaatggacatctaacagatgatgatatgatataggttgtcaatttttatacaacgtttcgttgctgtttagttgtcacggaaaggatataggtttatgcctaacaatatatttatcagatatcaagaaaggcctaaatggatcaaactaaaaatgaatatattaaaaaaatataatcatttagctatctattgtttatatacaatcatttatactatgtaacgatccgccaccaaccatgcatgtaacagaggaactcatatcccatacttatatctcaaacggctaaattttttttacccattagatacccatcacatgtctatttctatataaaaacatagtaaatatagtgaatataggacttagcttgttgattaatttaaataaaaaatacaaccattcaagcgtatatcataaaagtatatatcgtccataaaaaaaattactgcttgcaggttgcacagccagcttgttgctccatgcaagaagggatataaccatttacaataatacgttatggtgtgtatctcgtaataactaccttaattagaaaaaagaaaaaaacgagaaaatgaggggaggatgcgtacgtacagaagtcgggaaagtgcacgtgtgggcccaggagagaagggtgaggagagattttattttgatctgatggttaaaatcactgggtccactgttttaaatgaaaatcgacggtcagatatttttgtttttttcttatagtttccataatttattagagcgccacatggtggcttatgagcgtttgtaggatgccacatggcggcttgagagcgtttgtaggaagtttaatggatttttagtatataatagaagattgcgcatgtcaaaaccatatattctttctagtttctaccctggttttacccttacctgcagtatttggtacaatttgcagatgaaagctacaccagttcagagttgtttcacctttcaccctatgaaagtgcaaaactttaactgcaaagtaaaaaggttgcatgactagctagttcaattgtctacaaattaaattacagatactgcgatgtttaccaactttaacctgacggccgtgtaaccgcacatagatagtacacatccgtgtagcatcatacttagcaatagaatcttgtgaactacaaaagctcaagaactattcacatgtatctagggtggctgtgttctgtgtacaccttatgatgctttgggcatattcttacatggacaagggagaatcctagattatcatctgtgaaaatgaaaggtaggtagcttagctaggttggtagtcttcactctccagagaagaagatataggatcgaatcacaagaactaagccaaccagaggggggtgaatggttggtatac

SEQ ID NO: 50061 - DNA, 3827 bp, Oryza sativa
tgagaccaagctatctctaacttgactcattagcagcaaacaatagtattacatacgtataggatccatctagaagtcataatcatgaaataaactcggatatccaaataaacaatccgaaaccgaaaccgatacagtgtcggccggtcagaccgcgggtgcgcctgtctgaccgcgcaatacacaccggtctgacggtctgactagtccacataaaatgatagatcctgcgatcacctgtaaatccgatcatctccaaaaccacttcgtgaataaattccaaataacaaaaccaataatctccaatgcccaattgtttatcacagaataataataaaaacacctttaattttacagaggatcgagaagggaagaaaaactagttaaagcccgacctagttactctcattgagaagctctaaaaccttaatcactaaggaaagggagaggtatatagctagctagcaggttcttctaattgtttttgcacgcccacaagatattggatagcaaatcttatattcgatttttttttgctgcctagggccagcaagatctattgatttgcatgctcagctgtcttatatactgataaatgattattctatgactagcaatcgaaaagtttgtttaaacccatccttagtcagtctgacctgaattatttgataagatgttgttgaatttcttgctggattgcaccatcgatctatatatctgaaagcaagcgacagttaaacagtactagtataactaacagaattctatattatattattacatggacacaatgtaatcgtgaaattaaattaatatatgtagcctgatagtagaaattaaaagccattacattatgacattgaaaccatggagcgcacccacaccactacttttgggacaccagcaaacctgcccttgatttttatgcagcaaagctagtgcattcttactgatcatgactgttcgatgataggtcatcgaaagctacatgtaattaactcaaaaggggggcatatatataaacattctggttggccatgctaccttagctctttcatgaaggaatacagatatctggtcgatggagtatatgctcagccactggaatatatagcatcaaagctaatgttacactagtcacccatcatcatctcaaagaataaaacttgtagacaacatatatctatatatgcttccatctatgtggaatattctagtagtattgcatatcatagcaagtaagtaatcttccactgttcctctaaaaaaggtaattgcatctttcctttaatgatcagcacagtgtccacccatgcatcaatatttagtgactgtcagtgctatgtgcaagtaatttgattaggtagagatcatgcatgcaagctgcatggtcgcatgatgcatagcaaagctttcagaaagatgggattaactccaatttgtaagtcatactctagtgcaaatctcaaaggcaacattcacaagttcaaaaaaaaaaacaatgatgcatcattaattatgtttaaatgtatatgcattattatgcataagatctaataagtactaaagctgcctcctttagctagactaataaagcaggcgatgttgaggcacgacctttctgttacagcaagtgggtagcacgagacaacacagagaaggtatggaagatcaaccagacaatggtaagctctagctagctagctcgacagaaagatcaacatacctattgcttagtgaaagggaaaaggagacagtctgagaagagtactgtgagctagggtactaatcaagaagagtcattggagataaaagtatagtttagttagctaacagtacgagtataatcacataatatagtgaaataaaagcagggagttatgttagttaagtgccatggatggacagatggcctccatgcatgtgtagttcctatccatcaaagcctgaattttggtgtctgtacctgaagtctctgaagatgcatgcacgcacgatgagatctagcgactactgcatatatttgcaagtgcaggcacatggtttgcctccaggtttggagaaaagaccgcatctagggaggcttttggaaattcagaaattggaatcttagtttcttgtttggtttgacagggaggatgcactgaggagattgggccaggtgtccggctatatgctagcaacagttctctgcatacacctttatcttatataattagtttttagtagtaattattgtggcttgtcaactttattcagtgtcacttgaaatatgttacttttcgattaaatgactaaatctagtagtaaaagagtaggcaggcatgcatcttttgtagtaaatgtataaatatggtgtatatagttaatttcctactgcctttggattaggaactagaattaagagtcacatattgcacaacatgtgacaggtaggcatagactctcactacaaaaggtctcacaataatgttcttttttcttgttgaagtaaacactcctatgtgagtctgagatcaggagatgatgcatgtagacagtataccattggttgttttcaaagctaaaccaagcagttaaaacagaaaaggcagggcacatgcagttgtcatgctgcctggggccattaggaaatgggcaagtgatgggttaaaggtgttaatcagagttgagagtacacccccgcaggttcagataatcagtggatctccctaataggtaagcaggatcttgagaaaaagaaagcttagttaatgagatgttgatggagaggcactggaaatgtgaattgtgatggacatttgggcatgtgggcttgggccatccagctgctgggctgctgtaaactaggcctactctgtagaagcaacggcttctaatcctagctagctttatgctgatggatggtgcgaatcaggccgtgcagaaaaagagagaaaagaaaaccagtctaaaaagaaagagagaagaaagaacaaacacaaggaacagattcatcatcatttagttaggattaagtgatatgtatgaaaaccgaggtcttttacggtgcttgaaaggtacctcaggtaccttctatcaacagtccagataaagagttttttttaccgtccaacggccggtactgaattcctagacccgatccaacagctggtagagtttggtaccgtgagataccaattctgtccttggtacagtaccgacctaagaactaaggtggaaaggcaaaaatataatttcacgtgcaatagatggatgggagtcaagcggatagtgtgatagggttcccaccaatgccaccgccgctgcctggagtgcgtcgacctcgtccgtgcggcgccgcgaagaactccgcctcgtccgcccctcgccgctaggaagtacgtactcatcctctcggcaccgagaaagaatcctccttctccatccgtcgccgccaggaaggactactcctcctcgggccctcagcgcagggaaagtatcctcaactccgccgcccctgctcacacgccgtcggtgctgaaattgagcgcaccactgctaattttctctcccaatcctatccatcccgaattgaacggtcggatgagttttggcaccgaccggtaccagtaccaggcggtacaacttgctggacagtaaacatgctcccagataaatcccaagcaccgtagaaaatctcatgaaaaccacgtaagttcatccgtgcaatcaagaattgaagatgggggatcagtacgtaactgcacgctaaatattcctacatttcaaccagattaaattaagctggagagcaattgaaccgaagaccattggagtgtaacggg

SEQ ID NO: 50062 - DNA, 16447 bp, Oryza sativa
  unsure (1)..(16447): unsure at all n locations
cagctcggcccagcgggcggccgcagctttggcccaggtgggcgtgggcgcctccgcggttgcaggagaaggacgcgcaccgcggcgaggaggtggcggcgcgcatcggcatatcgatcgatactagtggagtggagtggagtggtgagtcaccttggcttggatcgattcttgcgcgcgaatatatcgatcgatcaaagatagatcatcctaggcctaactattatggtttgacggttttgttgagttgtattccaaattcatttgcacatatataaagaccagcttctgtcagagcgaagcggaagcccattattggaggcttggccggagcgaagcgtagggtatcgttatccttttaagatttcaccttcggtgctgtaatcttatcccaatataataaagatatttttgttgactgatgttcgtgtcttttgtgattgatctatcattgtttatcgtttatttgcctaacgtttcctaacaggttttgcccttgttatcgatcgggtcggatcgccgtcgacgtcaaccagtgagtctcctctccggccgttggccgcactgatcgatccggtaggcgggcggcggacagcgagagcgcagtggagtgacgacggctacccaccaatcgtcatcatcgtttgctcttgctagctccagataaagatgatgacgactggtgggtagtggccgtggccatcggcgagaaggacggcgattccctttccttgtggggaagacggaggatccaacaccaaacacggcatatatgcaaaggaaatacgggaccgctatatgtgctaccattaaccaaaggggttcttttaaaaaattcctagcacaatcaaaatgggcttcacgtatgtcgcattaccatttcggcccaacaaaaacaggcctcttgtaggttagaaacccgtaccggcccaaacatttcgcccgcacgtcgcattaccgacttacagttcaggcccattttatatgggctgcacggatacaaccaacatgggccttcccttccagtgcaacaagaatgggccaaacttgtgacagggcttggaccaagatgggggtttgaaggaccaagaatgggccttttcaatattgatcgatctggttctgtggtgctagaattatagctaaaaaaatctatgtgatttaacgctagtcaataataaatgggagttggggatttgtttcatcaccttatttcttattttgatttatttttatctttaacaaaattttggatgtgtcttatgattgaaggcggagatacaatctattttcattattaaaaaataatacatgtttgacgattgattgatagaaaattttgagatgcagagcttactggtgaaccgctgaagcaaacatctaccagtagcaatttgtgtagaagtcgtcttgtaaaaataaaatgcgtggtagggcataaaagcccaggcatgcatcgcatttgttgatatgcaggaatagggatcgatggatggaaagagagaccgggattcccctgtcggccggcaacaatcctctactattaattctttcgtcaactgaacctgaatggatatctgtatggttgttcaatcccatccatccaagatgcaggccagctctgagctcctctatttcatctagtgcatgcaatgcactggctgcagtacttatatatgcatctgtctgaggttctcttttctcatttggaggggatcaaatcaaaacacaattaaacagaggagtatacagttagaaagagcatgaaaagttggtttacgtctgcaataaaattcaagcagggatcgcaaccactttactttgccaaagaaactactttaatacttctcttcctgtacgtgtgaaagagcagaaactacgttctactactttactactacgaacaaaatcatccagcttcctttccagcatgcacctgacctcgcgatcgaatcaattcgatcggccgacgcatccatcgatcaatccatgtcgctagttcaaaccgtttacaccaacatatactccctccactaatgtatgacgccattgactttttatctaatgtttgaccattcatcttattcaaatgttttgtacaaatataaaaatatttatgtcatgcttaaagaactgaatcaagtcacaataaaataaatgataattacataaattttttgaataagacgaatgatcaaacgttggataaaaaatcaacggcgtcatacattaaaattttaatgaaggtagtattagatggacatgaaatgatgttgagcttactggtagctttagcttattattgttagcaagtgtcgctagctgttgctattgcaaatgtggtggtggtgcgagacagccatctgccggccggccatgacaagagaaagttacgtatggagtatcatggatgcatgctcatgctggggcctttgctaccactgcctcttcttcctctcaaagtcctaggttcccagctttctagttttgagagcctgttccgaaagtttttgatagctgcagcttttcaaattcagaaggttcctcaaataatttagctttccgttcagattctaagaagttgtagttgtagaattcaaaaattaaactaacaatcaaaagccgagtttctcagcttttctagattctcataatctggcgaccaactagttgtttctcagaatcttaaagcttctccaaacatgaccatatactcctcgtcagggatgggctcagagcgcgcgattacatcatcttggtgtaactgactgagggagtgtttgagagaaggagaaaagagaaaatgcataaaacaatgtgaaccactaacgcatgattaattgagtattaattatttttaacttaaaaatagattagtatgatttttaaaagcaacttttctatataaggttgtcatcggttggccaattacggataatacgccaaatgtttggctattgtgaaaaaaaatttgggttaaaacttttatatatgtgttttttttacttcaagctaaaaaaagaaactacgaaaaataaacctcaaaatcaacttttggtattggcatataacttatactaagacaaaaaagatgtgaccctaaattttttacaaacaacacatcttttaatagtttagaaaacgtgcacgtgaaaaaacaaggtgaattttctctcacaatcatctgtggacgaacgtaacccagtcttaatagagcttctattatctaaaattagactcctctcctctccaagccaatttagcttccattgcaccacctccctccctccctccatccatctctcttaccacgtaccaacaatggccaccatggctccaaggctgctcatcgtcgtcgtctccgtcctcttcaccgccggcataatcgcctccgccgccgccgcgcgcgacctcaccgccgacccggccggccaggccccgccggcctacgacttcggcatcccggcaggcttcttcgtccccggcaccaacaacccgtacaacggcgatcctgcagcgtgggcagctgggtacggcagcgccgccgccggcgacgtcggcgggttcgggaatggtggggcggaggcgccgtcgatggtttgctccgacaaggggccatgcaacggcaagaagctgacctgcccgaagaagtgcttcgtctccttcagccgctccggcaatggctacgccgccggcggtggcggcggcggctgctccttcgactgctcgaccaagtgcgaagctacctgctgatcattttactacttcatttcctcacccatcgaatccaaggcctcctcttgcatcagctcaatacttcatctatacacatcatcatcagctgatgataccgctccagatatctatctatctatctatctaatctacaggtttggtgcttgcttgctaatgtctactacgtacccatcttaatctgcttaattaattggtgcaaaatatatttctacctatatatgttcttaactaatcctgcatatatattctggaaaacggacatgcacatctgtttttttttacttgttcgaatgctgcatgtacgtgttttcattacctctactgcagagactactacttgtgtgtgtaaccgtacctataaacttgtactccatcacgtaatgatgaatgaataaaggagcgtgtcatatttgtaacccgtgttgtatctgcgacttgtgttgtaaattgttatgatggaggagaatataataccgcatgtttgcctaaccctgcctgcaaaacgccacccgtctcaatgtttgttgtcagccgctctttcagatctcataactcaaaattgccggtaagtacatatatatgcatcttaattcaagctatttcagtggtccaccaaatgatgaatcttttgctgtaagttttcatgcttgccttcttttactgtcaaaactagatgtatgtatctaaaagggtattttcatggtaaagagtatatgtgtttcacaagtgcaggcaagactgagttacccattaattccaacaacatgctcacaaagaattgaaggcaactcgcaactcatcagaaaaaatcaatgtgaaaagtgttcagaaactatcctatcgacttcttctgcccatcatgaggttaactcacaactccaactctcatcacgaagatcaagagctcatcaggtatcgattcatcagtcgctcatgacctcacttccatctgaatgctcagaagcatcagtaacaccccccagatcttcaccctccccactggtttccatatcatcaacttcagactcttcatcatcagtatccttgtcctcataaattatcggcggggatccttcttcctctccggatccatcatcgtcaatctgggagatacatactttcagttatggatttgcaatgctcaaaatgatggcacttgctggtggggtaaaagtaaaacttacctcactgaaaagataatctagacaggtagacaactgcagcgatgatttgaaggtcgatgttcttgcatcaattagctgagagaaatgcaatcagtaatagtaaaatccaaaaataaacatgagcacatgacttataattgttattatgtctccactagtgcactaaaagctgacatattcacagtaattttgacatccacaaattccaaggggctgtatagcctagatgcagacatcctgatgcacatcactaaaggaggttgtaagtggtgcatacggagacaactctttatgcagtacaggccatactttgctgctaatgctataggtatgtaaactctcagaggtatgttgcatatatatatggaaataatcccacgagtcagaaagaatatgcagtcggtaacactaacattcaaaacaaaaatgacctgcaatctgtctcttcatgtctgagctatagcgtgcatactgatacattcaagataataattggcgctaaacaggttacttgagaatacggtgcttagatatccagaggctagtatcattcaggaggccaccatctggtataggtaaagaaagctctcaacttcacttcacgtggggcagtaaagttctaaatcaatcaccaggaaatgatgtgctggtttttcaaaaaaatatttgttgctccaaaggatataaaggaaaaacatattttaaacaactcacatgatagagtgagttgagaagaagctcaattactgaacaatatccttcacataaatgtagctaattgctacctatgcaatcagaattagttaataaatactcacatgatagagtgagttgagcagaagcagagaagactcctgagaaactatgctactcatgtgttgactgagcaaactttgcagccatgggagcaaggaaaccagcactgcacccctgacaaaggggaaaaaatggaaaacataagacctctacgtcaaaatataaccaaataatcttggcagtatgtaaatataatcattgtttgagtagcccatgaaaatccagtcaaacatagatgcagaaaaaagaattgaagctctcctttttttcatgtctactgatgaattacataataacccgaattgtatatcctaagcccatcttctttgtactgaattgcaaaagtgcgtctaacgaattatcctacctcgattgcataagcaatatgaagaacttgagaagcttcacagcgtctgctggtgtaagaagtgatattgaattaacaatgacctgcacagaaaccaacactgaaattatcagatttgatgaccaaattgcatcaaggattagtcaatgttaacttataacatctctcaataacaggtaagaattagtgattaacactagcagagcaagtgatgaataaaatcatatttcagtaccacgaaaatctggcgatatagccgaatgcagtgcaagtgaaacggcaggcaagcatcgcattgcatcattgcaagaagggaaaaccatgacgataccttgtggtctttattgtacaagcaattgagcaaggatgcgtggtcatcagcccgcagagcctgcttgagcaagacgtgaaccgagtccgcgctcggcggcatcaccacggggagtggctgctcctgggtagcttcacctgctgtcccgtcgcctcctccgttgagcagattcagggtggccagcttttcctccatggtgggttcgtcaagattatactccggattagcaccactgtcgttgattgcatctgaaacatagacaccaagggcatgttcactttgatgccaaaaaaatacttaccaaattttggcattgccgaaattttagcaacttgtcaaaattttggcaagatttcttatatagttaccaaaatttgacagcaaactaaatatagccattttttggcaactttatcaaaatttggtaaggttgaaaatgacatcaaagtgaacaggtcccaaatcatgctgtcaccaatggctgttcagagagctcgcgtttatctgtgccagcggctagcctagacaagcagggaaaaaaccaagaactgaggaacagggttacctgatggcaggggagcgcccggggcaggttgcctccggcggcgccggcgagtgaggtccatccgcttacttcagcacgcagctggcgtcggcgccggtggagacaaacgaagcgagagagcagcggcggcggcggcggcggaagaagagagagagggggagagagagagagatgaaggaagtgcaaggccgcacggatgggccggaatacggcccagcccatcctatctccagacattttttatatttcttcctctccttttttttttctagttttctttccgtgtaattcttttgcacgttcgcgaataattttcttccaaatagtagctgctcatactggcattcctgtctaccttttcaatgctcacgacaagcatgctcattttctcattttcagaggttttgtttccaaaaacatttttactgaaagaatttgaggctggctaggaacaccaacagtccaatgcctatggttgacataggagtacacgcaagtacgcaactcgcggcaggtgaagcaaattaatcatccgaacatactcaacaactatcacaaggaagaattagcatttagttcatcattccaacaacatttcttctccatctggagcaaataaaagccatcattcctgcgtctcgcatgctaaaatcaccacaagcttactggacagtctgggctgaatgttgtaagaatccatatctcaaacaggatgtcaaagttgccattaacctatgcttcagttctaattcttccgaagaagacgccgttctccatactcccaccatgaattcaagcctaatgccaagtactagtactgcatatgcacaaaattgcagctgagctactagttaaactgtctctaaaccaacaaaaaagggcttcgggtcactcggcattactcagttcttcaggtccatcgcctccctgagagcaaatctccattagaacatccaacacaatgatatcaaagcacaacttacaatgcacaaataccaggactagtggtgagaatctcttaccagaacagtttgtccatctcatcactttcaggatccaactctataccatgggtcaacgccacgcaagctttctcataatcctaatgaaggacaaaatgcgcatatggtcagccaaatgagatggtagttagttagcaatgagaatggaatggtgaattgaagttttttttatgctgcaccttctcaagcattagagcttctcctagccgatggtaggcctccgacaacttcgggtgatgttttgcgcatgtggttgcatctttcacagccttttttccctcacccatgcgaagccagcaaagacacctctttagaagagttgtggcatcacaaggatcaacttccagtgcctgcggtgaaccaaacagtatctgtcaaatatagtgttgctgccacatccaaaaatttaattgtcacaaagttacatttctcatttatctcagatagagttgaacccatagtgaaattcacatatcaacaagaacttaaaactgtagatggcatagcaattatatgacagaattcctagaagatatatcatcccacataactgctgttgctcaactcatactgaatcatcaaaataactactcgaaggagacactatttcgtagtacatatactttgtgcacaaagctcatgatgattttatatcaaaaaatcattgcttatcctgtaaaaaaggtataactgctgattttttgaatccatgaaatggaagaaagctgcatcttattgacaattcaaggaaacagaaaattttgcattgagttgaatgaaaagaagtgatgagctcatggcactagtctttcagcatagtagcattctaatagtcgatgcactatttaagtagatagaagaatgtacctgtgtgtaccacactgatgctttttcataatcctgctcatcaaatgcttcattccctttttgtttcaggtcagacattttcgtgttaacgtaatcatcatcctgttcaatttataacagcatgagtcagacagattcagaggtccaatgtgacaaaatgcaatgtaacaagtaaaaggggatgtttattgataaaccctgtttctctattgttaggtctgatgaacaagctacgagctattgttaactttgggtcaaaactaatacaaactatcctgctgctgagaacaaggtggcatgttgcctgcaatgggtacaaacaattgtggttccttgtgtcaaaacagggtttgagaccccgctggtaatccaccatttttaccagtgatcctgggaaacctgatgtgtatcagtatctagaaaagcatgtaccaatccccctcaccaggtatcaattcagggaagcaaatttaatatagaaacaaacttccttcatcttctttttgcaagaacaataaaacaagcccacatgaagaaagctaaagagagcaaccagacgctagcaagtatgggcaactgctatagtaacatacctctagcttcttgcgttccagattggcataagtaattaccccatcaacgctccagtcagcaacagttggaattgggttggtcaaaggaaatagaatctcaacatcttcccttgtaccatacacagcagccagctctattggcattctaccatgctgtttggcaaacgaataaagctttataaagtcatattggagatcagagaaaggtaagacgatgcttccttccaataacgctaatttaggaattaactttgctccaccaaggcacatcactaaatgatgtaatgccaccacataaatgactgatgaatatggaatagtacttgttttatcaataattttttcaaaattgctaccatcagttcttgttgtcctaaactttttaaacatgttgccattagaaaagaccaattagcattatgctcaccgactattaattatctctatgcacctgaccaacaaaaaaagctaaatgaaaatgaaaacagggaatttagcaggcttgtgtcaactctagaagcagatgatagtggtctgcgaaacacaccacagaatggtgtacacatgtctcacaaatcaaatcacactattcaactgatgctcaaatgctccaaatcttttgcataatcttgtttccgaaagaaaaaagaatttcctataaccaaaaactgtgaactttcgatgctctataaccaattttgcctagtatcttttacaaataagcgtgtgccacatatgtgaattttcaggaatacatttcattgttccatactagtgatgcatatcaatgccacaggcctaaaatcattgaagctacaaactcaatctgctgatagtgatggtgtgataagcaaaacagaaggctcaccgtgtcaggacaatttgggtttgctccagccttcaacaacaactttatagcttcagttaatccactccctgcagctctcgccagggggttgtttgtagcatttacatcagctccagcctacaaatgtttatgtataatacaaaatgattatacattttcttcacataacttgatgattataacagctctagccatatatagtatcagttatttagccttatcctattgcagcagtccaaaggagaaaatattgtacctggatcaatagcttcacacaaggtaaggaagtagtgaataacgccgcagataaaggtgttgcttgagaagaaggcataaccttgttgggctggaaaagaaagaaatgtattatcatacattatgacagttcctagagaaagagataatttaagaaagttgtttgtgtttcttccgttgttcctattgattattcagtggagtagttgttaatgtgtggatcacggctcagccagcctgggctagctcagtgctcacacatcaataaccaaaatgagagtaaggatggaacagtgggaggaaatagtaagccccaacataagaaaagtataagcatcgtacatctgcttggtgctccaacaaaatcttcacagtactttcatatcctttaatagcagcaaaatgcagaggtgtcccatgatctgatttgccatcaacatgagctcctctagaaagcagcaattttactatttcagtcctccctgaacaatcacataaaaaaattgaaggtcactgatgtatgagagaaacaatttgggggcagacaagtttgagaagccagagcaaagaggcaatttaacacttaactgcttaactggaggataataaaagaaaaagacaaaccagtcctaaataacacacaaaaagagcagttcactcttggaggaacatgtttcagtggctagaacaaaacacacacacacaaaaagaaaccctggcagcaggttgataaataaatatgaggtttatgaagtagaaacagtccaacagttatactaggatgaatggtaaagtgcagataatctatgatgatgtgaatgatatattttaacattttcttatgatgaattaatatgtataggctgatgaacatgaaaagtgtacatcagcaaggtctatatcacttaaacaacacctgtaaaaacaaaatgcgtcaggaaatgctgcattaggcttgctttgttgtacatttgctagacgctaaggtccccatcagttgcttacaacttattataagccgtaacggcttattagcaattaaaaaatgttgtgcgaaaaaaacttttgtatatatattcttagcgacttaaaagtcaaagctgaaaaaaaaactatgttgaaaaaaaaaacatcaaaatcaaattaaaaatcaagttttaaagttcagattttggctttagcttataagccatagggcaaacaatgaggcccttacagtattgtctgcatttttctccacattcaacgtaaggctgctcatcatgacagaatgcagattggatgtagcagggaatcctacaagaagataggatattcccctaataaatccaagggcataatgctgttccactgaacgggattgggttgaagcagtattccgaatgacacatagtatgccgggtagtacagcataactcagattgttcttttgtaataaaaacaaaaaaagaaaaagaagaagttgaactaaatctgaggattggtttcccctgtttatacctttctttgcagctgaatgaagaaaagtgatgtttccttcacgttcatgatggatatcagcaccatgatcaatgagatacctgacagagggcaggtccccaccggcaatggctcgctcgaggggagtcttcctacctaggtggcaaggcaatgaaaaccagattcacaataacagtgagacatccagctgaaatagctagctagtactcctagctggcgaagaggacaaaaggaagcagaagaggaggatgaatcttgacatgcacctggagtggtgtccggcttgtgacgtccatgttggccacctcgagcaagtagcggtagacgtgcaggcttctggcggcgtgcagcgcgttcatgccgtggaagccgtgcgcgccacggtggccgcgatcccctccccgtcgtcgtccagcgtcgcggcgatctctgattgagcacaacagcaagcaagcaagtctcgttctatcacttccatgagcggaaatcagaagcccganaagattttaaaaaaagattttttttttgtttggtttcttgcatgtcaaatacangtggtcaggggtggcgagaagagaagtgtacccttgatgcggcggatgttgccgtcgtgggcggcgaggagcaagttggcctccgcgggccagctgtcctgatctgcgcgtgaatggcangcaaagggatcgaggaggaggaggaagagattagattaagaataaagaatgaagagaagaagacatgatgaatgcagcgcaataccgtcgccgagaagcttctcgaagaggtcgggcagcgacatgatgccgtcctggctaggctagggtttcgtttgttgctgctgcggctgggttgtgtttgggttggggaaaggaggagagaagggaagaatggtccaagaattgaagaagaagaagaagaagaagaagaagcgcttctctgctgcaactctgcaagtgcagagagagcagagaaagagagagagagagagaggcgaggaggcgggaagtgatcgatcgagtggggtcccactcccagacgcagaggcagaggaagtggagcaatggcgggtcgacatggcagcccccaatccccggcttttttctgctccgattctccccatctttttccatgtctttgccttcttctcctctcctatcctcttcttggcttcttgcttgttcatcctgcacaccacactagcagtggagtaaaactgtaaaaagtatttcagatctttgatttttgcttggtggtgagagataaataaaagacaagtcgtctgcaaccctgcatcaataacctccatacagataaacaaactgggccttgagtagttcccaatttttttttctaaaaaagtcgcatcgaatctttaaacacatacatgcagcattaaatatagattaaaaaatttaattacacagtttacatggaaatcgcgagaggaatcttttgagtctaattagtttatgattagtcataagtgctacaataacccatatgtactaatgacggattatttaggcttaataaattcctcgcagtttccaggcgagatatgaaattagttttttcattcgtgtccaaaaaccacttccgacatccgatcaaacatccgatgtggcactcaaaaattttcttttctcaaactaaacacaccttgggcctcctaacagcagaattactactagtactccagtatgtaaatcattctaaggccgacttcttttgtagattatttttaccgattaactgtacctaaaacgagaaacatgattattaactaaatattaattattgaaatttttaaaaatagattttatttgattttttaaagtattattgtcacggcatgcactacttcaggaccatctcaggaaggcgaagagcaaggcgggagacaagattcaaagcaacccttgttgcggcgatcgacacgtgaaaagcggcccaacagcttgtaccaaccgagtgtgtggacctagtagaattgggctgggccacagtgagggagagaggtccatagctcatcgctataagagaccggcagggaagagaacgaatcgaacattgtagaaacaaatattcggaaatcaattcaaatctctccctgttctattgctgcctctacctgttcttagctgttcttccccaaactctcaattctctccctaaatcctcaatttcttcccttgttgtggcacaaattcttcggagacgtaacaattatctatatagaaaattttcatgcaaaacgtataatttggagtagtgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacgcggacgaggaaacaccaacagcagcagcagcagcagcggaaccaacggtctaacacccaacaccacaggcgacggctgggaaccaggacgaaaccctaatcttcacttctccttatcttctcttcagggcggaggaactatatatatatttatagagcaagggtgagtactttcgtactcagcaagtcacgggaacttaggtgtttggtgctagcttggaagagaggcaaggttgttttgcaaatcttttgtttgaaatcattttgaaatcactaagtgatttatttctttctatgtttgggcgaaaagagacttgcgtctcgattcgactttaagagatgcttttcaacagctcatttagcaatgtaccgacctcccgggtcagatcattacttctcggctcccagagccattccacttgattaatcggctcccagagcctttttcattttctcggactcccagagtcctgctgcccagcagcacaacaatccgcttccactcgggaagcctagtctatgatgcccgcagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttccccagccgacccagggttacctcatgccacatagaaggatcaaattctctcataaacataggcctttttaggcgtgcacaaatcaaactccaaccaccttgatcggtaagtgagcaagcttctcgttcttgccttaccaggaacccggtttgtccgaccccgccccggcgttcccaactattggcatgcgaggtttccctgaaccgtctagttacttagccagggtgtcccattccaccttgtggttgcacttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaagcaacggtgtatgtgggatatttggtatacgcgctcagagagcacgaataccgaggtaccacaagggtggagcgacaaggaatcagggtagtacgacctacggaaattagtgtgactactgggtaggtccgtcggtctggcacgcaaaccgaggccaagcaagttaagtgtgtgattctaataatgcaagttgcaaacgaaataataatgacttttcaattataggagcaattgatcaaagggtgacttgccttgcttaaggtcttcacgaagcttcacgaatcttcgagagaacccgcgatcgacgaaattccgattaccgcaactatacgcaaacaatcgaaaacctaaacaaaagaccaaaagaaagatcctatttagactaattattagtgccattaaatagatctcaattttacggaattactggaggttgagcggagtcaatcggatgagcggtgggaagatatggattttctaaggtttaaggattttctaatcaaaggagaaaggatttaataatttattaaacccctttctggaaagagaattgaaggagggatgtaaactagactttttccggtgg

SEQ ID NO: 50063 - DNA, 7655 bp, Oryza sativa
tgcctctctctctcggcgcgtgcagcgcacgtgcggggaggaggagcagccgagaggggagaatgggccgagcaagggagaaacggcccacagccaagagggacgcaatttagaccttttccgagagaactgatttggataggattgagagatttagggtttggattcgagttcaaatttgatattcgaactcgagggtttagggatgtatcaaggggaattcaaggagaagtcaaggaaaagattcaaaaggaatacttgggtatttgttctcgggaacatagggtggagtcaaggaaggaaacaaaacgggggtttggacattttgggatttggaaatgtgtttggcgaggattcaaaggaagggattgactttcggatttagatttcggagacttgaattgggagaggagatttgaggcggaggattttgatttcgatgagagggaacaacgggatttgaattgagatcttggcacaacttagactcgcacacaaagaacgaaaattttcgcaattaggattttgccgaaatagtttttaacaactcacgaaaagcggagcgttacaagtagctttttaaaatacgtgttaatagaaatatagaagtagctagggccctgtttagttccaaagttttttttctaaacttccaactttccatcacatcaaaccttttatacacacaacttttcagtcacatagtttcaatttcaaccaaactttcaaacttcagtgtgaactaaacacggcctaagttcaattacctcttattagaacgcgaccttagaatagcaaaaggtgtatgttttggatcataatatcctataattaataaactcgcatcagcaaccgatcaggggatgtagctcaaatggtagagcgctcgctttgcatgcgagaggcacggggttcgatcccccgcatctccatttttttttattttttttacttccctattccaagcactatcttcccaactgttctgaatgttcaagaccgtttatctcaactttctgaatattttccttattctagtaacttgtaaaacgagatggagagcaatgagattattatcagtcccaccatgattatacatatagtcggatcaattaactgcgcacattctctgaactttcagaatattttgtttaccctgttctaagacgagaggagaacaatgagattatctgagtctcaccacaccatctgcatcttttgcatacatacgggtgtgtttagttcacgtcaaaattacaagtgatgtgatagaaaagttgaaaatttatgtgtgtaggaaagatttggctgtgtttagttcaatgtgatagaaaagttgaaaatttatgtgtgtaggaaagatttggctgtgtttagttcctgaaattgagaagaagtttgggaaaagttggtagtttgaaaaaaaaaagttgagagtttatgtgaaatgtgatagaaaagttgaaaatttatgtgtgtaggaaagttttggctgtgtttagtttctgaaattgagaagaagtttgggaaaagttggtagtttgaaaaaaaaaagttgagagtttatgtgagtaggaaagttttggatgtgatgtgatgaaaagttgggagtttggggaaagtttggtgtgaactaaacagagcctttaatgtgatggaaaagttaaaagtttgaagaaaaagtttaaaactaaacaaggctgtaatagatcaataactgaacacgctactagtctcaagtgcaaatcagacgtatgtacacatgtgtggagattatgggtaccccatacccacacggcatggttatctgactagttataggggataacttatatgtatgtaatatgtaacagatcataacttgggtgttacgtttccttgtatattacggaacggcctaaagtcctggttggctaatattgtaaagtagatttaggaaaccgataccgtattggttaaggtttctatctcgtaatcctgccccccatcctatataaggtgggcaggaggccctctagggggcagatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggtaaacgtcgagtttcctgacgacgagtgcgatggaatcaactttatgagtcgccggcttcgtcttcgctttgggagctccttgattcctcgccgccgacgacttcaacaagacgaatcgtcgctgctattctctgcctgatcttgttcgcatcagcacgacggcaacgacggggcaacgacagttcgacggatttgatggtcgtcctcgtccaccaccaagcctactggtccaatctacccaacgaggatgccatggtgttgcaagatggatctacaaacacgaagcatgccaaaaccgatctaatcggatgcataggagacggctgcagccacgccgatgcctccctgccgtcctgcgtcgtgctgatggacaccaacgccgcccgcgactgcgacctccgcctcctccgctccgtctcggagtcagtcgaagagatcaatctcggcgagttttttccttttaatctccgacttcgccgggttttttccttttcaacttattgttgtttattagattgatctctaaatgtcagattaatctctcttggtattttctgctgtttgcatgtaacgccgcggcactactcttgccgactggtgcttccgtctgcatggctggcctattaagccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcatcgccggcttgcctccgtcgccgccgattggtgcctccgcctacagggctggcctattatgccgccattagtgggcatcttcgctttcaccgtcgacagccttcgtcgccgccgactggtgtcttcattgttattaatggacgactttgttcctacattggccacctctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacctaagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttatcaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaaccggccgcctcgtctgccgccgactggtgcttccgcctgcacggctgacttattatgccgccgttgttgggcgtctacgtcttcaccgaccggcttgccttcgccgccgccaactggtgtttccgcctgcacggctggcctttaatgccgccgttgttgggcgtctacgtcttcaccgaccggcttgccttcgccgccgccgactggtgtttccgcctgcacggctggcctttatgccgccgttgttgggcgtctacgtctttaccgaccggcttgccttcgccgctgccgactggtgtttccgcctgcacggctggcctttatgccgccgttgttgggcgtctacgtcttcaccgaccggccgcctcgtccgccgccgactggtgcttctgcctgcacggctggcctattatgctgccgttgttgggcgtctacgtcttcaccgaccggccgcctcgtccgccgccgactggtgcttccgcctgcacggctggcctttatgccgccgctgttgggcgtctacgtcttcaccgaccggccgcctcgaccgccgccgactggtgtttccgcctgcacggctggcctattatgctgccgttgttgggcgtctacatcttcaccgaccggccgccgcatccgccgctgactggtgtcaccgcctgcacggctggcctgttatgacgccaattgatgctatcttcttcacggctggctacatcaccgtcaccgctaataggcatcatcatcttcaacacaagctgtctacgtctgctgctgactagtgccctcacctctacgtctggtttagacagctaccactactgatgaacatcatcgtcttccgtcgccgactggttatgctgccgccgactagtgcttttatcttcacaactgcgcgtcttcactaccagtttgcttctgtcacttcatcacggcaatgcaactttgtcatcatggatttctacttggacatcttcaacatttatcttcaatcaagcaatgactactcgacgataagaagctataattctcgactctatgttcagttgtttcccaactaaacaaagagtcgggggctacacaaatacatggctcaaaattcgacaagctttatgtcaaagatggagcaatcaattaatcagccaacgagtcaactccaggagtcattatcttcatctttgcttcggagcagatattctacttcaacaacttcaaatatttcggtttagacgagttgggcaacaacatcaactctcctccaattatttgtcttcacggttggcctactacgcaactgccgatagaggatctcatcgttatcatcggctgctacatcgttattgactggatcactgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatccttgtcgtttccgtcgttgcaaggttcgcgagtgcgccggaagtattcaagaagattaattgaagaccgattattgcaagttgaagacaagttgcaaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacattttgtcaccaccgactgttctttcgttgttgttgggcgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgatagaaggacaagctatatgctcaggggctcatcaactcaagcgtgaggattatatctccaatttggacttgttccggatacattccacatggattcatagttatgagtctattttctatgctcaacgactggaccaattattattccccgtaagggctatcaaccgaatacttgcgccattcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttataagtcaaggtgctgtttgggtttttaagcaattgattggatacaatattattgctttttgccacgtaagtgtgcatttttattgaccaatattatggcttaggctgattatatattgtgatcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccagtactttgaaaatttctttattcacaacatacaagcttctttatagctattttgctatgtgaattttcaatgatgtagccaactttaggttacactcatcatattttacaaagcagtcggtatatcacttggatcatattattcagggattcacaccgcatctgctacatattaatattaagtcgcttggttgactacaattatcgaaaccactcggtgcatctagtcgatgcacctgactttattttttcagccctccacagtcttctgatttagaaaaagtactcgggagatcatggcgaagatgattgaagcactcggctttggagtaatctagttcgagagaagattatctttctgactgtgaaggtctcaggggctactgtgagattatgggtaccccatacccacacggcatggttatctgactagttataggggataacttatatgtatgtaatatgtaacagatcataacttgggtgttacgtttccttgtatattacggaacggcctaaagtccggttggctaatattgtaagtagatttagaaaaccgataggggtgcaggaat

SEQ ID NO: 50064 - DNA, 4390 bp, Oryza sativa
attcaatccccaaacaggagtagggtattacctctcattgagagggcctgaacctgtctaaatcctttgtctccacatccatccacttttaagtctcgtgcgctaccccgttttattattgccgaattcatgtttcgacaacatgacgtctcaagtgaacagcggcacgcaattcaacagcataggaaagttgagatcatacatggttgcagcgtatgaacggcggaaggaggtaggccgccggatcaggcggtcatggcacggcacaagagccacccaactcggtaggctgctatgcagagctaattcgtgagacaagttatttaggcctaattaatttataattagcatattttttactacagtattatataggataatcatagattaattatactctatagatttatctcataaattagtccagagttatgaaatgggttttatcattagtctacgtttaatactctaagttagtgtccaaacatccgatgtgacacggactaaattttagtccttctaaattagtgtctaaacatccgatatgacatggaacaccactaaataccactaaataatgaggtagtcatattgtacaatagtaatctgaatgtgacacaacatggccatacatacatcatagaccaagaatgaactctttatactacatactagtctgatcacgcgcttgtttggtcagaaacacaagagttgcgttgaattgactgaaccaacgccaacgccaacggccggccaacatatttgactcccctccaaacatacacacagtattattcctcaccgccctaccttttcagttagcttcagcctcagcttctgcagacagtgcagagtacgccattgttcatccactcccattttgcaagtcagtgctaaccaaaaaatccaaaataaaacacccatcgtttcattcgcaagtactgctgctgtaatcagcatgcaagaatcaatgttaacaggctactgattgagttgattagcagctcgaacccttatccctttactggagaatggaagaagaggaatgaatttccatgcattcattcatatagaaccagcaggtagattaacgagatgttggcagaagagaaagaagtaacaggacacgattaagagtctcctcaagttagacatgctacagttttattcattactaatgcagaccaatatatgttcagtgttcatcataagcacaaagccacaaacactctgacagcgagtgtgttcgttgcttgctcaggcagctagaaaatcagtaaagtgttggtgcttcttcgatctacaattgttattattgcaattacaggaagaacaactagtggtactaacctgactgtactgctatcctgtatgaaattatacatttgtataggctactgaacacgaacaatcaagccatgcatcaccatcttacacttgattacactaacttgtcccgatcgatcgatattgaacagcaaaactaaactaattttttttccctttgcgccggcgagctatgtagcttaggccatggcagccgtggcgggcggttcagatgagggcgccgtgggcggcgtcgagggaggcggccatgggcatggggaagccgaaccatggcgcgtacagctgggcctcgtcgacggcggggcgcacgggcacgggctgcgccggcgccacgggctgccttggcggcggcggcgcgggggcgcccgtgagcctctgcacgaggtccctgaactccctgggctcgacgcggtacaccttgggcggcgcggggcctggcgccgccgacggagaggctcgccacgcttggccggcggcttctgcaccgccctgagcgccgcctcgtgcgccggccgcctcgcgtcggcagcgtgcatatccattgaattgaagaagaagaagaagctaagataagcagagtgagagagaggaggaagaagaagagagggcagagcagaggagcgatgggaggaggagcaggacatatatagagtggtgggttgggcgagggcgtgtggagggggttggattctagaagaagaagatgaagaggagaggtggcgggagagcaagcggagtggcgggagtggcggcgagcggggggcaacacgtggaggcgggcggtcaatggtggcaggcaggcaatggcgatggcattcgctaatcgcgcgtgttgcacttgcattgctgctgcattcctaaccatgcacggctctctctctatatcaaatgaaatctagtatccatctccatctcattggcattggatgcaccgcggcgatggcgtagcatagcagaagcaaaataagtgatgtgaatgatgaggcagttgagttggggcggccacctcgctcttaccgatcaacaagggcaagggcaaggccttgttgatggctacgctctgcctgccttatatcatcctcttatgtaggagtataacatttctttttcattatctacttacaaactacctgaggatgtagtggctggtttaattcattatttaaatatctaaatatttttaaaaataagcgtagtacaattcgttacttctagcaacctaaaagatataaaaaaagagcagccaaaaagtgttccaacacatatactgtagctctcaactctatcctaatatataaaatgggcgcacctaagcgtcgattcgttcagaaaaaagtattgtagttacagagtaacgttcaaaaatcacacgataacgcactattttcgcgaagtgaaggtggcgggaccaaatcccctcacctatgcgtgtggccataatttttttttcttactagtttgcatgatttgtgaagcaaatctaacattcgaaattatatgaaagttatattatagttacataccagttacaaatgcaattacggtataattatattgtatttatatttgatatttacttggacaaaatttattaacaaatattgttgtcaaaatgacaagagcttcacgtcgaaggacgtggttccctcggtggagtgatttgaacaataaataacatattaatttatgaaattttttagggatcccccttacacaaccctagggggatatttatagtcttagtacatgcctatacccactagggttcaatatgtacagagaaatttacattatacccttatgataaggatattagagggacatgtagtgtccatcccaactatattccccttgaaaggcccctggcctggccataataggcgaatggcaccatgggccgtgctgcttggcgggctccctggcgaagccggtcttccatggggcgaacctttcgtgctccgccttgaggcttcgcccagaggataaacttggtggcgaacccccttgacttcgtcttttggcttccctgatgcagtggcttgttgatttaatggtttagcaggttcggccgaaggctctcgtggcatgccttaacaaatatatagcaaaattatccactagatggattttaagtcctacctagatagccgccaggtcactgaatagtcaggtacgtgcagtagaaactctttttttccttagtcatgtataaaaggcctccttttactttgtgactaaagaacatatatattcatgtgaaaccggtgacaaagaagtatatttttaatttctttttctttcccactgttcctactgttctacatttccctcgtgctagcatacgtacaatcatgaaatagaagcacgcatattagtttcattcattcatgcatgcattcaaatatctcatacgcaacctactatttctgcagctagcgagcaaggttttctcgcagcctaaccaccgtaccacaagactattctctctactgttagcttgtctgaatgtctgaagaagaataactaacaatcaggttcaggttgagtacttgagcacgcacgagcggccggcccagtcaacgatggcacacgcacagctatggacattccatttctctctgtacgtctcgttatcattctgaaacgaaggaatttcatatgagatttgcagggcctttaatttgataattaattgaccggttgactatatttcagttgattggcgaattaaccacggacgtacagttaatagtaatactccctccatactcacaaagaaagtcatttagaacatcgatacggtctccaaaatacaactttaacttcttttttctataaaaatattcattgaaaagtgatatatgtatacttttatgaaagtatttttcaagacaaatctattcaaataatttttatattttcaatctcaacaacttaagagttattcatgatttatattcccaaggtttgacttaaacattgtcctaaacgacttcctttacgagtatggagggagtacaagttagtactccctccgtttcga

SEQ ID NO: 50065 - DNA, 3533 bp, Oryza sativa
tcctgcagccctgactttctagcacatgtttgaccgttcgtcttattcaagaaatttaagtaattattaattctttttctatcatttgattcattgttaaatatatttttatgtaggcatataattttatatatttcacaaaagtttttaataagacgaacggttaaacatgtgctaaaaggtcaacggtgtcaaacatttcgaaacggagggagtataactcaacacgttcagttcaatccggcacgtacgcggatattcggtcaaatttgatcaattttttttctgtaatttcttgtctgcaggctagaatggtgagatgatccaagtccgtcgtcctgctctgaatatgtcaaaacttgcgcttggcctggactttccagaattccagtcgtctctcgtctcttcccaaaaaaaaatctctctttttagcttactttcctttgggtgcattttgtttatcacctgattgttcttcacagtccaagaaaaattctatttttttccagtttagtttcctttggctgcatttttttatcaccagattatcttcacagtcctaaaagaatatctcacaaaaatctcatttttgggcttactttcctttgactgcattttttttggtttatcagaagattactcttcccagtccaaattttttctctctttttttttcagcttcatttcatttagctgcacttttgcttatcagcatgttattcttcagtccaaaatattctccctttttcacctcgatttccttacacatacgactagtaattattcctaatgcactgtacagtttaatcttttgatacctttctctaatcactcccacaagatgtatgtacagttcctggatgtctcctggaaggaggagatcaggagatgaatcccaatcagtctctatctcccttcagggacagagtaatctactactagtatagtctacggttagtggggcccacctcaaacaacgacatgcaagaacaggaggagcccacaaactgataactgaaatcatggtcttcttctcaatatcacccccacctccccttcaattatatacaagtcaccctttattctttttttcctctcttcttaggctgtgtttagttcagcgcaaagtttagattttggttgaaattagagatgatgtgactgaaaagttatatgtgtattacaggttgatgtgatggaaaaggactgaagtttggatccaaactttagatctaaacacagccttatactagtgtatccttttggatggcaaagtaaaagcagaggttgacaagcacatagccatgtacatcaagtcacatgtgggtgtgcactttgcacttcttttctatttggcaggtcataagagctttgtcaaattcgagagctctttggtgaatatatagctgcaactcttgtagaaaattaagaaatagttagttcaagtactatccgtgctactaataaagtatgttttcttcgcactatctacgatgaaacgaactctaaaaacagtagaaagttacataacatatacgtgcatatggtgcacaaacaaatcatctaccaaagcaacaaagtcaaggccaaatggatagccaaaaaatactgcaagtgaaacacatcgtagttcactcgaaattgacgcttcagaaaccaactggacagccaaaatattgcaagtgaaacacatcttagttcactcgaaattgacgttttcagaaaacaaagaaagggaaattttttagtcctagaaaaagcatcatcgaaaaggaatccggtggaatttgcgaatgtcttgagggggagcactgaaaaagttgtccccaagtaggcgtaggcaacaacaattcaaccatggccgtgctgaaaagccaaatcttccctctctaatctccttctttcctctgctttcctctaaatgtccagatggtaccaccacccaagtactccgattttttcagctcggcgattgaggaagatcttctcatcatcaccaccaccgtgctaccctagcctaacctagaggccttcaacctctgctcgatcgatctgctgctgcttctccaaggcgagcttcgtgatcaaaggtccttattctctcatcagctctgctctgcttggttttggttttggttcattcagtttgattcatttgatggatagattggcaaggagtatgagtatcttcttgtttccctttttgcggcgatttgctgctcttgttcgctttcagttcgtctctcatctttatgcgtttcttggctcccggtgaaggaatcacgattcaggaatctcggactccgtgattttcaccagagaaattcttttttttttaacccactcatcaccgtgtaatttttttaatttcttctctgcttcgatttcaccgaagggcagaaaccgctcttccttggacgtaaccgcttctcggatccacacatacattaattttttttgcatttttgtttaggataggattggagccaataatattgtttactagtaggatttttcatttttcaataagatgtcttgttcttggatgttgccatggacagcatgcaaggaggggtagcgatggtggtgacagtgaacggcggcaatggcaaggacagcttcggcaacatggcgaggccgccgtcgaggagcctcctccccctcaagctcctcaagccgttcctcatcttcgccgtgctcgccaccggcttcctcgccgccgccgcagccgccctcctcctcctcggcggcggcgctggcgcctcctacgtccccaacgtcctctcggcaacggcgtggcagcagcagccgcggtgcgcgcagcagcaggaggacggcgggcgggcggcgctggagcggtggacgcggctaccggcggcgagcgcctggcacaacatgagcgacgaggagctgctctgggcggcgtcgatggagccgcgggtgcggcggtatccgtaccggcgggtgcccaaggtggcgttcatgttcctcacgcgtgggccgctgccattggcgccgctctgggagaggttcttcaatggcagcggcggccgggagctcttctccatctatgtccactccacgcccggatacaaccccgacttcccgacaacctccgtcttctaccgccgccaggtgcccagccaggtactacaaactcaaatctcatatcaaatttgattagtttccgtttcaaatgcgagatgatttttttcatttctcaattaaattaaaagattggggggaatttggagagcgttgagtcgggttcgtgtccagatgaatgttcagcttccgtggcatcttggcaagtgcagtgcgccacgaatgcaagggtgaaaatgacatggtgtaaaagtctccctccttaataatcccaaaaaaaaataagaatattcaatcacacttgtacaggctacatacaattagctagaaacaaatttcatctcgttttctcatccatcgtcagcatctctgaaacaataattccagaagcaaacctgaagagtgtatgaaatggattggaaattgaa

SEQ ID NO: 50066 - DNA, 1778 bp, Oryza sativa
ctcatcagttacgtatagatgtacgtactgtacgtctctcactcaaatgtctacattatatatacgatgtatactcacatcacagaaattttttgagcggtaatatataaaattttttatactccatccactgttgcggttaatcggttatggatgaaaatggtatggactttcccaaccgtatcgactatcgtttccgtcttgtaccagccgttttatttcgatcatgtgtttgaaaagttactacctactgctttgaatcttcactataataggaacatatgatgttaatatataccgcctccaattcaaaatgtacgatgccattaacttttaacataacgtttgaccatttattttattcaaaacagttacataaatattatttagggcttgttcggttcatagagttttcaaatgaaaggaatagtaaaagcaaagaatcaggatgtcacatgcactccattccttaggaatttttctaaaaggtctcacatcatgcaaagaatcctataaaataatttttgccgtttctcatgtgctatgtagacaaagaacctgacaagcttcatattacacagtgcaagtacttagtagtgggtcccacatgtacatcttttcacttttcatctcccaatctctttctcctccccaaccgaggttgcaagctccacaagaccacaacgcagcgcccagccgttctccctgcgttgcgctccctcgaccgtcacggagaacgcgtgccctcttgtggctccgcctccgcgaactcgcccaggcaacgcactttggcgacgtggtgtcaatttttccgttggcactgaccgggctgaacgacacgtaggcccattgtaaatgccctaaggctacaatccttatgaatttgataggatccattcctatgaaatgaatgatgcatataggaaaagaatcataaggtttgaattcctacaataatcctatgaaaatcctctaagccaaatgagtccttatttttttctaacttgttttatgatcaaataaaatataatcttaaattatacttttacatatttatactaaatttttgaaaaaaaagatcaaactttgtgcgaaaagtaaacggcgtcatacattttgaaaagagctactatataaagtaaacattgtcgtgacttgctttcccttgtgacacattgttttcaaggctctattccggtaattttatctccggtgatttcattttttcgttatcattaatcatttttggctctttcgcttcgattccttttttaagaaaagaaaaacaatacggaaatggtttaaacattttctgacagtttttggccattttcatctatagacggatctagggggtggcccagtgatccagtgacaaaaaaaaatcctagcccaatacatatatatacatatgcgaaaagaaattttaaaaaaagaaaaaaaaagctcctttattaatatattataacgcacatttgattaatttatacttatagcttggttatatttagagtatttaaaaattttatatgaattgaaccacccatataaaattaactagataggccaactgttttcatccctagcttcaatgcttgaatgcccttttcttcttttttttttgaaggaaatgaatgcccttttctagtcaaagctgcaaggctgcaatgtgaagattctatggttgttcacatgctgagcatgagcagagaggcccaaaccacccaaccaaagaaaaaggcagccgccaccacagatacaattggagtggtcgcact

SEQ ID NO: 50067 - DNA, 2100 bp, Oryza sativa
ccttactactgtattattgttgacaaagcaaccactcaatttgctactgttctgttgttgatccatcaacatgtctaagtaagtattccaattgtactgttgcttgcagaaattatcatacaactctccacttccctaccaacttttactgtgaactagtagacccacaaactgaaactgacaggaggagatcaaaacatcggagtacaaccaaccaataattcaaacataaagtactccactccgtaagtactagcgattaagacagctcctcagctggttgctgcagctcaattcatggtgtttaatcaatgaaggcatgaagcaacagttgggagtgatgggagtcccagttctctcacaatgctcagatactaccaagcagatgaacaggttgcaggacatggacttgcttgcagcctcctagcctgcatttgatgatggctcccaatttgtgcactgcagaagtgcagagtgcaggctgcagatcgactgcctgatctgctcccctctgttgagccacacatgtaacatgctgccctgctgcttgtagccgagctgatcagctagctcatacatatgtatgtatgcccacctgttgccacgatctctcttgtgcaaatgccacgcgagcagtgaagcgcaggggatggaacaaggattcgttctctcattgattagcaggactgcagtgccactagttctaaattctagtagcatatgcatgtcatgtgagtatgtgactatatgtgagtagttgatggcttgattctggtgaaaagcttggcaggatcctttcttggtcactgcagcttataatttgcttagactgaaaccgaggcgaaggcacagattcctcactttagtctgtttatgtttattttcctttctgtttatccctgagagagttgtcatgtacaagtatcctcgtatcttcaatattcacggcttctttggtttagcatcctactaaaacgttgatggtgctaaaacctggacaagtttcacccttgccaacttgtttatatgataaagttgtgtttgcttttatgccaatgaaaagccaaaactgttgactaaaatctagaaagtggcaaattagacatttgcaatgccaatgagttggcttcaaactagaaccaccatatccactatttaagctaccaaaatatcagtagggcaagttttggctccaattcaaaacgaccctcagttttcactgaagaattttgcagaagaagatgaggactactgctgtgggtgtaaactagctgcaagaccattggttgtgatctcactatgctagggatgtgattgaagaagagagacaattagtaagaaattcagagctaattgtaaactactagcaagaaaagaaaaggaatgaggttgaagaagagagacatcgttttttttgttctgtctgcacctgtaactgagcaagacaaggcaggtgatggcactgaacaatatattagtactagaaattcaggacttgttcaatagatgcatgcataccaatgtagtatagattatatgaccacatgttgggtaagtcaattcaagtttgttcatcagttgatgtcaaaaaaaatcactggattaatatattttaataagcttgcctatgcgcaggaccaaactgaaaaggtcctagcagttttgcccataataaaggccagatatttttcttaacaagcagaaaccgtgtataggttgagaaatctcctcggatcatcacccagaatcaccaggatttgcaaaatttcttctttactgacatgaacaacacaataacaacatagcactaagaagtagaagtaagcagggattggatcatcgaattgctcctacaccaatcccatctttgtttggtgattttttttttgtgtcatgttaatctcttcgatccccgtttggacgccacacctatttacaatctaagtagtagagtagtgaggaacatgttacaaggatgcatggtgggtggtggttcacctcataggtccttgtcgtggcgcgcgctggcggcggtggcgccgccgtcgtcgtcgcagacgcccgcttgccgtagcaatgcaagaagacccagaggagcgc

SEQ ID NO: 50068 - DNA, 830 bp, Oryza sativa
acgcgacgcctaccgccgcgcctacgagctggctccgagagagaggagggacatcctccctcataggcgtacgacgccacgccccgcattcacgccggccgagccaggatggacagaggtcaaacctcggcgctggtggagagagaaagggcattcaatccatggccaacggcccgattcaaggcgagaagacggcgctggaaggagagccgccctctccttggaggagttcaaggctagaaccaggggacgttgcttcgtctgtctagcccgcgaccaccgggcatcggcgtgccgcgaccccccgcgctgtttcacctgttttcgcaccgggcaccgagcgcgccactgcaattcatcccatctcacctaccgcccgctgcgtctggacgcaaaagcttctcatgctttcccaagaacaccaagagcagacagatctcgctccccgcgtcccacacaccgctcgcggcgcctgcccagagctacttgcgcctcgccaagaacaagcagatcccgtttcccatccccccgccgccgacatgctttgagtgaccgccgccggaatcctcctccaccacgcaagaaatgccagggagcgcctgacaagcgcgcccccatgccgcccctccccctgctccacagttgccgagaagcagagctttgccaccgccgccgccacccactggtgttatggcgcaattgggtgacccggagacgcgccccctcgaggatgtcgtctttatcccgacgtcgcatgccatcgatgcatagctgtgcgagtgggagagcacggccactgtcacttgggcgatgccccccccccccccccc

SEQ ID NO: 50069 - DNA, 7220 bp, Oryza sativa
  unsure (1)..(7220): unsure at all n locations
ttcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaattatgtagtttatttggtactgaatcctgagtgataacacctttgcttcttttcttgtcctcaattctccttccacctctgaaatttgatctatataagctgtttacgtaacttcttatcacccttttgtcttcttgtacaattagctacgagtctaatggtatgatagcacatatgtacagccttcctttttggttcctttcagagtggcatgcatttgctttttttggtaattcgttctagtaagtatttcttgtttaaatcttatcttgtgtagtgatcacacagagttgcagttgtgcttgaaaggctttgatttgtgatgcagagaatacaaacaagatttatacttctatctgttatttcttttgcctgatatatatatatttcttgattctagttgagtgccaaagttagtaaaaatataatactaatgggaattaaaacattccttaccttgaactgtttgaagggagttaggatgcatgtcagttaggttcgtgtctgggtggtcgagggtgttttcttaaatgtcctggaaaggtaatgaggattagacatctatacagtagtacaaactaggatgatagcatgcttctattcatattttaaactattgtgcaaatataatgttggccctcatgtttccaatataaccttgccatttccactttactaaaatagctgcaaatgcattggaacaatagattgttatagtttggcagcttatgaagtgagacacttaaaagtagatgtgctgaaaagtttgttctttcatcattgcccttcacatggaaacatatggtatccgtgtcttgtctctgttggatgcataaattatgttaaatggtcaaatcacaacaacttaaagcaaacaagctattgtataattagttgttgccaaatttgagctgttttcagtagacttgtctacctgtatgcaataacatagcacttatatcctttggcaaacggaggtagtcaaatctattttttgtcccccaagactcggcgacatgctttcatgttttaagttatatatacaacaattagcatcttgaatctgttacttcgactatctaactagtctagatgagctgcttgagccaaagggttgttaattttggagcaactttactgctcagctggtagttgagtgtgtgtagtattgaatttgagtaacttggatcactgattctgaaatacagtgcagcagcagctgaaaatcattcattcaggaaaatatgtttctgagacaccttaatctctgactcgtgatttcatctttgagcatttgatctgtccttttttttttaatgttccttctccatagaaacaggactacttcttgatccttgtaatgatgatttctctgtgattgtgaaccaaaagagagatgagatacagtttttatgcataaatataatggccattaagaataacagcttgctgctggtcatatatctgcagatatactgtatgattcttggtcacctgcaatgactgtcagttcggtctgcatcagcattttgtcaatgttgtcaagttcaccagcaaaggttattatatataactaacacccttcccattttctttcgctgaccaaaaacattaaaaggtatcttgctataatgtggtgtttgcagcaacgccctcaagacaatgaccgctatgttaggaattgccgcaatgggaggtcgccgaaggagaccagatggtggttccatgatgacaaagtgtaagaggaactagttggcacttttgccattcagtaatcgtaataccttgaaatctcttgcaaggggaaaagagatgaatgtaggcttactgttaagcatcactctattggaccaccaagcttaactgctgggttggtttgtacatgagctgcctgcacacatgtcaagtcatgaatataatattaccataaatgattatacagaataagcaagtgtaccatgctgattctctgatacgatcgagcacaaaaagaatagcgtattgaactatgagtctgatgatttgctaacatgagcttgctgcatgtctgcatatgaattttttgctatgattgtctttctatgatgcggctgtgaacgaatggaagcagcgcagcaacaagaagcaatagcagcatttattcgtgtgaaatcaaggcgatttatttgattctttatatggcttactgataaaagaactccaaaaggaatagttttacccttgtaaagatattattaccctttatttaattcttaagtcaccaagaacacccttgtactacctccttccctaaatgtttgacaccgttgacttttttaaacatgttttgatcattcgtcttattcaaaaacttttgtaatatgtgtaaaactatatgtatacataaaaatatatttaacaataaatcaaatgatagaaaaagaattaacaattacttaaatttttttaaataagacgaacggtcaaacatttttaaaaagtcaacggcgtcaaatattttgggatggaggtagtaactctttccggtttgcttgatgatacaagtattgattggtgggatgggctgaaaaggcttgaaaacggaattgggccgttccttccaataaaagggctgacacgagtggagtcgggtcgttggcccgttaagttccttccgatccgctcgctctcatccgcctcttccgccgcagcgcgcgccattgcctctcctcctcgccattgccggatctgttgctgctcctaggttatctagacatcttcctctagagggacaactcttgttagggctccatcgcggacgatggcggatggtgaccgtcaggaggccgaggcgcccgtggccgggatcaagagggtgaaggaggaggaggcgaccgcgtccccaagtggtggcgagaagaagaagatcctcccgaattggaggaagtcatcgatcccgtgtgaggggagtgagatcctgaagaagaagaaggaggcgattgcggcgaggcctctctgggtgtcgagggatgtcccgggggcgatggagtgctggattgaggagcgcgagaaggccttggcggaggaggaggccgacatcgcgtccgggaagaagaagaggaagaaggtggtcaagtacaagatgcctaatgaagttatccaacagatgatgagatacccctacacctacccggagtgcaccgaggaggagctggcccgacgttctgcctcaaatcgccagctccaccgcctcagaatgttcatcgatnnnnnnnnnnnnnnnnnnnnnnngaccctcatcgaccagtacctcaaacatggctatgcgttcgacgaggcggagatctccgacgaggaggaggaggaggaggaggagcagaagtagcaacctgtctgtgttgtggtgcaagatccatctaccctaagtaatatcgcttgcttgcttactggagtagtatcttcgtgtccctgtgtctgtctgtgtgatccaccacctatccttccttcctaagtgaagtgtctgctcgccaatgactctggtcttggtgtgtgttatcatctcatatcttatttgctactgcatgctttgctacttgagctatatattttcctgatattacaccttgctatactaattgaaccagctatcgtattggaatgaatgagtcaatggatgtgttttatgctagtgaagtacagttttacaattgctgctgattggaacaattctagtattcttagttgagattcccccatctcgatggtcagataacacaaacgatttactctagtcataatctgttttgtttctgtatgtacggttgaatctggctactctttcacttctcggtccatgttaatcaatttggctttaccatcctaagctgttacatgattctgttttcctcgtcaaataagtaagttgttccatcaccaatgcaagagtgcacacatttctaaggattgatctcatattgccaatgaattgaaattttattgtcttgtgtggccatcagaatgtttgattccatcactgcatatttggagggaatcaattatgggcaattcctctgtatgaaatttgccgatcctgtccattacaggtttttgcattcgtgtccatcactgcagaaagtcagcattagttgcattatgtctgttcaggaccaccattgaatgttttgctcatctattagtaagagttgccaagttgtagttatggtgacatctcttcttttcagtcttcctctgttcatcggttacatttcatatctcctatgtggatcgatctaaacatttctgtgtagccagttaattacctgagagaaggatctaattacatttggcctcatgccactagataattattttgcttatggttattagttttgcgtgcaacaaaattacaaggagattaggctgtctagcatatctgagctgatgactacaggctatttactcaccatctatgaggtgtcagcctaccagtatttggtcgaggaggtcaaaatggacgccaccgcctgacactgctcagggtaatcatgcccgattagttcacttggcccttgaaaacacaggtcttggatgcttgcttggctcgacgagcttttatttgttcaactgtgtgcgcgcgcttgttgctaggttatacacccctggagctgcctgcctgcatcagatacctccttgatcatggcgcttatctgcatcaagttcgctcaaatggaaatgtcactcatcttcacaccgctgcagtgaaaggtatgaacagcgtgcttagcctctggtatacccttaggattatctttttccaattacagttactacttgtctgccaacccatcctgctagacgcatgactgtaagaaacatctagtctagcggcctttgccattgccttgatttattcttctgtgatggatccacatatgaaatcatgctggagatcattatatggaaactagggagaactgtaaataataaaaagtgtgttattctaatagctattcgagcctaatttagaatactataatatggtgattaacttgcgatccctaaatcaaaatgctcattggtgcttctattttcctttttaaccataaattacaataggctctggtctaatctaatatgctctcatattgtcacgccccgaactagtcccgaccggaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggggattatttatatagagcaagggtgagtacgggagtactcggcaagccatgggaagtaagtgtttaatgcaggcttcaaggaaaggctggtgtttttgcaattaattttatttgaactcttttctgaagcaactaagtgagtgcttctcaaacgacacggatgagacagtgcgtctcgtccggtcggagtatgtgcaatgtatcagtctttagaatttaaacaaggttggcacccgatcaacagctttttcaacggccacccgggccaacaacttttcaaacggccacccgggccaacaacttttcaaacggccctagctgatcccatcagctacagatttttcaaacaccgaaccccttttcacacagcaatttcacaagcagtagtcaaaccaaactatgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaagaaatcggtccttaagtgcgagagcgggaaaccgtacacccggtacgttccccgatccgtggttttggaaattcatttagttcgcaagcaccgacccaggtgtcgggttttccaagtcttttgtaaaactccagttttacccaagttgttactcagatttttaagtttgaaggcgaccgtcgatactcgcacagagtgcacgaatatcgaggcgcaactgggtggttacaaggggacatagtatagcaattaacaatggaaggatcaaatgcaacaagtcaggtaggtccgccaatctgccttgcagacgggataaaagattaagtgcgatcctatcaatgcataatattttgcaagcaatataattaaatttcaaatataggctcaagatgttcgggtggcttgccttgctcgagatctggagcttgatcctcgaaatcctcgcgctacgggtcttcgggctccgaaactacacgcgaaacgggacaactcaacaaacggcgaaaataaagccctattaatgacctctaagcgtgccattagatagatctcgagatttgaggaattttggaagttg

SEQ ID NO: 50070 - DNA, 4905 bp, Oryza sativa
gatacgggcaaaagctagcacaccgggcggttgttcgtgatgaggggagacgagccaacggctcggattcgccagagggagttcgacggcggcgaatcgcggcggcgacaaccggtggggagggaagagggaaacgccgacgaggtcacgagggaccgattcccggcggtgagagcatctacgcggtgtcgggaactcgatgctagcgtcggattggacggagctacgccgagcgaggctggcgacgtgtgggtgctacggagctcgagcggcgacggcggcgagcacacggcgagcgacggcaacggtcggggcggcgccggctaactacggggagtctacttgagctactaccgagcctctctccgacgaggagctcgccaattgttccgcgtcatatcgccagctctacggcatcgcaaagttcattgatcgcaagatgaacgattatgagcagctcctcatcgaccagtacgtcaaacagggctacgccgaggaggagaccgaggccaccgacgacgacgacgacgacgagtagccttgcaattaattgttgctcgttattggaacagtactagtagtattcttgcgcaaatgattgattacttaatttttccataatctgctttgttttatgttcggtttctgtcgattctcaattcccggtctgtgttcgtctccacagaaatccagcatctgctgcatattatgtctgtttttgctcatctattagtacgtaagagttgtcaagttgcagttatggtgatatatctcttctttttacatcaaaatcttcctcttttcattggttaccacctctcatgtctcctatgtcgatctaaacatttctctgttggctttcaacatgaatttgttttcctttgcacggcacccaaagccacgggcttcgttattttctccactcactacttgttcgtttagcaatttgttgttgattcgtggtaacaaggagagtttgtgaattgttgcatgcgctggactaaattatggacagtgctcaattcagtattcagcgctaacaaggaaccaacctgatggaccgaccttcctcttattttcttggataattcaactgtgacgatgacctctctgtagattcttttaattttcatcattggataattcaaccgtggtgatagattttcatcggagaattaaactgtggtggtgatcttcagctgtaaatttcaaagtcaaacaggcagaattttcagacacatttgttggaatggagtatatattggttgagctgagcataggcatcaatggggggagaggtggtgcgtcactggaacgctgacgtgaacggtatctccctccacatcgacgagcaaggcccctccgacggaccgccggtgctcctcatccatggcttcccggagctctggctgtcatggcgccaccagatggccggcctagtcttccgcagtttccactccctcgctcctgacctacgctgctactgagactacaccgtccccgacgaccccaccgactacaccgtctttcacatcatcagagacctgatcaacctcctcgatcacctcgccctgcccaaggtgatggtggtgggacacgactagagagctcatgtggagtggcatctttgtctgttgctgacagacatgctgctacggcatctcaactctagaatactctatttcccctcggggcctaactacatctcggaggcattcgcagggcgcgatggcctctacatcatgcagttccaggtttgcaatctcttaaatttaactacatacatgaatgaaagattgtattgcaaaattgaggatgtgaaatggacagcatatggaatggaaaggaagaaatgtttacggtgctttaatttgatgaaggaaatgcatcacctcgatctagtctgaataagatggacattttgctagtaactacagcaactgctttaagataggcacacaacacaaattctttgtaatgaaatggagtgtgctccaatcctgtggtaagttaaggatgctttgatttgatttttcatagacacttgcttagacttgttgaaactcaaaaattttgtgaatgacatttttttaagtctgaatgtgtgaaacctgcagatgttttgctgatgatctccttcagtgggctaactgcagctttaatagtttcaccccacaggatcttgttgatatgaaaaatagaatgctagcacaatgtaaaacttagttattccttctattcaatattgtgaaggtttcaaattttgagcaataaatgttcaggctggcatgaaagccctccatagttcctttttttgtaaaaaaaaaaaaaagtttgaaactgtctcttctactcaatacacaaatggcatgtcatcttttatttcatacacataagaggatcggagattttgacaatttagaggacaattggaatttgcaaaagattcacatttttcacttccatggtgccatcagaatgcaccttaattagctttgtattattagcagcagatcatcagcaccgtacgcgttcaaaatggatcaacataattaaaaaccgccttttgcaggaaccagggagagctgaaagagcatttgcccgttatgatgttgcaactgtcctgaaaaagttcttctccattgaaatcgatgacctcaccgcaccccctggagtggagatcatagactttcttgaggcacgttcgacaccgcttccatggatctccgaggaagaacttggccagtacgcggaaaagtttcagaagtctgggttcacaggacccatcaactactaccgcatgatggacacgtaaaatttggacccattttgttgtatgtgcgcattctatttgatttatctccacagtaatatatggcaaatgcaggaattggaggcttactgcaccctggcaaacgcgaaaattatggtgcctacaaagttcatttgtggtgacaaggacactggtctcaagtcctttggaactgagcactttgtcaagagcggtgctttcaagtccgtcgttccaaatcttgaggttgtcatcattgaaggtcaccatttcatccagcaagagcaggccgagagagtgaattccgagatattgtcctacttcgataagttcactggtgagaaggcatgaacactctgttcacccgaaccatgcaccagaagataaattatatgatatactgtaggatgctttgagatttctaggagctctctctctgtgtttttttcatgaactagaatggtggagctcagaataccctgccgtgtagttgaatgaatgttagagctagccatttgctgccttggataaataatgtataggttgttgttaagtcctataatatattttacaattcatatgcttcaagttttgttctccaagttaatcctccgatccatggcagaagaagcgaggaacctgacgattgtaaaaatgtatgatccattgggtcaaagcttgcaacgtagtaatgcagatagtcagtaaccagtggaatactgaaacagttcgtccatgctcttgcttttatgggtttgctggattcatgaaatcagagggtgactagagtgtgcaagatatctcctatacaattatctgaagttgtctggtgtgcagttcatgcatggctccaatcttctgtacgatgaatacatgtaacttcatttctttttgagaagatgaacacttgtaactttgaagtttgccatgtgattatgattatctacagatcacacaacattcttcttcttcttcttctttgtctgggtttatatcctgttataagggtcagggaccgtccaggtgacgttgtgcggttcagatcgagggagaagaaacctaaacttgtcacgtagatcgagtagtcagtttcctttttacctttccccggtacgttggggcggcggagcgccggcgatcggcgtcggaggtggtggtaggcgatggccggcgccggcgagtgctcctccgtgagaaccttcttcctctcgaggtaacatcagaggtgagttgcgagtgccgttatcgatggtgtctctgtctgtttgtggttgattgatgatgcgttcgatctacgtttcattgtgcagataatggcatctctgaaatcgcaggaacacgtcgtttccatgtctgaaggaaaaagtaatgttcacaattttctgctctctgtcaccgagtacagaaaaaggttcttcgatcggctaatcttttgctagcacagtcccacgaggtgatctatctgacagcgttggtcatcactgttccttcacttttaggttgtccagagaggctaagattttgcaatcacctggactcattatcttgatgaggtctgttcagttcgttgcatctcaaactgttgagttcgtgcaggatctggcacagcagtacagtgcagagctaagccctgttttgtttggagatggagattgtttccttgtatatgtccaaagatatttcatcaactcttgtgcggaatgatgatttcataaaattcatgggtagattgaatcctctattcaaaagaccagcaggcttcatggatgagcaatcggcaaactctgaaatgcagaagtagaatttcaatagcatctgcgattactatcatgtaagtcacttatcctaacttactcatagtctgatacttcctgcttttcatctctctattgggtgtgtaaacattttaccacagttaaagaatcaaagtgaaaacaaacataaacatcagcaaactaaactaaagctcttctaaagaaaggtaaatttcagaggagaaagaaagaagaaaatgtgatcattgtgggttaacatagtgggccagatgagatgggctctgcaaagcttgaacaccatgatcaaaccatgaccattctttccttcgtctgcctttt

SEQ ID NO: 50071 - DNA, 11979 bp, Oryza sativa
agttcttgaacgaatatataactcgatcaatagaagtattgtagcacatgtggttttcagatattggaaagtttcattgaatttagccaattacattaaggcgatacaaattatgtctgtataagatatgtaatgatgcatgtaacacgtttttttttgttttgagaggggaattgtgaggtggttattgttccagcgttccaacctctaactacctgagcacactgatgccatttggtcatgcatgctgaaattaaaatgctaccggtacaggtgagaggtcactatccttcagttcacgctgctactagcgtctgctaactatattcttgtgtatccacagaggctgacgccaactaataagcagctgcctatcctgaaaataaaactaacttgtttcagttagctggttatatatccagaaactattcatctacacaagtaaggtactaaaaagatggaaatttttttgtgctaatgaactttccctctctgtgatacaccatacacctgcaaactcatgacagtaatcaaaaggctataactttatattactactagaggttgtaaggactctgtctactgttggttgttgcatgcattagagtcagtaaggactctgcctagctagcaggcctcttttgcaaaaacatgttttttacatgctaattgagcaccagaaatgctgtcggcaaagaccagtaggtttttttttttcagccaaactcagtctgtcattcacatgcttttggcaacatcaaaagttcaaaacaaaaaccctgctgtattgcatatactagatactaaaaaaatattagaaaaagaaccttgcacctatcttagacaaatggactctatacagcaccacatcctagccaagatagcatattagcatccaaacaattgagaggagaacagcatgataatgatatgagcatgcttaacagataacactacttgcaaagtacaagagggcacatatttatatgttgccgatcggctgttgtacagttccatggtagtatgtatgttgtaatgttgcatgatatcagcatgctagtttgagtgttttggaagatggaccagttcagtactcttacagcctccaattagatgccacagaaatttatcaactactcttattagttctcatctgctaattattatttgatctgatggttgtacttatacatgtgctcatttacaattgagctattccctctgttttaaatttacttgttcttctacctttctcccaagctaaacatctgtatcattgatcataaatttatagaaattcatatagtttaatatcataaggtttatgtctttagattcaccatgagaaatactttcgtaatatataattcctatgttgccaaaccacataaatatttaaaaacttgataaaagataaaaatgtttgacttacgacaaaactaaaatggcaatcactgtgaaatggagagagcactgtacagcccatatagaacaacgccctgtccaattgcatgcacccctctatgtctcagtctttctccctacaggagtactgtagctagctagagtaccaagagtgcactgttgatgcactgaactcggtccatccatggcgcctggtgttgttgcagatacatatgcctgcctatctacatggccggtagtagccctgtagctgggtgcatgctcagactaatctgaactgaacccattgatgatgttgtgtcaatgggccctgcagtgaaccagtcagcatctctgtatcagcaaaagcttttttttcctgcattgcttccagtatcagaccatcagtaccaggttttggaggcacatgttataatggtgctcagttttgcaattgatagctgcaactcctatcttgctgccttcttaacagaatgttgcgatgaacagggcaaagctgcaacatatttgaaggcacctgcaccgtctgatcatatctgaacctctgatggacctgcaaaagctctgcactcaccacacaccataaataatgtcccaggttttttctgaaccctgattttctttttttttaatttttgatgcaatgagaaattggggcatgcataagttaactgcacaataatcaggttgctgttataaataaagatgaacaatatggtttcagcctttcataaaaactagaccttgatcagctgaaacagtagcgtttaaatgcgtagtggatcaacaagctgagtttcggtgcactaatcttgctgcttttttagggaaagctacatgtattgttaaatgtcattgtcaatgtcttacgcttgcaggagctactaattcagagcttaaaaccgaacacacatatcaaaatcaacttcctttcagtggtgtgctctgtgctagatgccaaatgtgcaacaataacagacaacagaaatgctccaaaaccaaaaggctatgcatagctctatagggcacagatagaggagcagcctaatgagcaaatttgttgacaagtaaatgttgacagggcagaacaacagtgtcatcctctccttcttggtgtatcatatgcatgcatgtgtgtgttcactgtagtgtagtacttttgccactggaaaagccaaagatctccagtagtagggttcttcctagcactgaacaaagaggaaagctttgacccactggaaatgtgcaaataggagtagcatcctagctatatcttctcctccttgtccttgacatggagtatagtaaagtgtagacagtagttgtacttaatactccttctagattactagtacacatgtactatatatgcatgctgggtactcattactatgtgatttatgtatcaagtacacagttgaaatgcatgccctagtgactcatttgacttggagaacacatacaccatggaggtgtttagatgtttctttcaatgaatggagaggagtcacattgacatatatgctcatagaacagctattcaaaccttatttgtgattgtgaaactcttctattataaactatatgtggaactgcaatacaatagtggcatgaagtgaacatatatatatgtccataaatattaaagcgatgtgtttgctccaaaaggtaggaaagggagatagagaaagatgtctcgatcggtcagaaaacttggtcatatgtatggctagctaagctcattctttctcttggttgcacgcatgactgataaatatatatttatatatatgcatatatctgaacagggacagctgcatgccctagttcatcatctcatcatcatctggatgaagatgatgtttcagttgtgtgagtttacgtgcatctatcaccgtcgatgcaacgaaatgttgtcaatataggcctaggagttgccgaagctcgtcatgttggtctctttccagagacaactttccaactgagtttcttcttcttttttttctctgaaaatctgaaaacaatcgacagagacgccgatcgaattttgttaggtcggtttcgtttatgattcacacgtacacgcactatgatatgtacttactagctgtgtttaaatatctgaaaattaactaacttatgggagcccatgatcctctgtaagtcatcagattaattgaaggacatgtgtcccagctagctggcttcatgcatgccaattctctgcttctctttaatttgcagaaacattttgagggggtcaagatagtaggttgtgataaaatttctaattacataattatattggccttttggcagcgctaaacggtgcagtgttttatcaaatgtttaattagcatgctacctgcagatcatttataggctaactggaagttgggtgcaattaatgatgccttgtataagaatttggaccctaatcaaactaccatctgaattcagtttaaacattgaaggaaatatgcttcaaaaaactgttttttaagacaatggaagctttattgatgaactgttcatcaataggtagataaactgtggaaggatggtggaatatatagaaatacgttgagatgggcaggcatcatcttcatggtgaaaagctcaagagcaaattgcaaattgatgtctaagctttcttcttttaatcgattacacacggtgtgatttggacacgggctttgtggtgttaatttgacagggtctaagatcccaaatagctctctgcatattcaaagatggctataccttcgcatagagctgccaagctgaattaaattaacaacctgaatagcaatttcttctgaaatttctctcacaacaaactaataattaagcttaagcaaatggaaaattggatcttgcttgtgtggcacaaacactcaagtatttgtttagtcaacatttgacaagacttgtttgtccaggccctatctaaaataatggcacaatcagtgtattgtttagacgtttctaatcctctaggctcagcaattatattttaatctgaatatataactatttggtggtctggatgatgacatggtagagacaacaataatctatactagtacattgattgtgatctagttggttaagtcaatttaagttaatcatacgtcgactttttggattttatcgcaagatttttaatgcccattgtctataccgtggactactcatcgctggagtcatttacaaactgacacggcatcaaacaaacgatccacgcacacacatatatgttaattattcttttcacgcactttgtgtaatctgtgaaaatgagagaataattaacctttattatcttcccagttgatactgatagcaatggcttatctccatcagtacttaattccttttctgcttataattttattccttgattaattttctcatagcttgaacaagtcattacattatagcatcacacatgtaaataaagttaaactaaagtgtaggctaaatcagcttggataagataacataagctacagaattgaaaccactacatatatccataggcgtgtgtgtgtgattttgttctgcagagatctgatctgtctctgagaaatggaacaagactagcactagtaatctactagtatatgaacacaaaattgacagactaagatcaacaagtccaataagcggcggccacgtggcgcattaggggcacctaattcaaagagaagcctctgtaattgagagcaatcaggcctataatggcgacaaatgcatctgaaaagagatggaaagaaaacagcacactaattagtttaggaaggaaggctgagtaagcaagcagaaactaacagctcccaacactaaattcaaggaccatgacagcgactgaatgctaccctgctacgtactcctaatttgtgtggctaatattgattaatcacccccacgtcactcctacatcagcaacaacatcttaattagctagttaaacagcatttgcatatattgcatatatagtggcagctgccctctgaattgcactttcagatcatctggtagctagagttagcctaattgcaagattatgcttgtaacaatcaattggaatatatagccattagtatatataggagttaattactattcctcaattgggaactagttcctatcgccatgtcctatgtatgactaattacttctggttatagtaattaatttactgtgttgtcagggagttggatgtcagcttcatggattatatgttcttggcttagcatatacgaaaggaaaccataaacggccaccaaaggaaggagatcttaccaaggcggccaaacaacttactgatcaaacgaactaatcatgccaattattttatcttaagctcactcattttaatatgatatcaacaatggatgctttctagaactggctacaacttgcaagaaaacctctcttatattaagtcctggataacaagacgaccaatatgattatctatcttgtataacaaggtaccacaagatttgtcatccagattgtatactactcaatcatttacttatttgttgttttcttgtttatttattgtgtcctgatgtactgcaaataaccataaacatatgtaatcatataatatcttatggaaaatatataattccctacaaaagtttctacctgacccgtccttaattaagtatactgtgtatgccattaattgttttccacagttaatatgtatatgctaccctggtgatcacaacagttaaaaggtgaaacacagattagtgggtggttacaagaaagtaaaaaggacaagtttatttcttttaaatatggtaggcagtagaagtagctagtagtagtagaagtaggataaaaaggaagatcaaagcaggtagggatggatttataatttaaagtctaagacaaggttggttttgatttaggtccacccactggttgttaggagatggagggcatccatccatcatcttcatatccctaaccacaacacccactcccaacctcaatgtgtgcacagcaagcccatttctctgcacccctgctgcatatatttcatgcctttgatttgaagagaggttactaaccatcgttagcaagcatacttaattaattagtgttgttatccctttcctaattcactggatgatgcatgtgggttatgtctaaattacggatcacgtgttctaagatcatagtataatataagtggtgggtacagtgatattgtggtcacagtagaaaaaaaaagaaaggaacgactgcaactgaactttcttattacctttgaggtgaacaggtataaagatcatctctttttgtttacaaatgtgcatctagtatgatatagaggttgggacaataatttcagtcttttattatataaaaagattagctcttttaatttgtatgataacattactagttgttcactgaaaaatatgaacttacacataattccactcatgtagccatgttaactagaacattttgcatgatttatatatgttttttttagaccaatgatttatatatgttgggaagaaaatttttcaaacccctttaatttggccatgcaaatttagcctaaatatagtatacatccacattgtctgtacctgccaaaagacaaatctgttgctggggtgttgtcattggtcaggtgagttgtagcttgaattgaattcatcaatccaattgcaagaattgaattcaatttggtgtagaaagagaggaggaggaggagggagttgggggcggtggacccgtgccatggcgtaagctcgtggaccacgcgaaccacccaatggccaatggccaatgcatagagagagagagaggaattggggatggggcccaccactaattgtttgttttttaagttcattgggggcgttgatgtcacacgtgataaatctctttgcctccatctctttgtcctctaatgatttcatgattctgcatatctcgcccattagctgtcaccactccgaaatgcatgcactaagcagcaccattacattgctattgtacagtgtctgaattatactggtagcttattagcctcaatcaccctcctgtttcttatatatatagtagtagtacccttttaatttcgccaagaaaaaaaataatcttctttttaattattttgctacctatagccatctctgaagacaaggtaacatgatctagtataaagagcagtgcaggacagtacatgctaatataattccatttttctgaagaaaaaaactgaattttatatgcagatataataaattaattaaatatagcaggaggagcatggaggcataggctttatcgtaaagaaacaactgggatcgacaagtagccgaaacttgtggtggttacaccagcaaataactccaagcagcagcatcagcagcagcagcaacagttgagaggaggaggaggaggaggttagctagctcgtcagtataatccttctcgacagcaactaataaaggaacaagcaaaactatttctttaggaggcaaacattattccatatttggtgctgctgttagtgggtggtctgagctttttttatttaggcaacaaggagcaagctagcacaactgctgcttgctagagagaggagagaagaaggaggagaagaagaggagagagaggagctctgagctctgtgctctctcttgctgctgctgctggctgctgctcacttttccttttgggattgttacttattttaatcctgggatctgattttgtccccatattgggaggatcgattatctttctcccctcctctcctctcctctcatcccctctcccctatctatctgtcttgaagaagatcagctggctgctttggtgtcaatcgctgctgcagttcctgttgcctttgccctgcgccccatcaggagcacaccctcaggtctctcctccattttcttattgccttctcttgtaccatctgctcctcctcctcctccttattgcagcatcatcagcaacggattgcatgcatgacctctgttcttggttcttggcttcagttcgatgatggtggaatttcactgaattatggtgtgtttcttgctcttgtggttggtgcttaacgctggctctcttgggtttctgagctcttcttgccttgttgggttagagagctagggtactgctcttcccttccatctgaatttttcagcttcttttgatgtttggggatttttttttgcttgctgctggtttttctcgatgaaccgaaagctcaggtgcaaagattgtttcttttgactgaccttgaggttccatgccctcaacctcaacaaagttcttgcctttctttggtgtatagattcttgtggagaaattcttgtgttcaaaactcatatgcttagttttctccgaattatgagttcttgttttcttctcggattgtaaagcaacccacttttttgtggctttgcccataatttgagcttatgtacgaacaggctttgcgattgccgactaaattgtcctagctttctttcttttttttccctttcttcctcgacgttacatggaagcagtcttcaaaaaatgttttcatggaagctgggctctcaaaagccaaatttcctgttacttttacctttttgcagtagttcttctgttgagttactgcactccagacactttatgctaaggaaatcttgcttgtttttcatcaaaatcttgtgcttctttgttctgtatgtaggttatacatgtgccttggagttttctctttggctctactctctaaaaatctagctatgaaaaagaatttgtttagactgacaaacaggctgctaagtaagttcatctcttgcagattttgattggtagctgtgttcgtagcaataacagcctggcagagaatctttgagaagttgcagtctattagttcaacaaggtactcatcatgataaatgatcattactcactcaagagtcatatgttcaaaccttatctatccaatgcaattctccttttcatgatactactgtggtttccccatgttgcttttatgaaaagaaaagaaaacactgggcagtcatttgattttggtttatggtgttgtccggttgtttatcttggtatataacaagaggaattcacaagtagatattcttataacatcttgttagcaaaggaggaccacaaagtccaaaacttttttgatccaatcttaaaaatggaggaccacttgtggctttagcctgcaaatcggcatgtcacattgtcagttcatatattatcgcacttctcgagcaaagttttgcaggtgactgcatttctatcagatagaatcctgccaaaacttagcctgagccccaattctgattactcacttatgactggcattctttgtgtgcttctgctgtatctatattaacagtttgctcaattaaactttcttgtctttgtttgtgcaaagtgttttgaagttttccattgaactgctttacaagcacttgcctgcagttatttttgttggcattggtgtgctgttattttacaatctcagaggagagaactccttattcaatatttgaacttccttgggggtgtcttatcagtccatttcatgtactcaattgcagggaagttgaacgggatcaagtttagtctggataacaaaatattgatgtcctgctggaatcatcaatcaagtcaacgtcaaagctggttcttcatatacatatatgcttttgcagtaatctcgagcaataagtagttataattgcgagatggctacttactattcaagccctggtagcgaaagagactcgcagaccatgtactcaagagacccaggcagtgcatcctatcctatgtcatcagctctagggaacttgctctatctgaacaatccatcttctggaccttatacggagttcagcggcattctgcagcctcagcagaattgcatggagatgcctggccctgggcatgcgtcagcaatgtcacaagacccctcttcaagggagtccgacatgctttcttcgcaccagggtcaacgctctttcagccatgtcaaagatatgaaaaatgagatgttgatgcatatgatggatggagcacaaggtagtggctctgagctcatccatgatgatgcccacactggttcacagcttgagtttggtgttctgaataatcacaactcatcaagtgttccatcaatgcaaagccaagggctatctctgagcttgaacacacaaatcatggcgccttccttaccgtactggtctataaagccagacatgttaacgccgcagtcttaccatgacaaccttagaggggaagacatgcggatgaagaatttgcagtccgaagcttcacgcgcaatccggaactcaaggtatctcaaggcagcacaagaactgcttgatgaggtcgtgagtgtttggaagagcataaaacaaaaggctcagaaagagaaggttgaatcaggaaaagcagatggcaaagagactgatggagggccaaaaagtgagggtgtatcttctaatccacaagaatctggcgctaatgcagcacctgagctttccactgctgagaagcaagagcttcagaacaaaatggcaaaactgatggcaatgttggatgaggtgagtactctaggagtctattgttttgtacttctctttctttttaaacagaagtgcaaccccaatttctttgagttgagattacagtatcaatagttttataggactgatccttggtatatgtatacaagagtagatatacagtttacttatagcacagtaatcttagttaattgattggcaaatcattttaactcaaaaaaatatatatttcaggtggaccggaaatacaagcattattaccaccaaatgcaaaccgtggtttcatcgtttgatgtggtagctggaccaggatctgcgaagccttacacagcagttgctcttcagacaatctcacggcactttcggtgcctgaaggatgctatcaatgatcagatcaatgttatcaggaaaaagcttggcgaggaagagaactcatctggcaaggagggaaaattaacccgcctccggtacattgatcagcagctaaggcaacaacgtgctttccaacagtacggtatgattccacaaaacgcctggagaccacagaggggactgcctgaaaactctgttacaattcttcgcgcttggctgtttgaacacttcctccatccgtaagtttcatcctttatgctgttctttccagcattccctcttttcttttctcttatcatcctccacaacaattttgcaggtacccaaaagattccgagaagttaatgcttgctaggcagactggcctgactaggagtcaggtaaatattgtttatcttttttgtgcactggaccattgatccacatttgatgttttaacttcttatcctagaagcattttgtgtttcttcaagagttcaacatgttgactgcttcatgcttctcctgttctccagatttcgaattggttcataaatgcccgtgtccgcctttggaaaccaatgat

SEQ ID NO: 50072 - DNA, 1329 bp, Oryza sativa
ctgcagcccggatttgcgaaacaagccaattgagcgagtcgagaaccagcattggagcaatgaatgttggcggagcgcctgttggcttccagaatgagcccaatcctgatgacagtttcatgaacctgatgctgaaggaccagcgatcgaacgaagtggatggcggcctccttctccacaacactgtcggcagcactcagacgagaacgcccggttcatggcctatcacttggcagagcttgggagatacggcaatggcaatgtgtcgctgacactgggcttgcagcactccagcagcaacctcgttcctaatgctcagccaggtttccctggtgttaatgaggatgacatctacaatgctactgctcctcttggtgtcaccgtcgcatcttcggactatgattcgatgaatcagatggatcaacggcaacggtttgagcattcacctcttctgcatgattttgtggcctgaagacagcagagaaacaatcaggaccatggacattaagagagagaattggggggcagcatttgtaacacctagtgggagaataacatgcctgaaagggcatgggatttgtagctttgtagttgccatttaatacagaagaggaggtatagcaggaaatgtaatataaggttagatggtgggggtgatagggtaaagaatcatatgtaaagataaaatccatcattactatatatatatacgtgtaaaagcttgtgatttgagcaccatattgtaaagtaatggttacttagggctgtccaattatacactctcacactactattagagcttttctgtcattcttttacacgtgtaagtggagctgaaaacttgctgtgtccagcaagttatgcagatttgcgttaagttctgttgtttttgttgtggagcactacagctcagctgggtgaaaataaacttgagttcatgttcatgtcagttgccttgtttctcaggcccctcatgttgaggatggcaacacctgcttccttctagttagggtttagcagccatgcaaatgctgttatcacaattatattatgcataacatttcagagaattcatatcattccagcttgcttagacagttgatcatcctctgcccatactagcaacagatagaatgtgataatgctagtttagtctaacagccactccaggaagatgtcacgacgaaacacgacataaaagaccagacatttgtttctgttttgacagcctaagtatatgtacacaaaaagcagcaaatcactgagcgtttgcgtcgttccatctttcataacacaaaagagcttccagttctgcgtgtgcttcttcta

SEQ ID NO: 50073 - DNA, 16682 bp, Oryza sativa
ctaaagctcgaccaagtgccctatgagccctctcatactcctaaggaacacaagtgcaaagccaaatcaaacaggagtagaagatatacaaggaacaagtgaattgtcaaaacgcatatcttgtctagttcaccttcagaaacattagagctgctccttgccatagtaggactttgcccactttggccgtagcttttcgcatgcattggcatcatccaaagccctttctccatcacccatgcggagccagcaaagactcctgtttgagaacaacgtgccatcaaacggatcaaccttcagtgcctgcaaagaaccaaacagtgccagatttattgctgttattgctataccagttctcagcactgatcgacttggaccaacaccctaaccaggtaaaattgaagttctcggtaaaagggcaattcccaccaactcctcccaattaaactaaagggattaatggaagacagatatcagtggactgctttgtgtgtagagcatgcgtgtgtgtggtggtggtggtgggtgctgctactgctagcttcaggctacaaaagtttccagtccacactgttcagcttatgctctaatatgcaaggagatgtgtgatagtataatgagataaccaaccaaattttgtgcactggaaaagtaaatgaacaacaagatcaacttcatggagaaaaagaaacaaggtgaaccatgtaaggcctgtttgggcaatcgataggtgggttttaattcaatactagtttcttattgtgtagtgtaaacacctccaatcttcagttaaatcccaaatatcataaaagaatcttccaatagagttttttttccctgtgtcttctggagtcagaaacacagtagcaataacatattgtgtccgccagatgaagatacacaagtaacggcatatacaatgaggaatatggtccaatgatgtaccatgggaatggttccgaagaatgtacctgagtgtagaacactgatgcatttagataatcctgcttcttaaatgcagcatccccttgttgtttcatgtcagaccttctctttttgataaaattatcgtcctgagtaaataatatctaaaattagacatatattcaaagatctgatgctagcagtgaagaaacatattacaacaagaagttaaggtgaagtgaaagggctaaaaaaacagatccaatcaatgcattgtttcagattcctggtactcacttgcaagttgcacagagaaatgtgcaatgcttcaggaatcttgcttttaaagtaatagtgttaatccataaaacatattggtttacactgagtggctgccgacattgcacagaagaccaggattgttgcaagatgcacaagaaaattggtacatacctctagttgcttgatttctgactgtacatgattaattattccatcaacactccaatttgccacagttggaatagcagagctgaaaggaaagagaatctcaacatcttcccgtgtgccatactcagcagccagctctattggcattctcccgagctgtccaacaaatgaagaatgaaatagaaatattgaaaatttgaaataaaacaagtagcaaaaagctcttcttgatgttcaggatatatgctcttcatagtgataatatagattaatgaaagagtagcctagttccattttaatgaaatggtacctctcctggacaatcatgtaaacagcaaacttattaatccatttcctttagaacagaccaaggtggtgctagtatgagacaaatatctaggcatacctaaccaaattaataaaaacatggcaaaaggaaataaaaaggaaacagtaaaaaacttatgcatgaacatactgtggcatttgttcataaattagtatcaaaccgtttactactgaagcagatatcaccggtgtgacaaaggagaaggcttaccctgtcaggaacatttgggtttgcaccagcttccaacatgcatttaatagcttcagttaagcctttctcagcagctcttaccaaatgattatttggcccctcaactttcacttcagctccagcctattaaattcaagtgtacagcataaacaaacatatggtttctccttataattgatgcttttatacagaggtaaactacacccaccactttagagaaacctacggccatataaagcagggagagctatacctgaaccaacagcttcacacaggacacagaagagctggttaatgccaagtctaaaggtgcaccaagtgccttgtttgtaaccttgttgggctggaaaaaacaaagaatatcaattgtcatgcaaagtaatgacagtccaaaagaaagaagaattctgaaggaaaaaatgtgctgaagcttattctgtaaagtgtattttatatgcttgtcctattgctttatcagagtttctgttgtgtgggccccttctcccacgcctgggttagctcacacattaactgtgagatgctgtgtacaagtgggaagaaaataacgaaggccacggcttaggggcaaaggagaacagattcatgctgaaagccaacagagaaatgaaagcaatcgtacatcagcattgtgctccaaaaggaccttgacagtgctatcatatcctctgaaagcagcaagagccagtggtgtccccatttctgattctgcatcaacattaactcctctagaaagcagaaattttgctacttcagagaaccctgaataaataggtggaaaaccaaaggtcataaaaatatatgggcaaactgttatagaggaatcaagcttcagcatctaaatataaacagcaattttccaattggcataatgaaacaccagtggttatcatactaagcaaaggatcatttgggggcaaactaattttaatggctatagtgaagcaatgcgtgaaaaaacacatgcaaaagatgatcccacaagtgatagtgtaaatacaattgcttccaaaaacttatagcaatttaatgacacaggaaattttatgaaacttaggccagaggattttatttaacctggaaagcatcttaaaattttcaaaagactacatgacattgatggatatgagaagcacatcagagtagaccatccttgtgcaatttatggttacaaaagaaaataaaagcaccagtaaacatttgcatctagcgatcacaagctaatcgcaatattagtattcccaattaggcttgaatagctatcagactaaaacatttttctattattatttacagttctccctgatttcaacataaggatctccggcttaatgttcaatactacaaattggatccatcgcaaaagaataaatcaagggaatggcagagtttcttacagtgaaaacatggatgttctagcaggatgggctggcagacaactaactaagacaggaaaaaggataatcctaagggcatatcagaggccaagctatgttgataccttttactgcagctgagtgaagaagagagacatttcccgtagagcgaatttgatgcacatcagcgccatgatcaaggaggtatctggtggcaggcaggcgaccatggtagacggcatgctccaggggtgtgaatcctaacaacaagcacacacagttgaagatggaagaacaaatcgtcgagccaagcaaagcatatccaagaacatgttttcaagatgcaagcgaactggagtagattattaccctgagcagtgtcggccttgttgacgtccattttgacctcctctaccagataccggtaggccggcaccttgccgagccaacccagtgcgtgaagggcgttcatgccgaggaagcttgtgttagccacagtcgcctcgatccctttgccgtcctcgtccagctcctttgcaatcccttcacaaaccaagaagaaaagggagacattttaggaacataacgaaactttcgagctgtatatacacgaagttgcaatctttgggtggttttgtacccagattttagtccaaaattagagaagagcacccccccacccccaccccccaagaatccgtggcacaaacagatcaacatcataccagaagaatccagcgcaagcacccacacatgaaaaccccgcagccatgttcagcaagaaattcgtaccaaatgcgatgcagaagcagaacccaaaggggggaaagaaaatgggttcttggatgtggcttactcttcatttcgcggacgtccccgtagtgggcggcgacgaggaacgcggccccgcgcggccaggcgtctcgatctgcacggatggagcaatggaaaagatgagattattaagaacaaactgaaacaaacgatcgatcgctagggtttagggagggaggatgagggaatggatggatggatcacctctgccgaggaggagctcgaaggcctgaggcagcgccatgtccaggtcgtccatcaccctcaccggagctaccggaggaagcttcgaatgcgatcgattgggagaaggaggaggaggagaagaaggaaggaaacgaaaccgaggaggagaagagagagaggagatggggaataaaaagggcgggaaagagagcagaggggcgcaggcgagggacccaatgggtgctcgacacgtgcccctccgctctgacactccttcagtctcgcctcggcttttcgtttcatcagtagctttcgagttacgctacctaccatacggatacggagttatgaattttgaattcgaattttgctacctcacctcattactaaagaaatacatttagtaaaaatgccgttgtattgtaatttcatactactccggtcaaacaagtcaaaaccctgttcaaatctcaatgtatcagaaattcaggattcagaaagtctcatcaaatagattctactattacagatagtgaacacaaactcagccaccatttcccacagctacttggcattaaacagttttttgagtcttcggaaaaaacttcttggaaaaagaaatgcagtatacaactaacacactcgtattcattatttaaccaaaggtacaatggacagttaaaacacattctgaaagctagtagagataagttgacagaaagacaccacaaaacacagatatgatatcagtgcgatagtctttagtacaagccatagaggaatacatttgtgctccaaacaattgcatagcctgctcattctgagcatcatcatatcaaaaacacaatataagtatcattgctctagttcattcagacagagcttccatgttattcatgaaccacagtacacatatgctccacacgaccacatctatttcgtatatacaagaattctatcaacactttgcgcaaaagaaccacttgattcagactgggtcgtgtgtggaggcaaggtaatgcacaacatcagaaagcaactcgggaaatcattcctcttattacaagcacagcaatatgatggcacaatcctagaatgtgatgaggcttgcaatcacaagaaaaccaaccaggatgagaagcgccttcaggtacacatccgcctgctgttgttgcccaggcggtccatggcggggagcagcagcagcatgggcatgtccgccgtggaacgcgtgcccatgaccgtgaccgtggccgtgtccatatccgtagggaaaaccagcaggctgcccataggcggttgcatctgggaacccatggacttggaagctgagcagggggaacaaacccccaaatgccgccgagaaggtgtaattcccccaccgtgcattggctagtgggatgcctccacccatgaaccaagggttggggttggcattggggaagtgggtgttaggattggcctgcggagccgtggcaggcctctgtccagctgggcgattaggaatgtcagccccagggacgttctttgaccttgggtcaacacggtccttaccacggccatagagggggacaagcctatcctcctcgacaacagccttgcagaccgggcactcaggtgaatgcgagtggatgtgcagccacttgtagaggcatggccagcagaagaggtggccacagagcgtgacaataggctcctgcggaagctcaaagcatatgttgcactcgaagcttcccccagaatcggcaccgccgctgctgctgccacttgtggattccccaacattggctgccatagtgggatgagatgagctgcaatggaggaaattggtacgctcgtcagcaacacagagttggcatgatggaacgtacaattgtagttccaactcttttggagtgcaaaattattataatctagggcaggggcaccacttttgtgtgctaaaacagggaaagaaaatggaaaagaattagagcaaaaataaaaaaaaaaaccgtagttcagcaacttgaggatttaacatgtctgctttgcaaagaaactgaagtattcgtcatttgttctcttgagttagtattatgtagctgtgactgaacttcctagcgtttatctggaatatcatttctatgatatggacatgaaagttggttgtgacaattttctatatttaaggtgtggatatgcaggaagaggttcggcgtgtcgaaatattaaaaccgctgactatgatggatgatttggaagttgagaagcggtttacattttggccgttgtgtgtggtatggaatgcaggtattgggattcagaccaagtctaatctagtctagctgagaagattgaagcatgtctctagtacgacaagaagaagagaaaatgatgtaaactggctgctggttcctgataaatgcaaacatgaaccggggcttagttctagacatcgtttcctatagagatcgatctgaatatgaagcggcagaagcaagcaactcgaatcgatgaacagtaacccccgcacgcatgggcagaaacaaactaggttaaagggatcggtgatgggcagcagcagcagcacagcagttgaagtgcagcagccaaccagggcagcagtaagagtggaagaagagaaatccatggagggggagatccgctgcgggcgatccgatctagctgctctaatctaatctaatctggaaagtaggaagaatcttaatcgcgcagagggtacgtacgtgaggccgagcaaatcaagctcgcgaggaggtagagaggatagaggcggatgactcaccggcgggcggcggaggaggagtcgcgtcgacggaggaggattcgccgcctgcgtgcgccgcagaggaagacgaagaggaagaggaaggcggagaaggttcgaggcgggcgaggggatcgggtcccgcatgggtgggtgggtccccctctaatctttttctttttttctcactaattttatataactcttttaattttaccgtaactactatagtactcctaatagtaaaaaaattaattatgcggccacctgcttttgtttgcaaaagtattgggccgacaatctatcttgtgaaggcccaacagatgttgtgtgtgttctcaatgggcttccattaggcccatcgtaccgtattcttcttctggacttagtatttctttctctcttttttttcattttggaaaggattcatatgctgtgtgtgtatcattggtcgatctatatacgcggattgcgttcattctactgtagtagaaagtttttctgtgtcaactaatcgatcgtggtttccttccttaaaaccacaaaacaaaaaaaaaatcaactcgtcctcatccaattccaaattaatccttgcttcaaatgttttagagagccgggggtcaattcaaagttcctcatgccatgcgtcttagtttgctgccatacgtacctacgtagcctgcttctagaatctatggtttttcctttctttctttctagagcttattaagaatccatgtccagaaaccaagataaatgaaattaacatatataaatacatcgttcggacccattccctattcaaaaccagtaattaaatcaaaacgtgcgtgcgtttgggtccatattagtaatttttcccagttttataaaagattaatctaattgatcggagtgtatcatgcatcagacgctgaagaacgcaacgacgaacacgtgcgtgtcgatatcaagttgagatcgatgtcgcctcatcatactatagccagccaaccgtctatagctactacctaatactcctccttaattaactctgtgctcacatattctttttactcttatgtatactctagtacagcctctgtttttaaatattttacgctgttaactttttaaaatatgtttgaccattcgtattatttaaaaaaattatataattattaattatttttctatcatttgattcattggtagatatactttcatgtatatatatagttttacatattttataatttttttaataagacgaacagtaaaatttatgttaaaagtcaacggtatcaaatatttcgaaacagagatagtaattaacaagaagctaagtaattaactatcagaatgagacatcggaaggctcatgaaggcgtgatagaaagctggcggggccaggtgtgtgttccacgtgtggacatgcaacccgacctgcagccacacacattaacagtgcagcttaacttcatcgtcaatataactggtcgatcctgcactcactgtacgtgccatatttatatatacggaatcactcttgattgaaaaattaaggtaaaatcttacagatttataacattatatctgtttcacgatttgctctagtaagtttctctttcaactctaacaaccacgttaatctttagcgaatggcagcaacaaccctgactcaaagaacaagaggtgccggattaagatggcaagagggtgagcagaggggggaaaggggagagtttaccgactttagagggatgaccgtggatggcggagaactagtggtgggcgatggactccgatgggtggcaccgccaatgtcgcgcgaggtggaggagggcagtacggtgggctagcatcagcggcgggaacaaaacgtgacggatccgggggcgtgcggtgggagggagaaggggacggggaggaaaataataagatcattgttatgcacaaatctcgaaagcatatctaatagtccaaaattcaaatgatatggaacgggattttcaatcacaggatatatagacaatcccatatatatatatatgtagcttaattaattggcatcctaattaattattaaggtagctggctaagcctgaagaaatcttcattactagtcagccggccagcgcttggtcgccgtcgtcgtcgtcgtcgtcacgccggcccaacctgacctccgcttttctccctctccgatcggtccatgtctgggctaccgcatgttgtctgccgtcccctgcttgcttgcttttttcgtaatctgaaatctgaaagttgcagttgctagtatatacagtaggtagctccgatcctatccgtctccatcgacggcgcaactgacattgcacaattcagagatgctgtgtgtgtgccactcattgtgtagagtagctcactcactgtgtacatggtttttcttactaatttcttcatgcagaaaacgatggcttgactagtctactactgcaggttcatttttcttcagaaaaaaaaaggtggtgtgcatgctttgaaggcgacattcttcttaatttctttctacagcaccgtcactgtgttcgtttctgaggtgattttggttgttaattttgtttgcgaacaaaggtagagaaaaagtacgtggattgctgccttatgcttcttgtcaagatgaactccacacttatgtgctccactgattgattgttttttctccccattgctttatgattaccaataaaaactgagcttctcaggagtcttctgtactctttttctttgggctaattaattatttagtcagtatggattcctttaattctcaaaagcgaaaggttggtagggaagcacaatcctctcatttctgaaaagaacaatccactgcttgtttttggaaagaataatacggagtataatataaccttctttcatatcatggatgctgcccaggcatcaagaatctcctcttctctttttgcggtattatgcttctgccgcaacagatcacaaaactcttttcagactccaagcaccttaaatcagtgacaacatgacttctcctcttaggtctatttttaggccccatttgatttgccaaaatataagggatttggcaatacaaataaatcgactatcccttataatatgagatggaagtaataggagttttatagaatttcaattccataagattttatttttcatatgcagttttttttaaataaaggataggacagtattgaatcatatgaaaatgtctcaatatatgtacaagttttagaggaattttaatatgagttccagccctatatttacaatcctatcaaaataatgtgttttttttatattcctccattttgttaatagtgcctttgaaaggagcccttagctccaaaggaaatatctagcctgatgtaaatagaataaatttgatggaaaaaggggtaaagcttagatataatagattgcaaccccaaagcaaaatccatgaaatatacaatatttgatacatgaaagagatatatggaggtgaaacaagtgaaaaacaagcagctaacgacgaattgacaattgaaacctggaaaaaaaaagcaaccgcctctctggacgatgaggaaaaagaaaattccttgattgagttgattctagtattccacttaactctatccacgttctagaacgacgacgttggatgatcatgaaacaacgtaaccacctcatgtcatgcatctagaaaatcgttgccctctgatcttctggtagtaataatttcttgtaatgcaaatcgtgactgactgactgactgaatgaattcaggcagttggcacacaggttttgtgctctcaaactctgatgagaaacaccaaaaggcaaaaggagaagagacaaataagaaatgatcatcaagccagcacttgttgaaagccagatgtcttgtgtccttttcctctcaggctctaggtcggttgatgatgatgcatgctatattccaagctcatgctttgacatatatctgctagtttgttggaccagattaattgcataatctgctacttaattaagccatggcctacatatccttctgatgagtacatcagctgttttgtaagcacatacagatcgcaagagggtgtccatgaaaagacagaggaaatgatgcaatggattaaattaagtgtgtgcttgttaaatcgaggacacgagataatcaaatgaaagaaacggtgccgactgacgacctcatcgaagaccatcctcgtgtggaaacgttaaacaatatactcctaggctagctaggaccattcttcagttgcaatcctaactgctctaccctttttctcaacatctttttaatttgcaagttttttttttgaagaaaggcaaaagctttgtcttgtgtatattaatagagcaggagaaaaataaacaagggtatatacagggttagccgaggaaaaagactagcccgcaaaaaagaaaaagagctaagtgatatttcccaggattccaaactcctgtagggttgttgcccctgctttgacccatgctcttccttcctccttgatctttgctaggattgaggacggtgatgacgcagagtttcgaaaaattcttgcattgcgttcgcaccagatttcccacgatactaggataatcatagtctttagaggcttgcggggggtatttggggactccgctacgagagtccaccactgcctaacagagtgacaagtttcccagctacccatctgaaggtcagtgcctgtccatctctggatttatgtccatattctctttgttagcctacatttggccaggaggtgtagggccgattcatccaccatgcagcagagtgggcagatcttttggttttgccatcctcttttctccagtctgtctgccgtccaaaccctgttttgagtgaccaatcaggagaagaatttgcactttggcggcgcccaggccttccagattgattggttgaagatggatcgcgcagccccaaggaattggagtctataggccgattttgtagagtactgctcgtttgctgtgaggttccatcgaatgttgtcttgattttcgtttagcggcctcatgtttctaatcactatccagaggcggacatactgttggaggtggcttgcctcggtgatacgagatatttcgatgtctcggatccagttgttttctgatatggcatcgttcactgttctgttctttcttctagaagccaaaaaaaatatccggggcgatctgtttcggagtttgatcatccagccatttcgagctccaaaatcgtgcagttttgccattgcccaccgttattgttattgcggccgtgaagagatctctatctaacttgttgcacggtagcgccgtccccacctagggtttttctggtgccacccattcattccaaagccatctgagtcgcagtgctgatgcgaattgttgtagatccatgactccaagaccacccaggtctttgggcctgcagactcttttccaatttactttgcattttccgccagagatgttttcgccccccgcccaaagaaacttcctcctcattttgtcaagttcttctatggttccatctggcagctttagagatgttaggtggtagatgggctgtgcagtgaggaccgaatttgtcaagcagattctggtggcggtcaacattaatttcccttgccaaggggcgaggcacgatcgacacttatccatcaaaggctgaatgtggactttctttagcctacctaccacaaggggtaggccaaggtacttcattggaaagtttgttaggcctgctgggaagatgccggtaatgctggacagatcaatattgtcacatcggattggggcaatttggcttttgctcatgttcgttcagaagccggtcacctgcccaaagtcgcttaggatgccagtcagatttgtcatgtcttgaacgcttggattcacaaagattgccgcgtcatccgcgtagagggaggttctgaacctgggggctctccccctaagtggggatagatgccctaactccattgctctctctaggaggtggtggagtgggtcaatggcgaggatgaatagaagcggcgagagggggtcttcctgtctgcggcctcttccatgctttataggcgttcctaggcacccattgagcaggatccttgttgttgaagatgcaagaatgttggagacccaattggtccacctagatgtgaagccttttctctggaggagatcgataaggtaatcccatctcaccgagtcaaaagctttggttatgtccagctttaggaggagagtcggcgttcttgtttggtggaatttcctcgtcaagtttctcacatacataaagttgtcgtgtatgcatcttctcttgatgaaggcactctgggcatgactgatcagggagcccatatgcggttgtaaacgtagggcgagcacttttgaaataagcttcctgattccatgaatgagactaattggcttgtagtcccccacgcattctgccccatctttttttggtataagcactacatttgccgaattgagaatcgagaggctattgcttcgcaaatggttgaaggagtgaatgaccaccatgatgtcatcttttatcgtttcccagcaggctttgtagaaagctcctgtgaagccatccgggcccggggctttgtcgctgggagactgctttagcgcgcgtgaacctcctcttcggtaatggggccattaattgcggaacagtcggcggcggcaatcgtaggacatcccagtcaaggtcttttaagcgtgggcttgggcgtgccatgaagttttggaagtgttctttgatagcggtagctttttcctcatggtttaatttccacatgttccccactcgtagcctttggatgaaaattttccttttcctcgcattcatcctcaagtggaaaaatttcgtgtttgcatccccctctttaagataggtgattcgtgcagcttgttttttacgggctctttccacaactgcaatccccagtactctatctttgaggccccttcttagtgtgagttcggcttggctcatttgtcttgactcttgggctatatcgagttgtagaataacctcgagcgccatgtggaattgtagcttcccctgagagatgagcttcttgctccacgatcttaggctgtttgacgtatgtcccagcttgtgaaagagtctatggtgtgcttcatggtgggattgtggggctgatcaggcttctgctacgacctcttggaagcctgggagctgaatccagaaattctcgaaacggaatgttctcgttcgtggagtctctccttgccccgttagcatcaaagggcaatggtcagagagtgaggtagagagggcatgcagtaggtgtctctcaaaggttgtgttccagcttgcattgcaaaagaaacgatccagcttgaccagggtcgggttatcttgttcgttgctccaggtgtagcgtctattctgaagtgcgatctccttgagttcgcaagcgttgagggtatctttgaaaattcgcatctgcctgcggttgaggttgatgttgtttttgtctaaagccttgtagattatattaaaatctccgagcacttgccattttgaattgtcggctggcttggtgtcgcgtagttgtctcaggaaggcttgctttgcactatctctggttggcccgtagacaaccgtgagaaggaaggatgtttggcaagcttttaagaagactgtggccgagagtgagaaggttcgttgcgcgaaatctttgagtcgacaaaatcatcattccaaaggatcaggatgccacctcttgttcctagcggtcttgttgccggcttgaactggaaggagcgtatgcgtcccccaccgagggagcttgccattctagcatctatattgctcattttagtttcttggagacagacgatgtggggtttagcatcttggagggtctcttttaccgtcgctcttctggctggtctattcaaaccgcagacgttccaagagaggatgtcgatgaccggatatgtcatgagaaacaatctttctcaaggggggagttgtgcacagtgcataaaactaggttgagattgtagggagacatctttacaggcctctgctttggctgtatacagcccattgagttgttttgtggcgttttcacccgggttatcagccttggcgtcgctgggtggcccaagaagtggcggtccagatgggggcagcaagcagtttgttgttgggccttgctggtgcactgggtcggcccaagcaggatggtcacatggagatgggccagagcaacttgtcgttgggccaacaattcgacggtggatgatgttgcggtgtcgtgcgtcgccggtcgccgcgcccgccacggcgcccatcgcgttgccttttagatgttgcgttgtcgaccaaaactggcctgggagggcttgggttcatgtcgccgtctggcggtgtgcacaccatgacgaagagggtgaggaacgtcggcgccgcgtcggcggcgtacatggtgatcgtcgccgagccccacggcgagtcggtggctgtgcggccgagctggctggagatcatggcggtcggggaggcgttggagttcgccgtcacgttctgagccaaggaagggtcgttcctgcccagggagtgcgtgttcgggttcgggcggctggtcttgtttgcgtcgctcttgtctctcgcgttcgatgccggtggggcaagccggccagcgagcttcgctatcatcgtcgtcgtggcggccttgtgctaacactgacatcgttatggtgcggaattgcggcaccgagaggggagaggtcggttcgcgaaattgctgcgaatagatagtccggccttggaaggtaatgtcgctgctcatgatcatgccaatggcgcgcgtccaggtctcacgctgatgcgaacgaggaaagtaaaatggatacgtggagatggtctactccagtcgccggggcgcgggacagagctctatcacgccgcggctatctcctcctggcagccgatgtcggagggacccaggtacattgccagggctgagtccgctgccttcatgtcttccttgtcgaggccgaacagctgcgcgagggcatcaatggcgtcttgcggcagaggcatgttaaacatcgccttgaagtcggcgatcgccttctcagtgagggccccctctggcggtgccagtcccatgcgttggcagaggttgatctgcgcccacagtgacatcggcagtccagccagcggctactgcgccagcctagggctcctcctccgcccttctcccaacgtagcagcagccacggtcggcatctgaaggtcgccggcgcggtcagcgagcgagttcggcatctgcagctcgccggcgtggtcgatcagcacctgcggcgtggagaggattgcaggcgtggagaggattgcaggggggagctctttgaacagggcacatggtggggtcggcgttacctgggcggattcgaagattacttcatcatctccatccatcgtcgtgggagtgagcggcgtcggcgttgcctgatgcagcggttccgg

SEQ ID NO: 50074 - DNA, 823 bp, Oryza sativa
tttgggccgcgaacgccgccccttccgtgcgcgacatcacgtcccccgttgtcgcgatcatcattgtcgtcgtcgcgccgtcctccacgtcggaggtcatctgggtggtcgctgttatacctcctgttgcgcccgcgacggtcatcgcggtcatcccggcgcctgtcgcggtgccccttctcttgccttcttccgccgtctcggccaatggcgtccctcaccgttctgctaccttggtcgcgaacctccctctggaaggcggcggtgttgttctccacgccctccgcgcgaccttggcggaaggtgaaggtccgcggcggatgcgggtggtaggggaagttctcgaagaggcgcggcggggctcgctcgccgtcaagaacccctaggtgccacggcggcagggtgcgcgtcgccggcctgcaggacttcgggttgcggaggtcgacagccgccgcggtgtagtcgtggatctcctcaatatggaagagaaccgggtgcttgacctcttgttgccaatgctccggcagcgtctccgagatcgtgatcgactcgaggagtggatcacgggtttggcgcgtgattgtcacccacacgcgcttgtggatgcggctcgggtttggagtccatgcccagagcgagatcaccctcgtgtcgccggcgtcaacagggtggacgaggtcgtttccaccgattcttaggtgcatgttcggctgcgccattggatgaagtagacctcaatacctcggcccttggcgaagccctgctttaccacctcctcgcaatgccggcggtgcttgaacttgaggaggaaggcctccggata

SEQ ID NO: 50075 - DNA, 766 bp, Oryza sativa
tcaattcatcaaagcgttcataaaactcccaaactgtaccattctgttttatgctatccatttgcctaatcaaattctcatgttgatccctatcaaattttgcagaaacagcagcacaaaaatcttcccacattggaaatctcaaatgagctctagaagatctcaaccaagatgctgctcgtcctaggaagtaaatggttgctatcctcacccataaccccgggaaagtattgttaacatcaaaatagtgctcacacttcatcctccactcctgagagtctgaaccatcaaattttgggaagtctaacttaggcacccgatgattgtactgtctatcaccatgctcagaatcaaattccccagactcccaacctcccccatcaaatttagaagtaaaattcggggtgaaatcaatcgtacccttgcccggggctggaccctgagtcgaactgaccaccggtgtccttccccggaaattcatctgaacgtggtggcctgcagcccatttgcttcctccttcggctgcggcgagttgggtggaagtcggcggcgtcggaagccgcgccgccttcgcctccgatggagtcggcagcagcggcgccttcctttcctcacccgtcgatgggactcaaggggaagacgcagccggtgcagattgctgagatttgccgacgaggtcgagttactgacgaagttcgctgacttcctcgcgcaacccctgaattgctgattccacttgaggtctccatccactcactcccgcatc

SEQ ID NO: 50076 - DNA, 942 bp, Oryza sativa
gagaggggcgtcgggatctgcgggcgacggaggagcatgggcgccaccggctggggcgccgacggcggcggaggtggagtgctcgctagcatttcaaaaaaaacccttctatctttcttttcattttaatttgtaagtgaatcatcctgcccctttttctcaattgcaagtaccaaattaatttctttttctctttgaagtatatgtactttcagagttgtaagcaatccgaattacatgaagaccttgttcttttcttattatgtattctggatttttgtttacacgctttgcaagtttttctaaacggtatgtttgtgtaaaaaaaaaattctaaaaattttattagaatactatttaaaacaactttgttaacataagaattcagattatattactcaattttagttatcagattaaaaggagtactaaaagaaattaagattattcattaattttagctatcctaaatgtacaactaagagtgtttggtcctggcaacaaccaaacacgtaaggaaggaggagcaaaagagcacgcgaatcgtgcctctagaaacccaaaacagcgagcctaattttagccgctccggtcccttctcctgacgtttttttaaagaaaaggatgaaaatttagagagagtctcctgtcaaactcaccctttttttatgcaaaaggccatctagaactctaattataaatcaataaattcgtcaaagaaaatcaaaaatcagaaacgagagcttgagctgaccgacaaattcatccgaatccaataaataaactcgaggctatatatatacacacacggacgaatccctttccatccacccgacacacgccgacgccgacgccgacgaccatggccgccgccacctccaccgccgcctactggctcgccgagcacccggcaatcgtgttcttcaggtggagccccacggg

SEQ ID NO: 50077 - DNA, 701 bp, Oryza sativa
attcctgcagccctgatagctcggtggcactcccgaacacgcgtagacgccggccctagacccgccgccgcccggcatggcctcgccgccgttgccgcccgctcccggaggccgccgctcgtcgccagccctccttggtgctcttccgccccatccgacgccggaagcggactccttgaaccccggagatgcttccaccgcctcgaattgaatcctcgtcgcccctccgccgtttgccctttttctcaccgccggcgagggccgccgcgtttcgtcgtcgccggtctcctttccgtgaatacgagccggtggcgcactttatctcctccgtctctttaatccggtgtgctccctccctctcgaatcgtcgtgacaagctccggtgaactcggccgccgtccgccgtccatctcggcctccccttcttcctcctcccgccggcccgcgtggctgccacgtaggcgccacgtcggagccacatcggccgcgaccgggtcagcacgaccagcctgccgcctccccctccctcgaccggtgcgcgcggtccacggagagccctatggctgcgcgtgggcccgccgcctctctgtccatccggcgcaccgcccgtgcgccatcttcaataaaccctagcgccacccccgcgtgaacccattcccccgtgaaccttgccgccgacatgtgggccccacccgggagcc

SEQ ID NO: 50078 - DNA, 8245 bp, Oryza sativa
  unsure (1)..(8245): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtttctgaagggctgccaaatcatactcgaggatctatggacatgcagcttctggtaatagattcccgcattttctcgtaggtccaacatatttttttttcaatgaaatctatatctatacctaataaaaaaatacgtaaggattccgatatttcttcgtccgtcatcccacgcgccactaaaatctgttttaatccgagtcgggtcggtcggttttcattgtattgcaaaaccgcagttgatatagtatatgtatcttccatgtaatcacataacacaagtggtaatttgcttgcttggttaatgtggaaaatcttcactccggcctctcctgtaataagtctactttcgctccctcgtgtaatgtgtctataggacctccttgcctaacgggtcgggccggcgcacgttgttttggcccttattttttcgcccaaaaatcattaaatgtttacataaaaaaattaatcactttgaaccatcattttaagatataaaattgctgtaaattttacatgtgcgttttaatttatttctaactaaatagaacccacgtgaagaacaaaaaaaaaagtaagtcttcgggtaaagtttttttttcatcgtccatcacacgcggaatcaccttcgtatatttcggcaataatttgtttttttataacgagggtttgtttagattgtagtcaaaataaaccttatcaaattttggcaggattttttatgtatttattagagtttgataaaaaaactaaatggatgcacatatttggtaactttactaaaatttgataagctttatttaagctacaatctgaacaggccctgacatcagtttcctaatctgcaaaagcgatataaaatttcaagatttggaagacatgtacaaatttgaaattttgtacacatgtatcatacaagtacacatgcaatattagcaatccatatttgtttgatattcacccgttacaacgcacgggcatatttgctagtcctatatataaattggttgtgtgatctccatgaaacaaaatcatcctctttggatttttttgtttgttcgtttctgttttgtttcatctgtttgcgatctggtcaaccggtttatggctcgatgatgactactcttgctttaaccacaccgaatacgaaggcttgacgaagcgtgctttgcccccaccgctacgttgtgctcttctgtctcgtcgattcctcgtgaaatctcctcgtgtcgaagaattagactgattttttcttctttgatgagagattgagatggatggattcggcgagattggtgagcatggtagtatggacgccaatgcctctttcgatggctcttcacatgtggaaaaactttggcctttactgagagcctaacaatcatcagtttattcacaagtctttggtgattctttttccagttttgaaactgctcgaggactttaccgagctagaattcgtatataattaggatgaaaataatttgtacgacaacatagcagatgcaacagcagccgcaatatgttttccaaacgaaaactgcagaaatctgaatagaacagcaaatgagacgtttgtcggcattgtcattgcaatctgattacgacaacagcaaattagaagttgttgacttgataagcatttacgtcatccgtcttaccaaacctgacttgctacaactaaaattatccagttacacgcacagggaccggacaggaagggtatgaacaccttcgtcgtcatttttttcaacggatgctactgctagttgaacgagttaagaagtggtcttttgcagtagatagtatagcagataaatagataaatatcattatcccagtatcaatcaagtgatcaacgaatcctgcgaccatttctgacgaaatgatttctggtaggatttctgactaaatgatttttgctaggatcagcgttgctcccagtcgtcaactggtgcaatgcgctgtgcgcatcaccgcagaaatatcccggtgagatacaaaagaaatcaacgacttgctcaaagtaaaaccaaagcgaatgacaggacaaacaaattgacagcgctcaccattgtcaagtgccaacgacgcgcagctgccaacaaaccttcattaactagggggtggccactccctctgctttcctacgtactccagcgacgagttctgttcaggccgccggttgctttcatccgaggacactagggccgagcagcagagtaactggagtactggacaatctatgcgatgacacttcagtagttcacagcatccaaaatctggcaaactgccctactaattatggtcccataaacctccaataccagcgaaattgcaataacgatcatggtccaagaactagcggctaccggtcggagatgggaccttagctagttattgcccgtaaagatataaatttatttaaaacatttaaaacttagatttaaatttagaaatttatgatataatcttttgattccattctgaaccgtgcgagcaattaaaaaaatgttcgattttgacccggacccatggtgcggtgcaatacaacatcgctcttgcagtttgattgctgctctcgttggttaattaacgtgggggcatatccatccatttctaagggataaagcctcgatgcgtaaccaagaaattactaactttcataaatgcgggctatgcatatgcctatatatcgggggtgctgcatcgctactgaacgggcttcacagcgacatgagaccaactagtgatagacctaaagctaaagcgatgataaagacggatggcttcctgctgaagcaggcagatcaaagaaaatttcagacctgattcacatcaacacgcgagagagaaaggatggaaatgagcatcaggtctttatatagagataaaagttcgtcttctttaaaatctgagaaatcttgttgactagcacttccgaaaaacttgaaacagacattattgtcacgctgaaacttactgccaccaaaaacttattgtcacactgattggatacaagtcgcggtttgtatatcgtctaaaatccaaataaactgtaaaaaagtagtccattggcacgtaaacatcgttgaagaagccaatgctgcatcatgccatgaccggctgacggctaatacataacttgtggattcatgatggccaaacaaagcttggcccttcaatcaatgccatgacagatacctatgagtactatataggaggccaacaaacaagttaatcactcttcgctaagtaagtaagaattgtggttgccactcggcactcgccaccatgctcctcgtcggcgtcctcctgctgctcttcttcaacctacatctccccacggccgccattgacaccctcacgctaggccagtctctgctgtggaaccagacgctggtctccaatggcggcaacttcgagctcggcctcttctcgccgggaaagtccaacaagcactaccttggcatctggtacaagaagatctccaagaagacggttgtttgggttgccaaccgtgagcgcccgattcttgagccgtcgagctgccacctcgagctgagcgtccacggcgatctgcggctgttctcgacggcgccgtcgaacaccttgctgtggtcgtcgaacgcgtccgcgtcttcctcgccgtcgcccccgcgcaccaccgtcgccacgctccaggacgacggcaacctcgtggtgaacagcaacgcgacgcggtcgcggtcgcgatcgccgtcgtcgactacgacgacgcacgtggcgtggcagagctttgatcacccgaccgacacatggctccccggagccaggctcggctacgacaggggccgcggcgtccacagcttcctcacgtcgtggacggactccgagaacccggcgcccggcgcgttctccatggtgatcgacgcgcgcgggctggccaagttcgacctcctcgccggcggcgagcaccggtactggacgaccggcctctgggacggcgagatcttcgcgaacgtgccggagatgcggtccggctacttcaccggcgtcccctacgcgccgaacgccagcgtcaacttcttcagctaccgcgaccggctgccgggcgccgtcggcaacttcatgctggacgtgaacgggcagatgcggcggcggcagtggagcgagacggcggggaagtggatcctcttctgctcgttgccccacgacgcgtgcgacgtgtacggctcgtgcgggccctttggagtctgcagcaacgccaccaacccggagtgccggtgccccgccggcttcgagccgcggtcgtcggaggagtggaggctggagaacgccgccggaggctgcgtgaggcggcaccctctcgagtgtcacggagacgggttcctggcgctgccgtacaccgtgcggctcccgaatggctccgtggaggcgccggccggagctgggaacgacaaggcgtgcgcgcacacctgcctggtcgactgctcctgcacggcctacgttcacgacggagcgaagtgcctcgtgtggaacggcgagctcgtcaacatgaaagcctacgcggctaatgagaatggccaaggcgatcctggcctcgccggagcggtgcttcacctccgtgtcgcccactcggaggttccggcgtcgtcgacggagcactcgtggaagaaatcgatggtaatccttggaagcgtcgttgcggcggtggtgctgctcttggcgagcctcgtcaccgtggtggcggtggcggcggtgttgcggatgcggcgtaggaggggcaaggtgacggcggtgcaggggtcgctgctgctgctcgactaccatgccgtgaagaccgcgacgagggacttctcggagaagctcgggagcgggagcttcggcacggtgttcaaaggcgcgctgccggacgggacgcccgtggccgtcaagaagctcgacggtctccggcaaggcgagaagcaattcagaacggaggtggtgacgctcggcatgatccagcacgtcaacctcgtccgactccgtggcttctgctgcgagggaaacaagagggcgctcgtgtacgactacatggccaatggctcgctggactcgcacctgttcgtcatgagcggctccagctccggccccgactccaagcaggtgaccctgacttggagccaacggtacaacgtcgcggttggtgtggcacggggcttggcttacctgcacgagaagtgcagggagtgcatcatacactgcgacgtcaagccggagaacatcctcctcgatcaggagatggcggcgaggctcgcggacttcggcatggccaagctcgtcggccgcgacttcagcagcgtcctgaccaccatgcggggcacggtgggatacctcgcgccggagtggctagccggcacgccggtcaccgcaaaagccgacgtgtacagcttcgggctcctgctcttcgagctcgtctcgggccggcggaacagcaccgcgccgtcgtcgtcgtcggagggcggccctgggatttacttcccggttcatgccgtggtcaagctaaacgaaggcgacgtggccgggctggtcgacgagagggtggccaaggatgccgacccgaaggaggttgagagactctgcaaggtcgcgggctggtgcattcaagacgaggaaggcgaccggccgaccatggggctcgtcgtgcagcagctcgaaggcatcgccaacgtaatgttgccgccgatcccttctcggcttcatatcctggcgattgagaacgaatgggtcagaggtgttccagaggatgagcgctgctcaaagagcggtagtaaaccagaaacagaagcaatagaagaaatgtagaactgaaaagaatctgggagcaccctacagctgaagtgaagatgcagcgtcagatatgaaaatgtagttgtaatgtcagcatagttgatatttcccgtgtggatgtatagccagtactgtactgcaactgttctgtaaattccttaaattccggaaacaggatcagacaagtaccttctctcgttttgttcccatctaattctggtccatccttgctgacagctgcacctttattgaagaaatccattagtgctacccagaagtccttaactaattgttgaaaacaacttgttgacaaaattgcagatccactcctccacactcactataattctgttatgtacaatttttagatgggaaaattttctgataactacaaagggcataagaagcatatatctacacgggcaactagtaacaacctatacagattaagaactaaatacaaccccaaagaatgaacgaatatcactatgtaactacaagaaccaacatatcaagatgtacactttacaggtaaagatgaagatgatgatacagagtaaagagctttaagtaaagaaatgaacttcacaactgtttcttcagagaaccacttgagtttccatgtatgcactgtgtaaatttcatctggttgcttgctctgtgaatttgtaatgctaccgttactgcaaaatcttccttcatgtgcatggttgtccaaaactaatgtcaaacatctcttgtcacagtgatccacaacctgaatacatgaagagagaatattgaatgagtgatatcaactttcaatctgacagaacagctaagcttacttacaatgatatcacagcttattttggtaggacacaacttcactagctaaaggaataaagtcagatgcaatcatgattcatatacttgatcgattgatattaaattaaagatggctgttcgtgttcaacaataggcaagcagcgctttgtttggattgtggaataggaggggtaggatacggattgagttaagatacaggaataggggaaaaatggatggtcaagcaaggggctattgctctaagctctgtatgtatgctattcctttcagacatggcattacctaacatcttaaaatgcaaccaaaatctaaaatgggtacgtatgcttactgctccctgtttttctgtttttctgtttttcatttacatcacaaatatttacagccaaggaagaaacagagtactaagggtgagtgttagtgacctacttaacatcaaggtgggaaggaattatcttttggagctgttggagcaaatcatgacaaataactagcaagggaaatgtcaaaagtaaaccatggcttaccacttcttgaatatcgttgataaaacaacaagcatccagagaaaaatatggagtatccggatcatcagggagggaaccaaactgatgtatgttctcgatacacacaaataatgacccttcagtaacagcgagggatctaataacaaaggatccttctgcaaaatagaatggacactatttcagcaagttccagttgacagcagacaaataatgaattaaggtaactggaacaatcctcatagttttcatatgccaaaattggaatatgacgtcagtggtaaaaatgcagataaaaaatctgtggtaaactattatagttttcataatgacctccctccctacttagcttatacaatagtcatgcatactcctacctcctttacccacctttttccaaagaatcccactctataaggcttcaaggaaaatctcagacacacccaaacataatttagaaccatcaaacataagataacgcagggaccgatctgttcttagtccagccacagaatagtgtgctgtttcatcaaccaaataatgcttaccttcagtatcattcttccaaaacatcaacaacgagtagagaaatattcccatttccaaacttggatggatacaattctcaagcaatttaagttggaccttctcccagctgccatttaaatacagaactaagtataatcaacaacataaaccgaaagtcgcaataaaaaaaagtttccttttaagcaaaaaagaacagtgttttgctcacagggaaagtaaaaggctaaacaaaccaaacctttgcaaagatatactactagttaattgtggaaaattagacgcggttaagag

SEQ ID NO: 50079 - DNA, 1942 bp, Oryza sativa
tagcactaaagtgagagagagaaagagagagggagtggtcccaaagcactttttgacacaatttactactatggactagcaaatgccaaatgccaaattgccaacttttgctactagtgtttagatccaaaatggcaaaaaaatacttcaaaatggcaaaacttttaccattttggaggatctaaacagggcctaaacaggcccaaaggcgagcatcgcgttttctttatcgaaagaagagaaagttagaagcaaagcatgagcagtggaaagtgacaagttagctcagacttactaatcatacggtaataagggctttaattcaatcgcacaccacagataaacaatgtggggcgggtagaaagtgaaactgccatgtctgctactgattaatagcagtaccagtcctctggtatctccagtgatttgcaatcagcgagttcgtgtcgactgatatctaaagttatttgcaatcgatcagtgggtttaagttgaactaaatcgatgcaatctacagtatttgtatgcttagacaaatttagtcgaacttttaaaactttaagtgccggttttataaaaaaatttataaaatctaacaagtctgtattactatgataatatttttcaagtcaagtctacgcatgccaattttttcaaggccgtagcttgaaaacgagttttcggaggccaacatactcactcaaaagaagtaaagaactcgctcccttgccttgaagatacaggtttaggtttcacctgatgtctagttccaaagaagacctaagcaagcaaagcaaatgatcattttccagtattcctttcaaatgataatgaccggttcaaggttgttcagcggtctgccgcaattgcatctcccatcaagcgccctagatttcattgaatccgtgactatctaatgagtactagtaatgactaatgacatacgtgtcatgatcttcccaaagagaaaatgaaaagcatttacatacagcagctgtatgaataggcccaggacgtgccaccaacgtagctttaggcccggcccaattattcggacggttctatattcggcctggtaagaagtttagagatcggcaccatcatctgcatgggaaactgtttctttctgctacgggccatggtccacaagcccaaatgtcacattcaattgcctctaactttcaccctagtggggagcccatccgccattcgcagcgtcagtgacgtcacctgccgcggccggtacgcgccgtcgacggcgagctcgagctcctggagcacgcaggcgatgatggacttcatctgtatgtacgccatctccttcccgaggcacaccctcggcccgccgtggaacgacacgtaccggaacgggctctccggccggaacgtcgccgccgccgcgtcctccagccaccgctccgcccggaactccgccgcgtccttgccccacacggactccatgcgccccatggcgtacgagttgtacgccacgaaccacccggcctccaccgccgtgccgtccggcaggacgtcgtcctcctgcgcatgcagcgagtccaccggcaccggcgggtagaggcgcatcgactccgtgattgcggcgtgcacgtactgcatctctctcagctcgtccaggtcgaagccgaccctgtcgacgtcgccgtcgccacggcgtgcgcgcaccgtggcgacttcttcgcggatgcgccgctccacgtccgggcgagaggagagaagccagaagaaccaggtgagcgccgacgacgtggtctcccgccccgcgaggaggaagctgatgacgacgtcgcggagggccacctcggtgtacgactcgtcgtggctcgccatgaaccgggacaggaggtcgtgcttctcgaggccggcgcgtatctcctcccgccgcgaccggatgatgcggtcggcgaagtcgtggacgatggcg

SEQ ID NO: 50080 - DNA, 4515 bp, Oryza sativa
  unsure (1)..(4515): unsure at all n locations
tcgcataccgcgccttctcatgagatctcctactagcactccatgttcgaacaaccaaggccacactcaccaagaacacgagcagcagcagcaggatggcagccatgctgatccgatttgcgaggacgacgaatttgagattaataatctgtttcatctgtacttcgagcgaattaagcaggtaggagtaccagataactggataaggaaatggcagagtgtaatgactggtgattagtgaaactgttgcggtggtgtcgccatggccactcgtgaaactcgtgatcttgttgtgttcttgtgcacgggctgctgtagtgccaacgtcaggtttgtccggtacgtagggacagacgaacagtgttgatttgttgctggttgggttcacaatttctctgaacgaaaatgccatgtagcaacacatcgatgtcgatgacgatgacattacgactactaactgcgtactctagtcctcagtgtcacgtcgttctacggtggcattccgcgtccatccaaagatttctgctcttgccatgttctcgagtcaacactagactaacccctagagattaatctttaaaatttcagtccgaattggggacttatctgaaaaattttctgaccactatgagttattaatggttttggtccaaattaatggggttttcagcgaacaaacctcaagtgagttctcctatctaggctcgagttcactagctttcgcgtaaacttgcactttatctcggtcttttagagctcgaatggagcctaggatgatgtacttgggaaccttgagctttttcaagagccaatcactagcaaaattgaactgaaggatctgtttgcaagatattcatccatcacatgcagatgcttccattcttttggtcgttaaaattcaacttctacaagttgtaaagaaaaacaaattaaactatgactagttaacgtatattcacagtcaatttttttttgcaacttgtagaagttaaatttaactttgcatgtttgtggagtgatttatcacatatcaatctatcttctgaattattttttataacaatttagatgacaaggaaacaacaagggaatgtcccctcgagagtttaaaataatttcccccttatcatgtaatgataccaccatataccatagagatagcatgcacataatatctttgtgccatcacaaagaatctctataatataactatgaaatatcatatataccttcagaatatttttgtggcatcaatcataaaatatcaatggtgaaaaaaaagttgcttctggactggcgaacaactcctgggtctctgatatccgcggtgccttcactgtcccggtcatttctcagtttcttcttatttgggatgcggtgcttcacgttcagctctcaccgggtgtcgaggattgtctcgtttggcattggacggctgaccagcgctctcagcgcgttcggtgcaccaggaattcttctatgaccagcatttctttgcctgtgccgatcttctctagcacgcaaagtgtcctgccaaatgcaggttcttcctttggttcgcatttcagtagcgctgctgaacggctgatctccttcagaagcgtggcatcgatagtcactcgacctgcctcttttgcgctaaggatcttgagacggcgaaccacatcctcctcgactgcgtgttcgctcggcaggtctggctccgggtgttgttgcctcttggctgggctgccttctctcccccctgtggcagctggttccaggactggtggccgtcctctagggcctgcttacctaagcatctccgcgagagtttcgactccctggtgctcctggtctcttggaaactgtggaaggagttgaactctagggttttcgactctgctctctcttcagtctcagtgattttggagtctatccattcggagggccatctatggtctttagctggtgtcgctacttttggtgatttgtttggagtgtagcgtggcttggtcccttcctgttgcttggagtctatttttagccgccatagtttctctaagcttcagttttttttttcatttgctttttctcccttcccctggtataagccaatctggctgattgcgttgtgtaactaaaactctttttcttctaatatattgacgtgcaatacttttgtgcgttcgtaaaaaataaaatatcaatggtacttgtatgataccaatatgaaattccaaaaatatcttcatgatactactagtactatatatagcaatggtatctttatgacacctccttggtatcatggaggtatcatgttctcttaaagtatcactatgaaatctctgcaatacaaccaagaaaaatttgtgataccgatacctccttgataccacgaagtacagggctgggcaaaattacttgaatctggaaaactaggatcaagacgaataaatttgatcatccattcagtcttagcatctaactgatcaaattttgtttggtcaattctgttaatatactcgattgaccgtttgtagcgcccgttccgtcgtggcgcctagcgggaaaatttaaactctaaaaaccataattgcgaaattgtttctttgcttgttgtcagtctccgtgcccaatcncctgatctcgaatccccgatctatcgtcaaattcaaatcccgaatccaaatccttgccaaatcaaattcctccgcaaaagtctattttgcctccctcaggttcggtgggccaatttcctctcggcccatctctctctctctatatctctctctctccctcagctctcccctcgctatgcctgtgtgccgcatgtgcatgagcggacgccgagccgagctctccctctctctctggttctcccgctctccctccttgctccatccccggcaaactccccgcgcgccgttaccttgcgtgcgcgcgcggtcgccgccgtcgtcagccgcctgctgcccgtgcctgcgccttccggccccgcgccctgccacgctgcgccgcatgcgccgcgccctgccccgcgagccagcacgcgtgccctgctgcgcctgagcccgcgcctgccgcccctgtagccgcgcccttccaaaccgcccccgccgtcatcgccgtcgtcacgacccggccccgccaccaccgcgcatacttccaagggttggaggcagagctcctcctcccactgcctcgtcgccctctccctccttccttcttttcccaaagtggcaagaggcaagtctcctttccctctttcttttcttcttccccccctctcccccccgccggcgtcatcctccctatcgccgttttggccgctagccggagaaccaactcgctggcttgaccgcccaatgtcggttcctccctcccaaaccgacaatgccgccctataaacccgagcctctccccaaaccaatcttccccgttttcgcccttgccattgccgcgccctgccctgttcgtcgtcgccgttcgtcgtcgcgcgtatcggaggagccggcacgagcgagacgcgtgacgtggactccgggcgcaccctctccttcctcttccccgcccgaggccgaagcgatcacgccccgcgccgtcggccaccgtcactgcgccccttcatcccgcacggtagtgcctcctccccgttctccctcctcgttcctcctcttccccttagctttcggtagaagctcgtatagcctccctgtagctagctggcgctgccccgaccgctgccgccgctcactatgtgccgccaccgtcgccgcccgtgctccgtagcgcccgcacgtcgccgacctctctcgtagtgtctccgtccaatccgacgctagaaccggattcccggagtcgcgtagatgctctagtcgcccgaatcgatctcccgtcgcgccgtcgccgtttcccccttccctcgccgccggttgccgccgccgcaatccgccgccgtcgagccccctccggcgaatccgagccgttggctcgtctcccctcgtcccatgcaacctcccggtgcgctcgcccttgcctgcatcgctgtagatcgccccgccgctcgccgccgccgtccgtcgtccgttccggccgacgtcgtcgtcttcctcccgccgacccgcatggcagccacgtaggcgccacgtcggcgccacctcggccaagaccgggtcaagcctaccccggtccgctgctaccctctgccccgctcgcgcgcgcggtccaccgcgagccgtgaggttgcgcgtgggcccgccgcaaccgcacccaccgcgagccgcgcgcgtgcaccgcgtcccttccccaaaccctagcgcgcgccgcgtgctccctccgcacggtgaaccgtgtcaccgacaagcgggtcccactcgggaccacacgaggtgagcccggtccaccggctccctctctcctcccctcccgcgcgtgccttgggccgtcttctcgggccggccggcccattnnnnnnnnnnnnnnnnnnnnnnnnnnnnnnnnnnnnnnnnnnnnnnnnnnnnnnnnnnnnnn

SEQ ID NO: 50081 - DNA, 6349 bp, Oryza sativa
attctgtggcaacaccattagcactgtgacatgcaccatcagtgaaagataagtcagattccaaaatgtttgagctgctcccaccttctgacgtctgtaccaagtctgagatgtcctttgagttctttgagctttctgcattttcttttgttcctcataccttccattgctactgttgaactctatgtaaaggttgtcaggttctgtattctccatgtattcatccatccactccttaaattcacgcacccaatcagatgatttctctttcttcaataattcagcatgtattgatcaactaagtaattcttatgtcattatcagcacctgcaacttcatccttcttagaactgtcactttcgtggggggtggtctgctggtccacaccttcatcacaaagacttgtctcttcctgcacaattaaggcatgtcgagaaatctttatctacagcaaatagacgggcacacagactatcgttaaagagatatcagcaaattttgcagagtacaaatgcaggatgccctacttttgcagagttgtttcaatttagtagcgtttaatagatggtgttatatcttgcatttctcgaaacaagattaccataatatgtcaatgggaaatctctgttaaaactagtgaataccccgggtgttgtagcgggaaatttaaaaatactttaaagaaaacacaaggaaaataatttgtaaattatatacttgtaatgcctgaaaaacaatattttgagctcatagtaattgatttagaattgcaattgtacatgacacatggatttatcaagcatgagaggatccaatggctattacttttctaagtgacatggttcaatgcacattgagttttatatcaataactacaataagtgggttgtaaatgtacatgacacatgattgagatcaaaacatgcaagagatccataggctactattttctaaatgatgtggcccaatgcatgtcaagcttttggttccaactatataggatatatagatatgcccccccccccaaaaaaaactgaggctataagaaaccagcttctgcatgtgaaataaacaaatcgtaagcatgagaagagatcactatgcaatatttctattggtaatgagataaaccgctctaactaacagttcttgaatattttctgtcgcatacaatagatgaattttgtggcagatgttaacttaccatctttgaatttgatgtgtcttcatcctcatggtcatcttttgcaggaaaataaaatccatagccagcaggttgcttttgcctgcttgaaaacagtacttgtttttcccagtactcctgtgtgttcatacctttatcatctaacttcaactgaggcagaaaaaggtacagaacagagctgtcatatcactctaatactgtggaagagactattatgatggagaacataaagaaaaaaacatgagaaaataatgcaatttgatgactactcacactttctgagttgtggagaaaactgaaaacacgtgctcgataccaacgagcacagcagattgggttgccttccaaccataggttctgtagcaaaaaaaggctaccaagtatttccagctccgagaaatttgagatgatgttgtaagacagatcaaggtccataagcgactttagatttttgatcccatgtagtgtagttaaagcattatttctcagtacaagttgcacaattcgaccgcaagcctgcacggaagtaacatgccatcaaacaaaaacaacagtacgggaaacaagctcgccggtttagcaatattccaaaggtattcaaaagaaaagacattttacctcactcaaggatgatatagagcgcaaatgattaaatccaagatctagatttcgtagctttgtgcatttccgcagattatccacctttgcaaactggttccgactaagatcaagggtttcaactgcaggtaacaactgcaatgactcatccatgagcaccagaccatttgaagcacatgatacatacaacagccgaccccatacgggtgagtccttgatatccatgatcctgctcgtgaagatatgcctaagagcatcctgaagtagtgcaaaactgaactgttacatggccatggacagtattgttgcattgtgtggaaatgaacaaaaaggaagcctaatcagaagaattgtttgaccaatgcaactaactgtgcaacttcttcctctattaacttttttgctgctactgagcttttgtttgtgtaccaataaaagatccaagcaatggcactgcccagtaaattgcagcctctaaagccacaaccaaatattgaggttctcaggctatatgctctaaacagtcaattatatgtctctactagtaattacacggtccatccacacacacaaacactttgtttgtttccaatcaacagtgttttagttgtttataatgggtaccctgtgataattacctagacaagatgacttattacagcattattaccttaaatgaccactgcggactccactgaaacctctaactcagataaatgacaaattgcctaagttttcctcagtaaatttgcaaaggagtatgtcaagaagcataaccctattttcagctgcatgaaagcatacacaagacaaacgtacaaagatattaaatggctacagtgccacacaacttctgcattcagagattaactaagcacgtcaggagggtaattgcagcgagcacaaaagggacagacgctacaattgcaatactgtggagtgcaccatgtgccacaaacccacaacacaagcctgaatgtgatcagaacttagtattgcaaagatgctcacaattctctagtccagagaaacagcatgtggattagattgctatcaaattcatattcaccagaggggtgcttgatgataacctaaagacctagcagcatcccgttaaatcccatgggttacaatggaaacattagtaaccatcaaatgcttgtggcgtcatgtcatatgtcatactagtatcttagaactcggaaaatgggcaaattcacccatagaaaagccagtaacatgctgagtaactatagtacaatacttgtaatatatgtgccagccaccaggatgggtcagatcctaggaacatagtattgattgtggctttgtggtctgtggggcataggtgggataacacttaaaaccagttcgttggatgtagaagaaccagactgcaaacaataagcacaattcacacttaatatagttcatagtttagtatgagatcaaaactagcgcctctgctcaccatgtgaattgccggaaacaacgaattaagtagctgcaggatcagaattactggggaacatgtcgtaatcgcaccgtggaattgtaacagatgagcttctcgagggtgtggcggaggtcgagcaggcccctggcggcggaggaggtggagaggtcgcacccacgcagctcgagcacgcgcaggcgcgcgaacggcacgagtgatagcggcgccgggtcccgccccggcccgggggccacgaccttgagcgacgtgagcaggcgcaggatccggcggagctgctcgagcgcgcggtggtcgccgaggtcggcgacgtaggcgcggaggtagtcgacgggcgcgccggcgccgaccgcctccagctcccgcagcgcctcgaggcgggaggcgacgtagtggagccccacggggtggagtcgcagggtgacggagccgtcgagcagcgccccggcgttgcggcccacgaagcggaccagcaagtcgaggtagcggtcgccggtgaccggcggcgcgccccccgcacggccagccgccatcgccgccgtcgggatcgggctagggtttggggacccgccgcatcggcgaatgggggcggagcggacgccggggagggaagaggtggtggtggtggtggtggcgacggaggaggaaacggacacggccgcgctagtatgattggggacacgcgggctcgtgggggagggaacggaaggcgacggggtgcggccgtgcagccaggccgcgcggttgccagtgggtaactggcaagtttcggctggcacctcgcggatcgctgtgctgtgatctccttcggagaagctcccggtttgtggaggccaaaacggacggaatcgcgagagtttcccgtgtaaactttgggtcggttcgagccggacggactgccggagcgacgggttgtggcactggtctgtgctcccgtgcgctgtgtgcggcagtttccggcgctaaagctttgcgttgtgagatgtgccgccctcgctggcttggcgtgtccactccaggagaaggcctcttttggtgttacctacagaagcgtttgtcctggtcttagctgccgcgtgaggcgggggatcgctttccccggaccgcgccccgtcttctcgtgatcgcgtcaggtgatgcttcatcagttcagcgttgtttcaggctcctacgcgcgcatgttggttcaccagatcagagttgttctcgtccgagaattatattactttttttcttgtactttagatcagatatgatcagaattagatccgatgagctattgtttcttcggcggctggatgaccacctgcctgagtgttattgctgtattccttctcgtagaacatggtatgtttcctcgtaatttcactaggataacatatggcatattttggcagtgtgggcagtgctattatcagcgactctatcttgcaggatcacgattcaatccttactcgctctcgcgttgcccacatgtccccttccagaatttaatgagccacatgtcgaccgcatgcgccgtttagcatgccacgctagacgctacaatgaactaataatgaagtcaaatttgtttattccctgccttgccagattcaaatcaaggtgtggctgcatccacggtatcctaggagaaactagctgtattttttggcatgttcacacgaatgttagttctacaaacgaaaagcatgaataatagtatcgggctgatcctgtgtagcagtactgcagtagcactggggaggaaacgtatcctgaaggccttgtttgccaaggctgaaaattctcaggaccttagggatatgggctttggcgaagatggccgaagagtttgagcgtcatgttgtaacgggagaaagtctacaagacgtccttcacatacaagcctagtctaatttttttctcaaccccaaaacaaggtacagcattacagcacccatattaagaattaaaaccggttcaatttacctctttcagtgttttgtttcctgggtttatcccatgtgatatgttgatcggttaaccaatgttaacgtattgtccacataagcaccaatgcgagtgtaagtaaagaaaaaaagaaaaaagaaaagcaacgggcttacatgtcatgtcattccctcactctccctcctccccacccccaaactcgaggaaggcatgccgagggtgggtgcggagctccgagaggataagctcgtgttcatcatcggtgacatgggaacaacagggcttacggatcgcacgggtggagcttgagctcgccaacaactgtgcccaaatgaagaagctcatgctcatatgtcatcagcgacggtggcaccattgaaggtggcagtgccccacgatggagtttgagctctgcgacaatatcaacttcttgagaaggtcctaaccctacggtagcttacctttctgagggagagagaaaagggggagaagagcagaggagagagaggattttatttcgtgtgcatcccatttttttttatttttgataagagacctccctacggctacacctattttttttgagaaaagtatgaattacccctctgaactatcacggtcgaccgaattacaccccttaacacgaaaaccagatattgttcaccctgaactttcaataccggacgaattacccccctcgatctaattcagagcggttttgtcctatgtggcgtacccgtggcaacccagtcagcattttctatttttaaaaaatgtaggacccacatgtcgttcccttcttcctctctcttcactctctctctcgatcacggggcggtgcaggggaggatgtgggcggcggcgcgagcggcagcggcggacgcagctggcggcaagcggcggcagagggcggcggtgcccaggggcggtgggcggcggtgcacgggggcggacaggacggaggcgcgaggcgaggcggcatcgccggaggtggaggcctgtggctcgcggtctgcccgtggcccgtggctcgtgccggcagtcgactacacgcagagccccgaggaggaggacgcggaggagaccgccgacgacgagga

SEQ ID NO: 50082 - DNA, 33055 bp, Oryza sativa
cccgccgcccgagcccgcctccgcacccatccccggcgccgacctcggctcatcgcgtgccgccagcagcccgcgcccgctaccgcctcgcctcctttgccctcgccgccgcctccgctggcggcaacggctgcaggtagaacctctccttcactggagggcagtggtaggaggccaagcttgatgggcttggcggccttggtgagcgctgcctgcgcgagggcgccgccggtgatcccagtggcgacgaggccgagcatggcgcagcggctggtctggacgttagcggcggtgtcggccgtgacaggcgtggcctctgatggaacgctgatggagaagagagagagagagagattgggagagagagagactgacaggtggggcccacctatatttttataaatgaattgttgactggactgccacgtaggatcaaaaccaccgtggattaagccagaggggttatttgtccggtttgcaaagttgggggtgaagaatgtccggttttgtgattaaggggggtattttggtcgaccgcgatagttccgcggggggagggggtaattcgtactttttcctttttttatgattaattataataccacgtaaacgtaacgttagatgaagattaggtcacgtgccacgcatgcacttgtaggatgaaatcatagtctcaaccccttgtgagaccaagacgggtcggttttaataattgatggagcttctatgtcatgttttgtggttgaaggacgataatcatactgagatgatagagagagccatctttttttttctattttgcaatttgttggactggaagtccatcttttatgcggtgcagccgtgcaggttctgccatctgccgttcagggagagagagagagccttagggtccatagagcgttaagttacaaacaaagttcgtagaagtaactaagtatatgtcagatcatggattcgacaaatcttggctatacgaactgaattaaacatggcaaagtgtccctcacaaaaaatgacagtgaaagtttatcaaacagatgcattatcaaccgaaattcgccccaaaaactgttcggtgccttactataaagaggtggtggtttgatacaagttgatgcgaaacataaaaactagataggtatcccgcgtattgctgcgggagaattacgtgataatatagagatatgagttctaaaattttctttcttacctattatacgatttattttcatgtgtttatatattttttgtacctttatcaattatcctaaggatggttgtatggtgtttcttttggagggaagagatggaatttacacccctgatgaatcatccaaaggctaaaaacaattgagatgatgtggcttcatgagagaagagagaattagcattaactacatttagtggagataaactttatagatatataggatgtgataagataacaaggtgtagcatggtaattctctcagcagccaattcacaaaacaaaaacaacagaaactctcacatcatattaaaaacaacacaaactcttcaatgcacaaatcctccgggctaaacgccgcgcaactgctaaaatggaagatcaaagcttcctaatcctatgacaacaattttctttcttgtgctagtcatattccctttgctgatacatacatggaacggaatgcaaagtagtatatagctgtgtaaagttgcaaatgaaatcccctggaatgccagtgctgcatctgcatgtatataaattaaccgggtgttcttcacgagcgcacaccgttggggaaggacgcgtccagccatccacccttcttggcgcgctcgacgtagcagcataactgcttgccggcgtccggcacgtcgagcgcgaggtcgtcgacgcagccggccacccgctcgaagcccttggtcatctggttcggcgtgatgaggccgcggccgtagcactcggcgaggaggccccacagccgctcgtccttgccacgcttctccatgatcgccaccagcgccttcttcaccacctcgtggtggaagaatggcatcccgagctccttgatgcactggcacgcctcccggatgtcgccgccgcagtcgtactcctgcagcagcctgccgatcttgtccttcacgtcgtccagctcccacccggccttgccggtggcgccgccgccccagcaacgcagtatccgctccgcagagagcttcgcgccgagcagggcacgggcgttccggagcgccaataagccggtggaggatccccctggcttgccgcggccggcctcctcctccattttctctaggttcgatggcgcgatcacctcgtcgaccactgacctggcgaagaacatggtcaggtcctcgacgatggcggggttgtccagcgcggcgtcctcggcggactcgatcaggaggtggaaccccgacacgacgtcctccggcggcattccgagcgaggacagcagcacggacgccatctccttctcgcggctcttccggtccatcgcggaggtgatcagcttcttgacgaagatggcgttgtaggaggaggaacacgcgtagttctcggcctccaggctgctcatcacctcgatgatgtcccctgtcaagaagtactcctttatgatcgacaatgtcttcgccttgaactgccgcaccgcagcgtcgtcctcgacgacggccttcttcggctcggggcccagcggcttcagcgacgacgcgcagagccatccctccgacgaggccttcaggatcatcgatttcaggaggcgcctcgcgtttggcacgtcgagcgtcagatcgtcgacggaatcgatgaggcggttgaaccctttggtgatctggctctcgttgatgatgccttcgtcggacgccgacttgaggagatccaggatgtgcccctcggcgccgccgccgcgctccatggcgagggtgagggcgcgcttgacgatgtcgtggtggaagaaagagatcttgaggcccctgatgcaccggcaagcctctccgatgtcgccggcggcgaggtactcctcgaggatgtcagcgatcttggccttggcctcctccaccgtgatgctcttgctcccgccccacctctgcaggatgatctcgccgtggtgcggcacggacaggtagcttttctccgccctgtgaagaacctcggcgcccttgcatccctccggcaggcacgtcagctgcttggccaggaacgccggcgggagtatgtcgtcgatgatggcgcgggcgacgaacacggcgaggatgtcgacggcgtcgggcgtgtcgacggacaggtcgtcgcaggactcggcgagcttgccgaaccccttgtacacctgcggccggtcgatgacgtcgccgtacagcgaggacagcagcacggccgccatctccttctccctgtcgtggcggtccatggccaccgagaccagcttcttgacgaagtagtagtggtagcacggcacgcgcagctccctcagctcgttcgccgtcgccgcgacgtcgtccgtggagaagtactcctccaagatcgtcgtggctttcctcttgaactgcatgaactcctccgacgacaccgtcgggcttcgcagcaggctcgcgtcctgatgacaaattaaccacctcgccatgatagttaaaagaaaaaaaacgcagaggcaaaatcaacgcaaatacggatctacctcggcggcggcgcattggatcgccggcttgtgcatcgcgggaggaacaagatcatcaggacgggactccatgggggacatgctgcaactcgttcaaactcaaaccatccgagttccgcaagctgcagatgccccctgctgcatgcagggggagacacctgtaacctcggttattcttgacgtggcgtccaccaaatgcatgcaggcgccacgatcctcaacttgttacatgtacagaaacgatcggtgatgagaagaacaccagaattattccgccccgagttgtcgagatcgagaggctgccgtgttcatctggtattatttgcctttggcagggacagctctagctcagggagcgattgagagagagctgtgaggagcgagggcagcagaggccatggcttttatgtgttcggttcgagcctcccgagcaagcaggaggaagaatggccacaccatgcaaatctctggaccgagtcactgggaagtgggcccgggcgttccaggtacaggatgcaggcgtggacacggtgcatgccgattaccgagatgggaatttaggcagttggatccgatgaaccgggtcgtggcccccgcgggaaacggccgagcggttgaatcggtctctgcatccgtgcatatcaaccagatttggagttgcctattagccgcatacggcggatgcgcgtgaattttcgtgatgccggtgtcatgctggattccaactcgatcatatcctaagttcgaaccgagttctaattgaaaccagtgtgccaccctatatacgaaatttttatactcacgctctgaatactagaaaactctctgcactcgttcaatcgatcaagcaattcgcttccatggctgttttcacacgatcgtaccccatggacgtcgacgacgagttagccgatgatctcgaccggatcagtgccctccccgacgacttgctgcacgtcatcctctccatcctgggcgacgcgaccatggtcacgaggacggccgtgctctcgcggcgatggcgacgcgtgtggacccatgcccagaagctctcctttgtcgacacggatccgaaaatacgagccaagccaggccagttcggtggtttcgtggactgggcactcgcccaacgcggcgatgctaacatacaatctctcagtatctccatgcccaccagcgacagcgccacgccagagcagatcaatgactggctccgctacgccatgcaacacaccatcaagacattcaaactttgttcgccttatcattcaagctatgagacggatgatgatcacccgctgccaattctcgagttgcccagcaatgcgaggacgacgtccatcgagctaagactgtcctcttttcggctccgactccctgtatatgcatatacacgatcgaacaagcgttcgccatctcaggaaccttggcctacgcatgcgcggacagtactcgtgcaatactgactacggtttatggctcctcaagaactgtcctaacatcgagcatttagacatatatcttcgacacatgttctccatgaatgggctcattgacctgatggacaagggcgcacctcgtcttcacaaagttaggagcatggtagtgaaaacatcttacttgtggccggaacatcgttttgtgacatgtgtacggccgttgctcctgatgtgtcctggcctaagatcgttttgcgtcaagattagtggtagggataaggtgagttgatttcctgaaatatatatctagtactatgttgttctctatataattagctactatatatatgcaatatcgcatcctcaaaatacaggcggcttacattaatgcttttctgttttctttatccacagataccactatttgaggacccaaatacattggcgagccaacccaacattaccatggatttcctacatgaggcaagtataattggcttcacaggaacagatcaagagatgcacctcgtgagtttcttgtttgggtgctcaacttcaatcacgtgcatgactattctgccagaatgtgatgacaacgacgatccaaaccgtagccaactactagaaattccatttactgggcacggttgttggcattttcaaagagataaatatacgtggaagcgaacgcaatatgaaggtgcacaagggaagagttgtgcatattgagatttaaccatccctgtccctccaaccgagagaactggtagacacgagggctcgtttgttttgcgatgatgcatcaaacatttgggggaaatccaaatgttgtccatgaagacctatgaactaccatatcataaagaaatagacgtctgaaatttatccacatcactatgattaaaacttttattcacaaatttaatgatgagtaaaagttttacaaagagtaaaagtttaactcatggagatatggataaatctcaaatgtttacggtagtttatatgtttgcactatatatgtggtttgcatcatgtatttgcttcatttgtatcatatgcatcaagcggccctcgtgttgtgtttctagtatagtttgttttcgacataaaaaatatgtaaatatactcttgtcttgggagttcagcggacctttgactttttttttcttagcaaacgaaatacacatagttcaattggttaggtctctattggttaggtttctagtgatgaaactcgtccactagagtctctgatatttatctgccgcattgttcgactagtataaatggccaaatgagccacccagcccggcccaatctgagatcaattaggctggcacgacctaacctacacgtcgggtcaggttgggtccgcccatgggctacaccaatgacccagacatgacccaaaacatttgggccgggccgtcctaaaggcacaaaaactcgtgaaaacccattgtgcttctccttgcaataagtctattgtttctccctcatctctttgggccgtgtcttatatgactagaataagtctatttgcatccctcttctctctgggctagaccttatatggctgaaataagtctattttgtctcccttatcaattttgactccgtgatcattggaccatgccaggctagcccactgttccaaggcagagacccggacacgatccaacttttgggccaggccagacactagtcgtgtcgtgccgtgtcgtgcctaagccaagcctagggctaggccgtcggtactcgggtcttatagctatctataccgactgcttttactacgccgtggcccgtggatgcgtgagggggtgagatgggatgcggagaccggacggctgtgtcctgttcaattccgatctgcatgcccgattggatgctctagttgggaactcatccgattccccagttgtctctctacagtataaactcgttaatcgatcgatcaaatcttgattacgtaaactgtgcaggaatttcgctctcatggcaactttcgcacgtgctgataccatggatgaccacgacgatccagccgatgatctcgaccggatcagcgccctccccgacgacttgctacacatcatcctctccaatctgaacaacgcgactacggtgacgaggacggccgtgctctcgcgacgatggcggcgcgtgtggaccaatgcccaggcgctctactttgccgatatgaatcccaaacgacgacgggccatcaagccaggccagttcggtagtttcgtggactgggcgttcgctgaacgcggcgacgctgacatacaatctctcactatccacatgtcctaccgcaagagcgccacgcaggatcagatcaacgactggctccgctacgccatgcgacgcgccgtcaaagctttcaggttttattacttttcgaacgcacgtgatggtcaggacctgcagctgctgccaatcgtcgagttgcccagccatgcgaggacggcgtccatcgttctatttctgggttcttcccgtctccggctccctgcgtccccggcggcatgttacgaagcgctgacagagctgaaccttcgctgggcgtcgttcgacgaggaagagggcgccagcgccggcggccgcaccctcggcgacttcttgtcgacatgctgccctcgcttgcgtaagctggagatgtcgagcctgaagctgttgtctcggctagttctgcgcaccgagtcactcgaagagcttcgcatttcctacgcaaacgatctacaatcgctggacgtgacggcgcccaacctgcgcgtcttcacccacacattctgctggtacggtttaactctcgatgacatcaacgcgcggtcggtgatcaaaatcgtggcaccgaggctggaggagatcgccatggacaaccaagtgttcatgaacactccggatttacatatacatggcttgaaaagcgttcgccgtctttgtgaccttaacctaacggtgcatggacaatactgcagcaaccgtggctacggtttatggctcctcaagaactgccctaatgtcaaacacgtagaccttcttcttaaatccagcgtgttcaccacggacgaggagcttgctgatctgacggacgagagcgcaccccggcttcacaaagttaggagcatggtcttgaaaacatctaagttgccgcaccaccattttacggcaagtgtacggtcgtttcttctgatgtgccctggcctaagatcactctgcatcaacattactgaaaggggacaggtgagttaattttccagaaaatatttagcaccgtactactattctctatgagatttgctaccgtccagcagagggaggcggtaccaaatcctagccgtccgttgggacagatcaaacggttgagattgctcggtaccgtgcggtaccattagctcttatagtggtaccgtttctttaagagaagtggaagggtagtatagacttttcgcatgtaagggcgagacgccggcctccagggtgcgtggtggggtgttgatggcggcaccagactgtgggttccagacccgatgtcgattgcggcggtaggtagcgaggtgcgctgcggggccagcatcgatggacggcgaggtctggggccagcgttgatggcggcggcggcgagctgcggggttcaagggttcaaggtggcgtgcagcctgcgagatccagccccagcttcgacggcggtggcgagcatcagggtgtgtcacaaggctagcatcggcgacgacgtgctgcgagatccgatcccggcgtcgatggcagggctgcgagatccgcggccgtgtgcggcatgtgtggcctgcgactctgcgagatccagtctcggcgtcgatggccatggcgggcggctgcggtggcggtaggggcgctgccggccgcgacagcgaggtggccgtggagaggtcagactaggtgccacggcagcggcgggggtgttggcggccgaggcagcgaattggtcgtggagttgtcggattaagcatcacgccagcagcggcgagtcgtcggaccaggcggcggcactggcggcaaggaagaactgcaaagacgcgcatatgagggaggaaataatggacgcaagcatgcagcggggtccaagaatgagaatttttcttttttgacgaagaactcaggaacgagattaattgactcaatattgggagagatttttactcattcccaatcctacccctaaacattggatagccagatttgtttcagtacctagtggtactggtaccttgggtaccaagtgctggacagtagcaaatctcattctctatacgtagtactagctgtgcacaaaattctctctcttaaactgcctacgtgtttttacgtttttcctacttttctttatgaacagatatcactatttaaggaccgagatacattggcgaatcatccgaagttaacgttggaattgcttcaggaggtaactataactggcttcacaaggacggatgaagagatagacctcgtgagtttgctgtttgggagctcaagttcaatcatgagcgtcaccatacatgccactgaaaaggaggatacagagaaagtctcgttgaaaaatattatggcagaagatgatgacaacgacgatgatacaacaactcatcagcaactactggaaattccatttactgatcacggctgttggcgttttcaaggagatgtatatagctggaagcgatacacaacagaggacgcactgagtgactcagtgacaagtggtgcctgctgaaatttaaccaactctctgtctcagatagagagaattaaacatcagagctatagcccactgttaactctaatttatctatagtcaatctaatagcaaattcatacaataattgcttgctatactattcatatatggtcccacttatcatacacacaccacgtcttgaagtccgtgctgtagttggctacaaatatgtagcccgctgctcttctatcttatcttttatctcattaaaatatgtttatagttagctaatagtctgctattgtatctgctctcaaaggctagctagctattcggttgtgttgcgaagtcgaatccaacatttgtactatgctgttggggcaccattgcgttcgatttctagtatagatcgatattctttttggcttaaagattatgtacaaatcttctcatattctgatctttgaatcttgaaattttctgtagcaaaactgaataaaaaccttaaactggcgtggtggtgttgtgttgatcactcgctcggccgtgtgcgctttatccgtgctgcccaggaaaactcttttaatcaccggggtttatacatggcctgacaagcgttcgccatctccgcgaccaaactccattgattcatggacaatactgctgcaacactgaccacgtcttatggctaataaagaactgtcaagagcatctttcctaggtaccacgaggtattatgaggtacgaggtaccctgagataccaatctaatctaaccattggtttagcatggatatgatcggcctaacaaaaataaggtctcctctcttccatctgctcgtatcaggttgtccgtgccggctgtctgcgccgcgccgccgtcgcatcgagcccaccgccgcctgctgccgtcgcgcgaatatgaggttgctgtcgtgcatcgagcccgccgtcgcgtgaagatgcttgagcagtaggaattctgaaggaagatgaaggttgtccaatcgaagatgcttgagcagtaggaattctgcaagagatggaagtttcttccaatttatacaacttcccaattcccaaatctaagctaataagatttttcacataggcttttgcaatccagtatgggattttagcaccagcataacctgaaatctttaggttcttcatattagaatttggctcaaggttaccaagaatgattgaacaatcttctctgctgttggtgccatcatcctctgaccattctagagataatgagccgagatgtcgtttttccttcagcttcacattcttggcttcgcattcgaaggtgctttaactttgccagtttgcccataaaatcagatgtgtggaacaataccgttttaaacagacgcaaagatcgtgcccttggccatatctgacaccctcgaccacgggggcggccggatctggtaacgaggtgacaggagtggaggcgctagggaaggggaggaggagggctccataggatgaggaggagcggaggagacggcagccgacgacatcggcgtccatgctcgaacgcgaacggaggagatggaagccggcaaccggcggcatctgttcaccgtcggtgggagagagaaggggaaagcgacgtaccgtacgggagaggcgggggagatcgctgggttgggtgttattgcgaaattaccatcttaccggctaggctggtcctagctgatccagcagcgtcttcggtcgctgggcctggaaacatgggccggaccacaacgggtaaaggaggaggaaaaagtacatggaaggtccctcaacttgtcatcgagttataaaatcgtccccaaccataaaaacagatatatgacatctcttaactaatgaaaaccggtcacaataggtccttcggtggttttgaccccggtttattctaggtgacggctgaatcagcgtgtgatccatgtgagccctacatataaggatgccatatcggcccacactctctctttcccctcttctctcccttcctctcatttttcccctgggcgtcgctggatgccgccgccgctccgctccactctaccggccgctcgactcgcgatcgtacgtctggccgtttgccacgacaacggggtcgcgcattagatcgagagagattgggcaccggaagtccgacggcggtgccggggctcgatttcttgtatcagcgacagcacgctcgccttcagcgcctgctccgcctccggtgccggcgagcaccgccggcactggcgcgacgcgagggcgaggacgtcgagcacgtcgtcggcgaggcccaggcgcccagctcgacgaccggcaagaggtcgagcagcgtggccaggtcgtggttgagctcccgtagctccgcctccatctcgtctgactccagcagcagccgcatccggcttcgcaccgagcaatcggcgacgatcgccttgaaccaggagcacctcccgcaggcacagcgacgccaaccgcggcaactccccggcggcgccgcacagcctcgatatctatatcagctccccggcggcgccacacactcataatgcaaatgaaaacattcagttcagatctatatcagctttatctgtcatgaattctcagaagcagaactggcatggtaagctgaaagtttgtttcatcattgccaaaccgccaaatctaacaaagtaaatctaatgaacgaaaacacgaatattttagaggaaatatgataactgaatgtatccattacgctgacacagaccaatcacgagctcgaagcatcatgacctgcaacactgaatggcatggtggatctagcacagtcattggggattcattcttcaaaggattccagtccgacaagcccggggttagcactgtgcatgaacagaacagatataaacagagaagagtgagatttttctaaaacagggtacaagaaaagaaactagtctgcatcaagaaaaaattgtacgcaagcaacaatcgtattgcctactggagccatggcaacagaaatgatttcttgacgcgtcgatctatccccttcttgcaaagatggtgacaccacagagatattggttccccaaccttaacaggagcaagagaggacgattcaaaacacacaggaaaaaaaccatataccatcgatccatgaaaaaaaaaatcaaattgaacatgtagaaggcaacatgaaaacacagaccagaaagaaaagataaaccgcggcgccccgcaggtcatccaacgcggccgccagtagcttagaccgcctcgagatggacgcgaacgaggcgcgcaggaatggcgcgggtgtgtcgacggcggacaggtcgcgtgccaggcggtgcagcgaccggagcagctccctgtaggacggccgctcgcacgcctgccgccgccgcccgcccgctcgctgcagagctcgtccgctgcgcgctcgcggccgctgccgctctgctcgctagcccgccgctgccgctccgctcgctcgcccgccactgccgctctgctcagcccgccgcgcactcgctcgctgccgctcccctcccctccgtcggccgccgcgtgctcatccgcctcctcgggtcgtctccatcgacctcctacgtcatgtcccggcgcaggcggaggcagcgccgccatcaccgccgccgcgtcgcccgtcgccggccgccgacgccctcctctcccgccggcgtcctccccacccgctgaccagcttgcgcagagtggtgagagagagaaggaagggagagaagaggggtgctgacgtggacaccctgacatgcggggccatatgagttccacgctgactaaataaccacgtcggataaaaccagtgttaaaaccacctaaaatgtaaaataaacggttttgtaagctgagagatgttggttttgtgggttgagggatgattttataactctcgcggcgatggcggcgcgtctggattcatgcccagaaactctgcttcgacgacgatcggcaatcgagatggaggaggttagccaacttcggtggtttcgtggactgggcgttcgcacaacgcggcgatgccgacatacaatccgtcatcatcttcatgtcccgcctcgacagcgcgaggccggagcaggtcaacgagtggctccgctacgccgtgcggcgcgtcgtcaaaactttctggttcaatgcctgcgattcgacgccgatcggtgcgtggtgggcaccgccaccgcgtgaccatggccaccagctgccaaccgtcgagttgcccagctatgggaggacggcgtccatcaacctcaacctgtcgtcctaccccttccggctcaaactcccggcgtccccagcggcaaggtacgaagcgctgacagatctgagcctcagctcggcgtggttcggcgaggacgaggccgtcgccggccgccgcaccctcggcgacttcatctcgtcctgctgccctcgcctgcgtaagctggagatcatcgatccgatgcggttgccccagctggtgcttcgtgccgaggcgctcgaggagcttatcgttgcatccacgcgagatacgcagacgatggacgtgacggcgcccaacctgcgcatcttcgaactccactacttcaacagcatgacatcagtgacgagctatggggaaagcatcgacttggtggtcagaatcacggcaccgagactggaggaaatcgccataaacaactccaccctggagatcgaggacaacctggacctgcggatacatggcctggcaagcgttcgccgtctcaaaaacctcactctagcgatgcatgggcataactgctgcaacaccgactacggttgagacttcgatacgagatgctcgccactcatgaggtcgatgatctgacggacaatggagcacctcgactttacaaagctaggagcatggtcatcgacgcatgtggattggatcaatatttggtcacaagtgtgtggtcgttgctactgatgtgccctgatctaatatcacttcgcatctgtttgagagggtgggggtgagctcatttcacttctagtaatttatttaattagcacaatataacagctctatatatgcaaactgcacccctcaaacacaccggtaaggcgtcgatctgttctgacgttttctttacttgtatttactctccatctacagagatcgatcatccaaggaccaagatacacggacggacaatcgtaatatatcgttggaatttctggaagaggtaagattaactagcttcacaggaacagatgaggaaatggacctcgtgagattgttgttcggaagctcgagttcaatcaagagcatgactataagtacccctgaaaaggaggtagctgataactgttcgggagactttttgctagattctgacgacgactatccttattatcaccgactgctgaaaattgctccactaagtcacctcagtcgttggcattacaagagatttgaatatacttggacgcgatatgcaacagaggacgcacgagcggtggacgctgaagccaattctcccagtccaagaacagtgagggctgtgaatattggaaaaggaaagaaaaatcaaagctagctagggtcattcttctgattttgattgtttaagtttgaatccaaaatgaatatttaggacattcaaaatattaaataaaatttgagttttcaaattgtcagggttacggataaggtataccctctacccttagatgtatgctatacggcaatacggtatatcggtgcatatacggacgttctctgaacacgctaaggaaatccatcacgaagtctaccaatggaaaggttcctacccgtataggactgggtcgttactatatcgtgcaggctccaatgtctccgagtcctacttggggaccgcctgacctgcgatataaaagggaccccccgggagacctaaggcatcgaatctcatagccgacacaacgaccacagcctacgaagccggagactacaggagccaagtcgccgagtgatctagtcgaatcaactcgactacgatctcgtcggtactaccgagttctacttttccctttgtaatatatggttctttccatataatcccatatcaactggattagggctattacctgctaagaggtctgaaccagtataatctttgtctcttgtttccttaatgtcgtattacgtagatcctcgtaccagcgtaccccaataccctctatatccggtctacgggtacccaccgtcgacacaaatattccttatgtcttcacggtgtatttctttagtgctatagatgttggttcatttttttctaggaatttggttaaagttaaaaaaagtttgatttagcataaaactaaaatgacttgtacaatatgaaacgagagtatccaacaaagaatgaaataaaacacaccatatgaccgcaaaatacccagtaaacaaaaaaagttcactgcttggctattagctgagatttcaaattctccctacttaattatctagttgatattcaggaaattcctttttttaagtggaagtgtggagtatgcatttcatgtgagatagcagtccacggaaataaatgggtcttccaatgcgaagtactaggtactaggttttgtttggtggattggcccatgaaactctcctccctcgcatttcgccatttctcgcatcaacaatctgagggtcacgccgtcgccctgcccgcctcattatcctgtcttttcccaaaaccctcgcatccgtcggtctagcaaaccttagctagaatgaagctcgttgcttgttacccacaagaggagccaatagaagatgggtgccgaaaacactagttcacgaatgtgcgtgaactagacatctcgcgatcagttttccaaccatgtagtgacgagagctggggtagggttaggttttcggggatggggagggggaggggggaggtggtgctgggggagggtaaagtaggggatcggatttaaagggatcgcctgagaggtggtgcactggtggtgggttgtcacaccccaatctggcaccgccgtacaacggcaactgacaggagcgtatcgtaggaataacggcgcgaaccgcttcctacgaaaccgcaatctcagtactagtcccaggacatagtgctggtacccatggtgacaaatatgaatcattgcaaatccttaaaataaatagaggatttatttaccttaacttaggttgcagctcagaaaagcccgagaatgcaaccgacgacacggacgaggaaacaccaacaacagcagcagcagcggaaccaacggactaacacccatctccacaggcgacggctgggagccaggacgaaaccctaatcttcacttcacttcatcttctcttcagggcggaggaactatatatatttatttatatagagcaagggtgagtactttcgtactcagcaagtcacgggaatttaggtgtttaatgcaagcttggaagagaggcgaggttgttttacaattcctttgtttgaaatcatttttgaaatcactaagtgctttatttctttttaactttgggtcgaaaggagacttgcgtctcgattcgacttaagagatgcttttcaacaactcaaatggtaatgtaccgacctcccgggtcagatcattacttctcaactcccggagccatttcacttgattaaccggctcccatagcctttttcattttctcggactcccagagtctagttgcccagcagcacaacaatccgcttccactcgggaagcctagtctatgatgtccgcagacatcccgaatcacacatattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcgcggctgttcgaccagttagttaacctctacagaggggtacattttacccacaagatacgaacttattccgaacacccgtcggtatcggaggttcgcaacaaagcctttcccaagccgacccatggatacctcatgccacatagaaggatcaaatcctcacataagtataggccattttagttttcacaaatcaaattccaaccacctcgatcggtaattcagcaagcttctcttccttgcttaccaggaacctggtttggctccaaccgaccctgttcccaactattggcatgcgaggtttccctgaaccgactagttacttagccagggtgtcccattccaccttgtggttgcactttgattatgctcgataagtttcccacaggaatcggtccttatatgcgaatacgggacagcgccacgtaggcacaacccccgcatcgcgagttttcacaattcattttattttcaaacacaccgacaccacatgtcgggttttcaaggcttctcaaactcatttcccaaattatcgacaatcgatggtgtctgtggagtagttggtatacgtgctcagagagcacggataccgaagtaccacaagggtggagcgacaaggaataagggtagtacaacctacaggaattagtgtgactaatgggtaggtccgtcggtttggcacgcaaaccgaggccaagcaagttaagtgtgtgattctaatgctgcaggttgcacacaaaataataatgattttccaattataggagcaattggtcaaagggtgacttgccttgctcaaggtgaagatgaagcttcacgattcttcgagaaaacccgtgatcgacgaaaatccggtaaccgcgactatacgtaaacaatcgaaaacctaaacaaaagaccaaaagaaacaccctatttagactaattaatagtgccattagatagatctcaattttacggaattattggaagtggaacggagtcaatcggagttacggatcgagagatatgaattttggaagtttaattggaatatctggaataggagaaatggtttatggattttatagaaataatattctcaataatattattggtagtcattgatatgtgggaccaaaggaaatgattcatggaataaagaattgatttatggaacgagggaaaaggatttaataatccctttggaaaagaaaaggaaggagggatgataatcagacttccttgggcggctcgcggcgcggcccgaggggcttgcgcagctcggccgagcctaatgggccggcacggccgcgaggagggcggcccaatggggcgcgggagggggaggagaccgaccgggtggaccgcggtccaccacgcggggtcccgggatggggcccacatgtcggcggcttggctcacggtgggggaggcgcatgcgggtagcggcgctagggttcggtggggttggtttggggttggtgcaccgggtggacggagaggaggtgggcccacgtgctgccgcacgccttgtcgtggaccgcgagcacggaagggaaaacggagggaggggccgaccggatcggcgtgaccgggtcaagccgacgtggctgccacgttggcaagcgggaggaagacgaaggctgtgcccgagatggacggcggcggcattcaccggagcaaggcgcgacctcaacggaaaaaggaagcacaccgggaggagggatgggacgagaggaagcgattcaacggctcggatgcgacggaggaggtccgacggcggcggattgcggcggcgaccgtcggcggcggaaaaagaggggaatcgccggtggtcaacgagggttcgattagaggcggcgggagcatctccggggctcggggagctcattcctggggtcggatgggacggaggagtcccgagtgaggccggcgacgagcggcggctccccggaacgggcggcaatcgcgacgagaccatgccgggcggcggcggggcttggggcttcgtctacgcgcgttcgggagggctaccgagctaccgcgcgagccaaaagagggagagggcgagcgagaagggagaacggagagagacactaccgagtcgagacgggcgctgtgatgggcgaccgacggcgcggggcgagctctccggactcgggccggggaaggggaaggagagggtgcccgtagtcccgcgtcacgtgtcgtcgcacacaccagcttcaccagcacgtgcgacggcggagggaggcgaggtcggcgagcggcagagatggtccggcggcaatggcgcgtggaggttgggcaaggaaacgaggaggaaagggaggggctcgagttgggttttataggcggtggtgatgtcggtttggggaggaaaccgacctaggcggtccaggagaggagctggcggtcacgggcggtgtcgggcaaagtggaaaaagtagggggaaaagggagcgcggttccttcccgatttgagcgaccagagggaggaggaaaacgcgcgtgagggagagagaggcgctgcctccgcgtcttggacgcgagcgcacggaggtggggcgagcggcagggcggcatgggcggctgcgcggcgcaggcggccagggttgacgcggcggcgaccgggcggtcggccacgcgcgagcgcgcgcgtgcgaacgcgagggcgcggccggatttcgaacggcggcggcggcaaagcggccccggggagagagagagagagagagagagagagagagagagagagagaatcgagcgagagaggaaggagacggcgacgctctctcctgctcctgaacacgcgcgacacacgtgcgagagagagacggaccgagagggagagatggaccggaaagagaaaaacggcccagttgaccaagagggaggcaaaatagacttttaccgagagaactgatttggagggtttggagcttggggtttgaatttcaaatggggatttggttatttttggagtcggggcaaatatttggcaaggattcaaaggtagttagatagatcaatagataaatagacagttggatacgtagatcgataggtagagggatagatggatagataggttagataagtggatagatcgatcaatggatagggagggattcaaggtgagggttcaatattttcttggaatcggtaaagtttttggcgagggttcaggggaatagattggatgtttgagtttgattttgggaacttaaatttggaagaggaattctgaggaggcgatttttttgacggcgacgagagggatcaaggacggatttgaattaagatccacggcacgacttagactctcacacagagaatggaattttcgcatataggatttttgccgaattagtttttaacgcctcacaaaaagcggagcgttacatgggtggcgaacaagggtggacgagaggcgacagcgaagccatgggacggtgggccagtattggtaacgggggtaaagcgagggaaagaggatagtgaggaggccgggtggcggcaccgtaagtggaaagaaatagcagcgtgcgcaggaagaatcaaatcttcaacttgcaatacacatgtgcgcgagctatcacctcatttcattttcttatatatacaattttacataccggttatagtgttacgtgtagttcaaactagctgggtggcccgcgcaattgtgcggctagcacccaaacaaaattatatattttttatgattttactaaaaaaattattaaatagctatctcattgtcttaagagtttgaaagaccaaaccttatcatccccatgtttctaattatatagttttttaaaagtcacaccagatactaccccttatgtcatctccttctttatttgcttgctcgatctaccactatttctattcattctccttagaacctttaaacattggatcttataggttttagagtttattttcacgttgagtttcgtttttataatttctagatgtcccgtcaaacgttgccattatactcctctatgacccgtttactgtctcttctctttattgtcattgagattttagaaatcgaacataattatcgtttgggttcatttttactttctagaagtcccgctaaaccgtcattgactttgccattgtacttctctatggctcgcccgctgcctcccttctttattgtcattgagattttaaaatcgaatatgactatcattgtttttttttactttttagaagttccgaaccttcaaaaattgaaccttgtagtttttagagtttattgtcttgttgggtttcgtttttttataatttttagaagtcttgtcaaacgatgctactatgctcctctacggcccgtccgccgcctactctttattgtcattgggattctaaaaatcgaacataactatcgttggaattcattttttattttctagaagtcccgtcaaccatcggcagctctgcaactatactcctatacaccccgctcgctgcttctcctttttattgtcattgagattttaaaaatcgaatatgattatcaatggggtttattttttttactttctagaagtcccggcaatcgccttgatcgtttgctttacggcctccctatcgcccctccttttaatcgtcattaggattctatttggtgtttcattaacaattttttttatgtcgtatcaaccaccaccactactcctttatatgcctgttacttaatttatctcgtcatgtgttttagatggtcttttctatcaatagtctttatttttatcacaaattttagttatttataaattgtattcctaattggaaccttatttttcttttttctaatttcagatttttttaaaaaaaattaattaatatcgaattgtgttcttttaatatttttattttttattttcaatttcagttgtttcaaaattgtattcctacttgaaatctcttttactttatctaattttggatattattttatttttattctgaattttaattaatctcgtatcgggttcttatatggattcttctttcaatattgcttatttttaattctgaatttcagctaattttaaattgtattcctacttgagctcttcttttattattttttttgctaatttcggattttatttttatttttattcccaattttagttaatctcgtattaggttcttatacggactcttcttttaatattccttatttttaattctgaatttcaactattttaaaattgtattcctacttggactatccttttttttttctaattttggattttattttatttttatttcgaattttgattaatctcgtattgggttcttatatgaaaacttttttcaatattccttatttttaattccgaatttcagctatttttaaattgtatttctacttggactctctttttttttctaattttggattttattttatttttatttcgaatattaattaatctcgtattgggttcttatatggaaacttccttcaatattgcttatttttaattctgaatttcagctatttttagattgtatttctacttggactcttcttttctttttttctttttctctgattaatgtgggaatttctagcccccacatcgaacgtggtgcctcctttcaaagctgttttaataatataatagatacaaatacaccataattacatttagaagtttttaactcagagcaattgtttaatttgatgtcaaaattaaccttaccaaaatttggtattgtcaaaagttggcgcatttttatagtaccaaatgttgatagcgttagaagcgtttagtttgtagccttatcaaaatttagtaatgctagtatgagagaacgtttatggaaataccaaattttagtaaggtgtcaataacaatagaatgttcggtttgttccttaattttaataatttgaccctttgagaaaacttatcaaaattttagtaaggtgtcaaaaaccaattttaaaaataggccggcaaacttgaacctttgcttagaggcttactggcacttgctccaagcaacgatgggccatccgtgccgagcccaacgagctggaccacaaagcccattgtcgtacggtcttttctccttttcggtaaggccggccgggctgcgacccatcgctaccagccacccgtgggcaccactggacagttggggtaaatgttcttattcttccctttttttctgaaccaaaggagcaaaaaaaatgtttcctgtaatcccgtgtactgcagcatggcacactccgtttgcatcgctgcatgcgggggcagaaacagccaagggcgattggatcttcacttgacgcgctgcatgatttgcgtcgtcgtttgcttcctggccattgcgatcaatgcctatctgtatctgaccatctgccattccgcgtagctttccgacttcagagcacccgctcttccatatatcgtggatactctcttcaacagagccatgatgttggtgcgtgcgagtggtacgtggaaaaacgggcgaaagaaacggagtatcagctgaggcggagtactacgtggatctcaaaatctccacatttcggtggcttcagaatccatatgatggtattaaaatattttcgatttgtttagatcgaattacaggtgcgagcgtcacgcgcgcctagcctttccactggccagcacgtgtgtaccattgcaaagcacgccaagacgcaagacgcaagacgcgtgccatgctggcggctggcttgctctatctcccatgccagtatcctgcaagagacgttgacatgtacgcagacacagtgcacactcaccctctcgagaaagcttgtaaaaatacaggcagtcgctctgcttgttcggatcgcgtattctggatttacggttgaaattgtgtgcgaagagtgctaaacgagtaatgggagccggggagaagtttctctgattcgcaccggcttgggaggatttggggactgtttggttggttgtccaacactacctaagccagccaaatatttgtggttaagttgttaaagctgtgatcaagaagccacaccttaacctttttaccatatattattatgtctatgatccaaatgtgggatcaagttcaaggaaagtttgatatgactaactcgtagttagaaccaaacactgcactaaactcagtaaaacatccttatcatacttgtggtaaattgaggcaaactttggtaagcaaccaaacaccctcttcatgctggattttccacaatttgaactttttgaaaaacttatttcgcaaatagacccttgaaaaaacttatcccgaaaatggtcattttggggcgtcaaagtagctggcgcagtcctcctaccaccgtggcggggcggcgctgaggtggcagggggagcgcgccaatgtagctggcgccccccttttttatttattatatatttttttcacacttaggagcacataagaaccaaccataaaaaaaataaactcaaatagacgaagtatgtgacctatagaatttttcaaagctctaccgaaaagcttctcgcctcgaaaacataatcttgcaagtggaatttggaggttttaatttcctcgaacccagcaaagcgggggagaatcggatgtaactttttttttaagatatccgtggatatattatttgcctgattccaagtccgtatgagaaagttacgactgtttcaagaaatgacacccgaatgtaacaaaaagaaacacgaaccctaactttttttattgtttataggatgtgaaaaatgtaaaaaagtctaagagtgttcgaaatttaatctactttctttggggactacaggaaaaaccaaaacaacgaaaagcagggagaacgcgggggagggggggtcttttcggtatagctttagaaaattttataagtcacatatttcatctatttgagtttaatttttgtatggttggttattgtgtgcttctaagtgtgaaaataataataataataagttgtacatatctctcctctacactagagagaggaaaaaatggggggagggaggggcgccaaccacattggcgcgctccccccacctcagcgctgccccgccacggtggcaggaggactggcgccgtcgtattctggcgtcttaaaaaggattatttttcggataagttttttcatgggtttatttatgaaataagattttttaaaaggactaaattgtgaaaaatccagctcttcatgcgtcgcacgcgccagatccgttagcagggcaatgtgagcattcaatccatcgtgcacacgccagtagtgcaaaaaataagcagtcctagtacaagagaagatcgcgtctagcactctccgatcacgatgtcacgcgaggtcacgttgctgtgtggcccgtggcatgttgcaaattgtcaaaactcaaaacctaaccaccaggagatagctagcactctctcgctggcttcagggatcacactctaatcacggtcattaatcccactcatttccatggtcataagatacgtgcagtactctgttgttgttgttcctaccaactgcagcactgaaagtagcttttcagacccttgcagcacacagttttacagccgcgccgattttgttcgttccgtttctaggagtagcatgactcagcgagcaatccgttgccttccacgtgttaacctatatttcggactctgtccagaactccagatgcgaaggcgaaggcggaggatttcggctagcttggtgatgctgccgttcgcgagcattttaaatacggtgtgggggcgttcctcctaatggcgaccctactacttattgcttgcctccccacccggcgcccccatctctctttgcgccaaaggtaatccatccatcgaatcctgcatcttttttgcttgtgccttgtgttgcaaagcagtcttggattccttctgttcgcattgccctgagagttctagttcgatccccaactaagagcgttttgttttcgtttttcttctgttcgttcgttctttcgatctgcagatcctacaaactcgccccccgaataaccatggcgtcgtcttcgtcgtcgtcgccgccgtcgtctgacccgtccttggagacggtagcgccgcacgcggctgttacgggggagcggaagctcaaccccaacctgcaggagcagcttcccaagccatgtaagcgattctatttctaccatgcagggatcgaaaaaaaaactgttctttctttctatctttctttttctttctcgatcgtctttgatgtctttggtcagtggtcactgaacactgataacctgataagagagtgagaggccggagttggctgcaaagcacgcggttgtgcgtgacggcagctcgacgtacatcagttgagacttgagagatcatatggtttaagtaccaacagaaagaatgtgtaattttaccatttaatttctctagatactacgtatttcgatgtactaaaatttttaagtattataaaatcttgatatctcaatgtactttgtcaagtaacgtaaaatttctgaaatttctcagaaagtatacatgagagcagtagcaccgctagtgctttactggtactgcatcatctgttacagtgcagaaaaattactaccgctccagtaactgatcctaaacctgatgtcgtaaccgtagccagctaactgctgctgtttttttttctttctgggttcgcgtgcgcgcagatctcgcgagggctctcgcggcggtggacccgagccacccgcaggggacccgtgggcgcgacgcccgcggcatgagcgtgctccagcagcacgccgcgttcttcgaccgcaacggcgacggcatcatctacccctgggagaccttccaaggtgagtgagtgagcgagcgagtgagtgatccgcccgtgtgtcttgctgtggatgaactctccacgtcgcgatcagtccatctctctctgctgctgctatatctgtgtcccgtttcggacaggcaaacagtttgccttctaaggttgtaattaagcttgacgcaacagaagagattaagagattttagggtcgcgtgttaagtcagaattatgcttccaaatcaacgattgcttgtgcagtgcagatgtagtatgagactttgagtatatggtatgttttgttttttgtttttcacagggctgagagcgataggttgcgggtatcccgtgtcgattgctggtgccatactcatcaacctcgtcctcagctatcctactcaaccggtaaagtttgccctctgtactccacgtgctccttattttcaatactttttaccaacatatatgccgtgccttttgctgtattgccaaactgtgtgatcatatctggactaatcttacgtcaaaaaaaaaatctggactaatcttctcgattatgatgtaaagaaattgtataatgttttttagggcgttctgaattttatatgttggtctgaatgttacaccaccttcttttgtaaatgtgaagaggtgtcactaggctagtgaaaattgaattgtagtgacttttgtaagtgggaagacatatctatcttcacttcaggctttggatttgatgtgtttttttatggaggggccaacatgtacagatgaacttatgtttactttctttcaaatgcaggggtggatgccttctcctctgttttccatccatataaagaacattcacaagggtaagcatgggagtgactctgaagcatatgatactgaagggaggtatgtaactttgtatacataattgttaagttcctctctttgcctagaaacgattacaatttctatctcgtttcaaatttctcactaatttatatgcttttactaggtttgatccatcgaaatttgatgctatattcagcaagtatggcagaactcatccaaatgctttgacaaaagatgagctgaactcgatgattaaagcaaaccgcaatatgtatgatttcattggctggtaagcggatggttgaattagcagtaccgttcgccatcatttttttttttcagttacaactttgctaattggttcttcctgcaaaccatcacaggattactagcgctggtgaatggatgctactgtacagcgtggccaaggataaagaagggctgttgcaacgagaaactgttagaggcgccttcgatggcagcctgtttgagcgacttcaggacagcaagaaatctgcttgaatatagcaatgagctgtgctgctcgaagaaagcgttgacagtaaagaatctaataagattagaaaaaaaaagggtctttgctttgtgtaattcaaatgaaaaatgttaattaccccatgacagtatttatgatgtttgcaatgatcaccacctcatgatatagtcttgttctttctttttgtatgtgcatgttccaaatttaccctcatttatttttaaaatcaaggtgaagttacgcttgttgattcgtgttgcgcttatttaagcgtcatattaacgtatttgttccggaagtttaaacatataattctccccccaaaaaattgagctatatctgataaactgagaagggaccataaaaaataatttataggttaaatttaaaataactccaaaataattttaaaatttttagtgttattagaggtttaaaagccaatgttaaaaaataaactacaataaaataattataaaacaagctgtataactaaaatttaaatttaaattttggttgtagttaataaatcaataaggagactatagatgatgatgggaggcatgcacaattgtttcaaaatagtaaactccaaattatgtattgtaatgcacataagcactcctcccatcccaagtctcaactatatagattttgctaaattgagttcgaatttgatgcgtccaaaatgtgttatccggcaactcatatttgagatttcttttgctgtataatatttttttattaagaaggaaaatccatcgaaggacttgttcaatttgttgcccaaataaagtataccaaattttggtaatgctaaatgacacattttagcattattaaatttggtaaattttaagagagagcttctgaaaatacctaaattcgattatggagggcatgctgtgtgttgtcgttaaatgaacagttatttttttagtttttgttttggtgtatcggagctttccagaattctagtcacgtgacatctctatattaatgaaaaatggaggggcgtcgcccttttgattaaagaaattctaaaatttgatactcccagtcaaactatgttaaatttaattaagttttaaaaaatacggtaattttcaacccaaaatagcatttatgtgataaatattgataaatttgtctttaaacttagtaaatctaaataagtttgacttagaaaaaaaatcaaaacaacttgtaacgtgagacggagaaagtactaggtagtaatggctaaagtaagtttagtttattatctaattttgataatattaaaattcggtaaagtcgaaagtgataacaaaagttgccgatcatccgagccgttgcgagcttcaactgaacggtcaagcgtgttcggttcgtctggtttagctcccctcactggaacacctctccgtcgtgaaaaccaactgccggcggcgtggaagtcgccggcgagttcatggccgccgcgctcatcgtccccgcaaacccaaaccctactccaaaccccacctcctccctccgtcccccatcgcgtgccgcctccagtgtgctccgcttcccccgccgcgaccgcgctcgaacccatctcactgccgcgtttgggaggggatcacccgcggcggcggccgagcgcggcgggaaggactactacgctacgctgaacctccgccgcgacgccaccctgcaggaggtcaagacggcctaccgtaccctagcgcgcaaggtgctgcacctgcactccccccccttcactctccgatgtcatgtcccctcgaagtgttagattgtgtgatactgctagttttagtgtatgcgcagttcaatttatctggaattgaaccggtagcgtgatatagttgcgattgagttgggccacttgcattatctgcttgttccaacctgggtaattatcgtcttctgcatcccctgcacaatcctggttacagtatatgttaaaatgagtaaaatgactatgtaattcttggtaatgtggatcatggaaatcgcacggtatcattgcaattttgagcattttcactgagatgatctacaaattgtgtactctgtctgacttggctatactacgtgtttactgtatgcaaaaaagatgaagaagttttggcgactacctggactgtattccacagcaaagctccatgaatccacgatatgttctgcttccccatttatttttttgctgttgtaccatattttaattcctccattttttaaaaaataaagaaaaggctgaagatagataatgatttttagctccatcactgagtttgcgtatttgggcctctgcgcgttggaagattattcttcaaataagcaatacatgattacacgggacccttctgtttatggagtaaaccacaaatgtatcagttttggatgttcagtgatatccaacttatactttatcatgtgctgtattactttgttaatatgcttcttaaattccaccgatgtttgcttcaagatggagctacaaatcttgaacatacttcattggttttctttcaattcagtaccatcctgatatgaacaaggaccctggggcagaagaaaagtttaaggagataagtgccgcatacgaggtatttactgatatagactggttgattttcgacgcatcttccttgtataacgtgcggttgacctaagttctggttctgctttatgtacctttatctgcaatagttgaaattccatgaaaatagggaatatgctacatttgatgttttacaatgtttacaatgtaatttctcatagattctatcagatgaagaaaaaagatctctgtatgaccgctttggagaagcagggctcactggagattatggaggtggagatattggctccaatggggtagtcattctgttcaatacctaagttacatttttttgcttctgatctgtccaaatttaggaactgaaatttcttgtctacctgatatttttctagttaattatattatccaacctttgacaattggtgtctaaatttcatatcgtgtttaccaatttttcttgtttcccatttcaccctcagcaaatgggttcatctcattttcccaactcctgactaagcctgtgatttccattgagttctgagaaacctgcagataactagaaaacatgctgcattatattggtatgccaattgccaaatattagaatccagagagaaaatttaatctgataaagttatttaaatttgttcttcaacagattgatccatatgaactcttcaatgcattctttggtggccctgataagctttttagagacagcatgggtgctgggagattccattatggtacaaaagtcacagacaacaggggacttgatattcggtaaacaattttaacctgacactgaagcaaggaactgatacttggatgtttgtttactattttaatctctcttttgtatataacagatatgatcttctcctttcttttgaagaatcaataattggaggcaaacgagaagtcagcatttttcgttatgaaacctgtggcacttgccatggaactggtgctaaatctagcaatgacataacagaatgtactcaatgcagaggtcaaggcaggttaatgaaaacacagaggacaccttttggtatagtatctcaggtgaactatttattgtaccgtatgtattcattctcagtatttgttcaccactacaaataatctgataatatcttgtggtttctttcttcttccctggatctactacaaaccagttagtagattaagtaaaagaaaaatttgctgatgaatgatgttgtgcaattataattttcttcttctgctgagtaaatagagtataagacggcttgtggagttttcatattcattgggacaggggatgaagattcattatgcaggaagccattgtatatgaaatattactagctaaatactcatgttttgctatggataaatatgagttatacgcataaatatgaattaattgtgaggtttttagaacaactcatccatgtagatgtctttgcataataaacttgtaatttagagatgaaataacaggcttgttcggctgagatttatgctg

SEQ ID NO: 50083 - DNA, 1200 bp, Oryza sativa
aaggcctcgatctgttttcagatgtcacaatagattatactgatgcaattttaggaaccacagtgaaggtgagctgttaaatgtggctccgttcatattatgcattacatagcaatgacatatatttatgtaatgctagcaggtagcagcagaactctggctccagctttacctagaaagagtgtttcttatttcaggttgaaacaatagagggattcaaggatctttatattcctcctggcactcagcctggggagcggctgaaatttgctcaactgggagctccagacattaagaatcctaccattagaggagatcataattttgtgataaatgtgaagatcccgaagagtatcaggtttgagttgcgagtattgttgtactttgtgatgggttaatgctagccgtagtattgctttgtagtttttatgcggtaaacatccttggttacagattatactgttacaaggcgcatcaaattatgttatattactcttagcttttggtgctttgccttatcaatgcttatattcatcagcaaccaagaacgaacattagtacaagaaattgcagcactgaaggaaactgggtgtatttctgttccaggtgaaggtacctattttcctttctgaggcattgttccattggtacatgactttcttatgtaatctttggctatttcagagactaaaaacagagaaaatttgggagagagaaactcccattcatccacagggaagagaagatccctctggcgatctatcaggaatttgttcaggtataccaccattcttttgtagcttctcttaccatgagcattaaatgcaactatacgcccatcatattgatatcatcaatataacttctttttgtggggctcattctataaaagttgggtgcgcctttattcatactgtgtaacagtttcatttctaccattctaggggcgacgatggggatacgagatttgcttcaatcagcgcacaatctgttactccattatggactccgcgacgaggatctcatccagctgttctgttgctagaaggattcctgatgatcacagtgctcttattcgtgataagcagaactcgtataatcaggtcgactccaaagcggtatgatcgtcctactgaagctaaagaagccgatggagagacttaaaatttattatggtgatgttatttggacgttattgca

SEQ ID NO: 50084 - DNA, 5202 bp, Oryza sativa
agctaagtgcctgagccgtgaggaggaggcggctgctggtgagacctccggcgagggccggggaagaggacccgctcggcgagaggaggatgcagccactggcgacgagccccaacacagtgagatcccgcgacgtcgacgcagcagtgcgtcatggctgagctggtggcaaggagacatcaatgaaaagaggaggggcggcggtggccgaagccaggagagggagggacggcggtggccggagctaggggagggaggggcagcggcggtggtagccgaagccgagaaagggagcggaggcagtggccggagctaggggagggaggtggtagtggtcgttggcgtcgggtaggtgtccggtttctgatacctagtagaaatcacctgatatttgataggtatcgcatgatacctcataagtatcatttgatacctcgcaagtatcacattctagtggtaagaatcgtatgatacctgacaggtatcatctaatacttcgcaagtatcacatgatacatgataggaatcgcatgataccttataagtatcacatgataccgagtaagtattaagacatgatatgtcagaggtatcaggatctaatacctaaccggtatcatcccgttccaacgggtttccgttgtatagcagtcggggaatgctacgtagtactactactccactatcttaccacaacaacttctggactctgaacagtttgcgcggccaaaaaaagaagttctaaacagttccggtgacacaaacatgttcacgtatttgaagcgtcgatgagagctcgccgattcatgtttgttagctcctttttaaaatctctttcttcctttttaaatttttttaactataattactattaagtatggtcaatattttaaatttcaaaaatagactttttttaaagttggtttcaaatggctaaaaagattcagatttgaaaataattttttgagagagtttatttttaaaattaaaaagattcagatttgaaaatatttttttgtgagagtttatttttttaattaaaaactaaaaagggtaaaacaaaataaaacttctcgtcaaggctcaagccccctgttccaacttccgccggaatcaaatccatccgaacgcgcgtccgcgacggcacatctcagggtccgccccaccggccgcaccagcaattctgcaaccgacccgaccgaatccatcctccccgccagccatggctcccctgccaccgccgcgtccgcctcaccggagccaccggcgagtccccgccgcctgctgcctcttcctactcctcctcgctctcgttctcctcccctccgccgccgccaagtcatcccgccgccccatcaccgtacgtctccctacctaatccctgcctttccttggcggcccctgtccgtctcaccgttcttgtgctgcgaatcccgtggtccaggacaacgagatccgggagaagaagagcgcctgctacaccgacgtcgagaagtacgtgcgccggaattacgcttccccccgtctgtgttcggtgggggtggttttgatggggaagtttctaatggtttctctctctctctctctctctctctcgggtggacaattgaatgtggggatgggcgtgcaagtcctcggcgacggaaaaagagaactgcgtgctgcggtgcctctcgccggagtgctacgatctcatatacggcggcgacccggtgagtgccggcgtgaaagtaaaatgtgatgtttcagaggagttttttttctaaaaaaaaaatcaggattcctttgaattttattttgggtgttttgtgttgtggcagcttgaggaaggggagctggactacatccgtggccacgagtacaagtactgcatgacaagtaagaaacagagatatatttgcaatctgttgttaagtttaggtttttggatgttgaattgggtctaccctgagtccaacttccatgggtttgccgagttagcacatgtgggttactgtagcacttatagctaatcatggactaattagactcaaaagattcgtctcgctatttcccccctaactgtgcaactagtttttttaatctatatttaatgctccatgcatgtgtccaaagattcgatgtgatgtttttgggaaaaaaaatgggaactaaactaggcctgaatatgattgaacgaacacacccatctgctcaaccttgttacaacatgctttctgtgagctataggagaaggggtcaatagttactgaataactgaatatagcaatcacagcaacattctaacaatactacttctaacaaacaaaatgattatgtttgttctacccaagtgttccccgacatattcctcaacctccacaaactccaatagagcaaaggttatgttctccacccagttatcgcttggattatgcagtctagatattgagggccaaccaccaattttggcacatccaaatgttcgatagtctgactgatcatccaccattatattttcagtccattggaacttttttttttgttatcatatactgtcatttatcagttccaccttgttactgaagagggagaatttcactttagtttgcacgtgtaaaacgaatgatatgcttcagtcctcccatgattgattagcttgctaaacataaccaaaatagcctgactaggaagagcattttgttgttttccttttctgattcagatatttctacttgaaagatcataaaacattgaattatcagcaaatgtcctgagaaaataaatctgctactccagatattattgcagttaacgttccaagagtaattgactcaaatttagatactgctattgtgccacattttgatcactgtgaatctgcaatcctgttttatgaaatttacttacgactagctgaagtgttatcttcaggtaaataaaaatacagaatacttaactaaaggaaaatcaagctgttggtgttattacaagaataattctctaatatgaggatgttttgcaaaagacattgacattagatttcatgcatttctgttatgtatatacacgctccaattttgaattgcacttagaaaattatacatctaaattggaatttgtatcaccattgcatgattactgttagacctctacccatcaagttattctgctgtttttctccttaaccgtgatgtctttcgtacaacttgtccaggtcttcccttggtgaaagcttggatggtgtcaagggttccttcagctattcatgaagtgcaaggaagtaggaagagtgttctccgagccccatgaattataatacatctgaacctacggtgtgtctttctgttccactagtcaaacaagcatacatgtatgaattctgttagtcattgtctcgttgaatccaacatatatcttcgctattcaactggactaataataaggcgagcttaagcaatattttgagcataataaattcagatttttttcacatatgagacaaatcagtttgcaacaatgttgcaaggtcttctattgcatatactaaagttttgcactactcatatcagcacaactaaccatcgctgcaatattgatacaaaaatataatcagcaacttagctcaaattatgttgattttaatgtgctctcagattatgggctgtcaacttaatggcctgctcgccacaagaggtaaagttctaaaccgtaattatgtgtggcaaatataaggtctagactaggttccaaacatatccatttcaatcaagccttaggacatattagatatggtctcaaagactaaactactgcattatactgatcagttattatgattaacaatcaaccattactaaacaacaagaacgatgaacgaacaatactgctagacaaaacaggataattgtacaatgaaaagaataacggcagtacatcaaatgttgatcacatattaaccttatgaaagcatatactctaggtggatttgccatgggggcagtgggggctcgagcccccactaccggcgctgagactatgggggccccccttaatattttctgccatacatatatacatacatgggaagggggtatggagctttgtccagtttgtttagcctcccctggtatttcttcttggatccacgatatactcacaggattaaaatgaattataacctagtccttatgcttgcataagattaaaatgtgatcaacttttgatttacttttattgttccctgttttgtctagctattttagtttttgttacttggtactggcacacataatcatggattagggcttgcctcttgggggtgagaaggtcattaaattggcagcccatcatctgagagcatgttaaaatcgacataatttgagctaagttgttgattatgttttcacatatttattgctgcaacagttagttgcattgtgtatgatatgggtagtgcaaaactttagtttgtgcaatagaagtacttgtactatcattgtagcaaattgattcgacttatatgtgaataaatttgaatttactatgcttaaaatattgcttaatctcgtgtttctttcaacattataaacatccaacatgatgaagaaataaagtaaatcaataagcaaacaaggtaaacacgtgcgaactccatactggagtgatggccgagaggcacaaaaccatcagtccatcacccacccctgcaacgaggcacgggcattccgcacacaaccatgcccgcccatgcactggtcagcaatgttggaggggtggaagacgttggccagcgacgttggcctgcggtctgcggaggagcagctggggagttggggcttcgagaggatgggagttgaggagcagcttgcggacttggggctttgagaggatgggagttaaggagcagctggggagttgccacgagtgataaagctgacactgcgacctctcaagccgatttattttggattcaacaagcacatatacatagaacaccagatataaaggtgagttgaaaaaagtttgagttagggagtacagaaatgacatatacatatgaacacaagagataaaagtgagttgaaatattttgaaatagggagtacagaaattagactgggaaaatggaagcagggaaagttagagagggggattacatttgggaggaaggaggagaagcagggacaaagcaattctcgaggaagacgatgactggttcgt

SEQ ID NO: 50085 - DNA, 7341 bp, Oryza sativa
cgtcgccggggaggatggtgcgtggatccatcgttgccggggaggaaggcgcgtggatccgtcgtcaccggggaggattccacgtggatccatcgtcgctgccgccccccgtgccgttgccgtcctccccgcctcgcaccgtcgccgatctccccgcctcacgtcgtcgtcgtcacgacctcctccgcctcgcaccgtcgccggccggaagcagcagatccggtgccatcgttgccgccgggaggaaggcgcgtggatccgtcgtcaccggggaggacggcaaccggcggtctctctctctctcctgcatctctctctccggcgggcggcgagggtagaaggggaaaaacagggggagagagccatgtccacgggctcctccctaggcacaggggtcgcggccctctgctaggagacagctccagccgaaaaagtggacgccgtgagtagggatactccagggcacccattgctgatgctctaaagctcaactcccaaagaaaaacttgcttacaaatcatggcagtgacaccgtcggtactctgtccaagaccgttagaaaccgttaatgaaggatttattgtactactactccgtagtattctactactactgtatcgccagcgtttagatgaagattcaagtaatgtaggagtacactggaaagaatcgtactcgtgtagcttcatcggggaactggccgataaatgctcgcgaaggggataacatgccgtggtggaccggcgactagtggatatgcaagcaaattccgtgtttagttaaggtggtgtttggatacagtgacttaactttagtccctctatttagacactaatttagagtattaaatatagactacttataaaactaattacataaatgaaagctaattcacgtgacaaattttttaagcctaattaatccataattagagaatgtttactgtagcatcacataggctaatcatgtattaattaggctcaatagattcgtatcgcgaattagtccaagattatggataggttttattaatagtctacgtttaatatttataattaatttccaaacatccgatgtgatagggacttaaaagttttagtcccatctaaacagggtctaagtctcaacttctaacttttcatcacatctaaaatttttctacacacataaactcccaacttttttttccaaactatcaactttcctcaaacttttaacttttttttaggaactaaacacaatcttaagctggaattcactctgggtgaactgatgaatggacaggctcaggtactagtactggaggttaagaatatcgaattccgtggtgaaacaaagactttgctcatgattttcaaaaatcaaattatggactcctcctagtttcttttgtcctgatggtcccacatccagccttacttaacctttaaagacagaggcacctgctgccaagctgccttttgcacctgcaggagctttggatataaaaaaaaaggagcaaaaggagagaattctccaactaggctccagtaagtgccacctagtaatccatcattaaagcaatcaagcctcctcctctccctaatcccatttcacaccctcaataacaccacatccagctgcttaagctaacaaatcttccattataattcaagattcccatcacctgcccagtccatttctcctctactactagtaatactcttctctcttctcacagggagtgtgtgtgcctccatgacagtgctcgctctccctgagccgagagagtaaaggctctctccttcacacacctaccgcctactctcccactcttcttcccaccccactcgtgtgcgcgccactgccgccggcgatggcgccaatgccggcgccggccgtggctctggcggttctggtgctcctctccgccgttccggggtacttctccgacgacctcaacaccgacgcgcaggcgttgcaggcgctgcggtcggcggtggggaagtcggcgctgccgtcgtggaacagcagcacgccgacgtgcaattggcagggggtgacgtgcgagagcggccgcgtcaccgagctccgcctccccggcgccggcctcatgggcaccctcccgtcgaacgtgctcggcaacctctccgcgctccgcacgctctccctccgctacaacgcgctcacgggccccatccccgacgacctctcccgcctgcccgagctccgggccatctacttccagcacaacagcttctccggcgaggtcccggcgtcggtgttcaccctcaagaacctcgtgaggctggacctcgctgggaacaagttctccggcgagatctcgccggacttcaacaagctgaaccgcctcggcacgctgttcctcgacggcaacagcttcaccggcgagatccccaagctggacctgccgacattgagccagttcaacgtgtcgtacaacaagctcaacgggtccatccctaggtcgctccggaagatgcccaaggactcgttcttgggcactgggctgtgcggtggcccgctcggcctgtgccccggcgagaccgcgctcacgccggccggatctccggaggttcaacctgctggtggaggcgcggcagacgccggcggcgcaagcagcggcacgaagaagaagctctccggtggcgccatcgccggcattgccatcgggtgtgtgttcggcgtgctgctcttgctggccctgatcttcctcctctgccggaagaagtctagctcatccacgccagcgacagcggtggagaagggtcgtgacctccagatggctccgatggacatggaaccaaagggacagaacggctcagcagccggcaacggcgcccacgtcggagcagccgcggcagcgccagccgccgccacctccgccgccgtcgcggcggcggcagcagcagcgaagaccggcggcgcgacgggcgggtccaagaagctcatcttcttcggccccatggcggcggccccgccgttcgacctggaggacctgctccgcgcgtcggcggaggtgctgggcaagggcgcgttcgggacggcgtacaaggcggtgatggagagcggctccgccgtggccgtgaagcgcctcaaggacgtggaccttccggagccggagttccgggagcgcatcgccgccatcggcgccgtgcagcacgagcttgtcgtcccactccgcgcctactacttcagcaaggacgagaagctcctcgtctacgactacatgtccatgggcagcctctccgccctcctccacggtaaaaaaaattcccccatcctttttttacgcttctgtcggcgaaccgaatccacactatcaaaccatgcgtttttttgagcgatctcgccgttacaccctggcgatattcctccggtctccagtttccaccggtggccgcagtggcgcaccgcgagagtcgtcgcctcgttgggctctcgcgtaaggtgtcgcgtccctctcgtgtgtgcatctcgttttcgtggcgtctgtctcgtcggggtcgcggctcgcgactgtggctgctccgcctcggcaccaatcaatggtggtctcacctactccgatccagtagtgatcctccggtttttcttctcatggtgtggccgtgtgtcgccgagccaagctgagctggttcgacggggcgctgccaaaagccaagtgtacttcgtcctatgggtgagccgcgattagttagtttaccagcaaacaaacactgcttcagtgtttgccagaggggtgagcgtgagatctaatcttagtttaagcccacaacgtgacagccatgactggccccccggcacgtctcggcattcgaactcgcagttgaaacaggtatagcaacttgcggctgttcatttgaaatctctgaactggtgccagtaaagtaagcagagtgccagagtttagtgtaggagggagttgtggtagattggtggtaaatttgggggcaagtggcgcatgtgagccggtgccccgggttgcagtccgggtagggtggtttgatggaccatgtgacgtttggttggcgccactgttcctcgcgattccccttttgcgcgccaataatttagcctcctcctctcctctcctctcctctcctctatctcgcgtacagatttgaagaattattcattcccggacagcgtagacagatcatagatgtacacgcgcactgttgcacacacacttgagacgtgaagctgaagctaccgcgctgtggtcgcgtgcaccgtgcagtgaacattcttaattgtccgccgtcgtgaaaacggagtaaaattcatggggaattcgctgtggatgacgcggtttttttctggtgtatctcatgggggttgcagggaaccgtgcttccggcaggacgccgctggactgggagacgaggtcggcgatcgcgctggcggcggcgcgcggcgtggcgcacatccactcgacggggccgacggcgtcgcacggcaacatcaagtcgtccaacgtgctgctcaccaagaactacgaggcgcgggtgtcggaccacggcctccccacgctggtcggcccgtcattctcgccgacgagggtgtccggctaccgtgccccggaggtgaccgacattcgccgggtctcgcagaaggccgacgtgtacagcttcggcgtgctgctcctcgagctgctcaccggcaaggcgccgacgcacgccgtcgtcaacgaggagggactcgacctgccgcgctgggtgcagtccgtcgtccgggaggagtggaccgccgaggtgttcgaccaggagctcctcaggtaccagaacgtcgaggaggagatggtgcagctcctccagctcgccatcgactgctcggcgcagcaccccgacaggcggccgtccatgtccgaggtggccgcgaggatcgacgagatccgccgctccagcctcggcgaccgtccggccaccgacagcgccggcgagggcgaggagccttcactataaccgaccagccgacattgccgtctggatcaccgtacatcgatctcagcctcagcgaacggaaattaagttggagaattgcttagttctttgcatggatcttgctcccccaggctacttttggttcatcagcaacttgtgcatgtttttttcattactttttctttcttcttcctttcttttttttcccttcttttttttgggcctttctctcacgggctttgattctattctatagcacatgtcactgtactctttgattcttggaaaggaacacttgataatgcgttgtatctatgacgaataccatcaccagctgtatggtttgctatttaaaatacgaaatgatttcatttcagctgcaggtagctaggctttcgttgccatgctttgcttcccgtctcttcttatcctggttgttagggggaggtaatggttgttggggtggctgcttccgacagagtaattaaccatcttttggttggcgaaattgccatctgatagctctctgcttgcaaatggcgtttagctagcttgctggtttagtaggttggaaaaaagattgtgtgttctttatctaggagtgatgcccaagttaacacgacgacagaaagagacccatgctcatgcaatcctgtgtttgtacgcagtttacatgacagtgacaagttttttttgtttttaaattttgagcctccactcaacggtgcagcagccccgcagtgccaccagatgcaagattagtttagcttttgcaaatgcaaatgatactcaaaatgtagagccgaatgttagcactaatgtggcacaataaattagtacgtggggactgactgaacgaatacagcagtaggctgatctttcttcattgtttagttggtactgtgaataatggaccctagaagagttataccacacggtacctcatcatacccgttaaaaatggcaccgacgatacacttatacataagccctcgtctgaaatgaattgtatttttcggaggactttttgtgaaaattaaactaatttctgtaaaaattctgcgtttcaaaggagctatgagattacatggataggctgaatctgatcatattggagaaagaaagttagcatcagcgaatagagtaagtttatagtaatacgggaaaaaattcttatatcattaaatagcacaaactctcagtctaaatcatctgataaatgtggattttattcgttggtccatcttaccataggatgctgttgctgctacaatttgttgacagggaaattaatttattattgttaatgcccccatgataatatatagacctaacgcatgcgtcgttagcctgttacattccgagtttcaacgctgacaatttgtcaaattgataatgagcaccttcagaaaaagaaactgataatggacggctcagattgcctgtcttcgatttcctgtacccgtgaagcagtatattactccgtacacggattggccagctgatgaaactgggctagcgggctgtctaatgtcaaaccagctggcacactagttgctggcttcaattcgttcattgtagctgccaattaataacatctaatgaggaattaaagacgcatgtagtacgccattaaccaatagtccccagtggcccactacaagtacgaaccgaaccgtttgtaaatgtttcactcctcatctcagatcagcattggtaattttggtagttttgtactgcacctgtaacctgtaaaagtagtaactagccaagccaacctgagcagcatcagccagcaagaagtgaagaacatattggctgtacaatgtgtgctatactacactgttccatgaactgtcggccggcggccattgcagcatgcggcctggcttacagcctgaaagcgaccagctctgccttttggctctggagtctggacaccagcttgctgggtcatgcctcgtcggaatcatcagattctcctgctgctacagccggactgatactattaatttattcctaatcccggttggttgtcctcgtcgatgttctatttgtgtttaagtttagctttgtctgtcaatgataacaaggttcttttggaaagaggaaataaaaaaaaaagataaggactcttttggatggaggacttttatgggaattgaagtaattcatatgaaaatcctgtaacatacatgcattccaaatgagtctttgagtgtttatgtgtgtttcattacgatctgatttagaggaggaactttttccataataatgtgggagttgaactatttatgtgaaatttctacgacattctattgaattactaaagttggccttaggcctcagcatatgctgctgatcatttttgttaggacaacatccatcagagttg

SEQ ID NO: 50086 - DNA, 2398 bp, Oryza sativa
catttactttcgttttcctatgtacctatgcaccgaattcttctctgatgccccaattccatggcagttgggtctgttcttgctgctacacatcactagcaagtgtgtgcacaggtgaagtgacctggacatgatctttgtgcagttttgcatttggttaagagtgagctgtgaaacctctaatataggagtagcttgtttggttgtaatgatgaggtggtaaagtatgagatgcctagcttggattccgatttgatatattgctacaggtcaaggagtagggaggaagtgatctggattatgatattttattgttactaccacttgataatgcttgcatattgccttgtttaaaaaactgcttgcaaattgcagatagctagtcgttagttgagttttttttttaaaaggaatgaatgtttagaaacgaaggagcgtgatttcggacgtgtaatacgttgtgatagggaataaaagaatgcataaacatataaataaaaaacacatgagaagagttgacgatagaaatcagaccgttcaatagtacctgcgtgcaattaactatggaataagctgcagaccagaaaaatggatatatgacacaaggttgtttattaaacattgttaagcctagtcattggaagattatttatataactgcatgaccttgctgtaatgatcctctgattgacagagcctcatgttgagttaaaaacggctttctggatttcatttcctccaaccagtttcagtgacttgccatgtactgaatcatagtgttgaaaacctgaatagtttatccttcatttcttcaccaagaaggcaaaatatagtagagatatattagcaatgctaatgctgccgatttataccgttttgtgacaacatctgcacatgggtaacaattaacaaatcccatgtagtcaaattacttctaccccaatcgctgattttctcaatcccgataaacaaaacctatggttacacccaacaagtgtggtccaggatcatgctacatatcagagagttgactatgctgatcagtggctgttagctcaacactggatcttgcaatgttcactgaagcatgcctttcaaacaagcattaaatacaagctccatcccgttgcttcacttgataaaacagtaaagcaaagtgaaatgtattattgcctactgcctaatgacgaaaacgaagcacgtccaaacccataagagtggtcatgcattagtagtttggactaaccatctagcttgctaattggtactgtaaatcaccatctattcttagcttagctcacattataggatgactcagccctgacaccagccacgtttgctcctcctgaaagacaatcatataaatagtcgtcactagcagaatcgacaatcgagttagtttaaccaaaaaccgaacctggaaatgctcctacaaaacaatctctgcagacagaggaatcattgtttcattagtcacagtgaatgtgcgcctagctgtaccttgcaagaaaatttttaattgtcagacaaaatccatctgcatcgaaaccatttgattctgattgcttcctaatacctaccatgtatagtgtcatccgtgtctgaagagggcggctttcttgttgcaattgacatagagctctgggttacagatgtgttcgttcttttcactgatttccattatatataaaaaaaagtagaacttttcagtgaacatggagagggttgtaactttaaacttttgtctcgttgtcgccatggaatcgatcgagaccaggtcgaaggcttgatgacaacgcaaagccgcacggtttcttctcctctctcgcctgcggtctgtctgcgtcgatgggcacgggtagaagaagaccaaaggccctgttacatccttcaaaatggcaaaagttttgttattttgtagcactttttgtcattttggatctaaacactaataggaaaagttgttaatttggcatttgctagtccatagtagtaaattgtgccaaaaagtgctttgagaccactccctctctctttctctctcttactttagtgctagaatggcaaaaatttaacatgcactaaacaccaactagtacttttacaatgccaaaacttttgtcatttgccatttgccattccaaatggatctaaggccctgattagatccttcaaaatagcaaaagttttgccattttgaggcactatttgccatttggatataaacagggcctaaacaggcccaaaaacgagcatcgcgttttctttatcgaaagaagagaaagttagaagcaaagcatgagcagtggaaagtgacaagttagctcagacttactaatcatacggtcataagggctttaattcaatcgcacaccacagataaacaagggctgcagga

SEQ ID NO: 50087 - DNA, 1582 bp, Oryza sativa
cttcaaccaaatagtcatgacaacccactcaaataaaccaataaatcccgggcacctaaaagccgtcttgtacatatcctcttctgccataaaaatttgattgtagctggcattaccatctagaaaactaatcactttatgacccgaggcatcattaatcatcatgtcggctataggcataggatattcatctttgggagtagttttatttaaatctctaaaatctatgcaaactctaatcttaccactccccttcttctccaccgggactatgctagatacctactccgcataacgacatggcctaataaaccccgccttcaacaaccgatcaatcttctctttgactcggtcatatagcaaaggattaaaacgacgagatggttgcttataaggcctaaaacccggtttaattggaagccgatgctcaacaagctcacggctaagacccggcatctcatgatactcccatgcaaagcaatcaacatactctttaagtagctcgattatcttaaccttataatcggctttcatatttttgtttacaaaagtcggccttggtttagtttcatcacctatatctacttcttccaaaggatcggccgatgtaaaccctttcccaagcttttttacttcatcaaaatcttcaacggtttcaccaatatcgttctttgtagaccgatattcttgcaccctcttttgtaaccactctaaattagcctctttactcattatacaaatttacatggcttagccatgctacactagctggctttacagagataagtacaaatttgccatcggagatactaataaaatcataactagaaagatccctccccgataagcattggatattcccatgacgccactcaaaagtagcatcggccattgcaacctcggccgatgtatccgcttgaacaatctcaacatcatcaccgtcccattgaattaaacattgatgcaaggtagaaggcacacaacaattggcatggatccaacaacgacccaaaataacattgtagttaccttgcacattgacaatgaagaaagcggttggtagcgtcttgtttcccacggtgagctccgccgaaaagatacccttcgcctccgttggttcaccattgaagccattgagaatcatgttggtctttttcaactcatcatcctcacgccccaacatcttgaataatgaatacggcatcaagttcacggcggcatctccatccactagcatcctagagaccggtttcccatcaacatggcctttgagatagagaggcttcatgtaacgattcgactcatcgggcttctcaaaaaccgcgtctttaggacctaatgagaattgagcaacctcggcttcatccatagcacaaaactccataagcaacatacataccatgttgatatccatgtcttcttttggagacaattcacctttatcaaccgattgttcttccttctcctctacatcaatgggttatgccttctctatggatttaggcatccataccggtggtggtcgcaactcattaaacattttatccctttgctctttggcccttttctctcttagctcttg

SEQ ID NO: 50088 - DNA, 17730 bp, Oryza sativa
gttgtccatgggatggtatggaaggacacatagccgatttgaggttagcttttgagaggatcgccggtatggtttgaagatgaacccacttaaatgtgcttttggtgtgtcggcggggaagttcttaggattcatggtgcatgagagaggagttgagattgatcctaagaagatagagaagagtcgtgatttcaaagcgccgacatgcaagaaggaggttcaaaagttgctaggtaaagtgaattatttgagaaggtttatttctaacctagcgggtaaaatcgatgcttttgttcctatacttcgcataaaaaaagaagccgattttatttggggggggcaaaacaacaggaggcgtttgaagagttgaagagatatttgtctactccacccgttgtgcgagcgcctaaagccggaaagccttttcggttatatattgcctccgaagacaaagtcattggtgccgttttgacacaagaggaggatggcaaggaatatatcattacatatttgagccgccgtcttttggatgccgaaacgaggtatgtttttatagagagactttgtctattcttatactatgcttgtaccaaattgaggcattatttgttatctagcacatgcgttcaaatacacattgcctgatgaggatttatatcgccgaaatatagatgatgtcttgttggagtgcttagataaagatcaatctaaagtggctatgggagagatacatgaaggaatttgtggaactcatcaatcggcccacaagatgaattggttgcttagaagagcggggttctattggtcgaagatgattgatgattgcttcaaatattatagaggatgcaaggcttgtcaacggttcggcaatgtttaattggcacctgccgccgtgttgaaccccataattaaaccatggccgttccgagggtgggctttggatttcattggtcaaatatatccttcgtcatcaaaggggtataggtttgtgctagttgctacggattacttcaccaagtgggccgaagcaatgcctttgaagaatatgactcatatggaggtaattgactttattttgaagcatattatccatagattcggtattccacaaacattaactacggatcaaggtgcttcttttatgtcgaaagaagtgaagaattttgccgaatcttatggtattaaattgttgagttcttctccttactacgctcaggctaatggacaagccgagtcgagtaataaaacattgttgaagttggtgaagaagaagattgaggaatacccaaagaggtggcatgaggtgctttttgaagcattgtgggcgcataggatatctaaacatggtgccactaaagtcaccccttttgagttggtttatggtcaagaagccgttttaccggtggaggtaaatcttggttctcttcgtaatgtcaagaaagatgatttgtcaagtgaagattacaagacgttgatgggagataatcttgatgaagtcatcgacaagcgcttgaaggcattggaagagatagagaaagagaagaagagggtggccaaggcgtacaacaagagggtgaaagcaaagttgtttcaagttggagacttggtttggaagacaattttccctttgggtactcgatccaaggagttcggtaagtggtctcctagttgggaaggtccttatcgagtgtgcggcattgttcgagggaacgcatactttttggagacacttcaaggggagcgttttcagcgagcgatcaacgggaaatacttgaagaaatacttcccgagcgtttggcaagacgcttaggaggtactatggccggtaattgagttattgtcctaagaccaaaaacatgttctatgcttttagattcacgttgttcataaaaaaggcagggggcatgtgtttacacccaaatttggcacttaggattaaaataggaaagattgccaaaatttggaagtctaccggtttcctccgagtgggccggtctgaccgccgggcggtcagaccggcagtgtgtggccggtctgactggcaggtccgagtccgactgtgttacgtcgggtttcgaggtttccttgctcgggaaggcatgtttcgggttttctttagtttctaccccgagttggacgtggaggaaggcctgtagagggcaggaccaacccctatataatggacatggccggttcattgtaaaaaaccaatctacaatccatcaatcgaatcgttctttttcatattgcttttagttttctcttagtttgtccatctttgttggtttgcgccgtaaaccgtccgccgccgctgcgagagtgtgacatctctttgtaggtttgtcctgaaaaccttccgttttgcccaggagacgcgtagttatctagaaatcggctccgctagccagtttagttatcaaaacccatctaggtttagctctttgctagatcgaggtggttggcgactctaggatcactgcaaggcttaaggtgctgcgatcgtgcttgtcaatttgtcaaaaaagttgccaacagtattgtcgccgttccgggagtttcaaccttcctctctaccagccaccaacctccccgagtgcgcgtcgaccgggaacacaatatgccaccgacgtcgccgcactttggccactggaagcccgacgccccgctcgcccttttctctccctctctctcggctcctaactgaagagaaggaggaggtgatgggaggaagaagaagaggaggagagagaaagaaaagaaaggctgacaggtgggccccactacagtactatttcacattttctagatttaattcaaattccaatttttagaagcccatatctcctaaaccgtagatccgattccaatgaaacttggacctaaatttatataaattcaaatcctaccttttggcactaaatttgctattgtaatatttatttgaattttcttatttattcaaatgccgtttgaatttatgtttgccttttcaaatatttctttttaacccaaaataccctttagccactaaaaagccgccggttggaactttacgcctttcatgggaacgttcgtgcggtctaccgaccccgacgtcggaccgtcggttgtaaagcccggcaaaaccaaacctaaggtcgaagtgctgctcctggcaccccacgcctcgatgcgtatagtggtcggagcttcactattccatcgacctccatagcacaccgcacagttagctctcgggctctgtgtgatcctagccgttccgtggccactcacggttatcggagtaacacttccaccccgctaaagcttcacaatcttcttatccctctagccattgtattgtctatcaatatcggctagacacctaacctagtcgtcatactatccaattctaatgacgactagcaaacacccaaatcccagtcgatattcatcctacctcgatatcggcttaatcaaatgaaaccccagccagcctgctatccaaaatccataccagccatttactctccaactacctagaacctacacataaaatatagagcctggccgatatattgccctactcctcaatcagcctaaatataaccaaaccctaggtataatcctaccttaaatcctagtcattcttctacctgtggtatttcgaggatcggataatcaggttgcctatctcggatttatttgtgttggagcaaggcaagttattattcctcccctttgatcataataatcctatattctatatctccagtatcttgtgcattagccatacataatttttaatgcataacctgaatatatagcaaaccagatatatgctagattttgcttagccatgcctagttagacggcataaaatataatgaacttagattggaacagtacggaagaaatggttgatttccgggtggctagtactgttccaaccgacataagactgccaagtacatgtgaagaacatacgagtacgaccgcaattctcgtatgggcatagacctagctgactacgttatctagcaaaggtggtacttctgtatagtggttcttcttaagtcctcgcgtaggaggcaaatttatgccgcgaagggcaattatgatatttaccgaggcgcaggtaaatatacttatattgatagtccaggggactatattatggccatgtgattttattaaccctgattgcgatgacatggtgtcatacaatcagttctctctaaatacctcgagaatgccagaactcctcttgctgctgataatgttatgttcagagcgcatgggaactagagttcatggaacaggtaccactgatgttagtaaccgaaaagctttgccatgataatggcacgtcatggattgcgggtaaagcatacatctactgcagtatgaatattctcaaaactattcgaatagccgtgctcgcggttatcgggcattgggactcacaatggcatcttggttagaaacttaattccaaacattattaaatattgtttgtcgcgtcccaaaacgactctaaaatatatcctttaaattatgcctagaataattaaaatctgtgtgcaagccttcaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaaaggttttataaaaagaaaaactctaaaaagtctttttaccccctccccttcttgggccggctcggcccatctctctccctctctctcctcttccccgcggcccattcggctcctccccgcgcgcgcgccgctgacgggcgggcccgcccacctccctcgctgacgggtggggcccacccgtcatccccttcctcccgccgctcccgccgccccgcccgcgccctagcgccgccgccgccgcgaatcccgccgcctcccgccgtccccgcgcgcaataaagagggggaaatcactccccgtgattccctctccctttccccccatttttccctctctctctcgttcaaacgggcggatttgccccccacaaatctcgccggcgccattgatggagcccgagagcgccgcgccggtttccttctcctccggccgccctctctcactaccaaccctatataaaccctccccgcacctcctccgtccgtttccgccactcgccgcccttcctcctcgccggaatcgagctcgcgccgtcgctctctctctccgccgtcaccgccgagctccggtccgccgccgtcgtcgccccggaccacctcccacctcggcgccgcctccttcggcttcgccgcattctcgccgacctcgtccacccctccgtttcggtcgccatccgccggaacgccgtcgaccccatcgacccgagccgcgccgccgccttccttcgctccggtcgccgtttccgtcgtcgccgtcgacccggggtgagccgtggaccgccgcttcgtttccccctttccctcccctctctcggccgccgctccgccgtgcctatggccgccgccggcgaccataggggcgcgggcgcgccacctcccgccgctgcgccggcgtggtcgccttcgggtgcaccgagcggctgccgcgtggggcctggctgccagccgcccgcgcccttaggtgcggctgacgcgtgggacacacggcgccggccggtgcgcgcccgggtgcgcccggttcaccgtggaccgtgaggctgacgcgtgggccccactcccgtggacccggtccgcgcgcccctcccctcggttgacgcaataaatccatttttgaattaaaatttaaatgaagaaattcgcaaatattcatttaaagagcatataaacttcaaatggccataacttgcccatttgaactcggaattggaccgttcaagtctctaatttttccttaagaagtcaagaacccatttttgtgctttgtttctgctgattatatggagtttattagagtaaaagccttttcttttccgttggtcgtgtagacgctgcagcttcggaagatccgctcttcgtggaagttgaagccgacgtttgggaaagcgagcaaggcaagtcacatcatcctataacatattgaatcccagtttataaaattattttgatttaaattattgcattatcgctttatttaaattcccgcgttatcactgttttatctagccatgcctatttacctttgttatgaccttattattgtgattgttattattaccttgttcaccctagaataaacaaaaccccaactagtggacactctactcatggtaccactagtatgattttaggtagatgcttcgctgtttaattaggtaacattaggtggttttacaactctagactttgggaatattctcatcacctggacacattggaattgttggattattgtggaattggattcacacctctccctctattcaaaatccccaaaatggttttaggctgggctcggggtgcatggttttgatagtagcaccacggccatataaggaccggtcttcgggcctctgttgcaaagcactaccgtacttccacatgtctagtgggtaaggcttagtttgtggctcagtctggttataaacaaaagtacacggagcaatgtacccaagttagtgttttcattcttaaaacctgcttaacaactaaaacgtggaacggttggccatggttggcttgggacgagctgggacccagggtcgggttgccagttcggtctgaatcatcgtaggccttgggttaaggcaggttcgtgtgggttcacggccttgataaataataatgtatagttctagaatcgtgtttacaaaatagctttgagcaactaaatgtctttaaatgctgtttactgcaaaccctaatcctttatattatgattcccttgtactcccttgcatttattctgcacttgtgggtgtgtcttgttgagtacggtggttgtactcagtcttgctcaatttttcccaaacccagaagaggagcccctagaagttgaaggctttggtgtctagctcgtgcctgccgtcaagcgcctgtggtcgtcgccctagtcttccgctgtttcccgtttgtctttgtgtgtgctgggccttcgtcgcccatgtaataaattaactatttacgcttccgcttgataaactctgaaatgtatcaactcttggtgtaccttgcctcctgggacaaggaataatacacgcacgtaaggaacgcccgttgggttaattccggtcgtgacaagttggtatcagagcccccttgaccctaggacgagccgtagatcccaagccttagcaatattttcaaaataaaaatcctgtcttatttgtgaaaattctctagtctctctctgtcctgctgcttcatttattgtcaaaatctgacctttaaaatgttgcttttctttttgtttttgtttgtagatggccggtagcatcaaccgtcgtggtctggacctgactggcttcgttttggagctgcggggcatgtgcgttgtcctggggtatccgcatggagtggactaccagggcaggcagctcccggagcaggagggtgacgatgcagagctccacgctgcttgggaggttactgcagtgatcctcactggctcacccgagaggacttcgttgacagtcaccgcgggtggagattctttcttcgctgcttgccagaacgccgcactcctcgccatcggcactcttcaccagcgctacccggacgagttgcagcactcgccctaccgctaccaccctcgtcgcggaggagcccgcgactacgccaccttccgggatgctagctcggaggatgacactaccatcatgcatctggcgcgcatggtggaggcgtacgacgcggctcgtatcgacttccatcagatggtgcgccgtgggatggtcgagaacaacatgaagatcctggagctgcgtcaggagaatctgcagctgaagaaggatctagacgcagtggaggcgcagctgcatcagctcaagatcgcccagggagaggtctgtcgccccaagcgtcgccgcgtctgccgcagccagaagatcaccacccgcaagagcacctccaggcccgagcttgttcgccagtccttggcatggacctgcttcgtggagacccctcgtgccgagcccgcgcccgtggttcctcaggagggggaagcctccggcgttggtagcacggaggatgcgctgctgctcaccttccgtcctggcccgtcgcagcggtagacgagcagttagtaggcttgcgcgtgtgtctttctcgtttgtcttcttgttggagtcgtgtggggcatggttatgccggtgtgtggtataactgtgtcggagcctgtctttattttatttgcctaagcaacttgaactttaatgaaccaatttaatagcagtaataaattcaagaattatggtaatcgtgggtggttagctttaattgtcagctctctctgtttgctggttctgtgtggggttttcagatggtgacgaccaggagaaatgctaatacaggtgatggcaaccaacccgaaggcagcaaccacaacaaccatggcagcccacctctacctcctcctccgcctccaccaccaccaccagacaccaacgccattctcacccaaatcctcgcccagcaggccaacatgatggctgctttcctccaccacatccaacatccgccacaacataatgctccaccaccacccccacaacactccaaactcgccgagttcctccgcatccgtccaccaaccttctctagctccaataaccccgtggatgcgttggattggttgcatgccgtggggaaaaagttagacaccgtgcagtgcagcgatgaggagaaagtcatcttcgccgcccaccaactgcaggggcccgcatctctatggtgggaccatttccaggctacgctgccagaggggcagcctattacttgggcccgcttcaccgccgctttccggaggacccatgtgcccgccggagtcatggcccttaagaaaagggaattccgagagttgaagcaaggcaaccgcttcgtgatggagtatttgcatgagtttaacaacctggcccggtacgccccggaggatgtacgggaagatgaggaaaagcaggagaagttcttggcaggaatggatcctgagctgtccgtccgtctagtctccggggactatccggatttccaacgtctggtggacaagagcatccgcttggaagccaagcacaaggaactggagtcgcacaagcgtcgcttggcgagtttccgcaaccaacagggggctaaccaaagggtccgctacaccaatccctatccagggggatcctcttcacagcagcagcaacctcgctccgcgccccgacctcaattcgtggtgcgcgtcccacagccgcagcaacagcagagtcagcaagggacttgtgcgccccgtcctccaacgccagccgcgcagcttggtcaaggccgcagggacgttcaaggtccgcagcgtctgtgcttcaactgcttcgagcctgggcactttgcggataaatacccaaagccgaggcgccagcaaggccaagcgcctccccgctccaacaacggtggtaaggatgtcattcggggtcgtgtgaaccacgtgacggccgaggacgtgctgacaactccagacgtcatcgttggtacgttcctcattcattccatccctgctaccattttgttcgactctggagcttctaactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttcctcggatctgattcttctagacaccaagaacttggatgtgatccttgggatgaattggttggctcaattccaaggagtagtggattgtgcaagacgcactgtcactctgtaccgagggccggaacaaccggttgttttctttgcacccccaacctctgtcagtagttctgtcacgtcctgataaattcatcccgaaataaaaatcattcgctaaaaggaataatagaattaattaaaattcgaaaagaaattggcaaacactaaaaatacgtacaagaaaaattcaaatgtggcccggagaatttttgttaaattctccttggtctaaaaggagccctcaaattttacttgaattttcagagcaccggaaataattattaagcaacaaaaacaattaacaaagtttattaaaaagaaaacctaaaaaataatcctcctcttcctttgggccaagtttggcccaaagtctcccctctctctctttcggcccgccgccgaagtctccctttcctccctctctttctctccctctccttctctccctccttctcttgggccccccttcccctcggcccagctccctcctccctctctctcccgggctgcctttcccccccctcccctcccggcctgcccggcccaagccgcctctccccccccctctcttcctgggccggccgcccgacccaagccgcccctgcccgagccgccccctccttccctcatgcacgcgcgccgcacgtgcgctgacgccgcgcgcctcccgcgtgggacccgcctgtcaggcgcgtccccgacctccagccgccggccttcttcctctccctcccgtgaaccctagcgccattcctcctctaaatccgctctattcaagccggctctttccaaattgattgggggcaattaatccccattgattcctcttcgatttcccccgttttcccccttgaatgccgcccccaatcgccgggaacgcccgcgtcttcctcggccgccctccattgccgccggccgtggttctcgccgccgttccgacctcccccgtggccggttccctctcctctcctataaaatagaaccccctctttgcgttctaccgttttggtctcttcccaagctctcccgtggtctctagccacctccccaccgtcgccctctctctcccacgttgccggccgcctccagccgcctgtgccgcctcgaccgtgcgccggccggccgcgccgtcgcctcctccagcgtcgccgccacctcctccaccccggcctgccctccgtttcgcgcggtgaccatcggaggcgcactcccgccgtcgcccttctcattcctccttgccggccacctccagccgcacctcccgcctcgcccgtgcaccctccggccgcgccgccacctctcccggcgtcgcagccgcctcctctttcccggcttcgcctccgtttcgcggggaaatcaccggagacgcgtcctcgccggcgtccagtggcgtcgccaccacttctccgcctccggccgcctctgccgcgtccccggtgcgccggccgacgtcgccgtctcctccgttgacgtcgcagtgccgtcctctctcccggccaggccacggcgtcgcccgaatttcgccggaacgccgtcgtctccgcgccggcctctccttcctcctcgtcggctcgccaccccgctgcaccaccaccttcaccaacatcgcagcggcgtgttccacgccgtcccctcctccgctcagccgctgctgcctgccatcatcgtttcatcgtcgtctccgatcgttctcgtcgtcgacgtcccatcggtcgcccggctcgtcgtctcgcggcgccgcctccgtcgtcggcatcgtagcggcgtgttcctcgccgtcctcgtccccgtgcagccgctgccggctgtcctcgtcgcctcctcgccggtcccggtcgtcgtcgtcgtcgtcgtcctctcgtcgttcccggtcatcgtggcgttcgtccctccgtcgagccgttctcgtccgtcgtccgcgtccgtcaagcaagccgcggcagccccgtcgtcgtcttcgtcctcggctccgcgtcgtcaagcctcgtgccggccgcgtctcgccttcgcccaaggatcgccaccgaagccgtcccctcgccgttcgtctccgttgtgcccgtctgtctccgccgcgcccgttcgtcgttgtcgttcccacgcctcgtcgcgtggtggtaaggttccctctccctcgctgctctgtcctcgtcctttcggtgtcgcccgtgcccgttgtgcggttgtcggccccggtacccgtgtatcggcgtcggcagtcgttcgcttgtgcgcgtggtgaccgtgttagtgtgtccgctcggtagccgcgtggtttccacgtgtgcagtccgtgtggtgtctagtggagtccgtttgtcggccactcgcctcggttgacacacgggatccgcttccgtcgacccgtggaccgactctgtgtactcggtctaccgcgatcctttaggttgacatgtggggtccgcatgttaacggcgcagccttcctgtcttttccaggctagcgcttacacctgttttatagttgcaaagcctaattataataatccgcaaatctccatataacagcattaaacttcggatgatcatatcttggtcatacgaactctgaatcgacccgttcaagtctcctaatgtttgttataacctaaagaaccctgtgctttctttttatgtgttgttattgcttctttataggcttgtagctttgcttgtgtgcttcgcgtagcttctgtcgttccggaggttcccgaagcgtggttcgtggtcgtcgccgtaggttcggaaggccgttctctctgagcaaggcaagtcacatcatccttgaacatattgaatcccagtttgtaaaattatgttgatttaaattattgcattatcgctttatttaaattcccgcgttatcactgttttatctagccatacctatttacctttgttatgaccttattattattgttattgttattattaccttgttcaccctaggttaaacaaaaccccaactagtgggtactctatttatggttccactagtatgaatttaggtagatgtttcgctgtttaataggacaacattaggtggttttataactttagactttgggaattctcatatcatttggacactatggaatggttggcttatgttggaattggatacacacctcccccgctattcaaaaccccccaaaacggttttaggctgggctcgaggtgcgtggttgggttttgttagtcgtacctcgggcactataaggattaagctcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcgtggcagagggttggtgccctgctgctagggggctcaatcctgcctacctgtcccggaggttccggccgtagggggattgggtcggtactcttgtttatggctaggatgggttgggaactatgtcacgtcttccgtccgtataccgtggtggtatgtggcacgtggtcgcacgtgaggaagatgtgtcttgtgggtaaagatgtacacctctgatcagagtataatctattcgaatagccgcgccctcggttatgggcaagccgagcaatgtacccaagtcagtgttctaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctataggatcgtctttataaaatggctttggggcaactaagtgacttttaaaggctgttactgcaaaacttaacctctatattattacccccttgtactcctttgcattaattgtgcatctccggtgtggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggcgtgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagttcagaacttcatcagataggacagtcaaaaatccccatcgtcagagagttcggagacgtgtttccggaagaactacccggtatgccgcccaagcgagagattgagttccggatagatcttgctccaggaaccactcctctgtacaagcgaccctaccgtatggcagcaaatgaactggccgaagttaagaaatagttggaagagttgaaagaaaaggggtacatacgtccgagtacttctccctggggtgctcctgtgatttttgtggagaagaaagacaagacgaagaggatgtgcgttgactacagagctttcaatgaagtcaccatcaaaaacaagtaccctcttccccggatcgatgatctgttcgatcagcttaaaggtgccacggtattctccaagattgatcttcgttccggatatcaccagttgcgcatccgtgaagcaaatatcctgaagaccgcattcaccacgcgatacggactgtatgaattcacggtgatctcattcggtttaaccaatgctcctgccttcttcatgaacttaatgaacaaagtgttcatggaatacttggataagtttgttgtggttttcattgatgacattttggtatactcacaatcagaggaagaccatcagcaccatctccgtctggtgttgggaaagttgcgggaacatcaattgtatgccaaacttagcaagtgtgagttctggttgtccgaagtcaaattcttagggcacgtgatatctgctaaatgagttgctgtggaccccgaaacagtgaccgccgtcaccgattggaagcaacccaagacagtcactcaaattcgcagtttcttaggtttggcaggatactactggaggttcatcgagaacttctccaaaatcgctcgacccatgacacagttgttgaagaaagaagagaaatttgtgtggagcccgcaatgcgagaaggcgttccaaactctcaaggaaaagctggtttcctcgccggttttaatcttaccggatactcgcaaggacttcatggtgtattgtgacgcttcgcgccaaggattggggtgcgtgctcatgcaggaaggtcatgtggtggcctatgcctcacgccagctacggcctcatgaaggcaactaccctacccatgatttggagttagccgcgatggttcatgctctaaaaatctggcggcactatctcattgggaatcgctgtgaaatatatactgatcataagagtttgaaatacatcttcactcagtcggatctgaatcttcggcagagaagatggttagaactcatcaaggattatgatgtgggaattcactatcatcctggtaaggccaacgtggtcgccgatgctctaagtcgaaaaagccattgcaacactcttgaagtccgtggcattccacccaaacttaatcaacagataaaagccctgaacctaagcatagttagtcgtggattcttggctacgctggaagccaagcctaccttgctcgatcaaatccgcgaggctcagaagaacgatccggacatgcgtggactcctcaagaatatgaaacagggtaaagccgctggtttcacagaggatgaacacggaaccctatggaacggaaatcgggtatgcgttccagatgtcagggaacttaaacagctgatacttcaggaagctcacgagagtccttattccatccacccgggcagtacgaagatgtacttagacttgaaagagaaatactggtgggttagtatgaagcgggaaattgcagagttcgtggccctttgtgacgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggaccgattaaccaaggtagctcggtttattcctgtgaagaccacctatggagggaacaaactagccgagctctacttcgctaggatcgtgagtctccatggcgttcctaataaaattgtatctgataggggaagccaattcacctctcacttttggaagaagctccaagaagagctaggtacccgattaaatttcagcaccgcgtatcacccgcagacagatggacagaccgagcgtctaaatcagatcctagaagatatgctccgtgcatgtgtcctagatttcgggaagacctgggataagagtctcccctatgccgagttctcctacaataacagctaccaagccagcatacaaatggcaccttatgaagcgttgtatgggcgcaaatgccggacaccgctcttgtgggaccaagttggggaaagccaagtgttcgggactgatatactgagagaagctgaagcgaaggtcagaaccattcgggataatctaaaggtggcacagtcccggcagaaaagttatgcagataaccgtcgccgtaacctggaattcgcagtggacgattttgtgtaccttcgggtcaagccattgcgaggtgtacacaggtttcagacgaaagggaagctcgcacctcggttcgtgggtcctttccgtatcattgctcggcgcggagaagtcgcttaccagttggagctgcccgcctccttgggcaacgtgcatgatgtgttccatgtgtcgcaactcaagaaatgccttcgagtgccgtccgagcaggccgactcagagcagattgaagttcgcgaagacttgacctacgtggagaggccagtgaaaatcctggacactatggagcgaggagcaggaaccgggtaatccgtttttgcaaggtccaatggagcaaccacgccgaggaagaagctacttgggagcgtgaagacgagctgaaggcagcccatcctgatctcttcgccagttcctccgaatctcggggtcgagattccgtttaaggggggtatgtttgtcgcgtcccaaaacgactctaaaatatatcttttaaattatgcctagaataattaaaatctgtgtgcaagccttcaacaattaaaatgtgcaaagttaaaagtcaaataaggcttggaggatttttgtatatttcctaaaagcctaaaatgtgtaaataaattttagtggaattttcagagcaaaaataataattattaagaaataaacaaagttaaaatggttttataaaaagaaaaactctaaaaagtcttttccccccctccccctcttgggccggctcggcccatctctctccctctctctcctcttccccgcggcccattcggcctcctccccgcgcgcgcgccgctgacgggcgggcccgcccacctccctcgctgacgggtggggcccacccgtcatccccttcctcccgccgctcccgcc

SEQ ID NO: 50089 - DNA, 1408 bp, Oryza sativa
gtcacatcatccttgaacatattgaatcccagtttataaaattattttgatttaaattattgcattatcgctttatttaaattcccgcgttatcactgttttatctagccatgcctatttacctttgttatgaccttattattgtgattgttattattaccttgttcaccctagaataaacaaaaccccaactagtggacactctactcattgtaccactagtatgattttaggtagatgcttcgctgtttaattaggtaacattaggtggttttacaactctagactttgggaatattctcatcacctggacacattggaattgttggattattgtggaattggattcacacctctccctctattcaaaatccccaaaatggttttaggctgggctcggggtgcatggttttgatagtagcacctcggccatataaggaccggtcttcgggcctctgttgcaaatcactaccgtacttccacatgtctaatgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacactgtcacgtcctgataaattcatcccgaaataaaattcattttctaaaaggaataatagaattaattaaaattctaaaagaaattggcaaacactaaaatacgcacaagaaaaattcaaatgtggcccggagaatttttgttaaattctccttggtctaaaaggagccctcaaattttacttgaattttcagagcgccggaaatatttattaagcaacaaaaacaattatcaaagtttattaaaaagaaaaacctaaaaataatctctcttcctcctttgggccaagcccagcccgaagtctccctttcctccctctctttctctccctctccttctctccctccttctcttgggcccctcttcccctcccggcccactgcctccccctcctctctctcccgggccgtttcctcccccctcctctcctcctgggccgtgtcccggcccaagccgcacccccccctccaggccgatccgcgcccccgcccgtgctgcgcacgtgcgcgcgctgacgacgcgcgcccgaccgcgtggggcccacgcgtcaggccgccgtcgccttcttcctccagccgccgcccggcttctctctctcccgtgaaccctaatccttccctccctcaaatccgtgtgattcgctcttgggattccaaaattaaataggggaaattaatccccattgaatcctcttcaatcccccccaatttaccccttgaatggcgcccccaatcgccgggaacgcccacgtattccttggccgccctgcattgcc

SEQ ID NO: 50090 - DNA, 9801 bp, Oryza sativa
  unsure (1)..(9801): unsure at all n locations
gccggtcccggtcgtcgtcgtcgtcgtcgtcctctcgccgttcccggtcgtcgtggcgttcgtccctccgtcgagccgttctcgtccgtcgtccgcgttcgtcaagcgagccgctgcaacnccgtcctcgtcttcgtcctcggctccgcgtcgtcaagccccgtgccggccgcgtctcgccttcgtccaaagatcgccgccgaagccgtcccctcgccgttcatctccgttgtgcccgtctgtctccgccgcgcccgttcgtcgttgtcgctcccacgcctcgtcgcgtggtggtaaggttccctctccctcgctgccccgtcctcgtcctttcggtgtcgccccgaacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgcctagtggagtccgtttgtcggccactcgcctcggttgacacacgggatccgcttccatcgacccgtggaccgtctctgtgtactcggtctaccgcggtcctttttgttgacatgtggggtccgcatgtcaacggcgcagccttcctgtcttttccaggctagcgcttacacatgttttataattgcaaagcttaattataataatccgcaaatctccatataacagcattaaacttcggatgatcatatcttggtcattcgagctccgaatcgacccgttcaagtctcttaatgtttgatataacctaaagaaccctgtgctctctttttatgtattgttattgcttctttataggcttgtagctttgcttgtgtgcttcgcgtagctttcgtcgttccggaggttcccgaagcgtggtttgcggtcgttgccgaaggttcggaaggccgttctctctgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattcttgttattgttattattattaccttgttcaccctagattaaacaaaacctcaactagtggacactctactcatgacaccactagtttaattctaggtagatgcttcgcaatttaataggacaaccttaggaggttttataattttagactttgggaatattcatatcacctggacactatggaatggttggcttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtccggttataaacaaaagtacacggatggaggtggatgaagtcggggtcgatggacattctccagggcaaatgaaggctacacgagctgcggcccggtagtcgagatgtcatggcagagggttggtgccctgctgctagggggctcagtcctgcctgcctgtcccgggtgtccccgccgtaaggggaatgggtcggtactcttgtttatggctaggatgggttgggaactatgtcacgtcttccgtccgtataccgtggtggtatgtggcacgtggttgcacgtgaggaagatgtgtcttgtgggtaaagatgtacacctttgatcagagtataatctattcgaatagccgcgccctcggttatgggcaagccaagcaatgtacccaagtcagtgtttcaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctagggtcgtctttataaaatagctttgggcaactaagtgacttttaaatgctgtttactgcaaaacttaacccctatattattatccccttgtactcctttgcattaattgtgcatccccggtgtggcttgctgagtactgtggttgtactcattcttgctcaatcttttcccccttcagtaagagaagctttggagaagaagtcttaggtggagtcttggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacacagggccggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttcagtcttaaaacctgcttaacaactaaaacatggaacggttggcctgggttggcttgggacgagctgggacccagggtcgggttgccagttcggtctgaatcatcgtaggccttgggttaaggcaggttcgtgtgggttcacggccttgataaataataatgtatagttctagaatcgtgtttacaaaatagctttgagcaactaaatgtctttaaatgctgtttactgcaaaccctaatcctttatattatgattcccttgtactcccttgcatttattctgcacttgtgggtgtgtcttgttgagtacggtggttgtactcagtcttgctcaatttttcccaaacccagaagaggagcccctggaagttgaaggctttggtgtctagctcgtgcctgccgtcaagcgcctgtggtcgtcgccctagtcttccgctgtttcccgtttgtctttgtgtgtgctgggccttcgtcgcccatgtaataaattaactatttacgcttccgcttgataaactctgaaatgtatcaactcttggtgtaccttgcctcctgggacaaggaataatacacgcacgtaaggaacgcccgttgggttaattccggtcgtgacactgttgcatttaaaacattataggctttcttcctttatattctttgctttctgcaagtaaacctagctctacaaaaatattaccatttcatgtatttattgttgatcaatataatagcttgctgagtacgttgtactcacccttgcttcaaccccctttttcagagtcaatttggagttcttatcgaagccgggagtttaatcatataagttagtctcattctaacttaattctcaagtataaattagataaatggtttaagtctataacaaaacactagaatttagtcattctatagcttctgctgtaatagttagccacaatcttgtaaataccctattattttttgtaagagaatccccttggaagccttgctcaaatgtatgcaatgaagatccagattgttgaacctgtatcaatctactgatccagggcttgatacagttaaacatgtcggtttccgaatcattagttttgggacccgacaatatgtatgtgtgtgtgtgtatatatatatatatatatatatatatatatatatatatatatctgtgtgtgtgtgtgtatatatgtatatatatatagaaaaactattctatacccctctctctccaacccacctcctctccttctaagggcccaaaacccacctcccaccttagtcaaaggctagtcaaaggtaccccacgtcagtcaaacccgctagcagtgacttcccccaccaccccctctcttcttagctctcgtcccggaacgacgtagtaatgtcttcttcatcgtacagtgtcacgtcctgataaattcatcccaaaataaaaatcattttctaaaaggaataatagaattaattaaaattcgaaaagaaattggcaaacactaaaatacgtacaagaaaaattcgaatgtggtccggagaatttttgttaaattctccttggtctaaaaagagccctcaaattatttattaaacaacaacaacaattaacaaagtttattaaaaagaaaaaagctaaaattaatccccctcctccctttggaccaagtttggcccaaagtcctccctctctctctcggcccgcggccaaagtcctctcttcctccctctctttctctccctctcctcctctccctccttctcttgggcctcctctccttcccctcggcccagccccctcctcctccctctctcccccaggtcgcctctccctcctctcctcctgggccggccgccaggcccaaaccgcgcccccctgcctgagccgctccccttccgcgtgcgcacgtgcgttgcacgcgcgctgactgcgtgcccgaccggtgggtcccacccacccgatcatctccttcctcccgcccggagttctctctctcttctctctcccgtgaaacctaccgtcgattcctcccctaaatccgcgcgattcaaaccgggaattccaaaattgattagggggaattaatcccctttccttcctcttcaattccccctaatttcccccttgattcgtgcccccaatcgccgggaacgcccgcgccaaccccggccaccttccatggccgccggccggcttttccgccaccgttccccgctcctcccgtggccggctccctccccacgcctataaaacgaatcccctcgctccgttctatcgttttagccccctcccgcgatctcccgtggtccctagccacctccccgccgtcgtcccctctctcccgtgccgccggccgtcttcagctgcccctgccgccgcgttagcacgctggccggctgtgccgtcgcctcctccagcgtcgcagccacctcctcttcgccggcctgccctctgtttcccgcgaagacctccggaagtgcatccccgccggcaacagtggcgttgccgccactgttccgcctccggccacctctgccgcgtcccctgtgcgccggccgacgttgccaccacctctcccggcaccggaatgccatcctcttccccggccaagccacggcatcgctcgtatttcgccggaatgccgtcgcgcgcgccgcctcttcctcggtctcatcggcacccactccggcagcccctttcgccgtgccagtgcgccggccgacgtcgccgtctccacctccggcgtcgcagcggcaagatcgccctcggcctcgcctccccttcgaccgaacccctctgcggtccatcgtcgtcgtctccgttcgttctcgtcgtcgacgtcccgtcgtcgcccagctcgtcgtctcgcggcgccgcctccgtcgtcggcatcgcagcggtgtgttccacgccatcctcgtcttcgtgcagccgctgtaggctgcccacgtcgcctcctcgccggccccggtcgtcgtcgtcgtcgccctctcgtcgttcccggtcgtcgtggcgttcgtccctccgtcaagccgttctcgtttgtcgtcctcgcttcgtcaagtgctgcagcctcgtcgtcgtcttcgtcctcggctccgcgtcgtcaagccttgtgccggccgcgtctcgccttcgtccaaggatcgccgccgaagtcgttccctcgccgtccgtctccgccgcacccgttcgtcattgtcgttcccatgcctcgtcgcgtggtggtaaggatctctcctctcgctgccccgtcctcgtcctttcggtgtcgccccgtacccgttgtgcggttgtcgaccccggtacccgtgtaccggtgttggtagtcgttcacgtgtgcgggtggtgaccgtgtagtgtccgtgttagtgtgcccgctcggtagccgcgtggtttccacgtgtgcagcccgtgtggtgtctagtggagtccgtttgtcggccactcgcctcggttgacacacggggttcgcttccgtcgacccgtggaccgtctctgtgtactcggtctaccacggtcctttaggttgacatgtggggtccgaatgtcaacagggcagccttcttgtcttttccaggctagcgcttacacatgtcttatagttgcaaaacctaattataataatccgcaaatctccatataacagcattaaacttcggatgaccatgtcatggtcatacgagctccgaatcgatccgttcaagtctcctaatgtttgttataacctaaagaaccctgtgctttctttttatgtattgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgaacatattgaatcccagtttataaaattattttgatttaaattattgcattatcgctttatataaattcccgcgttatcactgttttatctagccatgcctatttacctttgttatgaccttattattgctattgttattattatcttgttctccctaggataaacaaaaccccaactagtgggtaccctattcatggttccactagtatgaatttaggtagatgcttcgctgattaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgtttgtcgtacctcgggtactataaggattaagctcgggcctctgttgcaaagcactaccgtacttccacatgtctagtgggtaaggcttagtttgtggctcagtctagttaaacagaagtacacggatggagatggacgaagtcgggggtcgatggacatctctaggacaaatgaaggctacacgagctgcggctcggtagtcgagatgttatggcacagggctggtgtcctgctgctaggggctcaatcctgcctgcctgtcccgggggttccggccgtaggtggggttgggtcggtactcttttttatggctaggatgggttgggaactatgccacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagcctagcaatgtacccaagttagtgttttaattctaaaaatttgcttaacaactaaaatgtggaatggttggcctgggttggcttgggatgagctgggacacagggtcgggttgccagttcggtctgaatcatcgtaggccttgggttaaggcaggttcgtgagggtgcacggccttgattaataatattgtgtagctctaggattgtctttataaaatggctttgggcaactaagtgacttttaaatgctgttcgctgcaaaacttaacccctatattattaccccttgtacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagtgcctttgtaataatgtaaatattatcgatataataaagatgtgccttttgtatcatgtttgtgtggtgtaccccggcttttcctgggacggggattaatacactagcgttcgggaaaatgcaaattttctcggtcgcgacatgcagtaacaccgtgttttacttgtagtaacagaattgaaattcagtcatagtatagtcatgatggatctacttttgataagcactttttttcgaacatcatagtgcaaacggtttttaaaagtagtacatgatatgagagatattgcccttgaaagatttgtttttaaaaatttaactctccacaagtagtaatagtatatcaaaagtgttactagtgcatgttttgcgttaatgcaatcacatcatgtcgttactacaagatgtagtaacgattataagttttatattaacatagtgtgttactgcaattacttgataacattactacaagaatatggggaattggctcggtttactcgtgtgttttaatccatgttttttttatttcaggtttaccacaatttcaccacgatgttactgccaaatatgcagtaacgttctatacgttctacagtaacaaagtgttttactgcagttcttggatagtgttactgcataaacatgcggtaatgtataactggcaggtggtaatgtgtatatgccgtgcagtaacacttttacttttgtgcagtaacaagtatatagttagcatatgagactttgaacccatatattttttgtttcaattcctgatttattgtcaaaagtgcagtaacgtcatatacatgcatgcagtaacactatattagagggagaagaccggttttcttaagaagagagaggaagaacgatttcttgaggggagtatgtagatgcattttgaagttctattctccacatgcagtaaccctatagcatcattgtgaaaacaattttaaaaaataatacatatcttgtgagatattgcttttcaaatattggcgttttgaactttaacactccatatgcagcaacagaatatgtaatttgcagtaacatgggtatatatatgcagtaacatagttttaccaaatgtataaaattgttgaaaacactcctacatcaatcagaccttactcaaaaccacctacagactttacctatagcccacctattcgaccttcatctcgtaaaacagacatagtaaaactatgattatcgtgcagtaacataactacttggaagtggtaacatgcacatattatgtagtaacacttctacttttgtgctgtaacaagtatatggttagcatgtgaggttttaacccatatatttttgttttgattcctggtctactaaaattttactatgacattactgccaaaagtgcagtaatgccctatgtgttctacagtaacgtcacgtgttactgtacttttaccacaatattactactggagcataataacatgttatgagtttcggtagtgaaagatattagaattgataatcatattactttctcacaaaattcttgaaacaaataaaatcattagataaattggttagaagaatgtgctttgaactatgaggtcatgggttcaagtcttgaatttagcaatttattttttatttttctagaaaagagaaaaaatgtttcaggaagaaaaaacagaaaaaaaggaaaaaggaaagagagagatcgggaggagggagggggagcgagagaaaagcgggagggggaagcgacgggaaggggggatcgggagggcgggagggatacgggataaaaagggtaagg

SEQ ID NO: 50091 - DNA, 20702 bp, Oryza sativa
caatttcaatcatggtgccgggcaccatggagtcccatatgggtaccctatatatatatatatatatatataaatatatggattgtggttcatatgcacctcaatccgcttgttgacacgtgtacacatggctccggtgcaaccgtgtgttggaaactttttgtgacaagttgacaagcacaatcgcagcacataaacaccttgcggtgatcctagagtcgccaaccacctcgatctagcaaaagctaaactaagattggtttttataactaaaccggctagcggagcctattatagataactacccgtctcgtgggcaaaacggaaggttttcaggacaaacctaaaaagaggtgtcacactctcgcagtggcggcggacgatttacggcgcaaatcgacaaagatggacaaactaagagaaaactaaaagcaatatgaaaaatgattcgattgattgattgtagattggttgttacaataaaccggccttacccccttatataggggttggtcttgccctctacagaccctcctccacgtccaactcgggatagaatccaaaaaaaacccaaaacatgccttcccgagcaagtaaactttgagacccggcgaaactgacccggactcggactctgccggtcagaccggccacacaccgccggtttgacaggccctcaccaggcggtctgaccggccaacacacggcggtcagaccggcctaatcagaggaaaccggcagacttccaaactttggcgatataaatcttcatgcacttctcccatagccactttagattgatcattatctaaacacttcaatagaactccatctatattttggcgatataaatcttcatcaagcaatgtatatttgaatgcttgccgccgaattttccgatcaaccttaagtttaggatctttcaaatatctaatcaaaggaattctccaatccacttctgtttcctgggcacaaatgtccgaatttacaattaattcggtctttgaatcaattgcggcgtgccaccagcgctctgtccagagccggtcagacccgccgtgcaaggccagtcagaccacccggggtggccggtcagaccagcggtatgtggccggtcagaccgcccctggtcaccgatcagactggccgtgcaacgccggtcagaccgcccctggtcagaccgcttagcaagtgtgagttctggttgtccgaagtcaaattcttagggcacgtgatatctgctaaaggagttgctgtggaccccgaaacagtgaccgccgtcactgattggaagcaacccaagacagttactcaggttcgcagctttttgggtttggcaggatactaccggaggttcatcgagaacttctccaaaatcgctcgacccatgacacagttgttgaagaaagaagaaaaatttgtgtggagcccgcaatgcgagaaggcgttccaaactctcaaggaaaagctggtttcctcgccagttttaatcttaccggatactcgcaaggacttcatggtgtactgtgacgcttcgcgccaaggattggggtgcgtgctatgcaggaaggtcatgtggtagcctatgcctcacgccagctacggcctcatgaaggcaactaccctacccatgatttcgagttggccgctgtggttcatgctctaaaaatctggcggcattatctcattgggaattgctgtgaaatatataccgatcataagagtttgaaatacatcttcacccagtcggatctgaatcttcggcagagaagatggttagagctcatcaaggattatgatgtgcgaatccactatcaccctggtaaggccaacgtggtcgcagacgcgctgagtcgaaaaagccgttgcaacactcttggcgtccgtggcattccaccggaacttcatcaacagatggaagccctgaacctaagcatggttggtcgtggattcttggctacgctggaagccaagcctaccttactcgatcaaatccgcgaggctcagaagaatgatccagatatgcatgggatcctcaagaatatgaaacaaggtaaagccgctggtttcacagaagatgaacatggaaccctatggaacttaaacagctgatacttcaggaagctcacgaaagtccttattccatccaccctggcagtacgaagatgtacttagacttgaaagggaaatactggtgggttagtatgaagcgggaaattgcagagttcgtggccctttgtgatgtgtgccagcgtgtcaaggcagagcatcaacgaccggccggacttctccaacctctacaagtaccagaatggaaatgggatgaaattgggatggatttcatcaccggacttccaaaaacccaagacggttatgactctatatgggtagtcgtggaccgactaaccaaggtagctcggttcattcccgtgaagaccacctatggagggaacaaactagctgaactctacttcgctaggatcgtgagtctccatggcgttcctaagaaaattgtatctgatcggggaagccagttcacctctcatttctggaagaagctccaagaagagttgggtacccgcttaaatttcagcaccgcgtatcacccgcagacagatggacagaccgagcgtctaaatcagatcctagaagatatgcttcgcgcatgtgtcctagattttgggaaggcatgggataagagtctcccctacgccgagttctcctacaataacagctaccaagccagcatacaaatggcaccctatgaagcgttgtatggccgcaaatgccggacaccgctattgtgggaccaagttggggaaagccaagtgttcgggactgatatcatgagagaagctgaagcgaaggtcagaaccattcgggataatctaaaggtggcacggtcccggcagaagagttatgcagataaccgatgccgtaacctggaattcgcagtggacgattttgtgtaccttcgagtcacgccattgtggggcgtacacaggtttcagatgaaagggaagctcgcagctcggttcgtgggtcctttccgcatcatttctcgacgcgaagaagtagcttaccagttggagctgcccgcctcattgggcaacgtgcatgatgtgttccatgtgtcgcaactcaagaaatgtcttcgagtgccatccgagcaggccgactcagagcatattgaagttcgcgaagacttgacctacgtagagagaccagtgacaatcctggacaccatggagcgcaggaccaggaaccgggtaatccatttttgcaaggtccaatggagcaaccacgccgaggaagaagccacttgggagcgtgaagacgagctgaaggcagcccatcccgatctcttcgctagttcttccgaatatcggggtcgagattccgtttaaggggggtaggtttgtcacgtcccaaaacgactctaaaatatatcccttaaatgatacctagaataattaaaatccgtgtgaaagcctccaacaattaaaatgtgcaaagttaaaagccaaataaggcttagaggatttttgtaactttcctaaaagcctaaaatgcgtaaataaattttagtggaattttcagagcacaaataataattattaagaaataaacaaagttaaaatgattttataaaaaaaaaaccctaaaagtcccccttccctcccttgggccggcccggcccatctctcctccccccctctctctctctctcctctaaccgcggcccactcggcctctccccgcgcgcgcgtcactgacgggcgggcccgcccgccaccctcgctgacgggtggggcccacccgtcatccccttcctcccgccgctctcgtcgcctcccccgcgccctagcgccaccgccgccgcgaatcccgccgtccccacgtgcaataaagtggggggaatcactccccgtgatcccctctccctttccccccatttttccctctctctctcgcgttcaaacgggcggatttgcccccgcaaatctcgccggcgccattgatggcggccggacctcccgcaccgatttccttcccctccggccgctctctcccccttccaaccctatttaaaccctccccgcgcctccctcgcccgtttccgccccttgtcgcaccgtctccccgccggaatcgagctcgcgccgtcgccctctctctcctccgtagccgacgacctccggctggccttctccgctcgccgggaccgtctcccgccccggagtcgcctcctccggcttcgccgcaccgccgtcgaccccgtccaccccctcgccgagtccgccgaccgccggaacgccgtcgaccccgtcgacccgagccgcgccgccgccttcctccgctccggccgccttttttgtcgtcgccgtcgacctagggtgagccgtggaccgccgtctcttttcccccttcccttcccctctctcggccgccgctccgccgtgcctatggccgccgccggcgaccataggggcgcgggcgccgcctcctaccggccgcgccgagtggccgccttcgggcgcgccgagtggccgccgcgtggggcccggctgtcagccgcccgcgccctcgggtgcggctgacgcgtgggacccacggcgccggccggtgcgagcccgggtgcgcccggtccaccgtggaccgtgaggctgccgcgtgggccccactcccgtggacccggtccgcgcgccccctcccctcggctgacgtaataaaccctttttaaattaaaatttaaatgaaaaaattcataaatattcatttaaagagcatataaacttcaaattgccataacttggccatttgaactcggaattggaccgttcatgtctcaaatttttccttaagaagtcaagaacccatttttgtgctttgttcctgcttgttatatggagtttattagagtaaaagcccttttattttccgttggtcgtgtagacgttgcagcttcggaagatccgctcttcgtggaggttgaagccgacgtttgggaaagtgagcaaggaaagtcacatcatccttgaacatattgaatcccagtttataaaattattttgatttaaattattgcattatcgctttatttaaattcccgcgttatcactgtttatctagccatgcctatttacctttgttatgaccttattattgttattgttattatttccttgttcaccctagaataaacaaaaccccaactagtggacactctactcatggcaccactagtatgattttaggtagatgcttcactggttaattaggcaacattaggtggttttacaactctagactttgggaatactcttatcatctggacactacggaatggttggattattgtggaatgggattcacacctcaaaatggttttaggctgggctcggggtgcatggttttgatagtagcacctcggccatttaaggaccggtcttcgggcctctgttgcaaagtactaccgtacttccacatgtctagtgggtaaggcttagtttgtggctcagtctggttataaacaaaagtacacagatggagatggacgaagtcgggggtcgatggatatctctagggcaaatgaaggctacacgagctgcggctgtaacatcccggcctagggcttaataggattaatagaatactcatatcaacaagttacaactttttttccggaatccaatctccaaagaactccagggttaagcgtgcttggcctggagcaatttgggatgggtgaccgaccgggaaattcttcccgggtgcacacgagtgaggacaaagtgtgcagaaaagacatgtgttgatctgtgagggcagtctatgacctatgaatgaaagctatcagatgtaagcgggcccggcctgggggaaggcgggacgttacagcggcccggtagtcgagatgtcatggcacagggccggtgtcctgctgctaggggctcagtcctgcctacctgtcccgggggttccggccgtaggtggggttgggtcggtactcttgtttatggctatgatgggttggaaactatgtcatgtcttccgtccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaatttagtgttttaattcttaaaacctgcctaacagctaaaatgtgtaatggttggcctgggttggcttgggacgaactgggacccagggtcgggttgccagttcggtctgaatcatcgtaggccttgggttaaggcaggttcgtgtgggttcacggccttggttaataatattgtatagctctaggaccgtgtttacaaagtagctttgaacaactaagtgacttttaatgctgtttactgcaaaccctaaccccctatattatggctcccttgtactcccttgcatttattctgcacttgtgggtgtgtcttgttgagtacggtggttgtactcagtcttgctcaatttttcccaaacccagaagaggagcccctgggtgatgaaggctttggtgtctagctcgtgcctgccgtcaagcgcctgtggtcgtcgccctagtcttccgctgtttttcgtttgtcttcttgtgtgctgggtcttcgccgcccatgtaatagattaattaattacgcttccgcttgttaaactctgaattgtgtcaacttttggtgtaccttgcctcctgggacaaggaataatgcatgcacgtaaggaacgtccgttgggttatttccggtcgtgacatttcggcatccaaaagatggcggctcaaatacgtaatgatatattccttgccatcttcctgttgtgtcaaaacagcaccaatgactttgtcttcggaggcaatatataaccgaaacggctttccggctttaggtgcccgcaccacgggtggatgtggacccccgtttttataacaagaatcaatcgtgtaaacagtaccatttccctggatcaagtagtctggtacacacgaatttatagctgaaataccaagtgcacatacacgagagtctagtacgaattattacatcataagcccacaggcgcagtcttaaatcatcggaccgagcggtccgggatacattccaaaaacagaagtaggtaaggcagcggaattaaggcagtggcacgccattgacataggcaacgaccgtaactaagacctactgggcgccatcgtcttcatcaccctcctagtaataggcatagggatcctccgaagcttcatctccggcctctgattaagtttatatttgcaagggtgagtaccaaccgtactaagcaagccaccacagcaacaatgcatatgatagggatattcaaaagatggctatggttcttttgcgcaaagcaagttttgtaattcttttcacaaacctaagacctagcatagactgatcaaattttagttccagagttcatattaaacaacgacggttctgtccaccatccattgtaatcccaaggatagcttcccgccattgagtcgtcatggttttctgaggacgtccaccttcccgcctctcaggaagtggctccatcagcatagaaatcatcatgcatcatcccatcacacacaagttaagaatttagagtctagccaagtgtaacacatgtcccggtgctcaataaccacgagcacggctattcgaacagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccgatgatgacaccgatgtagggcacgcctctcggccctacctcaacggctgtcccaccgtagtgcacctgcctcactcaggggtgaaccatctatgcagggatactgcctccgctcggctatctaatccgctaggtctatacccatacgagaagtacggttgtacgggggtcgtttcatgcttaacttcatggctcggtccttaattgaccggggacgatattagccttttcccgataccacccaaatcctccgtccgccccagttgaaaacagttgtttaattctatttctcctttcacaaatcatatcatcaacatcatggcaatgtggcgctcatgtctccacatgccgcatctcaattaccttcccaaaggtaattgcccaagcatatagcatttgataaatatgagtatgcataaatctagagtagcatttctaagcatttgtcatagttgactagggacttatacgtagatcatggttacaaggatttaagggtaaacaatactcaaggcatggcataatcacaagtaggatgttcatcattgcatgcaatttttatttgtaaataaaaataatttcacaattgggatcaacatgttcaaagaatagtgatgacttgccttgctcaaagtcttgcgggtcttggccttcacttggatccaccactccctcgggctctatagttacgtgcgaaaattgatttgaatttggttagaattcaaataaaaatccaaataaatccaaatgaaagtcgaatgcgaaagtcgatttctttatattaactttactattcgcgaactaaggcaaacccaatttcgattcaaactattttgcgggtataaatattttgttgtcataagttttttttttaatttaatctacccgagcattatatacatacaataggttagaaatttctatcgcgagctaaatatcggacgaaatcctaaaaatattatacgatttaatttagtctataactaaatgattaaatataatacacgggtaaaatccctagtaattaaatccgaatttctaccgtgaatcgattacttatagggattacccaaaaataatctataataatatataagaattcatctaattgtttagctattaattacatctaaattactactgcgaattgatttcttatagaaattaccaagaataatccataatttatattaaattttgcaattctacgactataataaatctataattaaattctaattattttaaattttctaaacttccctaatctccctctaatttcctatttatttcccttttctttttctccctttctttttctttttccttcctttctttttcttttctttttcccccttttattttctctcccagctcctttcttccttcctctcttcttttctctctctccctctcggcttcttcctccctccctctttctcggctttttgccctcccggcggcgacggcggtggacgcgagggggaaaaggcggcggcttaccgacagcgacggtcggcggcgacgacagcgacggcggcgcaaggcggcgacgcacggcgcggcggctccgggacgacggcgcggcggcttcgaaggtggcggcgcggcggcatgacgacggcggaataatttaaattgaaaaaggtttttaaaagtcttcttttggctttgggccgaaagtcggcccaaaaccccctctctctccctccccggcccaagtcggcccagtccgccgcagccgcgcgcgccctcgctcgctgacaggtggggcccgcctgtcggagtcgtcgtctacctccggccgccgccgcccgaaaccctagcgccgcgccgccgctgtttccttccaaatccggccgctcctttccttctccggagaaatcaaaagaggggaaatgtttcccgagatctcctctaccttttcccttttggaaacatcatctatttcggtttggaaatcgatggattcaagatcgaatcggattcctctctctctcccgaacccgaggtttccttcgcgtcgccggtcgccgtgggccttcgccgccgccccctagcctctttaaaaggatccccaagtccgccgctacccgtcgccaccttcgccttcatctcttgccatcggaagcgtcctagcgccgtgtgacctagcgccgtcgtcgtcgccgccgctccagccgtgcgccgccgtcgttccagtcatcgccgtcgctcgggaaggtcgtcatcgtggtcgccgtcgcttcgccgtcctcgtccgccccttcgcagtcgctgttgaccgccggagcaccgtcgccgccgtcgacccgatcttctccgccgcttcaacctcgtcgccgtcgccatccgttgatcttccgccgcttctttggtcatcggtgagttcgccgcgtcgcgctctacgtcctggtgctctccgttcgtgccgaagcgctgttgttcgccggcgagcatgcgtgcccgagccgccgagccgctgccggtgctgacgtcatcgatgacgtcaccgctgacgtcatcgtggcggtttgccgtgagccggtcgtggaccgatcgatctcggccgtccgttttggatagggttgatctcggccgtccgttcccgtggaccgctgccgtgcgcccggtctaccgcaaaccctagccgctgacgcaataaatctctttttccttttcaaaaataattcattattgcgtcataattcaattaaaatctatataagtgttttaatccgattaaatcttcaaaaattcataactaattcatcttagctcggatttagttggttcaagtctctaaatttttttaaaattgagatctacatgttaaaaatatccacatgtactgttcatgcttgtttatgtgctgttttggtgtttttgctcttttctgtttagattccgacgtttccggagagtccgttttcgcaggagaagattttgaagagttccaaggccagcaaggcaagtcacacagatcccaaacaaccctttgagcatgttgatcctatttaaagctattgtttctattcaactattgcatctattttcgaatgtcattgggtggaattaacctattctttgttatggcccttttgtacttgattactttattccttgataccttgggtgattataattggactagttgagctttatatatattggttcaactagatattagatataattgcttagccatgcttagaaacattagcacactattgggataacttatgactcactattatttaatgatggcttaatggtagttcacgatggtcaatcgtgatttgttaattaattacttgccaactaaaattttataatggtgggttgtgagcacatggttttgatggtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatctaggaaaggtgcgctgtagtggattgtgttgtgcgaggggtattgccacagctcctttccgaggtaccgtggtggtattgaggcacatggtgacatgatgtggggctgtgtcttgtgggtacagtgatacacctctgatcagagtaaaactattcgaatagccatgcccgcggttatgggcgggcctaataatgtctttcgtgattagtctcacacttctcaccataataaataatgctataattggtaataatttgattagctcctggtttggaatggtatattcctggtttggggatagaactgtgcagccgggatggttgttcagaatggttgggcctatgcaatagggtatgttgtatagtgttggattaatattgtttaattatcactgaactgttttataattctcaaatgtttgctaaatgctgcttttgcaaatgagccctatactatgccatcctttgttatcctgtgcacttgcatatttgctgcgtgacttgctgagtatgtcatatactcaccttgcaatcattcatcagaggaagagttctacagtggtgctgatggtgtggaggattaggtgtagccttggtcaagctgcttgtggagtggagccgtctgcgccgtttatcttttattttccgctgcttagatctttattgattgagaggaactatctacctctgtaatgacattttattcgcttattaattagagtaataattgtactctattatcaatttgttattgtgtgcctcggctgattcctggatgagggttcacacacatgtaagcgtttggaattttggatagaaattccgggcgtgacagacgcgcgcggcgttgggacgtcgatggcgacggcgacaacggtggcgcgcggctcggggagggacgcgatgggcggcgacacaacggcatggcgcaacagcgacgatgggacggcgcggcgcgggcttgacggcgacgggacggctgcgcgaggctcgaggcgacgcggcgacgagacggcagcacgcgcggcacgggggtggcgacgttggctcgagctcggggcggctcggcgatgttggcgcggcggcaggcggcgatggcgacaggcgggcggtgtggcgcgggcgcgtggggcgcgaggcggccaggcgcgacgggcggcggcacgtggtgacggtggcgacagagagaggggaaagaggagggggctgggttaggggaccacgtcaatcacctacgccataatgaacagtgtattttcctatttatcccgattttagtttatttccaatataaatttgattctataattctaaatcttgcataaatgaagtttactcaatatttgtgttatcttaactaatgaattcaccctagattaatattactcatattttatttgtataatttatttgaatttttaattaggattaattcttatcccatcgcatttaaattcaattgatccaaatatggtcgcgataatattttatttatttctatccacacctaatctttattttaaattatatttattttaccaatttatttttagggtttattcctaattaactattctttactcacgattaatgaacttcgaaatcaaatccaaataaaataagcgaataagatcggcatgatgcaatcaatttaaaaagtttttgaaaatccatatttttagagtttagctttttgtcggtcgaattttcatggtgttacagtggagtagaaaaatacttcttcaacccttcaaacccctttaatagttcgattattttaaccttataatcggctctcatgtttttgtttacaaaagtcggccttggcttagttccatcacctatgtttacttcttccaatggattggccgatgtaaatccttgaccaagcttttttacctcatcaaaatcttcaatagtttcaccaatatcgttctttgtagaccgatattcttgcaccctcttttgcaaccactctaaattatcttctctactcattacataaagtgatatgacctagccgtgctaaacctgccggctttacggagatgggtacaaatttgccattggagatactaaaaaagtcatagctagaaagatccatccctgataagcattgaatattccaatgacgccactcaaatattgcatcggccattgcaacctcggtcgatgtatccgcttgaacaatttcaacatcatcgccgtcccattgaattaaacattgatgcaaggtagaaggcacacaacaattggcatggatccaacaacgacccaaaataacattgtaggaaccttgcacatcgacgatgaagaaagtggttggtagcgtcttgtttcccatggtaagctccaccgaaaagatacccttcgcctccgttggttcaccattgaagccattgagaatcatgttggtcttcttcaactcatcatctccacgccccaacctcttgaacaacgagtatggcatcaaattcacggcggcacctcgatccacgagcatcctagagaccggcttcccatcaatatgacctttgagataaagaggtttcatatgacggtttgattcatcgggcttctcaaaaactgcatttttaggacctagtgaaaattgagcaacttcgtctttatccatagcacaaaactccataggcaacatacataccatgttgacatccatctcctcctttggagatgactcatctttagcaaccaattattcttctttctcctctacagcaatcgattcttcaatgtctatggacttacacctccacatcttcgtaggtggtggtcgcaactcattgaaccttgtatccctttgctcttcggcctctctttccctcaattcttgggcccaaagacgttgcaacctcctcttttgagtagccgtttgttgatgtgaaaaacacgaggcctgggggatctgcttaactccagtgcaggtccaaaagcttgcctttatgtgtgtgagcgtgccagttgatttgatcctataaccaacaagaaataaagacaaagaaaacgcggttaaatccacaaatgatagccgattggctagctgtcgatgacgtatcatttatctttgggccgatgtcacatatagatcgatcggcagtcatgaataagtaagaaagaactaaatctactcgatcggctgtagatattaacaatatataaaccttatgtcgatatatagttaaatcaagtgattgggatagatcggtcgccatgccgagacagtataaatcacttagatcgaaatatatattaacaacaaaactatatatgttcatagcatagccgatcagatagatctagcatgtatcggctaatactccgataccactctatattaagatattaaagcaagcagaatatatcaaacaaaagcctaatatacttaaatgcaacaagatcataacataaagagcggatttaacatgtcaatcaagcatataagacataaagtagttaaatcaggtaagattggctgaaaccccgatactaccctagtcggcaaccagaaagtaggctagagattgagattctaatcacgacttataaggtcaaactcaattgatacagctataagtatgaaaagaaggacaatatccatacaatcaagccgctggttgtttcatagagtggtggatatcctatataatctaagccaacattggtatttaacctaatcggctgccttctaatgatagatgttagccgattggaggctatataacaatattgtcaaagattatataggatatatgataactcgacaagttacacaaacaagattagagtatcataaagatggaagcactaatcccgagaacgcaagccgccataacaagttttacctctagtagaagatcgaaaccgatgcagctcaactcgaaagcaagaaatcatcgaaacaaaatgaaagtaaaagggtggcgatgcgtcgagatagtactgaacgtgtcttgttgtattccatggggctcggggtctatttatacacgagattacaaaatatgttcgtgtcggacacgactcttatctctaacaaactctaagataccataagtctttgcgacagacttttgcccaaatatatctataaagaaattacataaaatatcctaattaacagatacaattgccttcttaggactcaatccgtgcatggcaatcctcatgaagcacattaactcaacccgacaacgtgtatcgcaccatattgtcggtatcggctcaatcgaccaaccttgtccgactcgaactctgccgatcctgctcgtagccgattcttgctctgtttccggaacaacttctttcttggattccgcttcgattcatctccatctccgattcttcgattaccaaatttcgttgttaacaccgttaaatccttaggcatccaccttggtttcggctctgttccaggaagtaaataatggcccctgttgagtctactcgaagatgacgaaacacccgcactacttcttgcaaatctcttgtcgaaccggcgctagagcccaatcagaccggacttagaccaccggtcagactggccagaagcgccggtcagaccgacattggatcggcggtcagaccggcctgatggcccagtcggaccggcagtagagcggcggtcagaccggccagaaggcctagtcagaccgactgactgcgatgagctagtcccggcttcggatttgttgctcgaggactctccaacttcgtttctagaagatactggcacatcatgagaacccactttggtggtaatcacctccaaagtcctcgcctccaccttaacacgctttccttccctcttttctttattgactcgatttttagcataaaaccggctattgtttggtgaagactaatgttcacgagctggcctcctaggtcctccccatccttggttgaattgcattggaggcatatgattgaacatggcggtgttgccccccatggcatgtagtaaggaaaaggataacccggcggcggcattggataaggcccccatgacatgtcttgagaacgatgatatgtaggtgattgcgaccgtcttggtgtcgaaacaagatttcggcaatacaaaaagggggtggctatcaagcaggaaaagtggatgggtttggaggcaatgaattttatacaggttcatgtcctctcaatgagaagtaataccctactcctatccgggtattgatccgccgagtgtgttattgatcgtatgatctgggagaaaagttatgccccaaaaggcacccggacccttccttatattgtgggaggagtctgtattacaagatacagcccatattcctaacggaataggcaaataaagataaaatacaatcgtaaccgactaggaccccgggtatttcctcgatacacaagttaggaatttaacccaagtcccttaaagatattttatccgcatatggtatccctattcccagtcagatacacaagccgtgtgggtatggggtatccataatctccacagtagcccctgagacctttacagtcgacgaaataatcttctctttgagtcttcaacatgatgatcccgagtgcttcaattattcctgccttggtgtcccgagtgcttgaatcaaagactgtgaagggctaaaaaataaaaagttaggtgcatcgactagatgcacctaattagatgtagctcccgactatgtgattagttgaataaaactaaacatatagtcaaggtacattaaaacatccatccgagtggttttatgaataaattaccgaagtaatcatatagctaagcatatgcgacctttaattaaacattaagcctactgctttagcttgattattatacccaaaaggtatataaaggtccaagtaaaaacactctaaagatctgtcaatcaatatatgcgataaaaaattcgagtaaaaactcttaaaggatttataaaatgtcgcataaatgataaatgacaagtctagatagtctaatctatgacttatgccattatcgaattaagcatataacaagccaagagaatgacaattttaaattggtcatctcaatataatccgaacagctttgcagcctaaaaagggcagcaaaattagtatgacacttttctgctgggcacctttttatttgcattgtagcaattccaaagaattatctaactgcttcaaaaagtattttaacggtatttggctattttgttgtgagcattatttgccaaagcaaaaaatatgcctaagtccctaaggatcacaaacaaccacaccgaaagtgaagttgggctgaaaatactgttaaggcccaggccgataagtatttcccgataccctagcgaaataatcgcaaaaatataacgccgcttcgtcttcctcattgcgatctccttcgttttccccatttttcgctacagtgccaaagctgcgccagcgaaagctagggttcgcaaacacacaccaatccacctcttccgaagcttcatgcctctgcgaaaaatcctccgcacaaccacttcatcaatctcccctccaatctccgccacccttgctcccaatttcatcatccatctcgcatccatggcagaggagagagaaagctttgagagtcaatgggccccctccaatgtcacggaggaaaacttgaaggaaatggtggtgcacggcgttctcccggcaaaagaaatcatcggatggcgtccagcgtacggcgaagccttcccgacccccaacactcatgaggtcgtcgtatggtggttttgtccttccaacttcgaagttctttagggggattctagaattttatggaattagtttgcatcatcttaaccccaactccattgtacatattgcaaactttgttcacgcatgtgaagccttcctggggaataaggcgcattttgccctattttgtcgcatcttctttttgaaaccccagccaaacaaaaacaagctatgtgtcatatccaaaatcctaaaccagcgcttcccgagtactcttgtcttcccccaaaatatcaggaaacatggaactcacttccaatgggagatgaaaccgctcaagccctcaccttgttaaatcgtatcatgaagctcaaggagcaaggtctgcaaggggaacagatcactcggcactttatcaaaagctgactggcacccatcaaggagaggtctcgtactgccttcgagtttgatggaaaaaatgatcccaatcgtgaagatcccgaatccctcgaattcaaaattatgaaggagagaatgtacaagattctcatctgccatagtggtcagttattcacatatactaccagtggtgccatattacgcattcaaccctcctcctccagtgagtattgaaaactctttaatctccttgcgatatctgctcttctttgtaatgttcttgactaagggtttgaaatgtcatcctcaggaatttgctttgatgaagtctgatccatcgactgctcaacgtcgttctcctcgccatcattccagtcaaacctctggaggtccaaaaattcaacatgtcgcacaaacgagtagcccaaagccgactgatcagacgggccccagaaaaaggaagctggtcttgagtgacaatgatggtgatgataccgaaaaagccagcaacaaagagatgactggaaaacagcctaaataggctaatccgccaaagaagaaaacattcagccgtccaatacccaaaatcagaaagtaaatccatacagcaaatgtaagtatcatgtctatagtttcacttatccaatcggcaaatccactgagatgctcaagtatgtaatgtagagaatccatcttcaaaatgaagcgaaaaccgcaaccatcgagaagctagttccccatcttagtactctggatgaaaccagggaactagctaggaaaacataacatgatctcagggaacgggttgctgagcttcaaaactccaatttcgaattgagtgggtcttcaaaaggtaactttactcctactcgacccattctgacttgatgttgtgtttaaataatcattgagtatatgatagtccaagctgccaagattgccgaattgaagaagcgaattgaaaccctcgagaaagacaaaggcagtcttattaaagagagggaatcggccatcaaagatgttgaaggtaattgtaatagaaatccaagataagcttgctgatgcctcctagtcctgatctgaatataactgttcatgtagatcgcaagatcaaatctcaagctcaattcgacatcttggtgaataaaattaagaatcttgaaggggctagagatgaagtcgccaaagctactatgcacttaatccaagccatgttctataataacaacggtccgagtacaattgatttagttgaggtcttcgacaaattgcgagctgctccggacacgtgctttaaaaatatcaaggaggctggaagcatgggagcaagcatggcgttggcgatgactaaatccttgtatccgaaaatcgacattgatgccattgatggctttgcagaagaaacaagtgaagaggatgccctttgatctcatcaatgatgcctagaaggacgccgacaagattgcgctgatattgttgagagatttcaagataacaatcttggtccgactgggtttcatgattccgatgatgaaaaaactgagtctgaccgaactttgtaattcaaacgatgtagtctttgatgatggagcctcaatttgtacaatactgatatatttatgctgtgcttgataatttaaattcggtctctgatttcttaaaagtttttgtcaaaccttattgagcctaaaacccgaaatgttatcaaaaaactctcagtcctcattaaccaagctaaaaaatcaaacaaggcaatgataaatcaagtaaacaaattgaattgataaaaatcacactccattattattatgatagcccccgactgataaatcaagaagaaacttgatgttggcagtcaaagaggaaaatagtgtacaaaggtaatgcctaagcataaaacgacgaagatgctcgatattccaagagttttcgacgaccgaaccatcttcatgcttgagtcgataagaacctggccgagt

SEQ ID NO: 50092 - DNA, 8614 bp, Oryza sativa
  unsure (1)..(8614): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatagtttccttcaaattcaaacacttagttgcatatatacaagttgctttggtgaaactaaccggcgggtaaaattcttgtcattcctaacccccgccgagttagtccgtccttgctccattgtacagaatgagaaggtgattgtctcgtctattcaaggggtccagctcttcaccaagccatcatgaagagactagtactcgttcatcagttgatgtctcgatggaagacgccgaagctccgcgacaactcttgaaggacaccgacctcgaccttgtcagtgatcgggagaggcaagcctactatgtgcagagatttgctgtggtagatgagcctggttctcgtttgcttactttgcaatttctgtgcactttgaaagaaatagaagattgtatttcctttcactttttccataaggagtacacacttacatggaaaggcttaagtacacttcttggttttcacgattcctgtaaaatcgatctccagaaaggaatttctgggttcgagaaaaataggttttgggaagacatttctggtgctccaatttgcaagaaacctaaaaggaatgatatccataatcctacacttaggctcatgcacaaatggattgctatgactttgtttcctagaagtgatctgagacccattaggggggatgaattgattatcaaaattgctcctgtgaaatgtatgataaggcaatggttagaaagtataaaattctctgcgcctgttgagtgcacttctctgattactcggataacaaaagggctatgggtcgttaacgaccaaattgcttttatctcagctgctcgtccgtttattgattaggcttatctagtgcgagggcatattctgaaacatggagtagatggatctttgatatactttttccccggttgtacaaattggattaagtagatggatctttgatacactttgtggagaaggtgctctatgccgcttggagtatttggaagcaaaggaatggtttaatttttaataatgttgtaccttccattgcctcctggagagctttctttaagaatgaactctcccttttagtccataggcttaatttgtttgagagagatatacttgtaaattggattaatctgttgtaaatatcttggttttattttataaaatttaaactgtgggggcttcccctacagtgctttctttcaaaaaaaaagaaatttgttagaccatatgagaagaagtctaatgttaatttgattgattaccctgaggctagtgatagtgatggtgagggtgatcatgatatgtatgttgccgagtggtcatggactaacaaaaataagcctattgtgtgttctaatttaatgccgactcctcgtaaagatcggcaaagtgagcttaagtatagttttgatgtggccaagtgtgataagatctttgattatcttttgcatgaaaaacaaattagattacctaaaggccatgtcataccatctcaagaagaattgaagcgtcgagcttattgtaaatggcatgattctcattctcattctactaatgattgcaatgtgtttcgacgacaggttcaatcggccatagatgaaggacgattgaaatttaccgatggttccaagatgaagcttaatcattattctttttccggtgaacacaattaattttgatgataagaaggtgttgattcggctggagcaagccgaatctactaaggggaaaggagtggtcattggagaacctatgccaaagatgatggtgccaaagaatccggaggttggtgtgtggaaggagaatcggagtgaagcttcaagttctaaagctcctagtaagactaagtgaccttcgatatgcttttggataagtatgagaagcaaagtggtgagaaggctcgcaacaaaggaaaaagaccaagatcgcctcctggggagcgatttggtcattcaccaagtgtggagattgtggataccccatacccacacggcatgtatatccgactgggaataggggtaccatattcggatagaatatctttaagggactcgggttaaattcctaacttgtttatcaaggaaatacccagggtcctagtcggttacgattgtattttatctttatttgcctattccgttaggaatatgggctatatcttgtaatacggactcctcccactatataaggaggggtccgggtgcctgttggggcataacttttctcccagatcatacgatcaataacatactcggcggatcaatcccctgacaggagtagggtattacttctcattgagagggcctgaacctgtataaaattccttgcctccaaacccatccacttttcctgcttgatagccacccctttttgtattgccgaaatcttgtttcaacagttggcgcgccaggcaggggttgcatcaagcttttcgccgatcagtgcgatgggattcgtttctagcatcgatgactttgccttccctcccggtcaggcataccggttcggcagcctcaacttcatcaccgatgacttcggcaagatttctctcctcgactcggattcaaaatagttgggaagagcccgttcggtctcccgaactcggtcgagatctaccgcaagactatcttatccgagttagcctcaaaccactcggacgagatctcatctacttcgacacgaccaaatcaagacgatgcggctatccaccgatcctgatgaagctccctgacgatttggctgttgttttcaccacaaaggcatcttcttctcataggtctagatgggacctggcctcggcctcgatgcaatcttgcttcagggaagtcggcgtcatacttcagcccctcgggacggtttcaacagaagagttggatagctacctcagctctccaggcgttgattcacagccaacagagatccttgactacgatgacttcaggtacaactacgactttagcaacctcgacgatttcgatgatggctatgaagataattacacgcctctctttttcggtgttttcatggccgataatgagacaacagaacagcgtcaactccatgaagcagaagaacaacgtacacgacaagaagccgagcggcgttgattggaagaagagcgacaagtgcaagagtgagaccggctgcagtgtgagcagcagcaacacgagcgggccgcgaaagaggctgaagatcgatgacaacgcacaccggaagccgggcgacgagcacgagaactcattggacagcaggacgtcgaagggacagcgttttttctcaccccacagcagaatgcaatagcagcaatcactctctgggatactctgctccaggaagatgcgcccaaccacgtcctcaacattatcaaccagatgaagaccatgatcgccgcctcggacccagtcaacttagcaagcgtttgcacgccgactggcagccaggttccgcctctccgatctcaagattatcaccaaccaagccttagcatgactgcttcaggatctaatcacaggagcagggattatgccgaacgttctgttcactcgcctgctgatagatacagagaacgctgtgttgaacagcctcgctctccacgtcgtcggcaacccgtcgatcttcgcgaaacactcaaccgacaccttgcagaaagaggctaccaaccataccgttcaccaaatcgctacgacgacgatgaagatggagtcgcatcctttacaagtgacctgtgtcgagtggattggtcggctagtttcaagctgactggtatcgagaagtatgacggcaaaacaaatggcgagtcatggctcaccgtctatggcctcgcaatccacgcagcgggaggagatagcaaggctatggcaaattacttgccattagatctagtagattctgctcggtcctggctttatgggttaccccgtggcacgattggatcttgggcagagcttcatgagcacttcatcaccaattttcaaggcacctttgaacgtcccggcacccacttcgacctctacaatgtgatccagaagcccggtgaatcccttcgggactacattcgacgtttttctgagcaacgcaactagatttctgacatcaccgatgacgtcatcatagccgctttcaccaagggtgtctgtcatgaactcttagtcggcaaatttagacacaagcctcccaaagattgattcatctacaagcagtttgcggagaaatacgccaagcaagcgaagaaggctatagatggagatcagagcacctcaaagaagaaagatgataaagacgatggaccgacggttttcaagattctcgcaaagagctcaaccatatctttggtgggccccaagcttatgagtcaaaacggaagcaaaagctgattgatagggagatcaacgccgtccagcccgacacgcctcaatatcttcggtggtcagagacaacaatcaagttcgaccactcggatcatcctaatcgagtggtccacccggggtggtaccccctggtactggacccagtggttcacaacttcaagctccgacgatccctcattgatggtggcagtgtactcaatatcctttttgccaagactctggacgatatgtagatccctcgtactgagctgaagacgagtagcacaccctttcatggagtcatccagggttgtcctctactccactcggccagatcactctgctcgtcaccttcggcactcaggagaactttcgcacagagaatatttgcttcgatgttgctgattttgagacggtgtatcacgctatacttgggcgcctggcgttagccaaattcatggtagtcccacactacacctacatgatcatgaagatgccaggacctagaggagtcatatctttgcggagcaacatcaagcaagctatcacctgcgacaaagaaagctgtgagatggctcagacatgtgagattacactcgctcgggacgagatccgactggccacatcaaccgcaaccgaagaagtgcctgcaacgaagttatcgaagatcattgtttaaagttaagtaccgtgctggtcctaggctagaacgtacgagagacgcgagcctagacacaaacgataccacaagatagtactagaaacaactcaagcacgctctgatatgtgaaagcaaactcaaagatacaactgatttttctcttttctttctttttttttctatctttttctttctttcttttcttttttttttgttggtgcggcttttgttttctttctttttagcacctttctgccttttttttctttttttttaatttttttttcagcaaaagccaactcaaggaccttaatgcaagattacaaggactcaactgtaaatatacaaattacagggactcaaatgcaaaagtgcaaacccaaaaatttggactatacaaaaatggaatgcgctcgtcccataggttctgtttttgcaaacagatgtcgaatccaacactcaaaaattttttaccaagctctctagcaactcacggtataggtggaaccgagagtagatggagggagtcgactcagcgtggtggtgggcggtagcggaaggatactgcacacgtccagatttgctgagaggaaaaaaggaaactgatccaatctactattttctttccaagcacaacaaaaaccaatttaatctctttccatccaactcacgcgcaacagcctccttccatccaactcaggcgcaagagcgcaatcgaccacggcacaaggcaaaccagaccacagagaccaagatgcaactgctaaactaaccgacagaaacttctgaaaactacaaaaattgaaccgtggcagtgttttcgtaggtcccgacgacaacaaagacacgatgatggtgacgacagtggtactaaatgtgaccagaactcgaaactctaaacagactaaacgctaagaccagcaacacgactcgacgatgcaacacaaactcaacaaagcaaaaactgaaaagaacaatgcaatggcacaatatatggctaggtacaggatacaattttttttgtatggcaattttcaggttataggtagataaaaactcaccgagcaacgaaagctctgataccacctgatgaatcctgagctcctctcgacactcaaggctattgttggccgatctttcggtgagttgatgataactacgacttgggagacacgttgacgatccgactacatccgtacgagacgttgtgttgcgccttagcgatcgacacacgcgctgcaaggaagtagcaatggctaaactttcatctaaacaaaaccccgagaaaccctgaaggggtacctagctatatataggggtgggaggacgacctaggggtgcctagtggcgtgctgcaccagcttggggcgcaccccacataggccccacctgggccagggtcccaaatgaagttacaagctcacaggcccataataggtgacgcaacaccttgttcctgtgattctggccacacgagatggaattcagagacgatgctggatccgttggaaagagggctccgagagctttccatcaagtagtcacgggccgaaaacggaggtcgtatgcagattcggccgccgtttaaagtcggcggtgtaataggtggccgaatcggattccagcacttggaggacgtgatctcggtatcttcttgttcatccatgatgtgagcaatggttgcatccatggtagccatggtcacatcaccggagaagacgacgccaagaccaagaagattccctttgatctatctgatccctccaaaactactgtaataggcggtgagttagattgaaaataggaaagcgcgctcatcacctttcttcaaggtaacaaagatatttttgcgtggaaaccatctgatatgcctggtattccaagagaggtaattgagcactccttaaatgttaaagaagacgctaaacccatcaaacaatgactccgccatttcgcgcaagataggaaatatgcaatcaaggaggaattaaccaagttgttagcagcaggcttcatcaaggaagttttacatcctgactggctggcaaacccagttttggtttggaagaagacaggacagtgccgtatgtgtgttgattacaccgacctcaacaaatcatgtcctaaggatccttttgggttacctcgcattgaccaggtggttgattcaacagccggctgcgagctactcagttttttggattgttactcgggttatcaccagatcaacttgaaggaattcgactgcttgaagacctcatttatcacaccgtttggagcttatttctatatcaccatgcccttcggattaaagaatgatggagcaacctatcaacgcatgatccagagatgtttttcaactcaaattggtcgcaatgttgaagcctatgttgatgatgtagtcgtcaagaccaagcagaaggatgacataattgctgatctagaagaaacctttgctagcatccgtgcttttaggatgaagttgaatcctgaaaaatgcaccttcggagtaccgtcagggaagctgcttggctttatggtgtctcgtaggggcatacaagccaacccagaaaaaataaatgccatccttaacatgaaaccgcctagttcctagaaagatgtttagaaattgactggatgtatggcggcgctcagccggtttatttcacgactcggtgagcgagggatgccctttgtcaagttactcaagaagactgacaatttctagtggggacctgaagtccagcaagcctttgatgatttcaagaaacttctcacaactcttccggtcctggcctcaccaaatccataagagccgctattgttaaatgtgtcggcgacatcgcaaatcatgagtacagttctggttgttgagcgagaggaggatggccatgttcaaaaagttcaaagaccaatttactttgttagcgaggtattggccgactccaaaccaagatatccttaggtacagaagttgttatatggtgttttaattaccgtcaggaaattatcccattattttcaaagtcactcggtcacaatggtcacatcatttcctctcggagatatacttcacaatcgcgaggcaaatgagagaattgtgaaatgggccctggaattgatgtctttggatttatccttcaagccgcgtacttcaattaagtcccaagctttagcagattttgtcgccgagtggaccgagtgccaagaagacacacctgtggagaagctggagtattggactattcattttgacgggtcgaagaggctttcaggtactggagcaggggtcgttttgatttccccgactggagaaagattgagttatgtgctgtggatacacttttctgcgtcacacaatgtggcggaatatgaagca

SEQ ID NO: 50093 - DNA, 2184 bp, Oryza sativa
  unsure (1)..(2184): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactatggaattagtgatgagttggattcaacttgggctgccttatcaaattgaaacttgaaacctcacgtgacatactcatagttcactatagcaaaagcactagtccagtttatttcagtcataagaaactaactgcattatttgtttgtaccttgagaaaatttataaatagccaacaagactcaggatcaccgatcacaggcggtacacactaagttagtattacagaagcaaaatgtagaatagcaagtatactagtctggaactgccattcatgttttattttcgtcctgaaatcttagtcatgcttctttataataccatgtcaaggagactaaattagacaccccaactaagttttcctggggaattgtgtattcactcagggaggtttatgttgatttaatataaacgtcaagaatcacagacaactaaaagtatcttctatttcgatgattctaatctctaaatttattcttctttgcaaaaattgtagccctaaatcctaatggatgttgtcatgttgatacttggtttctgttctttctgtagactctagttcaggttccagatctgccacagttgcagagtttggtcgatcgtctaaaaaatgtcggcgatcttctgacagtagctgttactcaatatggtgacttacatctacacgttgccacttctcttgttactgttggttcagaattcaggaaacttcgtatccttggtgttcgtggtaagctgctctacattccaaagcaagtgtcaataatgtctttttagcagtgctgtcattatgttgaaattacctttttgttttaacgtgaatgaaattacttatcttatccatatttttatatgaattttctgcatttcagcaaccgcacctgttggtgatcaaaatttgagtgcttccactcgtaccaatatggcaattgagagaggggaggcgctctcagtggtattactcctaagagcttcacgttttttttttttaccatttttcatgcagctgttcacaagtttctgtctttctgtgtttttacagcaagtgaatatgaagcacctagctaaaagtctacaatgtcatttggctaagcccgactgtaccttctatggtgtgctttccagctatttctgtaatcttactgacaagttccaaatttgtgttggagagtcactttttgcttaaatactgtcctttttaatggcacaggtatttctcctggtggtgcttgcttgactgtgatattccagtatttcattccaggaactagactgacggacaagtccattagcttctactgcaggcttccagtccttgaccctggcagttaaacatattacagcgtggtaattactgacttgcttctgatatcatctaaggatatgcaatactattagcttagctactgtacctttctgttcaatatcttactatcttatgtgttatgacttgcttgtggactcaatatatgttggctcagcaataattcgctattttggaacatagcatttttattatcgatacctgcaaaactgaactgcttccactcattgttgttgtgatatcacttcgttccaagttgagccagtctcctatgcatgcgatctatttcctaactactatttacaatcccactgcttcaaacatccagatctcagtatcatagaaaaataaaaggaaaccagatttacggtaaatgataattacggaattatgttttttattaaccgagtacaaaattttcagtacttcccttttgagtgtatgaagatagtaatcatttttggagcaaatgaaacatttttttatcaatgattgcatggggcaaatgtatactcttgagccccatgtccttggtctggcataagagggaccaaaatcactggaatcattaatcttcctgtacacgcgtcctgtactagccacctcgacgctcttacatgtatggaacgtataatcctacgaacagtttttttatgcagtactaacagtaat

SEQ ID NO: 50094 - DNA, 9820 bp, Oryza sativa
aagaaccggcaagaaatgggcctatatctgctaacagtttatattctagctttcgttaggaccaagctctggatccacaacgtagcctctgagggagggtgtcttgccaagaggttccttcttttgaagccttttccttgcaatgtacccccgaatccatggcagtgcatcctcatttaccttgatcatgaggaagaacagaatgcggtagatgaagatcatgctgaaaattactgagagatcaatccactttgaccggtgcacgttgatctggaatatgtacttcagaatgaagtctccagggatcttcggttggtctgggtactggttgtcaaatacgagaccatccatgtcattctggcattgcccctgtcaggttgataaaagtttggtgtcaaattttcttcaagataaaaatttagtgtgtttcccctgtcaaagagtgggatttaatttacctgcagcgcccagtaatggaagctgatgtactgcatggggtatctccaaacaggcttcggaatgtcgtaaggaagtctaaagtatccagagacaagcataaatattccctaggaaaaaaaaagtaagacgagttatgtttactgagttatgaagttctgaaattttaattgaaagaaaaagcgtttcctttgtaaggcagcaatgtaatgcggccactaaaggataggatcagcagttagaagaacaaaacataggaataagatcttgaacgacctcaagctgtctttaaactgggatgggagtagtgtacagtaatgctgggtagcgtacggtaaagttgtgctgtccagcatttatttctttgtcaagcttgctggtttatttgactcatatcagattatattagaacctttcaaagttttgtaagctctcattcatgaacatatcttaaatgccacatgatcctctgggacaatgccatggaaaaaaaaacagacttaagaactgtaccagacgggaacaaccgagttcggtgtttcgatccaatctttctatagcactatatttaatacatttggtcctaattaatatgattgttaacatgatagtactttaaagatagacctaaatgaacatccattacttcaacaataaaccaagagatataggttaagaaagcttatgaaagaagcataaagatgtacctgaatcccagctcctataatgatccccatgaggaaattagggatgacacttgcaatggccatcatcaagctctcaaccacagtgacgctggcgtagaggttgagaacgaagaagatgtagtgggagaaacctgggtgaaggcgcaccatgaagtagcatatggtccctgacaagaagcatatcaggaccaagaatggcagcgccgagattgtgttgctgatgacaaaagccgcgacaccgtaatgcccattcagccgctccctttggaaaacctgtcaatgaacaagggaaaactgagcaaatttggcatggtaattctagcatccagatgaaaccgtttgcttggaattcaccttcatttcttcaacaaatgaagggaaccctccaattgacatgaaagtgacgaatccgaagacgaatgcggtacaggcagccctagcctgttcagagtgtaaaccaaaacacatcagaaccagccaattaatggattcatgacagattactcatctgactatgttttttttaatataaacttctattacagcattccagtcataagaatcgcttatcagttccttcatttcttaccaggatggatgtgtacttggtgccgacgtcatagtagatggtgccaatgcagacggtcacgaggagatagatgaggagcctcagccagtaatacccgaagtcccttgacatgttgatgaaggagcgcttggtcagtgtgcctgcctgcatcaagaagctagcctggcttcctcctgaatccagcacagttcctttctgcaacgaataacatgggtgtgttagtgttcatcctgttattgcctgtcctggatgcagtcttaactatacgtgggggcgcaagaaaaaaaaaacagagaggaaaaagagtgatatcaatacgcgctgctgtattagggtcgccaagaacacgtaccagtcgtgagatgtcattaactctctcccttgcagcgtagtagtactgggacctgctgtaggatgcaaccaacttctgatggcttcagatgtggtcatcctgtccagaggatcgtccgacctctcgatcttcaatgagaatgcccaaaaattagatcattttaagtgcatcgtgacacgaacaagtttgagcagatcagctatgaacattggtgtgtcttgatctcttcttacccttgccttcatggaacctttcagggtggccttcaccttgtcgaagtcggagttgacgcatctcaggaaatgatccgatggatttctcagtggcggcacgggaagccggtctgggcgaagaactgcaagcacgagcacaagatggtcacgttagaaaccatggcgaatgatagtggtgacagatatatatatatactggttgctttctgaatctggtgactggtgagatgacttacctcgcatgcctgcgatgcttggccgaagtagacggttttgccgctggagaggaggaagagcatgtcgaagagctcgaacacctcgctgctgggctggtggatggaggcgatcaccgtcctcccgtccctggccagcccccggagcgtctgcgtcacgaagaacgccgacgagctgcgcgcatgatcaagccggcatcacatcgccgcggtcagtccagcgcacaccatcagtcagctcagctgtgactggatgcagggaggacgcgtacctgtcgaggccgctggtgggctcgtcgaggaagaggaggcgggggcgcatgaggagctcgagggcgatgctgacgcggcgcttctcgccgccgctgacgccgcggaggtgccagttgccgatgacggtgtcggcgcagtcctggaggcccatctccacgatggtgccctccaccagggcgcgcttgtcctcccggggcatcttgtccggcagccgcagcatcgccgagtacccgatcgtctcccgcaccgtcagcgtcccgatcaagttgtcgtcctgcgtcacgtacgcctaaaaaaaaaccctccgtaaacctcgtgtttcaccgctaaatgcacttgctttgctatagataaatgaaaatacacttatcatatgtcatagataaatattttttttcgaataggttctcgcttgtttgcagggccggccctgacttttcagtggcccggtacggaaaaaaaatgaaggcccccattcaccataaaaatacaagataatatttaaaaactcattgtcattaatgaatttcacactaatcagtttaaaatacaatcaagaagtcacgatatgctcgatcgccgatcggttttctatctttcctctaaccctatcagatctgataccatagtatacattttttggaggcccctaatttttagaggcccagtgcagtcgcaccgtccgcactgtctcagggccggccctgcttgtttggttattggtattcactttttggaaactaaatattggagtatatatattagaaaatatctgaggacaatttgtaataataactttaaagagcagtgatgagatggcaccgctagtagagtcatttaaatgagtatataatacgtaaatgtgacggtacaaaacggcgccgtagttttggtacatgtaataatggtgtgtacactgtaaattaaaagacccgcctgaaaagaaaaacgtagattcagaaatgagctgatacttttttttcatgctgggcgagcttggttacagctttgagcctacaggtttggtcagttattaaggcattgaaatttgaaaacgaccagcaaattaaacggcccaagttgtctcgctctatgaggataaaccatcagatttgtaatactattttttttgtatgcagaaaagtccccctccttccttccattactcctgtagtataatcgttggtaggacaaaccacgcggtcactgcagctgaatggttcatgtcaccataaattccccacaggttcgatcacgaacaaatccaagtatatccaactgtctgtatttatgctatgtaggtcgccgcaccacaacctctaaatctcgtctttcgaaactactcccactagttctccatctcttataaaaaaaagagaaaagagaaaaaaaaatctcgcgtactacgccccaaatgaatggaatcagagatcgaagagagaaaacagatcgaattgattgctgcacctaacaagcagcagtacacgttatgtgcacttatgcttcgttggggggttatatttacagcctttcgccatcggggacatggcagatgacaaaagtaattaagccctgcaacccgctggatcaacgagcggacgtaggtacgcgttgcgtttgtccagtatgttttgatggcgacgataattagccggtcgatcggaccgtggtcgcctactcgtaaaacgccacttgatgggagtgtgactgtgtgtttatgcacatggcgccatcaacacaggctagggctagctagttcgttagttagcttgactattaatgctgaaacgggatggatacttattatggatgatgactgaacttatctagctaaggagacagtaaagtatagcaagggctgtggtacgagacaattttgattcctagaaatggagattttgttggataaaacaagtgaagcaagaagctaggtatggagtactacatgagtatatgatttttgtatgcgtaccgcggcgccgaaggagagcttggccttgcggccgttgaggaggacgttgccggagaggaaggcgttggcggcgaggcggccggcgagggcgtcgaggagggtggacttgccggagccggagggccccatgagggcggtgagcgagcccggctcggcgtagccggtgagctcgtcgagcacggtctgcgtcttgccggggccgagcgccacggtgaccgagaggtccttccacgtcagcctcgccgacacgtcgccgatgagcgccgccgccgccccgggcatcgccttgctgtcccgccacagcgtctcgctcagcgggctcagccccaccaccatcccgccgcccgccgacgacgcgttcgcctgcagctccaccatggcctgcccggccgccgtcctcctcgtgtcccctcctcctcctcctcccgctctcatggcgcgctctagctcgcagcgaccgatcagctagctagctgtgagcgacgacgcgatggcaagcgaacacgaacacgagagagagagagagagagagagagagagagatgcaatggctgttttgctagaggggagaggcagcaagggaggagttataaaggtgaaaagcatgcaagcataataaagaagggaagttaatggatggatggagcaatcagagagagcaaccatgggagggccactacttaacaaaccgccaaccaaaatgtcttcttttaggctttggctggcaggcagatgagcccttactcctactcgaatcgatcactagtcaccactcctgttctacatgcaacgtgtggtacccaagtatggaacacagtttttttttttcgacgaagtgtcgtgtcttagaaatggaaaatactgttggtacgtacagtactagttttgttggattataaggtgtaattttcatcattaatcccaggtagtttaatgtaacatcccgtgatcagtattctgtacagataaaatatctacagagcgtgctagcatcaaataattagagaacccataagtacaatatactgtcactatatactagcaacgaatggacgaattaaaaattttatgaaagttagaaagggttttaaataatttcatggttgagacttgatccagtctaatttatgctcgatggtgccggtgcagtcgctggatcttatttgtgcgcctgcgagagacgatgacatgcgtcacagtttctgatcaattttgatcatcattcaaaataggggtataatatgtacttcgattataagtgatcaattaccgatcaaattgtaagttgtactataataatagctgtgcgtgaaagtccttaaacattttgactcttcctagctagactaacacattcttacaaccctcgatgatggtatcaatttattttatctagattaattatttttttattaacaaaaatatccaataacaaataatacatgcacacgtatatgccgcgcaatgccaattcacaggtcgtacgtacacgggtagaacaaaaacagtgcatggttttacatgacgtctccagtggcaaaaataatacactccacaccaccacaactacatgttgttgtagatgggagggaattaaaagagcactagtcaatttaattaggggctggctggcgaagcagcaacacgttacggcgtgtgataccatgtccacacacgcacacagagcacatgacgagacgagatccggcagcagcgagcaggtgcattaatagggtactggtagacgttggtgtcgtacttttattgcctgcccggccagcccagccaagccagccttctttctctccctccctctcctcctctactactctcccttcatcccgataataattctcggttgctgattcccttcatttaatctcgaccctcgccccgtcttacatttcgaaattctctttctggaccaccatcaccgcatagtcacaggccagcggtatttccctccatcgcggtgcaagacgataattagtccatgatcgatccatcatgcatatacctaggaccgaactggaagaagcaccctagcgtattgccgctagtagctagctagccaaatttgcttcgacttttgcggtgacgtacgcgcccatatacatggcaactttaggcgtcatcaccggggctcgtgggcgtgtccgcttccagatcaatggagtccagttgctcgtcggcgtcggcgccgcgagatcgagctagctagcgagcgatcgagtcgcggtcagcaccatacctgcgcggctgggcggcgagcgctactagcccatctggtaatacgtagtactgacactgtggcgcgcgtctcacctaccatctccccaacgagatagaggagtcgacggtcaaacgtcaaagctgtccgcttcggcgcgggagaggcagagtagtagtcaacgaggcgttgggaggcagcgggcaggtagaggcagagccgccatccagtagcgttgctcgtcggggcactcgcgcgcgcgcgcgcgattcgatcagtcgggcaaaccgcccggctaacttacgcacgtacgctacgccgttggacgtccgattctggccgtaatgaggtcgcgccgcgtgcagctccaaccgcgcgcttttatcattactactatctcgttccgatccgtaatccgtttccgtccccgcgcgccccacccgcctcccatccctctaggtctcacctgaccggaaaagccatatactctcaaccgcggtgacggcgacgcgcgctgccgtgcgtgcgtcggtcgaggccgccgcccagcacgcagcgcgcggtgcaagtacagtgtagccgctgccacgccgatccgtgtggggatttctccgacgcgcgcgcggtgaggacacggttggatcacggatgggaacggggagatttccgcgtgggaggggaaggttctctgtcgatctgtcactgtacatgtagcgcacctgtaaccgttcggcgtatatgccattcagggtgtcaattcctcaactgcaaaccacacgcggcgctactcaatgcagtacaacgactgtaacagtgatcggtattgagagagcccttgtaataggacgtcaaatgttacgtagtatcggtactgttcacttgtagatactagatagctatgcatactagctagcttaatagtaccacctatctaggatgtgatatgatgatgttaggtccaaactggcgtacttactcctatatagttgcggtgaagttcaccatccaagccacatacgtgatgattctgtacgtagagattaacagtagtttgttggatggtgtctctcgtctatcgtcaaaaacctgaaagtgccatcgatcccctacaactgcactactaccattaagtacacggatgacggatcagtacatataggggtagtactaaaagtactggtatagtagtagctcgtgcagttcatcgatcattcacgtggaagaaacatagtacgagggcgaaaaattatatccgacttagcaaattctataactcctgcctatctacctcgtgcatgagacttgcctgcttattcaactgaatctatatatataggaaagtaaattgtggagagttaacatcacgacgaggaacaggaatgggtatcgatcgtgaggtgaggccccggggcaacccgcggaatggaatctcggtacaagggaggaaaatctagcaggtgggcacgcatttcttgcacttgacaacgcacttggtggacgggatgtggctgaggctgctactggagctcgacctgtagcacctcttgccgcacagcaccttcttcttccggcacatgtcggcggggatgcagttcgcggcggacttcctcgccggcctccccctcgccgtgctcctcagggacgccctgatcgcgtcggcgccgtcgccggtggccgcggcggcgtgccacccgtccgctccggcccggcgcggcgccgcgccgaggaagtcgctggccttggagatgagctccctgagctcgcggccgagggtggtcgggatgccgccaccgccgctctcgccggcggcgagcgagagcttgctaccacccatggcaacggcgagcaggagcactatcaggaagcatgatctcgtcatggctgtcacacctcgtgatgttacagcggtacacatgagttctcatgtgaatactgttaccctcttatataggagggtcattgcagcgatcaaacgaaggcatggaagcatttgcatgaactacctaatttgcagtgaacatcaaacgcgtgatgatgaacaggcagcccaggtgtgaagtgtgaaccatggacggaacagcttagcaattaatcggcctgcctttccttgtaatagttccggcatgcttgctgatgtgaacgtcggctagagaagggtgcatcgccgcctggtcaagttgtttgcttgattgtagtacaattttcttttcatacgccagtaaaagacaggtgtacagaaagaggcatgtcaagacacctggttcattatatacacagttttaactaggacaacttatttcatctatcctgaagagtgtgggttttatattatagtgtggttctttagagcaagcaaaatgcaaataggtaatatattcattgagttcgttctaattctacaactaccgagcagggtttcctaaaccgccggggccggggttaccgcgccccggcggtaagcacgataaccgcggtaaccgtgaaaaaccgtgcaaaatttatcaaaaattcaaattatttttaaaatttatttgaatttaaggaggttaccgtggtaagcccggtaaccgcgcggtaaggtaaaccctgctaccgagatcattcaaccacactcatgcataggattgtaggactaggatagctttcagtcatattcatacataaatgtatataagaaaaggtatgcatttaatcagcatgtccggattccagaagcaagcttcatcaggaaggcaagaaagccaaaccatgttacctgctataataaatttaaat

SEQ ID NO: 50095 - DNA, 5311 bp, Oryza sativa
tagacacatatgtatgcctagattcattagcatctatatgaatgtagccaatgctacaaagtcttatattgtgaaacggatgaagtatttcataccttaaggtccataacaacctgcaagatggaatcatgaaacttacaggcaaaggatattctgcagaccagtcttgctatccatcattactgattaagatagttggaaagcacctcccaacaacctgcttagcccctgcatggttgagcggaagaaaataagagactataaacgagcatgatcagctagagagtagaggaagagtacgttagttcaaactgaaggttagacttgaatgaagaactcaaaatggtaccgactaataaagttttcctttttatcagagttttgcatgtggagaatctatacattgagaataaagcaacctgtccaaccccccatgttaaatgacactagaccccccaacattaaattagtagccacaaatctcccagcagacatataacaaacaccactgtactgtactgctgtactgctgtagtatccaactatccatgatggggttaatacgttgatcacctgacacaaaccgttgacaagaaaagcaaaatagtagcatgttacatacttatatagagaaatatggtcacctaatttctaattcaatcatgattaggacacaaaagagaactggcccctccaaaaataaagcaatcaacccaatatactccacgccgacgaaatatggaaatagaagctcattggaatgacaccttttttatgctcatgaaagagggagcacagaagataagcaatttggatagattttaacaaattataaagttcttattataaacctaagaagtgcaaaaatgagttccaaacccagaaatcccctataacctttatgcattaacagtagtgcgacagaatactatgattctacagttatagaactccttcggcatgagtatttcagataagcaaatgtagtaatttaaccaagaaatataagccctatttattttggaacaaatgagaacgagaataatcaaacatggatgtttgtctggtaagaatataagttactttattgcaacacatcatactacctaaatttaaccaagagtgaccataagtccacaacaactttgaacctagagttacatgagacatgaaacattctggctaaggaactgttttctcaattcaagatttaggtgttcacagggtttattcaaacatagaactgtagttattaagtatttatttaatccaactttgaagctcataagtaaatttgtggggatattattttctgcatagtaaaactatgttcatgagcaatgatcttccaaagtggttccttggctctaaaaaggtaaaaaactaactttcatcatttggaagagaagttgatacgatagactgcaacatttccatttgcagttcagtccccagaaacaattgttgaatgcatatgtatgccatgaaccaaagcactatgtttctaatagggtgtaattacctaaacaagagtacacaacatgttgaaagagttatcattaaatcacatccaactgaaaactcccatacaatctaattcggaaaaaaaatccccatacaagatgttcttcccttggcaaatggcaactgatggatagatactcaggctaacgcatttatcaaaaccacaggttcatgagatgaggcaaacgatatgcattttcatatcaggggaacaccatgaaatgcccacaggtggatgataaatacgctatgttgcaaatcaggcttgacaacaagcaatgcgacttttctagattttaaacaccacgtcatgttatttaccaagcaagcaaggttgaacttgaaagggcatatttctcagcatatcaaggccatgcaatgatttatgttcaactaaccatcaatagatgtcggaaagcagattatgcagttcttttaaattgttgttgctgaagaatgagtgctgaattttatggctcggaaataagaagcatctgacaggttgtatgaaaggatggtctgttgagaacaataggggagaacccaactgaaaaggatctacaggatatagagaaataacaataggagtatacgcccaaaaaatgcaaaaattgacagaacaaagtaaaagagataaccaaaaattgacaggtgtacagttcctacaaacggtcagaaaaggccatcaggccgtaaaatgaaataaacggaagtctagatggttagctaaatgctcggaaattcctggaacaacattaatataacaaaacgtacacatatgagttatatatggtctaagactttcttttgcacttgaattaacattttccatagtaacctattagtggtgcttttacccactaaggaaaatacagcttaaaaaaatcaatgacagaccgattttttttacttcaagttacaacacaaagacaaagaaaattcaaaactgggagaagcatttttattacataaatattacaaatattcggtataaattacaagaccgtaaaagatggcaaagtcaactaatgcacctcactcaatctcaatttgttggggcgcatcattttgagatccctcacttgattcatcggttcggctatcctcagcaactccagaagcctctaccgtcctagtgatccattccttgagaggatcctcattcaggtcaagcctcaataggccagcaaacacaccacccatgaatgcaactggctcctacacaagaggcacgcaaaccatcactccatcagtacatgttctggctttgggaagagcctacgaaaattaaaggcaattcccttgcactgatgggaatattgagcatctgcagcttaagaatcaactcctatggaccaattcctgtttagaacgctgaaatagctatatgtaaaatgtaactcaattgttgggtaaacctaaaactcccatggattcgtcaggaacctcacaaaagggtgtgttgtttcagaatttacaactagagattttacagcttgacctcgacacatcgaattaattcatgctataagcctacaactaacactggatcggaaaaaaagaactggaagagtcggggacgatacacaccttcaaggcctcccggaggatgcgttcgtccccgggaggattgaagcaagctcgcacggtccccgcggctccctcctactccgcccctcgaacccaacaacgaagcccctcctcggaaccggagccctcctccgcgacagctacaaaaaaaaaaaaacgaagaagcaatcagtacaaggtcaaaccctctcgcctgatcacacgagcgttcctgctccaagcgcagcgctttaccgcggcgggagctcgcgagtttgggaggaggagtacagcggaggaagcagcggcggccatggataacgcctcgagtgttcgccacgccgcgaggtttgccggaggcggaggatttttttcctcgatgccgtgtacgcgctagatgggctcaggctgggccgaaacgggattccgctgacatgcggcccgtataatatgggccggaatgggattgtgacctacgtgaggcccatggagtgtaaagtgtgggtgggccgtactggagagccggagccgagttgcacttgcacgggctgtcacctgtttacgtcagcgagactgcgagagcatacgcaaggctcgcctgagccgtccgatcctatctgcgcggcggagattgaaacagctcagagacgctcgtggcggccgtcggtgaggtcgccggcgactacatggatgcctccggtcggatcgatctcctctccggcagagatgcacaaatacgtcgatctaccgtctacgagctattctcacctcgctcatatcagacttgttggatcgatctccgtttttttttttttggtgttcctttgtggtttattgctgctgctgttttttcgtgtcagcaagcacgcgtcggtttgtcagttacctacttctctctccaggagtccagcttgttcctcgcatgacgatcgaggagaggagcaatctctccaggctgggctaggctagctagaggctgcatgagatatgtacatgtcgacgacatgcatgtcgtgtactgttgactcctgcttctccgttccgcttactggtgcctgaccacaggtagtgaggtagagggtagagatagacttcaagtgctcacgcattttccctgtgccgttttgagtgactattaagcttaagctggactgctggatagaagcgatgactggctccatgaaccaaggattaatctagtaagacggtcacgtacgccagatttgatcatgagcaacagtgggaaaaaagcgaataagagatgacaaactaagctgcgaagcatgtttattcaccatagtcgctacacgggaaaaagctgggacattctgttttttcagaaactattatgtgtctttctcctgaaagcaatgacaagtaaagcttatgggtgtgatatagtaccacgcaacatatcatatatagatgcacaagctaacgggttgacagaaatattccatgcaggcaaaataagccaaattaaagaatgcttcttaatccatcgcatgacatggcctcgccggcagcacatattttccatctgaataaaggtttatctcatcctgtcatatgtatagcttgaagttttgtacaagatgcacgcacaaactagcttccacatcgcacacatagagcactaaatggtaaaaaggaaaaaaaggcagaaactaaaatgggaagataagtccaaaaggccacctcagcgatatctccacctgacaagtgatgattcatacgacccaaacccccaagacaaccagttataaatgtcagagactgtaccaagtaggaatgtaattaagatcatatctcctagatggctgataagttaaaacaggctatatatgcttctcttccctgagaaaagaaccagaccacacatctagctagctaggtagcccacctcaacatcggcttacttgttttggagtagatgtttcagattagaagcaacatagagatttgagatatgggaagtgctactgctgattccagatctggtattaagctttttgaagcttgtatcaattcgaatctgaggtccttccttcacagtgttacgccaactttggagccctacaccgttgccaaggtacaaaccatcatgctatcttttaagaaaaagaaaggctgtgcttctgcttgtcaaattcttttctcctttgatttctgtatgaatcagttatgtttccatagaaattacaagaaatgaaaaatc

SEQ ID NO: 50096 - DNA, 4236 bp, Oryza sativa
gtgtctttgtctatgtcatccttctttgttattccacgcgtatgtaaagtggcatggattcaaaatactttttggcgcgagacatgcatggtgtcttcgtgcgaacttttggcgcgaaacacccatattgtaacgtatcactcaagtcaaacatttgcttttggcacgtgcgagacacgtgtcagattcagtggcggagccaggaatttaaccctatgggatcaattactattagtttgtatttaagtgaggtcatttctctatttttttttctgggtttatacatgaaaaatggtcagattgatagcatctttacgaagattctatgtgggatagaattgtagaataaccatttaacatggaaaatcaccatatgaaatggatgtctaaaatggtgatcctttcatccataaaccttttattttgccacaccttgtggttatcattacctcctaacaaatttagccttttatgcgcaaacatgcatgcttcaccaagtgctaacctattggttagaatcctgtgcacaacagtaaacatttaatttattttcatatttgggtgcgtagatgtaatctttattagttacatttgcacacaaccaccttcatgttgacttttgtatttaacatctccacaacttttgatatggtcatccaatgatagaatgtattaattaaatatagaggacttatatagattgtattggcacttattaagtaggaccaaatcataggactaatataggaaactgcacatatggcaagagcagtcgtttcatactactcgacatcccgagttcaattccatgtgacacgctcccttccttctaaataaatgacacgaagctcctccttagtgtcccatattttttttaagaaggcaaaagttttgtctcgtatatattaatagagcaggagaaaaaacaatcaaacaaccaaacaagttatttacagggccctgccgaaaaaaaaacagagcccacaaaaggagaaactacgttggctctcctatcagggttgactcagcgagttttgcgactcccgccttgatccaggtcaacgcctcctctttgattttagtgatgatggtgattggggttggtggccacgtggtggaactgtgtttttttaagctccgctggcagcaactttacaggatgaattgcttattatagggaggatttttattttgttcttaagtagtgctttagttgagaacgtagagtacttggctggtagggtgctgccaggagatgctcaacgacttgggtttgaaccaaagttcctcaccccctctcctatctttcttaaatacattgatactaagttcctcaatatccaacatgttttcagtagtccttagttttagttttattgctatctactggcctgaattaaataatcataattatgatctgtgtctgcagccaggcggctattctggtagagtgcccgagttaggtagatgcttcttccttgtagacctttggaaccacttctacccgttgagcgcctatggtgtcggtactccggttcgtctcccttccggtcaggaaattgagcagtactttgtgccgtatctttcagccattcagttgcacaccatctcagacttcacttcatgcaagtaagtatatatatgtcagtttctttgtgtataattggccatcagatgcatgaagagtttgagagttttacatggttctttttgtctgaactgggcgtggtgacagcgagataatggtcggcaataacttgtttgatgcgaacaactacggctggtgcagtgcggcagataactggaatggtcagtatgcaacaacatcattagcgaggtatgacagcccgaggtcaatgaatggagggccatgttttcagtactttgaatgtgattccccttatgaaaggatgcctctcgcagacaaggtacgcatgcagtagtagctatagcttcaaacttcttctctggaaaggaaattccatcagtttttttttaagtttttaacttgcacttaactttaaagcttactagtagttcatagtatttgcatattccaatgaattgtacagattagttcttccattgcaaactgccatgttatatatcctctttctgacattctttctatctatcatgtattcaggtgtatgagctgtgctataactttccacccctatcatatcttagcagtattgagctctctccatctagttggatgtcagttttctggtaatttttccaaattcaaaataacttcctcatgttttttatttaatcatgtaaattcacaagtacattttagggcaacgttagctttccattaacttgaagcaggattgcagatttatttagcgtctctaatctaattgtgccaaccaaaacagaggtccattatctattaaaaaaaagagagcaaatcagttgccaatcttttatatttacttcaggtatcctataggccatgttcccgcgatgaacaagaaggacctgactacttgcttcttgacttaccatagcctgtcaacattagaaggtaaataaagacagtgacacattaccattaattttttttacttcctctctggaagaatgctatatattcaaatatgaataatattttggctccccgtttgcaaattgcaatgacttgagtttcgtcaaaatcctgctatgcaactgcacatatattggttcatgctcttcgaacaggctttctacacatagtgagatgtagtgcttcagtttttctccagaaatgaaatctttgttttgcatatggagtgtgaaattaatgttctcgatctaattcagaaacattgtgaacattttattgtagatcgtacgccgtttgacagcaaggacccgctgacgcttcccccaattggcctcgcgacgcacaagacggacggagatgtatggacaagcgcgaactccggcgaccaagagctgaccacctccctcgtcggcgcggcggactcgtggctgaagaagcttgacgtccagcatcatgacttcaattacttcctcaacagtaacaggaacctgatccactacaggtccttgaccgaagcaagtaccagtgcagtttgacatggcgaacttgactggctgaaagcggttgccggagctggttgttctgggtacaagaaggaagactgcatcgatactctctcttctttttatttttgcggtggtggtttgcagtaattggatcctaatcactgagacatcgtagttggtactgaataattgcttgttttagaccaagactttatcttgacattgagttttactttcacatgaaaaactgcaaggtgtgtgctcgaaagtatgcagccttcagaaaagggagttatttaaatgtcctcgcctgcaaatgttgggttattttgttgtagcgcagtagcatctgtggccctctctctcgtggtagcatttggttgctcggttgttcccgtgatgatttatttaggaacatggaaatctgctaattattccgtaattttccagccatgatatcaccatgtgcaatttgtggcttatggtacactagagcaaatatgcaggtgctatgattcagctcgatacatcagtaatcctcggcggccacgggaagccgagtatctgcagctgccggcggctcaggctgctccgccatgacaaactcgtacagcgcgccggccatcccggcgccgatgagcggcccgagccagtaaacccagtggtggcgccagttccagccgacgagcgccgggccgaacgcgcgcgccgggttcatggccgcgccgtcgaacgggcccccggcgaggatgttcgcgcccgcgaccaagccgatggcgaggggcgcaatgtcgccgccgccgcttctccggtcgacggcggtggcgtacacggtgtacacgagcccgaacgtcatgacgacctcgagcagcagggcgtgccgctcgtggatgcggtggccgagcgtgaagcccatggggcgctgcaggacaacgtttgtcaaagtgagacgtggcaaacatgacgcacctgtacacgctggtagtggtagatagctcatgccaaaaggaaatacgcaaacattaattttttggttttttgtggtaggccaaaagaagcaaaatacggcgtcgctaataatgatcaattgatatataacagcatgtaagttgtaaatgtgatttaattaagcgctaatgtaggcttttggtgacgaagagataaagaaaagtg

SEQ ID NO: 50097 - DNA, 4013 bp, Oryza sativa
gacgagcacgccgaacgtgacggccgggttgacgtgcccgcccgacgcgttgcgcgacaccgccaccgcggccgccagcgccagcgcgtgcgccaccgccaccaccagcaggccgcccagcgtccccgtgtccctgtacatcttccctgcagcaatccaaacacacaaaaaaaaaatcttcagacaaacgcacgggagagcgtgcgggcgttcatgcatgcggttgggttcgcgtagctattttacagaggccgtagacggagccttcggcggcgaagacgaacacggcggtggctacgaactccgacagcgccgcgcgggtggcgcccggcaccaggggctccatggcggcggcagcggcggcggcgtcagcacggcggggagtgtggcgacctggcagcatggttgacaacgaccaagctagctaggaaggatttcgcctttctttttccgttcgtctgcacctggtgctcctgcgtcctccgggtgaagtgctagttgagtggcaggagccctgagcgggacaggacgacaggtggtcagcgaggagggacacgtgtggcggggatggcgccccgaaaatcggcggcggggaaagctgaaattggagacaaaaggtgatacattagttgcaaatatttgtggaaaccatcagcatttggctatgggctttggatcaaacttagaacgcattacttgtaagtcactgatacatttgaaagaaataattctgcttgaacatttgaaagaaataattctgcttgttctatatccgaactgctttcttacaataacatgagtagcactacaatactatcaaatttgtacttctaagctgtcgtcaaaatcccatgtagcagaagttgcggctatagaaacattgaatttcatcagctgtttcagacgagattagcgatcttacagaacagggaatcaaatctacaaacttggttcatttcctccagaagagacaaggaatgtaagtcgaaacaaaaacttaaaatatgtataattaattcaatcagcattctcgctttgtataactcataactaccaggctcttaaacaacacttttgccagctcaagtaataatagaaaggttggagatactgccacaagttataatcctaataggatttacaaaacttccagctgagtatcctggaactcttcttcgatgactcaaaactcagagcagcaccagctatccaccaaggtgctcagttatgttttaccattaatgcccttcatgataaaggcgaggggccatgccccagttcagaatcatcgaccatcttctctaatgactcaatatcactggtttcagaaagtatgtgaatcctaatgctgtctgcatcctcactgctcacatgaaaaaagaggaaaagcataggtcatgacagtagcattaacagcagttgcagtaaaagaaagatccaccacaaagtaaaattagtcatactctgtaactccgaaaatttctttgacaacgagtgagccatcgcgtgagcagaactctgggagctggatattcacaaaaaaacagtcataagttatatatagcaagggaaaatacagaaaatcagacactggaccagtttgaaaaactatgaaagatcttattacaggacctagacaagactttttaatccatttttctctctgggtgttgacaaagcacggtgcatcaaaacaataatggaataagttttataccccaaattttattattctccaaaggaatttaaatcataacaataatattacctaaacagattctgttgtctttgaatctagttgtttatataacttttgaaaatactgtatcgaattcactccactgaatccataggcaaaaaaacaaacatacaagtatcaccatgataatacaagtaacacttctaaattctaactgaacaaagacagataatgtttttgaaaaatgaaagattatcatgagctgcaagcagagcaataagtgccctatcaagccttttcatttcagtacagaggtcaagcaaaatctggcttatcatcaacagaactggaccttttggtcaagagaaataaactatcaacagcttacctctgataagtacaggatttttccgaacaacgtttgcacagcaagcttacgcttaaaaccttgttctgtaaacccagctaagtccatgactactggtcctgcaagatcataaagatgcaaaatctcttgagtacttctcacagacttgttctcgcaaaccagaagcataacctcatgattaccaagtactgataggtgacaggagataaataaatcataaggaatcaaggatactctccttacgtatattcatactatatggctcatgcatctattgtatgaagaaattttgccttcaagcagtaagatcatagatttcaactgacatatttaaaaattcaccaaataaagcataaaaatgtacaagcataatggtatggcttacaagtacaaaatgctgcgttgatttcatagaatctttttcagtacttttgaaaaacagttaattagtttgcacctggcataaacaaaataacaaggaattgcagaaattttattactggatgcggattgctaccccacatacatgtatgttaaaatgcttcttgggaaaacatgacaacagtaagtcaaagattttacattatgatacagacatgtttttcacgcttggacattgtactattgcacgaaacaacataacagaaaatccccactactaattgtttgtcatggacatatctgaaggctagcagagcatgtgtaattgagaacgatgggagatacaaccgaaaggcatgcttagtatataagcaggggatgtcatccttcaataagtgttgcacaaatctttaagcatggtaattgcttcttcttctaccttgatttgttctttaaagtgcagttcccatggggtacatataaaaacaactcgataggaaattgtgggacacacaactatcaattaccagaggaatagcattgagttacacaagtacacaagccagagttgaatttaggaaatacatgtatccactattaccactagaatagtagaatcagacccaaagaatgagcaatacctttttcccgaacaattcgtcttgaaatctcattcaaaatttcagcaacttcagcatcttctaacattgacgctttcctaagatgtatgagatccacgactacatcagggttgaatggtttttcattcagtgtgtatcgaatgtacttccttactacatcatccatgtcaaatcctgtctgaatacatgccaaaaacaacagttaaatcatgtggttggtagctttgccactaaatacaaaggcatcaaatcattcctgaaacagaagtagatatcatcatatcaacaatggatgtattggtgcaaagaattaacaaattactatgtccaaaatcatcattctactttgtgcagcaaattttctaatttagatcataatcacaatgtggctagcaatctaaagatgtataccacaggataccaatatcaccatcagcagttgattgtcataacaagatttcctgttatcacaagatatccattaactaatgccggctaaagtacactcatcatccataaatagacaataaagcaagcatatcatagaactagtctaatataaaggttgaatcaagggcacaccttctccattagttcttggagagctggaaaatccactgcctccctgcccttctgaaacaactcatctagtgacttcagcaaaaaaatattcttgctcacctgcaaaggaacactgctttaccattaaataccaagaaggtatagcaccataattattctataaataaagtcaagttcaatattgcagtaaaaaagaggaagcaaactcagaagacagttctttgcatctgcgtaaaggcatggaggagtgaaattaagtcatggttgaaagaaaatcattgcaagttcattgcccttctgagtatgctaagttataatctag

SEQ ID NO: 50098 - DNA, 7025 bp, Oryza sativa
taaagtcaagttcaatattgcagtaaaaaagaggaagcaaactcagaagacagttctttgcatctgcgtaaaggcatggaggagtgaaattaagtcatggttgaaagaaaatcattgcaagttcattgcccttctgagtatgctaagttataatctagcttgaaacatcatgaatgcataaagtgaatatagttgatcctctctactcactagaaatactagactgcaacattaaaggaaataccatatacttaacaaactcaatcaaactgaaatttttagtggggtatacactactttatgcctagatataaacttccaaatatagaatcccctgctgttcccatcgcctatagtcactgacataggtaaattaaatgctagatcaatcctaagaaactacttttccccatgatgtacctaaatttccaagaggttaaaagtcgatctcaactctcaagagaacggccagctagaaaacgtaacagaatagaataatttcgatcttatagagcagctacctgatgatataagtgcaattacattccgaatcacgtcacttccccagcttcccaatgagcaccaaactataaacgatggctcttcactgggtatcaaactacaaacgattttgacacggaaaacttacccttcgcttcttctgggtgcgcggggaggtgaacctgcggacggtgcggacgacggcgagcacaaacgacacgcctacgtaggcaagcggcacggcgaggagccacggcacggggctggagccgacgcggggccccggtatggcctgcgtgacggtgccggtgaactccacgaggtccagcgccttgtcctggatccagggcatctcctcctccacctccacctcctcgtccgcctcccgcttcggcacgtcgctggggttcgcgggctgcctcgaggccgccgcggtccggctgccggggcgcttggcccgcgcgacgaggaggggcgtcggccgccggagaggcctcgtgcgggtggggaagggcagtgcgagggtcccgcgacggagccgggcggcaccgccggcgccggcgccggcgatgggggtcgtgagcggctggaagaaggaggtggcggtcgccatggaggcgggcggggtggcgacgattagggcttatcgcggcggagggccggaggttggaagcacttttgtcgaggacggagacccagtgggaagtagctgaaccaaacttgtgaagttggtggtggaagaagaagcaatgggccgaaaggccgaacttggagtactatcatatttgggcctcttgtcatagtgcgttggatgggccgttcttcagaaatctgaagaaaccaatcggtaaattgaacatgtttttcctgtcacaaattattactccatccatcccaaaatatagcaagttttatttggattggatgtatcctagtactacgaatctggacatgaggtccaacaaaaagttgctatattttgggacggatggagtaagtcacgcatatatatgaatgtagtcgaagttatatgtgctaagtgaactagagaggcgaggcaagcagtgaaatagcagtcgtctgatcagttcacaagcacggacctcacctcagacagctgatctgacgaacagttaccaattcaaggcaatacattgatccatcattagctgacagtaatcgcgagaataattaactttgatctttacccactcgtataatccgtctagaactgacgtcatattacaagttcgtcagttctccatttgaacagtaagtgtttgttgtaaattaaattgtggaaatactacttatttccgccgaagtgtcttggacgcttcattgctgactcaaatttatgtaccaccatctcaaaaacaattgatctaatacggaagcactcgtagaagaaacaaggtgatgttgtgtgtcgactggtggaggaatgcctgtatcagtgtatcagccaaacaccacaccatctaatcaaagctttggcttagattctctggaccatgctggtgctctaactttcaggttggacttctcagcctcctcgtcattctcctcttcttccaaaatctctttagaaaacgcctctggattgattttgatgcagtcctgcagtgcgataaaaggcttcacacaatctgatccctgcgaaggcaaagagtccaaaattgtagttactattccggagaaacagacgatgaacaaaaacttagcattcttccaaacgtgaacaacagccagttcttgagattttatttgaacaaataacaggtaaccgaataagtgcctttaattaaaagaatctgccctacattaacattgttgtgtaaccaatttgatttgagaaaatcttctttatgcactcattgcagccctaatctctgttctgccaccaacttgacctggggaaaaggcatactggtgatgttacgcagtgcactctcccatcgaggctagagcaagtgagcaacccaagctaaaaaattctcctgttatcacggccctgctatcacttctgataagagaggaagccttttctctaagatagaagtggcatctatggagtaaggtgactcaaacaacaccgacccaactccaagccgtagtgtgaaatcctgaccagattacttcgattcacctcaaaacttacacttctccttgtttggcaccactgtccagttactcagttgcccatcaagtttgcacctaaaagacccttatatagcatcctcataatttctctgatgtcaaaattttcaagaaagttttaaacatttaatgcaacatagatccctgaagttcttcagtttttgtgacattttgattttccatggattctcaaaatgcataaacacataatggtcttttggtgaacaattggactgggcaataacaatttgttggtagaggagaatatgactgcaaagagtggcaaaggaaaaagacaaagaatttttgtgcttttattatattggggtcataaaatgatttgctcataggaaaagattgaccttatgttcaattagatcaacgaacaacttgagggagctttttatatttgtataatagaaagaaacacagacacatttcctacagtggcatggcttcagcctgaatgcccaaatcagctggaaattatcagatatctgtaaaaacaatggattacatagaaatatatatatggcaaccgatagaaaggttacactacccatcagcaagactgcacatgagaaaattgcatccataaaacaactttttttgtaaatattagctccaaattttagaatacttattaatgtgattcttatgttgactaagtttttcatgaacaccattaatatattatcaccatggtgatgtgcatgaatcattcttgcattgcaaattgcaagcagctcggtgccatggagaaagaaataggaccttttcctcttctgtgcttttcaggaagcaagagaacgcatcaacaaattgacttccacaaggaccatttttcaactcagctacacatggacagtccagtgctttctgtaccttcacatcaattgactgaatacacaaaatactaagttcactgatcatccagggtgccaagaaatagtaaagcaaataggatagtgatatataagcatcccactcaaaagtcaaaagcaaaataaagtaccatacctcattgccatcctcgtcaaatgacatagcctctgcatttaaggaatccaacctcagaatgctagcatgagaaactatggagaacttaagtgatgcatttttttaaggaaaaaaaagagagagaagtccataatattgatggccattgcagtaattttgactcaattttttttgagataaaaagaaacgcgaatattagggaaggacctaatatcaaataaatataaggggtgaagcttcaaacttaggccggctagcctaccaccttgtggagctagctataagacccctgggttttgagatagcaagcttgctaggaactgagagtagtgaaattgccactaatactatattagctcagtgactcctctgacccgggtgttcttattcttttgagagggacccgggtgttattaacttacaaaaggatcagacaaaaggattgcctgccgatgcattaagattttgggggaaacaaggtacagtgtaattgacttattacatcacgtgcatgacattaatattttaatctatctaaattgtcaattccggcatgaatgattggtaagatatcagctatcatcagttcactatccggtacacggcctgccctgcacaatcacatactcgaattcgatctaaaaaaagagagatttggagggagagacttcgctccaaacattttcttaagaatgaaattatgagcatgttagggattgaacacagaaatttggtattaaaaccacacacctcttgccactgcactatctactgcatctcaaagcttcccaaatccaaagcaacacaacaatctagcgcggctaccgcatctcaatgaaaagtcacgagtgcacgagaaaatcgccattggatcacaatattcagagtttttggcatgtacctgcggcgagcgcctcgagggaagatggcgccggggcaggagacggcgacgacgacggcgccgcctcgacggcaggcggagaaggctcctccaccgcctgcgcgggctggctcagaccttgacccatcgaggtgtagcgctagagaagaagcaggcggcggccacactctctcgtcttcccgggctgcgacggcgagaacgggagcaagcggcggcgcggcgagttggagcgtggtcaagtcggccggcgtccaagtccaactaaataacaggcccgagcaccaccacatcaccggaagcaaaattggacccgagttcaactccggcgagcgctttcccagccgtccaaatcgcatcaagattcgtgcaacgcggagacaggcttactgggccggcccggcccgtttggtgaatggctcgcgacctcggagaacctaaagcctaaaccgcggcttgggttcgggggagctccaggccgccggcgacgatgggaaagccgctgggcgacagcgtgttcgccggccacgcggccgccggcgtcgcggcgatcaccgcctccgcggtcgccgtccacccgctcgacaccgtcaagaccctcctccaggcgagcgcccccctcctccctcagattctctcgctgatgctgttgctggccccttctcgggggctttgatttggtactcattcgcgggtgttttactttccctcctgtgctggctgtgcagttgagcgctacggggtcgcagcagaagatggggctcggccaagtggtggaccggctcatgtccgcctccggccctgcaggtttgggtttcttgcccagttgctagataattagagatcttccactgtttttagtggtggtaatcccatatcgtgaattgcgttagggcatgtcgatatgcatagctttccaacacctacaagctactgggggtttatgaggataggtgatgtttgagttttgcggttagtggtgagtgactacttgctcagcctgccatccaaaaatcatggtagcattgggagactgaaaattctaaaatggatggtaatttttatgtagtgcccacattataaactatcaaatttgtaaaaagaacttgctgcaaattgatcatattggtcatacttggcagctggtgttgtaatagaattccaggccacctctttagtttttggccatattcttaggtgtctgttccttataaaatttcctggtcgagaaatacagggagaaaccatgtgaatcctgcccttttttctaattcctgtgtgatgatttctcatcacctatatatatgttacattggaatgaaattattttcctttgaatttattgtgtgtgcttttaggcctttacagtggcattggatggtcagtattgggcaagctgcctgggttgggagcacgttttggaacttatgaactcttaacagccttctataaaggtacagcatggttccagaaatttattgctcaggatggtctgccttatagaatcattttgtctgtccatttgtttgcagttatgaacaaacaatacactcatttaagtatatgatttgccaacttctctgtcatattctcttgccttcctattatcattttcctctattacagaatggttagcctccttgtatcgtttaatgtaataattgccaaatgctgtttagttatttgtactatgaattaccgttgacactgcaattttttgctgctgtccaatgcaacaatctgtagatcattttgaaatgcatgcgtttctggatagttaaaagtattcctttcctaatgcaagtactttcttatgaattgtttgttacgcgaaacatcatatctataagtactgcaatatctgattataccagattcgttggtgacttcatcacttgatggtgaaatatgacaaatgacatttgttttgtatatctcccgcagatggaaaggaggacaactatgtttcttactctgaggctatgttggccggcatagctgctggtgctgttgagtcagttttgtgcacaccatttgaacttctgaaacttcggagccaagttggttctgtgaaaccaatgaaagccacagacccagcaaacattacaaaagtggcatttccactgctctccaaactgttgcctggttatgtccctgacatcagagtatggaatagcagtgtcagccttttgtccaatctttccccaaagcatcctgacatgatgggtgccctgaaacagcatccgtggatgcttactggttcagggaagcccccattgccctctgatgttcaggttccttcaagagtgatagcacttgaaggatggggtgctctatggagaggacttagaccagggatgacccgggactgcgtctttggaggaatgttcttttcaacttggcaattcatacacacagcgatgcttacttggagtgctgttaatat

SEQ ID NO: 50099 - DNA, 1687 bp, Oryza sativa
atcctatgcaaaatggtgcaggtttcctttcgacggaaaaaagtaccaactcaaattcgcaaattaatcaatgtttgagaatctgcctggtccacttccccagccttatgaggtagcactttcttgtttgtcttccacaattgttgtacagccttgttgtcataaaactcccttacataaagcctcttaaagtacagcaacttgtggtagagtatcacaatgttatattatgttgaaacagattagcaagcgaggcagcattaacatgtagaaatccagaatttaactgagttttactatgacaagaggtgccaatatcttatgccaagttatatattgttttcttcaaatcatttttgctgtttatttagggtaatcattgttaagtttttttattcaaatgcttattttacagttttacttcatttatagctgatagttaccttttgtttttgtctgactgactccagaactcaatttgctccgttgcttggtagttctggtgttgtcgaaacaagatttcggcaatataaagggggtagcgcacgagacgtaagagtggatggatgcggagacaatgatttagacaggttcaggcactctcgatgagaggtaataccctactcctgtttggggatttgaatccgccgggtgtagtattgatctgacgatccagtcgtgaatcctctaccctagaggacctcctacccaccttatataggatggggggggggcaggattacaagatagaaatcttaaccaaaacggtatcggtttcctaaatctactttacaatattatcaaatcaggactttagaccgttccgtaatatacaaggaaacataatactcaagtcatgatctgtacaaattccatagatataagttatcccctataactagtcggataaccatgtcgtgtgggtatggggtacccataatcttcacaggtgtggtgccagtttggtggatcctcgtggagaactttgctcgttcatatgatatttaggtgatgtgcccattccccttcaggacttttttttaatgaactagcacggacggaggtgtgtcaatttcattgaatatagtgaatttccttcaggattcgctctgcaggtcccaattttctcattgccggattttctttttgacagagttgccagatatattctcttcaggtttgtattcaacttttgttttccagaagcctgacccagatgcgatgccaacaattctgacgcccaatttgcctgaccctgagaatgctcaggaagtggtctgttctgcatttagcactgtcgattttttactttatgtgatgtgtgttaactgtagcgaaatagcagggatgcctccggaggcagcaggcatcagtggacgatggaaagggctcagagcctcagatgctgatcgatatgattcccatggaatggtcagaagggtatctctggtcgtccccgggcctgctgatatcagtggacatagaaggggctcagatgctgattgtaattcccatggatcgtgcgaagagcatccttggtcctcggcctgcagatgtgaggctttagagtttactgatgaatacttaggcataggcgcatggctgaacttggagttggctatgtgcatcctttgcatatatgccgggtatttagggtatataatcatcttccttatctctactacta

SEQ ID NO: 50100 - DNA, 11207 bp, Oryza sativa
gtcacgcggttagcgtttggaggcccatcagacgttcagacgatcattgcatgcgcgggctcctctacgccgagggttttggatgtctttggtggtgtagaatcggcgagttgcactgatgcgtttctgctacgtactggttttctgatgctcaaaagcaccgctgcggcaaatgtgatttttgcattataatcagagaaaggagagatgtatgtacgcttcggtttcactggttggatgatacatgcggctgaggtttttttttttttgaacgtacggtatgtggctgagttgctcttccttttctttttccaacacgtccgtacgaacgtttaccaaatctttttttttacggtttttcctcccggttgattctcggattttcatcatccatcaccttgttatccttgttctcaactccgatatcgacatcaacatcaacttgctccatgtttataatggcatggttccaattttctcttactatcccacactcccactccgcgcacgagctgttgccccagtggcctcgaacaacgtaccagctacaatgatttcacggggccaattgacattgattacgtgctacatgctttatcgtcttctctggctgcagtaccatattgctcgtgaacatgaagttgagagaggtggtactctcgtcgtattataaaaacaaatctaatataaattgtgatatattctaatattgtaaatctgaatatatttttactcatatttataatattagaatatataatatttcggttgtagggagtatttggcatggttgtagcgttggtgacctgagtcattgtctgagcgacataaatcatattgcctactttctccgtaaaaaaaaacccaacctaattagagatgtgacattacctagtccaatctggacataggtaatatcctatccctaattagattgggcttttttcttttgtttgaatggagggagtacgcagtataacataccagaccacatgcagtaaaagaaaaatccatcagccatctctttccgtcgcctctgcgttcacccgcaacgaaaggtatgacactgtaaaaaataattagacttcttgttgccttcacctattttaacacatgtgtactttttaagtaattgaaacattgaattagtgagatgtagcaatgggaatatagaccctgtttagatttcttggcaaaattttataccctatcacatcgaatgtatggacacatacattgagtattaaatatagatgaaaaaaataactaattacatagattgcgtgtaaattatgagacaatcttttaagcctaattgcgccatgatttaataatgtggtgctacagtaaatatttgctaatgatagattaattagacttaataaatttatctcgtggtttaagacaaattctgtaatttattttgttattagactatatttaatactttaaatatgtgtctatatatccgatatgacacgccgaaactttacacacatggatctatcacgaagtcatatatgtattcgatacattaggaaagattattggcaggtaacttgtctcatcagtcgttttgatttgggaaagataatatatcttgctactttgtcttcttccaaccgatccatacgcaaaatctatcgtccttgcccaacagcgccaccttggtagtctgctactagctgcgccatgtcttcctcctccgtgcaaacctctccctcgccctcgcatgaagtcgacgccgaaactgacgaggaactctacaagcagttcaccgactcggtgtcctcctggccgagctcagaacccatgcccttcctcccgctctaccgccacgacaaaggctggtacagtagcctcatgcctatggtcggtgcgatggtcgccgacgcgcggttcgccgcgcgcccctccgacatcatcgtcgccaccttgcccaagtccggcacgacgtggatcaaggcgctcctctacgccacggtgcaccggagggagcaccccgccgacgccgccgccgaccaccctttcaactccctcggcccccacgagtgcgtcaacttcctcgagtaccagctctacaccaacaacagagtcccggacctgggcaggctgccggacccgaggctgttcgcgacgcacgtcccgttcacgtcgctgccgagcgccgccgcggcgtcgggctgcaaggtcgtgtacgtgtgccgcgaccccaaggacaacctgatctcgatgtgggacttcgccaacaagttcagggcccgtgaggggcaggagcccatgtcgccggaggccatcgccgagctgttctgcctcggcgtgtcgccgtccgggccgtactgggaccacgtcctcggctactggggcgcgcacgtggcgcgccccgagcaggtcctcttcttcaggtacgaggagatgaagctcgacgccgcggcgcacgtccggaggctggcggagttcgtcggcctgccgttcagcgcggaggaggaggaaggtggcgtggtggacgccatcgtcaggctgtgctcgttcgatcacatgatcggcctggaggcgaccaagagcggcaagacggagctcgtggtcggcacggcggcgaatagctcattcttccgtcgcgggcaggtcggggactgggcgaaccatctttcgccggagattgcacagcggatcgacgccataaccgaggccaggttcaatggttccggtctcaggccaagtggcactaaatgatatatacctgatacctcccgttgaagtgggctaaggtgaaatgcaaccttcaagcttagcgtcagtacgtacttctataatctatttactcccttcgtttctttacctgtacccttacaaattaagcattgactgattccctttgccaataaatctgtaaaaatttactatctctttcatattataaattatttgattttttttattagtcaaagttataagcttatagaaaaaatatactactccctccatctctaaatatttgacgccgttgactttttaaaatatgtttaaccattcgtcttattcaaaaaatttaagcaattattaattctttttctaccaattaattcattgttaaatatactttcatgtatacatatagttttacatatttcacaaaagtttttgaataagacgaacgatcaaacatatttaaaaaagtcaacgacgtcaaatatttagggaatgagggagtactacctttgtcccaaaaatataaatatttttgggtttcgacacggtcttcaaaatacaacgttgtaacaaatataattacgaatgtacaataactatttttagtttggcaaattttgctacaggacatcacaattgtgtggttttagctcaaggacaccgcaaaaacaaatttttagggaaagacactccataaccgtggatatttgccaatggaaaccgcaccgtctaaatgaaacttgtcttgttgacgtggcggtcgggagcccttttttgatgtggtcggaccgaaatacccctgtgccttatctcccttgggggagtagccggtcatggtgaagaacccctcgctggagtagaagatggggcagttcgggcgcatcgcgtcggagatgacgaacgtctgctgcaggctggacagcgcgtccttgagctcctgcaacacccgcggcggcgagtcttacaacgcgcggtggccgctgccgccgtccaccgacgacttgccgctccccatccccgccgtgcctccgctgtcgcgccccgccgccgccaccggatgctatgcctgctgctgttgggcgctgcttccgctagggccctcctcggcgatgatctccaagccggcggcggtggaggtggggaacgccatccacttctctctcgacgtgttgagtgcggctcgacgaatacagcaacggcgcggctcgcagtggctgtgtagcctgatgcgggcagccggcgacgcagcacagcgcaatcgtgcaagagcaacggccggcacgaaggcagacggcttgcagttggcggacgactaggcctgattagcggagaggaccaggggctgcgcgccatgatgagcgacggcgacggttggcgttgacgagtgccgcaatgtgcggcgaggacggcgctgtgattgacgactagccgcgcgtagtgagggacgatagggctgatggtttggacggggttcccgccaccggtgcacatggatgcgtcatgcgtgtggatgaggcaagaacgatgttcctggatctggagttgcttggtgttgctgctgcttggagaagattggaagacggagaggacggctggctacttgactacttcttgttgcttgttggatttggtgaattggatgtgctcgttgttgcttgttgcttgatgcttgaacgcttgaagagcctgccctacaactcgacgatgctatggacgggttggcgatggagacggagcccggggacaccacgaggaggcggcggtggcgattgtctacggcgtcgtcgtctacggtggcggtggtcgtcttctgttgcagccgcgagccgcgctgccgcaccaccaccgtgccggctgcggctccgttttcgcggggcggctgctccaccttcgcgccggccgctgttcctgcacgagtgcgctgcgctacgtcgccggccggccgcccgcatcaggccacacaaccgccgcgagttctcgtaccagcaagttctttcgtcgatggtggtggcgaattgagccaaaacagctccatacgaagagataaggtgcaggggcatttcggtccgaccacgttaaaaaaggctcccgactgccacatcagcacggcaagtttcatttagactccgtgatgtctatcggtaaatatccacaattatggagtgtctttccccaaaagtctgtttttgcagtgtccttgatctaaaaccacacaattgcgatgtcctgtagcaaaatttgccttttagtttttgttgtaactaatagaagtcgaatttggcattgtatatttgtggagtgatatatttcatatattatgttgttaatatttttttaaaaaaaataataaccacttagatgagcaacgaagaacatccccaaagatgaaaatccatatcccgcacaattcgttcattccatttggacttaacaagtccggctgggccagacagccagaggcagtcctgctcacttgctcagtgctcacgagttatcacgactaacagacatgacacgaccatgagaacagaaccacggagcaatacctgctagcctcttcacacattattcaaccagcacatgcgcacgcacgcacgcaccctactacctatacacgctacagaggcaccaccgcaccacgcaacgcatgagtgaccccccccccctcccctcccctcgtttactctggtgggcttggcctggccttcttgaagaccacgacgtgaggcggctggctcgcgcccagccacgcccgcgcgccgtcccttgacacgcccaggtcctggcacgagtccctgcacgacaccagcttgtacccaccgccgtacttctccacgcggaacgcgttctcccgcccgctcgggctcggcccgatcaacggccccgtcaccacgcgccgcgcccccgtgagcggctcgtcgccgacatgccactcggtggactgcacgcagatcgtcgcggcgttgaagcggatgcggacgtcggtcgagacgcggatggtcctgtcctccggcgccgcggcgccgccccacggggtgaagcgcacggggaaccccttgcggcgctcgtccgtctcctgcgccacgaggagcgggcaggggagcacgcggggcgccatcgtgaggccccctccgtggccggggctagccgggaggacgtagtagctcccgtcggcgctcagctcgtggccctccgtgtcgtacaccggcggcggcgcggcgctgcatgagaaggagatggccaggagggagaggagtatgagggggaggcggaggctaaccatggctgaaacccttcgtctcctgctccggctcgtgcacgacgaaacgaggggagtgtgcgagctggtggctcagggctggtatatttgtactgacctgtagtagagtcgctgtttttctcgacttctggatttgcacgtgcgtttggctggtggttagtggtactactcaccactgcgcatgcggtgcctgtctgtaaacaagtagtagtagtacaagctgatttggaaacagcaatgcgaaacgacgatatcacgtacggttcccaatcgtttcgatactagatgggtatcccgcacgttgcttcgggagaattgtgtgataatatagtagatataagttctaaaattttctttattatctattgtatgattttttttcatgtatttatataatttttacctttatcaattatccatagattataaataaatgtctgggttgtatagtgtgcttttttaggggtgtcggtgacatgggaccgggagtatcatgacttagagacttgaggcagacacgatcacccacgtggcctaacccactcggggggaggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggagaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagatgggggatttatttttttcggatccagaacgaccagagagggagagagtaagagctctctggttctccagcttttttgtagcttcttcatacatagatccacaaaaacacaggagtagggtattacgcttctcagcggcccgaacctgtatacatcgcccgtgtcttgtgtgtttcctttctcgcgaaccttccacacacagactaggagcttagaatctcacccagggcccccggccgaaccggcaaaggggggcctgcgcggtctcccggtgaggagccccacgctccgtcatctggcgcgccaggtagggggttctgcgtgtgttcttctaagctctcgcactctttcgtgtgcgccaagcttttcctgttcaacccaatggctgaacaagcaaaggcacacaacctctctccgagtgttagcggtgacgacggggagccaaacccacgccgtcgagctcgtactccaccgccccctccacgccaaagtcctaggcgggaggaggcgctcgaaagggtcgaaggatccgcgacttcgacatccacgggtgatggggaagggcggcgagatggggagcgtcgcctcctcgtctacggcgacggcagcacgccccagggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggctccgtatcgtcaaggcggagggcgcggcgagcggcggctgttgctcgccattcggccgccactccttcgtcagcgcctccgacccaggaagatctgcgtggggggccggatgcccgcatcagtatcgagcgccagcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcacccaggtgaagaagcggacttacatgcagtccagcgaagggatgatgagtcacttcgctcatacattcagcggttctgtcaagtccgcaacaccataccatgcatccctgcacacgcggtgatctacgcgttcacggggggtgtgcggcacaaccgcatgctcgaaaagatcgcctccaaagagccccagactaccgcggagctttttcagctcgcggaccgagtggctcgtaaggaagaggcatggacctggaacccctccggttccggtgtggcagcttcggccgcccccggatccgctgctcggacagggcggcgtgacaggaggaagaagaagaggtcagcccattccgacgacgagggtcatgtcctcgccgtcgagggcgcttcgcgggccacccgaaaggggaggcctgcgaccgacaaaaagaaggaggccggcgctcccagtagggagcgcccaaccggcaagtggtgcatcgtccacaacacctcccttcacgacctcacggactgccgcgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaatgtgaagctggggcgtgtcctcattgatgggggagcagccctcaacatcctttcccccgcagcctttgacgctatcaaggccccggggatggtgctccggccgtcccagccgattatcggtgtgacgccgggtcacacttggccgccaggtcatatcgacctcccggtcaccttcggtggatccgccaacttccgcacggaacgggtgaactttgatgtcgcggacctcagtctgccctacaacgcggtcctagggaggcccgcgttggtgaagttcatggcggcagtccattacgcctacctccagatgaagatgccgggccccggtggccccatctctgtccatggcgacctcaaagtcgcgctcgcttgtatggagcagcgcgcggaccacctcgccgctgcgtccaagcccgagggtggcgacgagaggcttggcacctccgtccccgccgccccgaggcagcggatagtcacgtgcgacgaggtcccggtcaaggaggttgccctgggcgacggcccgtccaagaccacacgaatcggtggtcttctggatggcaaataggaagacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacgacggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcatcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccctggagccaaatgaacccttgctactctacttagcggcgaccccgcaagtggttagtgcggctttggttgtggagcgcgatgaggacaatcctcattccgcgcacccccaccctgtgctggcttggcccgggagagagcaaggaggagaggccccc

SEQ ID NO: 50101 - DNA, 8163 bp, Oryza sativa
cgcttggacaaagagcgccccagggatgtggcccctagcgaagaggatcggccccaccgaaaggtgcagcggcccgtctactttgttagtgaggccctccgggacgccaagacccgataccctcaggcccagaagatgttttacgctattctgatagcttcgaggaaactgcgccattatttccaggcgcatcgggtcacggtggttacgtcttaccccctcggccaaatcttgcataatcgagagggtactagacgggtggtgaaatgggcaatcgaactttctgagtttgatttgcactttgaaccacgccacgctatcaagagccaggccctcgccgattttgtggcagagtggaccccagctcccgagcccgtctcagtccccgaggccagctcgggcccctcgcagccgcctcacactgcccactgggtgatgcagttcgacggctccctgtctcttcagggcgccggtgcgggggtcacgttgacctcgccgagcggagacgtcctcagatatttggttcgccttgactttcaggcgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggtgtatggagcaccattttgacgggatagagcttcggcacgtgcccagacgggataacacggttgccgacgaactctcacggctcgcttcctcgcgagccgagaccccaccgggcgcctttgaagaaaggcttgcccagccgtcggcgcgacccgaccccttaggggagacggacgcgcctgacaggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccaatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggtcatttgctgtctgggggctcgatatcctgggaccgtttaggcgggccccgggcgggtttgagtatctatatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagctgtgctctgggcgaaccaaaccacgccaagccgagcaaccggggaaacgcctttcttcctcgtctacggcgcggaagcggttctcccatccgagctcaccctgaggtcccctcgggccaccatatactgtgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccatatcgagtgatcggcgtcccccggccgggctccgttcggatggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgaatattcttatttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcatagtgaactccgggggggaatcggcaaaaacccacactcgggtcacccataaccctcggtcaccacgctcccggcctggccagtctcgacatgtggatctccctaggcactagccccgacccgagccatttgaggactaggacctgggcacgagcccttgttcaagccaagacacaaaaggaccgcggcacagacatcctcgtctcatacacacaacaaatagaattgacaaaaaatttcctctttatttgattgcagattaaattagtctatacaagaagggggcccgaaggcctcggaagaagaaaggaagaaactatttaaagattggcgggggcctgggggctcactccgatgcacccgggtcgccagcctcgtcgccactgtcgcccacaccgccgtcatcgccctcctcgtcggagttgagggcgaacgcgagccgaggggccgaaccctcgaagctgtggacgatatggtcggcggcatcccggacctacgcgcgcgcgccatcctcggtcccgggagggaactcgtccagcgccgtccatggggagaagtcggggtccctggcctggtaactcgccagtacgagctccaccgctcctcgggcgaggtccctcgaggatgacttaatcgtcccctcgagctcctcggggagccgctggagagtcccggccatctccgagaggcgctgggcgaggcctccctggttggcggcgtacttcacagtccgcccgccccagagacccgcctgccgcccggcgcggtctaaacgggacacggcgtcgcgaagcatgctgggccctatctcgcctgctaggcgaagggcctcgacctccccggtggacgaatccagcgcgccctgcagatccgcgatggtgtgttcggcagctgcgaggcgggcggctaagtcgctgtcgcccgtggccgccccgccgctacgcgcccttgcatccagctcccttgcctgcgcctcgagttcagcggcccgctggttcagtgcggcctctcggcgcgggcactttccagattgcgacgcgcttgttcctcttgcgcagcctcgcggagggacaggctgtccgccagccgttgcgccgcggcctcggcttcctcgagagctcgctcccgctcggtgagcgcgtcctcgcggaggcggagcgcggactcttcttcggcacaggcggcttcgtgcaccgccagtgtgacctcccgaatagcaacggcggcctcgcgatccgccaagtccctctccacggcgcaggcacgctcttccagcgccatggcacgggcctcaagggcttcttcgcgccgccgggatgccacctcggtctccgccgcccgccgttctcgggcagcggcagcgtcaaggaccatccgggcggcgtcgagctttttccctagctccgcctcccagctcctgtattgaaggcggagggtgtcctgcgcctcgttcatcacggtggtggcgatgagggcagccccccgctcctcctccacctccttggcgatctcccccagcaccttccgacgggcttcgagctctgagacgtgccggcggtgtgccttgcggcccacctccaccatggcctccaccgagcgtcgcccctcttcgacacgcgcccatgcggcgtcaagctccgcccgctctgcttgcagggcctccacctgggcacttaacccgtccaacaccgtggtgtttgcgacggccaaggcctgcagaaggggttctgcgctcagtggagcaacggaaggcgtggggaagagccgcctcggtgaggatgccgcgcggctcggcccaccgatggacgtgccggactcagggatgtcccccggacctggcttgtcctgagcgtcgcccgagggagtgggcccaagcgatgcgcccgcggcctcgtcgcgagctgcctcggaagtcgtcgctgtcacgcccggaaattcactagtaaattaatgaacatttaatataaattctgataataatttattaaataatttataaatcctgaaacgaaaatcagggtgtgacaaatctaccccccttacaaagaatctcgtcccgagattcggaacggctagaaagaaaagggcataggtaaactgcagtctatcttattccataactccgataattattctaaggctttaaagaaaactactgctgctttgaaactggtagctgagctgtaacacttgaagacgcaactcttgaagacgcaactggcactgcattggctcctgtgacgacaatgttgttgacttgcggctgctgatgcttcggcttcggacactctcttacaaagtgacctggcttataacaattgaaacacacccgctgctcccttccattactgttatcttctcgagactgatcctgctgaaatgacactgattgagtagcttgctcatcattgtcttcattgcttgcattagtctctgagttgatctcaccattcatgcccaactgttgtgactgttcttgacctgcagaaaaagattcaccaatttggagtggcttgatacgctgcctctggctactatcctgtgcctcctggaatacaattattttccttttacggttatccatcctgttcttcttgtcttcaagtcgaattgctttgtcaaccagctgctgaaaatcaacatagtcatgggagatcaacgtaactgacagttcatccttcaagccttccaagaacttctcctacctttcctcgtcagtacacacatcttctggagcataacgtgccagacgattgaactcatgaagatactctgccacggtatgatccttttgcttcaatgctctgaactcacgcttcttcaaagcaacaactcctacaggtacgtgtgtcttcttgaatccttcggtaaactcttcccaagtgattggttgtcgttctgctctgttcatccggaaatgatcccaccattctgatgcagattagaaaaggtagaaggagaggggttacactaaagacaagaccttaaccaggttaacactgatctgatgtgtgtagactattatattgttcaagttgattaagcaagcaacctagtatagttacacactcatcaatgaactactccaataatgggaatgcaaccatacctacacacaaagcaaacaacaagcgttctactctactaactattcttcaaagacactttggcggcataggttctaaggtaggatccaaacttcattccatcttgaccacttggcacctcggttcttcctcgatcccctttacttaacctccataagtagtcctcattggcgtcttcaagtttcaatgtcttagaactactcaagttgaaagagagagggaagtagacaatgaaacaattttcaaagaattctagataaggaagaaaggagaaattttcacaaatcatttttgtcagaaaaattcgtccttaaagtttgaccatttggcttatcctacagtcgagatggctctgataccaacttgtcacgcccggaaattcactagtaaattaatgaacatttaatataaattctgataataatttattaaataatttataaatcctgaaacgaaaatcagggtgtgacagtcgccgcctcggcctggcgaagtctggcctcctcccgagcggcttcttcagcttggcgagctcggacggccacctgggcggcctcctcggcttcccgtaggcgatccgcggcttctcgccggtcagattcccgcctccgagcctctgtggtcgccgggtcctcggccttagactggccggacttggaatggcgggagggacgcgacgggatctcgctgaaacagaagaaagaccagaagacaaacaagatggatgagtgaaaactcgcgttgagagaatgaatacggccacgatgggagtgggacgaacctgcgagggggtcggttaaacgaccaccttggaggggaaatgaggtttccccgggatggttctgtcccccccatcttgcggagccgtttcttcttccgctccccctcgggctgcgacgtcggcgtggccacctccgggcgcctgctgctggcacgcgccgccccgccccctcggggaggagatgggggaggggttccttcctgcttcctcttcccccgggtgtcggcagggcggccgctccccgggcccccgtcgcggggcccagaagcacgaccccctcccggggtagattgttcccccctgcggctcccgcccgctccatcgtggcctcgaggagcccgctcctccgacgccccgaccgcctgcatgatggtcaggatggaggcgcggtctggatcgctgcagagggggaggactccttgaggaatgagggatgtctccatggaactgagattcagcacccgttggaccactatcttgaagtcctcaggagcccagtcccatctgaccccctggtgggtcctcatacagtcctcggacccggtgtactcctaggcgccccgggcgcgccgctggagtggcgcgatccggcgacgaagatagtcgccgaacaccatggcccctgtgagcccctgggatcgcaggcccgccaggcggtcgaggacggcgtcatagccatctcccagatctaccggcacccgccagctgtaggcctgcgctagaggctggctcggaagtcggaggcgcgcttcgtcggcgaggggggtgtagaaccagtcgctcttccaatcatcccacttcttgcggaggacgcagggaatgtagcggttcagcaccggcccccgcagctggaagtagcaaccaccaaccaccgacggcggcgacaccggctgtaccccgatgaacatctcgcacaggtgcgcgaagatggccaatgtcattaccgcgttgggggtgaggtgcgccatctggagatcgtaaaactccagaacatccatgaagaaaaaagaaaatggcggaaccagccatgccatagcaaaagggaggaagaagacggaccgccccgggtagtgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgatgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcggggggggggggggg

SEQ ID NO: 50102 - DNA, 5394 bp, Oryza sativa
acagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagatgggggatttatttttttcggatccagaacgaccagagagggagagagtaagagctctctggttctccagcttttttgtagcttcttcatacatagatccacaaaaacacaggagtagggtattacgcttctcagcggcccgaacctgtatacatcgcccgtgtcttgtgtgtttcctttctcgcgaaccttccacacacagactaggagcttagaatctcatccagggcccccggccgaaccggcaaaggggggcctgcgcggtctcccggtgaggagccccacgctccgtcaaggggagatgcaatttacacccttgatgaattatctaaaggctaaaaataattgaggtgatgtgtggcttcatgaaaaaagagataattagcattaactatacttattggggataaactttataaatatataggattcaccggcagtagtacgtactactaaactccttacagcaggtgcaataggatcacagcaggtgcggcgctgcaccagcgattaaaaaaccacataagctgcaccgatcagttggcggagaaaaggtataagcgcaagtagatgatgaggtgaattaaaaaaccacgtaaatctctacatattatctttaaatttatcatatagaattagataatgaggtgaataagagaagttaggagagagagaataagccactcatgtaaagagcaacctctatacaatctaaaaaacaagatgatgtgatagtggactaatattagggtttgagtagctggtagtaagcgatactattaaccttgctcatatgacaggattacacagtctcttgattttgattgacacgttcccaaccttatcgtaaggaaaaaaaaaaaggttgctagtactatctataaacaaaagaatgatcatgcaaatcagggttctctagactctagtagtactattttcctgtcccaaaatatataatattttaatcgaatgagacacattcacacattcataatattatgtactatctccgttccaaaataagtgtagccgtaggaatccgtgtccaacgtttgaccgtctgtcttatttgaaaaatttatgagaaaattaaaaaaagttagtcacacataaaatactattcatgttttatcatctaataacaataaaaatattaatcgtaaaaaattttcaaataaaacgaacggtcaaacattagacataaacagtgtaaaactacacttattttgggacggagggagtatcagagacaagagtagtattagaattaatctgcatgagtacttatttttggagacacttttgcaatgaactcgacaatgatgaaaatattgactagtgacattagtacactactcgagaactggagtgctctatagcctatggccgtgtttagttcgtgtgctaaaattttttaaagtatatggacacgtatttaaagtattaaacatagacaaataacaaaataaattacatattccgcctgtaaacagcgagacgaatttattaagcctaattaatccgtcattagtaaatgtttattgtagcatcacattgtcaaatcatggcgtaattaggctaaaaagattcgtctcgtaacttacatgcaaactgcgcaattggtttttttcgtccacatttaatatttcatacatgtgtccaatcatttaatgtgacggaatttttaaaagtttgaagggaactaaacactaccatatccctgttctagagagagggggagaaacattactcctgctaacctgttcaatgaaacccatgaatgacctcgcataaaaccaccttgactagaatcagtcaaaggctccatttattctctgaagcaaaacaaggtgcacagattctcaatagtactagcttgttttcaaaactcatattggacctgcaaacgatcgacgttgcctagatccagttcacattccataatgtaaaatgacgacgttactactctcgtagagacgagccgcgagagcgtgacacacggacctacttgcatacttcagcaacacaccgagaagaaaatccagtgatggtgttactccaggtgaccacgtacaagcagttaatccgtcataagacccaccgcgtgcgcctgcaacgtagccgtgtatatcctgccagattgcttcccaaccaacctaatttggatccgtcctccagccaatgtccaagctcacaaaggcttcatcgatcaggacacggatcgacgccgatcagtttcgcgaaacgccgtattcgtacgaggcaacgaggcattaccgtcagtacaccaacagcttgtccgcttgattacgtgcgtttccatgagttctatttatctgcggtgggcggtagctcgccgctaacgccccagaggcagccaatgccacgccgcccgggcgcgcgagtaggtggcggcggtagacgagacccgttcaaaaacaggtccatatgaacgccgcgatgggtcggtacgattagatgctttcgggccttaaagataaaaatctgttccggcccagtccatacagacgggtcaacggagcaaattacaggccatatctccatcggtttaaacggcctcgtctggtagaaataagtctattttgtctcccttaactcatgcccctggttgaatcgaatccctcaaccgcaaaatcagatataacccgttcccctaactctcaaaatcagatataaagacggtaacgttaaacagactaggctgactatgagaagttctcttcgtaccggccctgttcttttaagatgtgagtttatatgtgctttaaggtttagagaattttttcaaagaagtacttcctccatactcgtaaaggaagtcgtttaggacagcgacacgatctccaaaacacaactttgacttcttatttctataaaaatatttattgaaaagtgatatatgtatacttttatgaaagtatttttcaagacaaatctatacatataatttttatattttttcaaactcaacaacttgagaattattcatgatttatattcccaaggtttgacttaaacattgttctaaacgactttctttatgagtatggagtagtactgcattaattatacaatttgccttaagctatctactaagtttattttaaataaatatttaattcattctataataaagaaatagtccgcgatatctgcttaaaaatttaaaccaacaatcagggcctctaggaaattctcgagaaggatctgaacaacttaaaattttccattcatcaacacgggtcatggttaattttcgcggcccatcgtacaaaatactagctactagtatttgaaagaacacacataatgtcaatccaaatcgtacgcggaagaacccgaaataagatcgagcaacttcagccagggctgcctcgcaacaaaagacggcgcagcagcccataacttctcttctcatcgtgccgacggaacaaacaatagtggacctcgcgatcaccaccagaccaccaacatgcacgcgcactagtcattgcagctccgagatggcttgctgcatgtacttgcacgacctctggtagctcacgaaccccatgaaccagaactcgaagccgtccaccgtgacgacgtggatgtacttctcctccggcttgtcggcattctcgctcggccgcacctgggcgatcctcctgagcgggaccaccaccttgtagggcacccgcgcgacgtcgcccttggccgaggtgaccgtgaccggccggtcgctgcggaaggcgaccttcttggtggagacgaagagcatcccggcgatgggcccgccggtggtgtacaggtagcactgcagcgccttcaccagccgctcgcctttctccgccgagaacgccttccggaacacgcgctcgatcccgccggcctgcaggattttcgcgcccaggctcagcttccccttcaccgtctccgacagctttggccccaaggtcactgcacgttacacacggtgatggatatatatcaggacacggcgttcatcacttaagtcctaatgatcaacaagtttttttttatggcgaattaaacatgcatgcatgaacgctaactcaccatgctccctgaagccctgtgcccttctgctcagcttgctcacccagtggataacctgacccttgctgcctgcagagatacaaggatcaccataaacattagaaaccacatgtcttgcgtgcatcagaaattgatctgacggttttgatgtgatcgtgaccaatatatatacttactgtgcttatagccgaaagacgtataagggctggggtgcgacaacgagaccgcaaggtgatcgccgtcggccttcctgaacgactggcccctggccaacgacacctcctcctctatgccaaacgccttggcggtcaccgggactccgatgacatggacgccgttgatgcttgacttcctcatggctgttcgctcgatctgcagctagtgtgcttactacgagcctcacgagatcgagcagctagtgcttgtgttgtgtgctgcgttgcgctgtttgccttagcgtggaaggaaaagtggattggtaccggagtgcagccacggagagcggcctatataggcgtcgcggcggggtggtggatccttttcgcaaaggcgcgcagtggatttgcggagtcagcaaccgggccggccgagtcaccggtggatcagaaaggcgaggtccacgttcgcgtaaagaaggcgtagaccctcctcttgctgcctgctggttgcaggcttgcagctgctcgtttcgtgagtggccgcgtcatccgctcggccattcggcctggctagaaatggagcttttggaggtagccccaccttccatgtgaaggccaggtgtggtatattcattgctcgaaagcgagattcgagatttctctatggtatcgagacggccagatggccatgcccgccggctgccgctttccgagaagcgccccatgtgcctgcacattcctgcacgcaccggatccccgggaaaaaaaggggccggtattgtgtcgggagctacgaaaggggccccactgcgccgagccgatgctaggttactcgtactttgcaaggccacttgtatagctacgttcttcgtgcattgcaccgagacgttatggctcgaatgaacacacactgtggcgtgcacgagaattgttccccgagatagcggccgcacggg

SEQ ID NO: 50103 - DNA, 5841 bp, Oryza sativa
ttccctaccaaaccaagcccagacgtcttggtcacatcccacgcagcaccgactcagcaaggccccgacctcacctaacgcgcgcatgtaaccgtccgcccaccgcgcgcgtgtccgctcggctgtggtgccaactgcccaaggcaagcaacgcggtcgcatgggcgcccacgcgccgtccttgtcgcccgcatttaagccggcaacaggagggccgttgcgacgccgacccggcgcttcctcactgcttctggatctgcagacgcgagcgacgtccgcgcgcgcgacgggcgtgcaacgcagacaacgcaatgcgctgcgtgcgctgcacggctgcaccgctgcgctgcgttgtcacaacgacaaggaaagcccgtgtggctacctgctcggaaacagattttggcggtggggctcgggctcgtccctgcgcctggattacttcagcgtatcttcctgcggagtacgtgcccacgcagggccggagaagtcgctggagaaacgggggacacttccgacgagatcgttttcaggacgatcctgctgttttctaaggctgcgtttagttcagcgcaaagtttatattttggttaaaattggagatgatgtgactgaaaagttgtgtgtatgacaggttgatgtaatggaaaagggctgaagtttgaatctaaattttatatctaaatacaacctaaggagatggcaggagaagtaacatcaatgatgatgctttgttgtcaattgtcatgcagtgtactaatgtctaccacacggttcatctgcgaaatgtggtgtttctagatacgacgagagaacagtccgagttctgtgtgtgaatttcaggtgttcttctgggtgtgaatttcaggtgttctggagctgcgattgcacctgaaattccctcttaggatcgtagtttggttctgtttaaaagtatggccgagtttagatccaaactttttcttcaaacttctaacttttccatcacatcaaaactttctcacacacgtaaactttcaactttttcatcacatcgttccaatttcaaccaaacttccaattttagcgtgaactaaacacacccaacagaatctaagttgagtttggcagagtagcagggaaccacaacttttttgttttggaaagaatgtttttcaaactactacacgatgtgttttatgcaaaagtcttctatatgaaagttttttaaaaaataaataaatctatatagtaattaatactctattaattatgcattaatgacttacatatttcgcgtgctattcaaaatcccatcccaactgcttccaaaatccttaagagggattgacgataattttagctataggatatctacttttcttaaaaaatttattggtactggacatcgaaaaaagtttcacgatgggataacacaaaaaaacagataatttatccgagaacatttccggaacagttggagagaggaaatctttaaaaaaaacaagattctaaaaaataatgcaactctcaatcaaccatcacttaaagtatattgctagcagatatcatatttcatctttacttcaatgtcagattaaattctcgttactctagggacatttctgtctttttaataatttctatctccaatttgaactgaatgtacttggctaaattattagttgttttttcctccaaccataacacatttttgtgatgtctatcacaaattacataaattttgaatgttctatagcaaaattttccattgacttgtgttgaatttcatttagggattgacctatgttaaaacggtgaaacaaatccaacttgtttctctataacttgtgttctaaaattatactttctttggtaaaaagaagttcacatcgacgtggtaatcaaaatacaattctaaccaatagtttttaatacaaaacgtttaaaaaccccaatacaattataacacaaatctgcacatcgatcaagtccattacaaaacgtttaaaaagttctaaaattaattatgaaagtactttacgagacaaatctgcacatggatttccaaatattcaacagaaatatttaaggtattgatgtcaatggtttttatgtacttaaattaacgatcgatggtattcaccgaactgaactggcctagttggttgcttggttgttaagtattgacagttacggtggctagatatacaatgtcgagagtggctaaacacgttagcttggctcttcaataaagcttctgaaaagccaaggcaatgccaatcacacagagcatggccctgttgagttcatgccggtttattcgtaatttctctattaaaaatgagttatattcataattttatttcatattattatgatccggttattctgatatatttatctcgttaagtatagttcaatgaattaaagtgcccaacggtgacataatgcacctaatcactcttgccaataattcatgcatagtatagtagatatatagctgtgggatcaattttattggaagtaaactgatgcaatcaacaagttttagagtgatgctgacatgattagatcgcataatattttttcctcttataccttttaggctgtagttttattttattttatttttttttgagaaaagtaggttatacacgcatagtttcagatgaaaggtcttgattcatcaagtcgatcagtcttgccaataattcagcatattaattagctagttccaataatacacacacacacacaaaataaatcatttatagtctgcgataccagttctctagaataaaagccaagaagagatgagctgaagtactgtagtatgtagtgttgaacaaacatttttggatttctcattgatcttgtacataccacatgtatatgatggcacttttgccgtggcactattttctccaacaccaatcaagaaatttgatgcactaaaatttctcctaccatgtgtaccggacttgctccaaagccaaaaacgccaagcaatccaccacaaacacctacgacgctaccacatatgcacaacagattaaccagaccacacacaaggcacacgaccaagaaaccgacgacccaacttcgacgtttgtttcatcagagatcgatcgatcactgcgcctgcgcgacggccagctccaggttcttcagggtcacctggaagctgacgaatcccatgaaccagaactcgaagccgtcgtcggtcaccacctggacgtacttctgctccggccggtgcttgttctcgctcggcttggccgtcttcaccctcctcagagggatggccaccttgtacggcacacgcaccgtgtcgccgctcggggtggtcagcgccagcgaccggtcgctccggaacgcgatcctctccgtcgatatgaagagcatgccggcgatcgggccggccgtggtggacaggtagcactgggaggccctcaggagcttctcgcccttgccgacggcgaaccaccggcggaagaccttctccacgccgcctgcctggaggattctcgcgcccagcgtcagcttgcctttcatggtctcgtacagttttggtcctagagtcactgcaaatcatcaagaaaagattgttcagtaccaattctccaattcgcaaccatgaaaaatcgaactcatccaagatcaaaagtagtatggtccaagatggactggagaagaacgtaccatgttctttgatgccttgagcgagcctgtcccctgtcctgccaaatctggagctcgtacgcgcggttgcagagcttttcgcctcggcgtggtaggcggctgctccttcgcttgggaaatccggctcctcgatgccgaaagccctgttgctcactgggatcccgatcacatgctcgttgcacgctgccttctccatctattgatccttgggacgaggaacaaccgaaaattcctccctgctcttgtgcgaggctgtcgttgagtggtgagatgactccttgatgtgcgtgggtggttgttgctcgagctccgtgcttcaagtaggaggaagaggggtgccttttatacaagggttttctcctcagaaggatcaaattaaaaagatttggagcctatccagtacacttttgaatggaacagtcaccgtctcccaccgggattcaggataaaaggagttttttcctatatggagctggcctcacctagtgctgtgctgcatgtgcagaggggaggggaggtgcccactactgcactgcagctttgtacagtcatccaagcatggactgatactctatcatccaaccagttgtcacgtacatgcatgcatgttatagcatggatacggtttgggatacggataatttatgacatggacacatggtaccaaatttgggaggggatcaggggaatcaggtagggaaagaaccaaattaagaggctctgtggcgtgactgtactgtgactgttcctcgccgtcgagtgcgtcattgatctttctatgcgtgcaacggtgcatgggtaaagcaaagtaataatcccaatgtgcccggagcaactttatgtgtccagattactccaagttttctttttcaagcatttctgcatctgcatgagcaattacgcactcgcgctgatctgacgacggggatgacgcggaaacagatggataaactgggcgatgggtccaaccccccctactacacgatcaccacgagcgaagaagtacgtacgtacgcggccgcgcgaccatggaagacgccgtcacacgttcggtcaccaaggccccccccttttttttttctcgcgcactttcgcggtttcccctgctttttccccttcacgcccacgttgcactgagtcagcgtcgcgtcctaccgggcaccgagtcggatcacccaaccgtccccggttggcagccgcgcgcgccaccgatcgtggcctcgtgggttgggttgggttggtgccgacgtaccgatatatcgattgatcgatccagccagcctgcaggcaggcaggcagatcgatcgagctgatgggctctcgcgtcggtcgttagctcggtcgtcattttctatggcgggatcagcggcgggcgccctcgatcgagagttgacagttcgccggccggcagcagcatgcatgtgctgtgatcactgatcaggacatgcgcatgtgtgtgcgttatggcttccctgtcagtgatgatgcgatctggcaatgtgtacatgtctcgtttggatttttttttatgtgttgcttttgtgaccatgctctgtgttgttgcgtgggatatggtcatatggagatagacatcggagttaaaaggttgttgggggagctggcgttttgatttcagaggtcaaagtggataactttagtttggccttccattgactatagctaaagcactcttgctgtgacaaaaaaaaaaaaaaggaaggaagaaaaacatgagaaaaggtggagaaactgcgggatatgcgctgggttttgcgtggaaaatattccctatgcacagctagaatagataaggactggaatatacaaataaagaggacatgtgtgtgttatctcatattgatagattattagtgtctgaaaggtgaaagtagcatgtatctggtgcgaaattggtctattcaaaatctaaatcggtatgtcgtcaaattagatatacttggagctcaatggaaaggagaagctagcttcattgttatccaatggcaaatgtatatggatgcagacaccgcatgcatattcagttactgtagtcgtaagtgctttgtagtatatttaactatgtatatgacccccctagtagctcatcccactatgcgtttaaggcactatatcatattcttataccagctggatatg

SEQ ID NO: 50104 - DNA, 2688 bp, Oryza sativa
accaagagactgacaacggcaatcaagtcaggttggctagaagtggtgaggaggagagggtggttagataaataaattagggttgaacggatcttgaagcaatcccagttgtaaaaaaattaataatacttaaggaaaaaatatcgatgactaatgctacgatgctattatattttctaaaataaactactaaaatttcatgttggcgaaggtacaagtataaggatgaaaacatatgatcttggcattagctcaacgcaaattgatacatgccatgatacaatcacacgatttcctattcggacggttgtggcatgctatatagaacaggaaaacggtaagtaaagattttccatttgatcgacgcaattgattatgtttatatcatggatattaaaattaagcatttaattttttgtcacttttaagatgtgacaattaaggatttaccacttacagtctatgacatgtgcgttttcatgtgtctataacatgtgggttcaatggtatcttataaatagttaaatatcttattaaaattatgttccttaaaaaatggtttatgattatcttaccttgtgagggatgtcacgttgccaccattacttggaaaaagcaaaatggaaaaaatcaacttattatttttgagagggaaagttgcattcctctcgaactagtccagtactctccatttgacttgtgtgcattgcagatttgcagaagaactactgataccctgcgatcgagtcaccctttcactctaccggtgtcccagtctaggtggaagcagggacatgcgccacgaaatggagccttataaaggtgcaaattgttcgtcagaatacatgcagcagaattgcagaaagcaaaatggaggaggagaggatagtacgtactaatagattacatgaaatcaaggatggacctccaccatgtggtagataaagaagcagatgcatggcttatatcagtgtaaagctacggttgagctacgtgtgttccaatcaaaagctcgcagcagcttgcttctgcttgatcacctaaaaacaaatcagatcaaataaaaaaaaaaggcaaagaagaaaagaaaagtttcgcgtagcagacaagacctggtggttggcggtttaattataggtccttctcgcgctccttattcggtggtgttgcagtttgtgtcacggatgaatcagctaaccaactctttggttttcccttggcttgtccaaatgcaacgcacccagcatcttacagttgtgttgtgtgggggctgcagtgaactttttggccaaatttaagtaggccatgcataatctcgatatcttttccggcgattagaatggcatgggtgcattcaactgtgggccattcggcgattaacttttatccaggcctctctctccttatatcgatgatctatgcataatttttcaccatttcacatcaaatatttagacacatgcatgtagtattaaatattaaaaaaactaatcacacagattgcgtgtaatttgcgagacgaatcttttaaacctaattgctccataatctgacaatatggtgctacaataaacatttgctaatgatggattaattaggcttaataaatttgtctcgcagtttacaggcggattctgtaatttgttttgttattagtttatgtttaatacttcaaatatgtgtctgtatatctgatgtgacacgccaaaactttatacctatggatctaaacacagccatagtgtaagcaacaagcttttttacataagaatgcatcatatcataaaagcatattagccgcccatatttaagagtttggataaacgacgaccattgaatcaaaatacatgcactttttttaaaaaaaatacacaaataaactaaacatatgaaaattttcggagatttataatgtctcccgttagacacataaacacggagagagagaaagaggcaaagacaatgaaaaagatatatataggaaccttctagttatttataaagtaatctaatataatttagctaaatatatagttggctagaccaattgatacttaaatgaacttacatcaaaaccttcttgaaagctaagataaactaacaaattatatacaaaattaagttcttaaattgaatcaaaagtcacacaaaccacgactatgtgactagttaaagaagttgtagtatagtagcaaaagaaaaggaaaatagatgtggttaaaaaagttaaaaaagaaaacgtggctagttaaagaagttggagtagcaaaagaaaagagaaaaaaaaaagtggttttctcttctcccattgatccattctcttttcttttcgtttccttgaaacggttttgtggggaggagagtgattaaagagtagcatgacagcaaaatcccaacggaaaggaggaccattaaatccctaatactctggagcgagcgaaaataaggacgatgccaatcactcgatcggtttcgccgatatcgagctgtccgttgaaaaatactaaatccacaaaggcaaatcaatcagtcagtccgtccacgcatgcacccactggggttgctggcgattacgcgggaagtaaggtgaggccggtgtgatcagagggagtcatggcgattagaaaagctatagctcccgaccagccacgcgtgtctccctttgtttcggccggcggtcatgggcct

SEQ ID NO: 50105 - DNA, 12224 bp, Oryza sativa
agattaaatgaagaaagagagcaaaactatctactaaatggagatagtctatagagaaaaacgagacaatggattacagagctatagatacccatgtagacataccattgaagtggtttactattaatctagtctattgctgaggtgtacatgttttatagatagcaccttactttaccattgcgggtgctcttatagagctgggaggtggaagaaaacaaagcgggatcttccgatcttccgcgattggttcggaatcttcgctccatttggcaggaatctgccagccagttcacatttcgtcattgtttatgtcggggaagggtgatgtggcccacagaacaataggcccaaagacctaatgggccgtttcaagggtatagcgagaagtttgcggtaatatcttatttctataaagttaatatccactaaacatctaaagttcaacatacaagcatttattaacacttttaaaacctatatgcaagtatgccacactaacccattaaacacacaaagctcaacatataaaagtatatagtaattatatctataatctacttcattctaaaactaaacatacacatgctagatcatcattctcaaatcattttcataatatctcaatccaaattatttcatcatttctccattatctaacatatatcccgcagcaaaacgtggggcatcatctattaaggctatgtttagatttaggggtgtaaagttttggcgtgtcacatcggatatatgacacatatttgaagtattaaacgtagtctaataacaaaataaattacaaaatccgcctgtaaaacacgagacgaatttattaagcctaattaatccgttattagcaaatatttactgtagcaccacattatcaaaatcatggcgcaattagacttaaaagattcgtctcgcaatttacccgcaaacagtataattagtttttttttgtcaacatttaatactacatgcatgtgttcaaatgtttgatgtgatgggaaaaaaatttaccgtggatctaaacacccctaaaaaaacgcaacgccaatagccgagtttcacgtggaggaggaagaatggaaggagtgaaatgagcgccaggcgtcgcgtcagcgcgcgtgtgactttggttggttgtcttcctcttcgctgcttatttgccgcgcctacgctgaggccggccaaaccaacgcaacgcacgcatcacacacaagcatagcacaccacgcggacgcaggggagacaatttcctattcttcctcgcatcgcgttggctctcggcctcgcctgagtctaactctccaaactccgtccggtgacgccgcgacccttgcccttgcccaaactttagtaatatgggcaaggcctttcaaataggtaaactgtcaggtcaacctggtaataaccaaatagaaagagaactgacgatgatctcgcatagacacaactaggagcgaaaatgatttggaaagtttatagactcctgacctatttttaaaaacagaaagtgccggtcggagtattttttttagaaaattttggaaatgaaaacaaatttgatttttttcttggaaatgaaaggcactatccataggaaagcgaaagttgcctagaaacttcctgaaaaattcttagaattttgaagtaaaggcccatattaccaaacatcaatttggtccaacccaaatagtagggcctactactcctatatattaagatagtcaaataggggtgatcaaaaacaaaccatccactaaagactgagccgaaccgaagatgtgttttcttactaaaaagttaaaagctcagtttagagggttttatatttcgacaaatattcattatgatattcactcctatttatgtatgatccattttcatattggttttcgatttcgaaaagaaaatgatagagctggttacctacacaaggcgcaggccaccaccggcaccggacgagaattctgtgttgctgatcctacccgaataaagatcaaaatcagtgcggggacacaactttgtcatattcagagacatttataggatgtttaaattgtatttttctcgaaatacagcaaggggatgtagctcaaatggtagagcgctcgctttgcatgcgagaggcacggggttcgatcccccgcatctccattttaatttttgttttgtgtgactctgactctgctgccttgtgtccttgaccccccctgttgtcaaaatccaggcagcccaaaacgagctgccttgtttttttttccccgtattgtgaatttttgatacacggcaagtgctttccccttcttttaagaaaaaaaattccgtgagacgagaaaaatcgagttgggaacttgggacttgggatttgggaattggtcctctcttcagctgtagtacgtgggattgggccgtaactgaatagctcgctgatcgcagcgtgaggagggctttgtgttccaataatttggtttggcccggaccacggacgcctgttggaccgcacggcccaggcgtgccatcatcttcgccgcgtctattcgaagcgatgctgaatccaagaccgaatgcctccatccttcttcagtcattttcggagtgaatttgctccctcctgcacacgaacgaatacggcaacatcatggacgataacgattgacaagctaacgagagtgattcgtcgagaagaagctaagaagcagcttttcatgtccacttcctaagcgtgttcatctatggttttgaaggaagcgtccaaaactggagatgtgcagcgattagcatagctcccagcccaacgtgcttcaaagcgagtcgaggccggttttgaccggaccgtagataggatatttgtatagcatgaagagcagtctctttttgtgtgtcattaattcatctttctagcattgcgcgcgcgcgcacccacatatatatatatatatatatatatatatatatatatatatatatatatatatatatatatatatatataggacactcatatggggcaccatggtgctcgggcaccatggtatcaaatacacaaaatcactcaaatttttcaaaattttcaaattgtgagtatatacctagttataataactcgattcatacctatacctatcaacaaaataactcaaatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagccccaaacagattttctatatatatatatatatatatatatatatatatatatatatatatgtgtgtgtgtgtgtgtgtgtgtgtgtatgtatgtgtgcgcgcgcgtgcgtaatggtagaaaatcttttatatatatatatatatatatatatatatatatatatatatatatgtgtgtgtgtgtgtgtgtatgtatgtgtgcgcgtgcgcgtaatgctagaaaatcttataatatgaaacggaggaagtataaaatttatatccccaaattaataaaacggcagctcctagttattattataaaatttatctttaaaaaatctcctactttttaggctgtttttttaataagtataatagattatcttgtaaatataaatttatctttgtaaattaactccaaaccatctcctatctcatgtctctaatccctccctccctgtagtcattgccaactcaaatacgcaagaccaatcatgaatgcatattgagtagacaatgactagaactagaacaagaacgtgcggttgcccttgttgagtagtcgaggtggcatagagtagagggacgctaccaccctaatggaccccttcgcaatcaaaccgatgatcttgtacgtgccaccgctccagctacttcgacatatcgatgacaagccctggagcggttcgaagactacaatctctacttccactgcagacatcacataggagatcactgggatcgcattaatggtttctcatggtgtttgtcaatttatgacctttaagtcatttcgacttttgtcaaagtcaaaatggttctagtttgataaagtttgtagaaaaaaatagtaatatatttagcacaagacaaatatactagaaaaatatattcaattatagattcaatgtaactaatttggtgttgtaatgttagtatatttgtccacaaacttatttaaacttagggtgtgttaggttgggcttttcaacctgcttttgcttttgcaaaatccaaaaaccaaggcctaaaagctacaactgttttttttcccaaagccagcttttggtgtagtacaaatcaaacacacctctacccttgctttcacatgctttcgaggaaaaaattacctaccactgccattaaaaaaaacggtttgcttttctttttctcccatcccttccacaagcgtcgctcctcatcctcctcacttcgccatcgccgctaatcctcctccccgccgccgccgccgtcgccgctcctccagtcgagctgcccgtgcgtgcgaagtcgtcgttgttcagtcgtcgtcggcgggcatgggaggtggccgtagtggagctccggcgacggcgagcgcgcgtgcgcggcggcctccgccccactcgcgtctgcctctgcctcctcaccgagctagccgcccacacgtgcgaagtcgtcagccgccagcatgctcgtcaggggaggatggagaagatacctatgtatatgacatgtggggtctactcgttaggggagaagcttttacaaaagccatctgtgtgtaaccaaacgagcttttggttttttcacagctacttttcaaaaagtcacagcacacagctattttttcaaaagccacagcccaaccgaacacacccttaggctgcgttcggatatgggagatgggaactcattccctccgcacggaaaacagagcggtccattagcgcgtgattaattaagtattagctattttttttcaaaaacggattaatatgttttttaagcagctttcatatataaactttttgcaaaaaagtttagcagtttgaaaagcgtgcgtgtggaatacgagggagaggggttgggaaccctttgcaatgaacacggccttagagtagcttgactttgatcaaattcaaaacgatttataatctgaaacggaggtagtattacactaatcatgtttaggctaaacacatattccctccgtcccaaaataagtgcagttttgtactattcacgttcaacgtttgaccgttcgtcttatttgaaatttttttatgattaatatttttattgctattagatgataaaacatgaataatactttatgtgtgactaaatatttttaattttttcataaattttttaaataagacggacgatcaaacgttgggcacggatatccacggctgcacttttttttaggatggaggtagtaaatagtatagtagaaatctacacttgactttacgtgcacgatcaccccttcctagaaatggatccgtagaggtgcataggatgggatgttcgcccctgttgtccaccgtctgatttaggctgtgtttagtttcttccaaatttgaaagtttgggttgaaattggtacgatgtgactgaaaagttgtgtgtatgataggttgatgtgatggaaaaaattggaagtttggatctaaagtttggatctaaacacagccctagtaaaatggattgattgtctagatcgattgctatatcagtccactcgctacagtattcttagagcattaatttgttaatgctatgatagtgttttcgttataatggtgccactcccacccctaaaaagaagcccctactaagttggtggagaagaaggtggcgagcacgaatctccaagcaatgtgacgctgcatgacatcaagtttacatcatttattcgggttcctacaaatttgaaaaatacaaaatcgactccctcccccgtgaaaaatactcgaaccaatatttgcaataatgtcttggaccatctttagccctcgagcaccaggttttcaaacaaatccagccaaggcggccggtacctctcgagttccgtggtacccctgccggtccaggcgcgtgtacatgtgtgcccacagtgcgctgccatccttgaggcgatcggcccgcgccgcctccttgtcgaagcttcacatccggccagccccaggacggtgacgcgcatctctcgaaccggccggccgagaccgcgccaccaccctactatatacgacgctcggcgaaacctggtgaaagatcgtactcgtacgtaccggtgtacctccacgcccggacaatccgcgcaatgtcacggtgccaaccgtccggtcaaacgcccaccaccggcgcgtgcgcgccaccccacccgttcgtccggccacaggacgtacgagagcctcacggctgggtggtgggtctacgtcgtccgtcacgtgagggtggcgttccgccacggcgccgtccgcgcggatccggggccgtgcagcaccgcacgcgtgggtgcggcgcgcgcgcgattaaatgcgcgacgtcgcgtgtttgcgtggaccgctgcggctacgtggtggtggcggccgcggtggcaccccagtacctatgatgcatctacgtattatgcttttgggtggtaacgacccgcgggccatccacggcgctgccctgccgccgagggaggaagggaaaatcacccgccgagccgctccgcgcgctcgcacacgcgttgatgcgacgggcacgagcctagcagccaagccatggccttttcgggatatttacggaggtgaggccccgggcctggccggccgcagcgtgcacgacggaaaagcagaaagctaggttttggaccagtttggcaagcggccggcgtaggggctagggaggggtgtgctacgtggcgcgccgtggtagctccggcggcgccttccgagccgaagctttgactgctattctgaccacctgacctctcgatcgcgtccttccctcccggctaatatcctgcttccagaaccttctatcctgcttccagaagcttcttcccgccagagccatatgcatcgtacgcgacactgaaatcagtactgctaatatatatagctattcacgttgttaactgtactggaaatgagatgctacgaatcgattgttcttcatatttcagaagttggttgagaaaagataattgtttctttcagatttccattacctagattcatggactgaattttcaccctgcacctgaccgttctttttctcaagggggagtttgagctgctgtcgaaacgctggccacacaactcacaccggctcattttaggagttcacaaacttcatctctactgaaaacgaaatctgatcgagcttaagcaataaagaactccaaaactggttcacctattgacctgcaatcgcattattgaccagtgccgtggccgtccttgcatccacacacacgcactagatatttcccatggaacagctgccatatcaaaatttgacacttgggatcatatcgctagcttgaaggtcaatgtaccgggccacaccatctggtacttgtgccacttgtccggacaaaatttccccttctgaaattgtttatgaacatgaaggtacacataagagcgcgggatcgattggatcgtgccatctgtcaaatacagttcgtgttagtctctcttcgttgcaatcatgcaactgttcatgccctttgttgccttgcaattgttggcaacctgaaattcttggccatactgttgcttttggaagttgttatgatcatcgaacaagcaagcagaaaaggctaagctgaagcgacttactgcaacaagaaaggaggcgacgatatcatcatccacaatctaaaaatcgcccttttgtataaagttggcttttatcatttctctgggcgaaaaggtcatgaaaagctctagtagtaacatgctcgggccggtctccctgcttttgttcaacttttagcgaggatttagcaacgggcgtgtgatatcagaaatgtatctcacgctacctagctctgctgttggtcctcgctgtgtttatctgcacagattgtagcgtaagtttgcacagctcactagcttgtcgataagagggaactgtccgtacactccacagaatatacagtgtcaatcttctgcgaggtagaaatgctaactgttaattcttggtgtaattagcggaaacaactacgaatctatgtcacacacaatacagctttgctccacggccaagagattagcaggaattgtctcctcgcttgtcaaatgattagccatgtactagtgtcgttcatactgattacacgataacatcaatcacgtgtggaataacctgtgtcctaaacctttgtttggaagctaagaaggacgctggtatacttatccacaaaaaaggaggaagcctgcaacaacactcaagaggcaccgtgcctttcccctttcggcacgagaatgacacacgcgttgatgtcaaccacaatttgttagtagcagacacggtaggtgccatcagattcttcactgtttctcttacacatgaccacattacagcaagatggcatctgcagcagatacgcatgggattagcactggcaaagagacgaaccaaattcagcagcgaatgcatgcatccatacgcgtgcagatttgctgaaaaagatttggtctgaagaatctgcatccacaaactgaagattgggcacgaattggctgtattactggcagtactccagagtgcagacggtatctaacccacttgctcacaagggttataagcagtgattaaaattatatggtttaattaagcacgtatatttagtatgaccaccgataaatactccaaacgggtagcagtctgagcccaactatactatgatgagcggtggcagccatatgattatttaatctgatccggaggattaaacaagtggtgattatgtcacgccatgatccaattctggagttggttacgttgtgacgtttggttaggcctgcgaaaaacctacttgaaatatactacggcttctcctacagcaacagcatctagtatatacggccacgtccacctcgaaaaagaaaagaactttggagttgtaagaaattcgaacgtatattttaaaaagaattaaaatttaggcaaaatttaatatggttgaccactattagcgtaggaaacagaaacagctgtacaataacagttcgattacgattttattaagcagtggcagcttctcttttcacaggagagttcccagtttcaacgcatttagacggatagtacttgtacctggcgaccgacattattctacatttctactccgaagaccaggcacagccacacaggtgtccccgattaggctagtagtaaatcacacgaggaatctcctggtagttcacgtgacgattaaaccgttggtgtgcagacgaggaggagatcgctagctagtttgtctccgtcgaagaagtaggcgtcgtcgagggctcgagagatcttttttcctccgatggcctccgtgcagctgaccagctgtgctgtgtggtgtactggtgtgtgggcttaataattgtggggtagatttgcatttgcatcagcacgatcacaaagcttctcccctttaaataggacaagtcatacacaggagtagcctagtaaacatctctctctgcctctctctccatctgactgctcgaccagcagcaataggctctggtttcctcttcttgcaagttgcatgctccctagtccctagacttgaacagttgagcccttcctgattttgtggttctagaccacctctggcttgcagcgagaagcaacgttcgctcgcatgacgttccagctccaagattaggtaggttcttggtttcctccggattttccagcttcgtttccatgatctttgagaaaagtttgcgaatgcactttgtcgatttttttaaactgcagtagaggtacgctgatatcagaggctaaatatcggatgacgcattgcaattgcaaccctttcctaagtttttttctttctttctgatggcacaagttggaggaactgttctaaacacagaataatactacctctttcgatgcgaaaagtatgccaatttggccgtacattacgccaagttgtgctcttgctctgatgttgatcggtcccctacgaaccaagggataagagttttgcttccttttgtccctccactgtgtttgcgttcggtgtggtgctgcgcgccagcctgcagaagaagaagaagaagaagaagaagagaagatagtggtggtgggttcaatcagagcggttcttggtgtctgaagaaacgcacaaagccgaagtggaaggaagaataaaggcaagagcttttctccatcgcctcacccttttttttttgttcttgttcgatggaattctctctctccaattgcgaaattaccgtactcgcttacaagttgtagttttatttttactcaatttgataagtttcattcttttataccttatcttggttttacccttttggatggttccggcgagtaactgatattttttcgattgctgggtgttctattgcaccgtggttcttgcagggtgaggtgagctaagtcgtaggctgtctgccgcgcgcgtaccatgggttgtgggctgtcgagggagaaggacgccggcggcggcccacggcggcggccggggagcgtcggcgacgtggtcgtgttcctcccggggctccgggtgccgaggagcgtggacttctcccaggcgctcgccggtcgcctcgacgaggcctcgtcgaggctgtcgtcgctgcgggcgcgggtcgtcgacatggcaatgcaagaatcggcggcggcgctgaagccgaagcggcgggcggcggcgcggcacggtgagtgagggtggtggtggtagcgcatctgaattgctggctggttttgcctgcaaaatttggattggttctcatttctttggttattttttctacaggttcgagcactgctaatctcctacaggctctggaagactatctgccagtgctgctaggattggtgaaggaaggtgaggaattgctccgatatggtggattggtgttctgttggttgacaatcttgttgtttcgtttgattcagcctgtgaactctgcaggtagcgaattgcggcacggagtgcacttcgtctggactaaccaagaggataatgctgaggtatgtgttgggtcctaaaaatgtggtgtgtcatcttcctccatgatgcccgacagtagccattagatctaacattggaattgccaactgcaggaaacggccatggcagatgcatggtatgaagtgttgtccgttctgcatttgatggccatggtctgcttgttgcaggccaattctctgcttcttcccaggtcatacggtgatggttatgcgccaagggtttctgaaggtataaaactgtttttctgaacttctgaagcaatatgggcatatgaaaatgttcatgtcctgctttccattgagttacttctttcagtgtttttgtgctaataatgcaccatgtattgccaatgtacacagagagcagacgagctactgttgatgttttcttgaaggcatctggctacctagactgcgcaattagacaagtactaccccaaatatcgtcggagttaaggttatgaacttttgagaagctgagtagatgattttgaggatttaagctgaaagaaggtgtattgacatccatttcaatgtatgcattacaggagacaacttccagtagatctggctgaaggaaatctcaaagctcttagcctgcaagctctgggtcaggtacaattttctgggctcagctcatttggctctttcgtaaatgaactcaagaactgcattcctaaacctaatgggcattacatttgttgtagtactttttatgaagctgaaacttttatgctatagtcccaagtgacatatttgctatattacccctgaagctcctatattctgattaggaatgatgcttagtaatctatttgcattttttctgtgggctgaagtagaaactattagcactaattcaatttatagca

SEQ ID NO: 50106 - DNA, 2303 bp, Oryza sativa
attttcctgatgttaaattacttcaagttgcaattgtacgtctcaaaactaatgtgcactttttttcaggctgcagcatactatttccatggtttgattctagacgagggaaacacagagaaatctcatggaatggcagtagctgccttgcaagcttcagaagaatttctgaaagaaagcaaaagggcttctgaagccttccatgcaactcctccaacatcaaggcaagacattttaccttttgagcatttcgcttttcaaattttcttatgttttattctcagcataagaactttaccaagatggtaaactgatactactcagtatactgtttaatgaatagctattgctgttcagtgtaaaaatccactcttaagcatggatactgaagtcaatacctggaattttgcaggagccccactcctttcggaacagctaagtacatgcttgacaagattccaaaagatgcttcaagcaaggtcaagatcaatcaggacctgtatacgcaagagaggtactaagaatttgtggtgtaatatgcatacaacaaaatttcttgcaacataaatagtactacatctagtgatgttcagggtattgtgaacctcaataagtgatgaattttttcgttgtggggaatctgcagggtcattggaacaccgcctccattgccggattttgcgttggctctaaaacctgacgactacgatcttcctccattagatccactttggaacaaagaagacagccgtcagtagcagtatattcagcaagaatgtgaatgttgtctttcagaggttcaggctctagtataccatgtcgaagccagacgtggtacgaatgaagtgtacaaaatttgtcccaacaaattgtggtgtcagcaaaatttaaacaaggcctggagataatctcaagagcattgtacaggcgaatcttattctgacaaaggaaatgctttgccaaaaaaaaaagaagaaaaaaactaaccatttcaaaagattccaatatgactcgtggatccattttctcaggattcccttcagaatggcttggttttgatctatactgagtactgtgaaaactgtcacattttgatcctgctgcagcgactatatcatctagacagtttccagtgttctgagatacaactacacaagcgaacaaaacgaaacttgacacgctcgtttcaaaagcctttgtctgatgttctacaatggtccaaaaggcaagtatgcgtgccaaataacacaaagaaaaccacgcgaaatggcgcatatatagtttgcctactgccgtgagcacatatatggctacaatttacagactccaaattataaagaaacatcattattgtattatgttatttacatgttactcttaatcatacacgattgctgtttacatcaattctattctttaccactaggtttgtttctgttcaataatattgctatcaggtattcaggcaggaacatattcctttccaaaaacattatactccttgccatagtcatcagtgtgaccgactaccacctttttattttgacaatactaaacttttctggtactgtaaaagtaactttatatttaaaaccgggcactattcaacctgaactactataaaacgtcaagtttgcccaaatgtaaagtggctttggatgatgcgttgttgaccaagagttataatataacttcagagttaagaacaaaaatcatctaaccaaccatatgtgcaattggttccattgtctaaagacatatagatgcgtcacaagatcagccacccatccaaatggaatgccagtacaattgaagtaaaatattccaagatatattgtaggattgctgaatagtaccgtaaacagaagtagaaggcagctttcagggaattatggcatccccaaaaatattcacaaaaagccttaccgtttactttctaatgacaagaaaaaagagagaagaagtaaaatcttatgatgaaattaaccttgaacaataatgaagacatatttttttctcacaaaatccttatcaaaaacttaaaaaggatcttcagtagttgctactcatcagtcatcctaccaacaatacggtttccatacaagatacttgttatctcttcaacaaaagcctgataccaaaagaggcagccttgaattctgattgacataaaaaaatgttttagcagccaatattataacttggaacacgcagctctaacaaggatgagatgaacaaagtacaggaacaatcatggatgcccaagtggttacctgttcttcaattattcaccacatgcacat

SEQ ID NO: 50107 - DNA, 1812 bp, Oryza sativa
  unsure (1)..(1812): unsure at all n locations
nnnnnnnnnnnnnnnnnnnnnnnnnnnnnnnnnnnnnnnnnnnnnnnnnnnnnnnnnncgagacgcgcgagatcgtgccgaattgccgatgtcacgagttcacgactcagtgactcacgacgagtgcccatctcacgagatggggatgtggcctagtaaagacccaaacgggcccatgtcacgggagcccattaccttacgaagcaaaggcaaagaagcccactgcaccttcgtttgggtcgggccacgtctgacttcagcgttggtggggcactcctcccattccattttctatacgaacgtgtgaataagttggccagttctttttttaagagaagttggccagatgtgatattcattcgaaaaaacaatgaagacggcatcaacatgtacatcgtcatcacgatatctagatggatgaggcagacggcacgttgaatgtagtagcactaaagtagaattatgtcatgctttctattgcggagtgcgccgcctgtttcgatcattgccgctgtttctcccacatatagatgattctcgccatctgctgcaaaagaggaataagcaaccgccatctattttcttggctagaggaaaggagagaagtcgagtaacgaactaacgactccaaacaaactcgctcaagctgtatactacaagttagtagcaatagcaatccttcttgtattgtggtacattggttgtatagataggatcataggaacagtaacaacttgcgttgcgtgccaccgccaaccccacggcacgcaatgcgattctttgcctggagacggtagctactccacttgttgcctatcttcacgttatgcgtgcctgcccagtgcggcagtgcccacgtacattcgcgaccttaaattaacaccaactggtcctgctgcgcggcggcggtggctaccggggaggcaacgccaaattgcaaatccccttccacactggcccaggcccgcttgtttatcgtcttctatcatcaggcctctgaattctgtcacacctttttttttctcatcggaacactactggttgctgaagctcctttagaagtgtactcaattttcttccttaatcatccatccgacgtacattttgtattttgtgctgtcctatcttctgttatacaattagtagtagcatcttcgagagataagctcgatcgtgtatatactagctggagtatactctgtgtgttctcatcacctcatgacttcgcagtccccacaccattgattcgataaatgttccagctagcactgtctcccccgtacaataatgtttgcaaattgtaccaacagtgagtgatgccacggccaagctccaactagtcgcaacacaagaacaaagtgaacgacgaaatactactctctccgtctcataatataagtgattttgagtttttgcttataacgtttgacctttcgtcttattcaaaaaattttaaaattattatttattttatttgtgacttactttattatctacagtactttaagcacaactttttgttttttatattagcaaaaaaaattgaataagacgagtgatcaaacgttgcaaacaaaatcttaaaatcccttatattgtgagagggagggagtatatgcagaagaggcgtgtcagagagaagattactggcgggagaaagttaaaaagtactgtcaaaacaaaacctgcaaacaccgcaccggtgcgaaaacgtacataagtacatactggtgcccgcagcctgcgtagacgtactggagtacttgtattggattgatggatactccaacctactgtgccgtagtactagat

SEQ ID NO: 50108 - DNA, 3313 bp, Oryza sativa
cttgcttgcttgcgcgcgtgcgtcgccgctttgattgctaaccaccgttgctgctccaccgaatattcattcccccgcgattttatccgttcccccgttggttttctccgttgttgcgggagggaattgtgttgttctgttgtagtagtagtagtaatagcccatgagatattttggatcctggtgcggcgctggttctggttctggttcagcgtggtggtttaaaccgagaagaagtcaaattggcgcatagtttttattatatgggcggatcggaagaagtggcccaaggctccgacggcgcgcgagttgctgtggtggttgtgggagcccccgtcggcgacgactccgccgctcctccgcccgcggctgcagctggagcagccccggcggtgacccccggcgaggaggcggctaagcgggagtccttgttggcggcggcggcggcggcggcggctgctgagtgcaagcaggaggcagcggcggcggcgacggggttgcaggccatggcggtcaccgtggcgcgggacgtcgaggcgggcggcctggacgccagcaccagcggggccgcggacgagaagccctcgtggttcacccctaagaggtaaggtgcttagcgcgattgggctcgggatcattgattttgcgggtggaggtgggtttgaattgcttggttgcacggggtttgcgcacctcgtggactgtttgatccgaatttgggcgatttgattgttttgcttggggagttcgagttatcgtgagctcgattgctcaaacctgccgcactggtgcagatgattgcgggatatcgagtagctgatatgcgtctatatgaattggagcttttggcgatgccaatttgtagtgtgaatgtaaataggagcaggccagcggaggttgccatttagttgcttgatagcaaatcatctctgatgcgtattggctgttccattcgtgacctggagttttagaatttgtatgtttctcctcgttagttttcttttgtgtaaaatggatctgcgttaggtacaagtttggtgttggcttgatgcaattcgaggtgcatttttttggttttcagacggcatttttgtgggataagctaagttaattttcatggcattggaattggaaaggagattggtctggcctcgcgtgttgtattttggtgccgactgagctgtgcacttcaatgttggagagataagcttgagagttcatgaaatctgctacatggccccagctgatcctgtttgtacatcttctgctttcctgtgcttattatccctctggattttagctctagatctctctcatctgcgtttggacaagatggagtaggaatgatagtgtttcactgcaataattccgaactctgaagtcgaacctcgtgtaggtatcgagttcagatgaagattgtggtttcaatgcagattgctcagtacatcctgtgctcgttatgcctctgaattttactttctatttgaatttagccaatattttcatgttatgtggtattgtcttcagaacagctgtttgtgtagtcagtggacatctggtgtttgtgtatttgatagttatgttttctttattgtaattgagaactctatctatttatcccttctttgggttgattagtttatattgctgcagattacttgtgatgttctgcctcatcaacatgctaaactatgttgaccggggtgcaatagcaagtaatggtgtgaatggtagccgccaaagttgtactggtggcacatgcacatcaggttctggaattcagtaagtcccagtggaaattccatacagttttttttttagattgctgtatgtcagactcattgtatctcatggaatgagagaacagatcaggacaaacactctcattctttttaacctttttatgttgttatatatattcacactgaatttcttttttgcaataaattcattataagtcatcactgatttatcaatttttgagtttactcctgaatgcccttaccatgctgatacaggggtgatttcaatctgaacaattttgaagatggtgtgctatcatcagcatttatggttgggttgttgattgcttcgcccatatttgcatcattggcaaaaatgttagtttcctattaattccaattttcgatatgtggtacattatcctgttattggtgctcaatccacaagaagaaaatattaaagatgggcaactgcttttcaaagaacaatatatgctaatgctacagattgtcagattaaggaatatagaaacattcatacttcacgttctgctggaggctaacataggtttctgaaacatcaaaccttttatagtgtaatgttctgacgcatgatagtttgttccccttctttcagacacaatcctttcaggcttattggtgttggattattagtctggactattgcaacagctggttgtgggtgctcatttgatttctggtcaattactatatgccgcatgtaagtaccttgtcattgtgaataatcaattcatgtttcagatctgttacttaaaataaatcttactctgataatgacacgaacaattctccaattattgttacttaggttagttggtgttgtgaagcatcatttataagtcttgcagctccattcattgatgataatgctccagcagcacaggttctgtcattcttagaatgcctttacaatctttctctgcactgagctgatatattatgttcaaacaaatcttatttttacacagtattgtttctgtgctcaatatacgcttatattcttctgggaaacaatctacatcttcaggcatacaagtacaatatctatcagttaagatatatatgtttactatgtagtcaaggatacacatgattttactccagatcattgtatatttataccagatgaaccaattatcacacctgtgtaatctaggcttaatttcgaagggtcccttccagatatcctttgttaaaatgacctgtacggcacataggtatcatcagactgtgagctacaacggagcactgtaatatagcatttgtctggctagcagttctgagaactctttactggttgctaatagatgttgaatcagcattaaattgctcttgaatacatccagctagctatgcatattacttggaggttctgtttttaattgtacttgttttcatgtctagtctctagtgtcaaccaggaacttacttgctactcctatgttaccagaaaacagcatggcttgctatgttctacatgtgtatacccactggaatagcggttggctatgtttatggtggtttggtaa

SEQ ID NO: 50109 - DNA, 2509 bp, Oryza sativa
tcaaaggcaacaacatagttctccgagctaatgctatttggaacagtcgtcagaccctgacccttaccgtgtaaagccttgaaattattttaatattttgtcctacatatcagaaatatcatgcaaaacagaagaatatcatcatgccattactcaagcctgttgcacgctgaatttaatttagagaaagtatagcagaaccaaactcagttaccactcatgctcagcgagctaacaacaagaattgaggaagaaggaacagttagggggtttcaagtttcaaccatgaagcaacggacaagaatcaaatgcacaagggacaagctggcctttatcaactaaccttaataaaagagcctccaatcaaaccaactccaattaataaaactaactgaatcaaatcacttggcaagcattagctctacaggctgagtggttactgtgtcacatccgccatgcgcttgccgcacgcgcactactcagaaaccacttatcttcaagctgaatgtagggaatcaattcttcaactcctcaattagttcttaggagttgtcagcatcatgcagtacaatcaactatgagaggttagtccaacacggcaacatggaataaacccataaagatattaacctcaatgcattgcgcaacctaatattagtctaccgagagatgcacgataacatctgaaacacaatgtttgataatgaagttcatcaatatccttttcttcatccaactcttgttgaagaaaagaacggggcctatgaggttatcatctgggccatttaggattatttttaattcaagtgttgcaagatctcatgtcttatctagcaacatccaacagttagggtaaactgaattgaggtgtgggtgctattcttctttgtaataatttttatgttagcaattataaatgtatgtcactggctaaccttttataatctataatacaagagccattaagaaaaaaaaataaccaagcagtcacctatgttttagcgcttatgaggcatatgtgactgcttgtgccacttaagcagtcgaaggttgcaccagttccttgtatacagccacatagaccttgtgtttacaacagtgtacagaagaacataattcatgagatgtccgtatcatattatagatgaatcaggaatcatatgccccaaacttgtctcttaagtttgagtaatgaagatatattgttcagaagcttctgtgcatgttcctcagtatcctcactctcaatacattactgtctttcgacatagattaacagtcaagactagcaaaactcacaagtaaatcatattacagatacagaggacaaccaacttgcctgtaaacgctgcgtacagcaaactatatctgccaggatccccttctcttgtaattgagcttcaaaattatcctattatacaaaccactacaaatgtcagctatgaactattcatacaagaatactgctgtgtttaggtgtgaactcgctcagatgaactcagcaatgagagactgaaaggtttccttttgctctgccacgtctcacaagcatcattgacaatagatgcaggtgtagaaagtgtgtgctcattaacatgacagactagacaatctaaccatcgagcccccgtactgggctttcaatataagtcggacctctggcctttttctaaaaaaaaaaaaaatctaaccatcgagaggattaagctagtgtgaattatcctaccaatccctatgtaccgaccaatttgaacatcatcccacttgcctgtatcaactcaaccatcacaatagagattgcaaacctttttcgtgttccaatcaacaaagagaagtatcggatttctgcttctgagtatcatgctgatttggaacaaactgacaatcaggaacaaaggagcagataacagactgtggcataagaaaatgccaaaaaaaaactaatgctaacttatgcttcacaaaacagttgcaaaatcaaacaatgttggcttaactcagataatagcatacacactaatgctaacttatgcttcctttacaaggtatatcaagtcaccaaacggtttagggtttaacgggcgaatacgctgtgaattaggattatggcgcgcgatctaatcttctctaatgccaatccaccgtgctctcatttagagtcactaacaaagcagcagagttcctagagctggtgcagtccaccacgagtccacgatgcaaggtacctgatgatgcggcgatgagggggagaaccagcagcgctccagcctccaggtgatggaagaacccagctgcgtgcggtggaagagggcggcctacaggaggcgggcacccgccaccacccggagtaagcgcaaagccggccgtgagtcgggtaacaccgtccgcgcggctgcctgggggagggggctgctcggcggcggcggatggggaacgggcgcgcagcagcggtttggacctggaagtctcgggcctgtttggcaagacaaggaaagaggaatggcggcct

SEQ ID NO: 50110 - DNA, 5566 bp, Oryza sativa
tcattcctcgtaccttctctagccaaacaggcagtgggagtttgaagaacggagttgatggtgggattggtcatagaagttatatttttagtccccatccgttgtttggtttcacatcgaatttccttcaaagtctcacgaatcaacaggcatccctcatatgagagattggtggaaattggatctcttaattctctatcccaaaccctctcgaattttaaagtcttccaaccaaactacaaacttaaactctcgtaaactctcgtccccatcaccaactccctccaaccaaacaatcaagaaaagccctaggctggtgtcattaaagattttaaagttgatcaaaataattaattagaacggcccctatagctcagtggtagagcgtcagtcttgtaaagtgaaggtctgcatgggggcattttattacattttgttttttttccaaattagttagttctcagtttactctctccatcccatccgaaaaaatacgtcccatctaaccaaaacagggcatattcttgttttttttccaaattagttagctctcaatttactatttccatcccatccgaaaatataaggatgtgccccatctaactaaaacatggcatattctcagtttccctgctagtctctctatccgaaaatataaggatgcgtcccatctaaccaaaatattttattactttagggtgctttgttttttttccaaactagttctcagtttacctgttactctctccatccgaaaatgcagggatgcgtcccatctaactaaaactcattatatttattgttttagctttcttttgtttttatggtccaaactagttttcagtttacctgttactccctccgttcaaaaatataaggatgtgtcccatctaatcaaaactagtgctcggttgttaacttgcaattattattttagctataatcttgttcttttttttttgtttggtgttccaaacaaattctcagtttacctattagtactatataagattactcagttgttaactgcatatatatttattttagcataatgggataaatattccaggcactttgggcgatccttcttcccaaaatgggagactgcgggcttacatgcaggtgaacaagaccaactgcagattacacagaaaaaaaaaaaggaatcgcacgtgaacaaggtcatttgcagattacacataaaaccaggattttggggtaaaaacgcaaaaaataggcagacgaaatgcggtgagcgtggatcgaacacgcgaccttcagatcttcagtctgacgctctcccagctgagctatccccgcttttaccatccattttaactaatttgaactgacactcaattttcatggttcaccctccatcgacacgtacactggagactggagtaacagtaaccccatgagtagcatactcttgaatgccaaatattctgcactttacagtgacagcaacagttcaagaattctgcgagcattgcatagtgagtaaaccatatcggtgtgcagaagaatgcatgtaaacatggtcctaactcctaaggtagggcgcctttacagcccaaatggcctacagcttgactcgaattatggccagaggaacagcctgaacctttctcaggggcaaagtggcagcggccgtgacagagcagggcagggacgctgcagcttttgccccagtgcagagataaaagcaattcactgaaattttgtgaagatcttgttcatggagatagtaacagcatatggatcatatcgaggagaggataaaagccccccgcgtcgtgatcattggtttgcaggaaagtgcagtctgggatgaaatagtgcaaccattggacgtttcatcattgtttggcagttgggtcagcagctgtgcctttcttctcaaaacatcaagagagcaaactgcgcttaaacgctttccactctccatgacttgcaatgcaaatcacaatttcacaacatcaggctagtcacacaggaataacataccaccaccgtgttagaccactaatagaccagttgccatagcaacagtgacatgacaatattgctaaaaggttgtgtactgattactgaaccaaacaccatcgtcatgtcacagatgacagaaccatggcaacggcacacacacacactgctagaaaggacagacaattaatcgcaatttcacaaacccaagaatccaaaagacttggtatctacaattgctgcctctgatgatctatctgatcacattcttgattcttcaccagctacttactagtattctccggcctaaaatcaagcaaattcacacaaaattcacccatggaaacaccagcggaaatgggaaattaagtacggcaagccatacacacaagacaaagcaagactagctccaagtacaaatcaaccccgcgcgcgcatgcaatcacgtcgcaaattgagctgcatagctgcggcgcgcgatcaccgggactcctcctgtgctggccgtctcgtggcggcgccggagagcgcggagagtaggttgaggtggtggacctgcgccaccgacgacgcgtacgcctgcgcctcctgcgacggcgagacgagggcaccccacgacgacacggcgggccgcggctgttgctgcagcgcctcccagaacgtcggcgcctcgtggtcctcctggcgcgggcgcttgccgaggaggaaggaggaggaggcggtggagggggcggacgagcaggagaagacggccggggtggtgccggagccggtggcggcgaggatggacggctcggcctgccggagcagccactcgatggtctggccgtcggacttgagccccagctcgcgggtgagctggaacacgcgcgccgcgcagacgatcggcatgcgcacgcgccggccgcgcccgttcaccttgctgtgccggtccttgccgccctgcgtcgccgccgcctttcggggagctgggagcacggcgtccacgagcgccgccgtgaacggcattgtgatctgctgggacgacggtggcagcgccgccggcgttggcattgccatgggccggtagacctggaaggtggcggcgtcgcgggaggccatggctttccgtgcgaattgaacactgaacaggtagctagggtcttgttctctaggccccttcccccttggggttatatatttataaatggactttgaatattaagttgcattttaattcttctaagtgtgtaaaaaatgttctgctggtagtttgtatggtttcactagttatatttatggccccataattgctacacgacgatagcattttttccccccgaaggaatgtaatccgataagcatattctgtaatcgactgatgtctcgagttttgtagtattattattattattattattattattattattattattattattattattattattattattattattattattattattattattatgtctcgagtagtaaaaagaatgtagacagataaaaaatgtatttatgaaaataatagtaagaattgtatactcaaatataattctatttttgaaatctagttccacgcaaaattaaaaattatgctaattttaatcattacatctagtctctgcacatatccaaatgaaaattattaatcaatcagtctagatagtaaaaaggtctggcaactataaaaaaaagggggggggggttaaatagtttgtttgcccgtatactacacttgggagcctacgagtttctttacctctggatttactttgaagaacaaaatactggaattttttgtgcctctttatttattccagcttgacacacaatctgaatgatgaataacccagccttccggtcttccagagattcttgcaattattgggaaggaaatactcctagatgcagatgattaactttagattttttttttcctctagagtatacccaggacagcagcagcattgcagggacaggcatgcagttctgtactgtagcagtagtgcagcactgtgagcataggggggcagggcacatggggagctttcactttgatggagcccgtggcctgtaggttttcactttgctggagctgtaggctcatgagcagtgcttccatctttcagtcgttcaccgctacccccctacaagacttgcaagagggctcttctggatcgagcgatttccatatgaattgaaaatggaggatcttttcctttagaggttacttggattgtaggatttgaagttgaacatttcctcggaatacattcctaagcctcaatttcataggaatttaaacatgaggtctaacctcatgggtttttttttccttttagaattctcatgcattctctttctttctctctatactcttactcaatataagtacgtagtaatatatatttttcttgtgagccatccaaacacatgttttgagtacttcgtgtgtttttgtttcttgtgcgattaaacatgttatggcacttcaatcctacgtttatttattcatgtatttttagattcttgcgtttcaaatgagcttaaaagaagagctgtaacaaaattatggtattagtattcaatgggatagataggtaatccatgggtacaaaaaacataaagttcttgggacgatgaggttgagaagcaaggatcaaggaacgtagtacgctatttgctagaggcttttacaagttcctgttttcctaggacggggatgatgttcccgcgtagaggaacgctgtctttgacctgttttcctgtgactgcataatattactccgtatgattttatgtttttaaacttttgatgcatatgagtgcagcacctgttgactctcgtagtctttgttggtcttcttcttcctcttttctttttttctatataacagtgctttacaaaatagaaacgtcgtactcctcatttgtgtataaaagtttatttattttagagcggaggaagcaacatgtagcatgacataagaattaactgtccttttttttatcaacttttcctagccatttgagttgtgttttcttttaaaatgatgtatgcccagtgaaacaaaataactgcacctgcatttccccgcctcccattttcaccgtttgcgttggttcagaggtcagttgagttcaggactagataggataggctctgatgtactaatgcaacaaccatgaacaaggattgcatggatgccatggatgctactccagtctccagctaagcttgtagacggcgaccaagctacaggcacgtcattttcgctcaaaaagccagaactgatacacagcgcgatcgagactcgagagcgtttgttaaagtcgttttcaagcaaaaggccacgctaagcatgcagcaaacggtgagatacctgtcccccccagaggttagctttgcggatgctgaattgctgatatgtgtagcagagtgaacctgtgattgtgtacgttgtacgtactctagatggggtagtatgtcaagtaagcaacttgatcattgttgggtcccggaagaagaagaagaagaagagggagaggaaaaaaaaaaggatcaccgggaggattgacg

SEQ ID NO: 50111 - DNA, 1640 bp, Oryza sativa
ggcctgtcaatttggctcgatagaaacaattactggattattttcttttccggtggaggacagaaggaaaaacatgcaccttttgggttcaacacaccccgcatagtgtagtacacatttttgagttttcgtacaagaactcgcatataggaggaagatataaattgtgcttcgtatgattctaatcaaccaggttacagcataacactgttgtcaccagaaaccaagtagttctgatactctgttgcttgtatctgtggtctgtacacaaaaagaaaagaaaaatcacaaagcaaaagattctgctttcttctatatttacaggtacagccgatacacatgcaaatttgcatttcacatgttcctggcgtgatggacataatccggccaagagtaatctacaagagaaaaacacggatttaatgattgcgcagattactaagatgcccgtgcctcttcgttttcatcgagcaatggcctgaggtttgatctctcgacggcagggacatcatgctcactctgttcgttgaaacgatcaacgctacggacaaatatgcctgcaagacaacatctcaactcagtgcaaacagagaaatattacatccacaccacaacgcactactagtcttctatccgcatcgatgacaaccgacagaaaccgcctgaaatgtttctatgctaaatttcattttagtaatataccagcaaaaatatctgtacgttattacataatttaaagaaacatattggcttaattttagaattaattagcagtttttggtttcaatattgtgtgttccaaagtctatacgtgacttctactgttctatattatgtttggtttggagtggcatgccagaattttgggtatgtttggtttggagtggtatgtcagaattttggggagctggtggtggggtgattataaattcaccactcaccaccagcacaccctttcaaaggaatatagatattattttagataatggattaaaatctggcctctacatccaaaatacagccaaacaactaacagaagtacttacactcacacccttacaaacatgtttgacacaacaaacaactcaccacgagcacttaggcttcccaaattagcttggttctgtcttttttctgtttggatgtggttaaaggagtatagatatggcatgtgatagtggcagatttacaattgttacagggaataatagacaacagaaaagaaattgggcctgcggggttgtaaacctgtaacaagacgttataattgttgtgctaagagaacgtaccaataaaccaaaatatagctgcaatgaagaggatagatgtcaaggtaagagctgtcgatctccagttatggattttgtcctgcattcaacaagttcaagcagtaaaaccatgagctttgaacacgatgaatacccaaattaactgtcatctaggaggtattggatgcaattcagtgtcataacgcatcgcacatagcaagaatctatgtactacaaagatttgtgcaacataatatgtgcactacaagggccagtctcatctaaaatgaacaaatggatttattcatgggaaattcggcaattagacaattattcaatattcaaaattacaaatttagtgtgaacaaacac

SEQ ID NO: 50112 - DNA, 6255 bp, Oryza sativa
taaaatatatttagttgattagaggttgtgtacttaactatatcaggtaatatgaactatgcttgggttgattctaggacttggcatattttagactccatttggttctcatcatcaacaattttgagcaaaccatgtgttaatctggcatgttgcccatgttatagtgtaattgataaaactcatataactgaataatcagtgacaattatcaaggttttcattaataaagggactatgaatgaagaacattatacttatcaagcgttcacgtcttctcaattcgatactgaactaaatttccgtttactctctacatgttttacattccttactttttctgcagttgcataagtatttagttctccatataattctatattgtaatgcaggcgaagaaagtgtatgcctacattcacaaaaatgggtataaaacaaagttgatggctgctgccatacgcaacaagcaagatgtgtttagcctcctggggtatttttcttattacagatcaagattgatcgcaatggatgttagtttgtacagaactaatatttctgaaatgtaggattgactacatcattgcacctctgaagatattgcagtctttggaagaatctgtcactgatactgacgtgaagtatggttatgtcccaaggctgactcctgctcttggcaaaacgtacaacttcactgaagaggaggtttgctcacttatcctggattttgtgcagagtcttatatcatgcattctgtagctccaccaaactactcgctataagagactcctattaggggtgtgatgttttatctaaaatatataggatcttcacttgtcatgtgctttaacactactagagatgaaataaggaaggaaaataatatttggactgtttagatcacccttaaaaggtcatgtcaaagctcgtagtaggtgtaatcatgattcaccaaacagttactagaacaatacaaacaagtcattgacatcctataagaagaggaaaaataaaacaagagaagataagtgattatattttttatatggcaccttcatgctaactgttcatatttcaaatgataccacgaatgcagcttgtgaagtgggaccaattgagtctagcagctgcaatggggccagctgcggaagaactacttgcttctgggttggaaggatatgtgaaccaagcacgccgagtggaggaactcttcgggaagatctggcctcctccgaatgtttgaacacattctatgatgaggaccagaccatgccacagtcttctattccaaagaataataacaacagccacggacagtgctggccagcatttgctcgttcccttcaaagaatacttctcttagcctgtctgtgtttgtactttgtagttctctagctatctagcaaatctcacgatgacatgtcaagaacatctttgttttcttttcgcaaagattggatacggattttctcgagtatttcattagcccgtgagatgtgtaccatgaaatgtcacccaaatgctctgctggattgttctgaagtctgaactgaatcttcagagttgcagttacttatcactacgtttttttataaaaagatgggtgccatcagctagtactgtgaattcccattttcagtaaaatggaagaaatgctgatgaaaaaaatgctggtcaaacttgctctcacttttcagagtaatcctctgtttcttttctttcatggacctgacatccctatcattccaaatgccaattacctaatactactaggatgctggatatgggttctggttggatgctggttagctcaggaatcacactgctggcatgagcttactagtttttgttatacagttatcattaacatacgtatttattttatgccaaataggcagatattggaaacgtttcagtagttcgagcaagatcagttggacaggccggtggttcacgcccatccagtgatgatgaagttatcatttaatttaaaaaaatatcaaaataacataatactctctccatatataaaagaaaagagtctcggatgtatttcttttgtcaccgactatcccgtatgtgactaagaccaaagactttaagcatacatgcaactaatgagtattaagatagcaacttaattcccatcaacaatttaatataacactgtaaaacaacaatttaatatagcaccataaaacgaatagacagtctctttgatgcatggagattacaaatatgtttagaaaaataaaatatgcttaagattttgggataaagggagtaaagagtaaagtgcatttttgtcctattttccactgcaaactacaaaataagttattattttacccgcaggccgcaaccgaaacatagaccatgcttcctccaaatgtagttttaacataagtttttgtcccctaaaacccttacttttagagtgggtccgtattaatgaatgacatagtggtcttttaacctcttgctgaatactccatctgacctaaaataaatgcaataatgtaatttgaattacactgttgcacttattttgggacgaacagagtatgtctttgactatctaatactccctccatcgtataatataagggattattcccttatgtgcaagattaaggatatcaccaaaatactagaatacccttattaaatgaaatttgcttataggtgaatgggtagttgggagttaaaataggtagaaattaaaattagagttgatggatgtgacaccaaaatcccttatattaatggacaactagaagaggcttttaggcaccatcttttcgcttatacttatgcttatgcttatcagtcaaaatttgaattttcaaccttaaatttgaatctgattttgaagtttttcatcgaagtttatttttcaatctttgcttttaggtcgctaagaacacgtatataaaagttttattcacaaattacttctcgtttacaaatatgccgtttacaatggggcctaaagtctagagtactatagtcttacaagtacaaaggaagaatagttttgatcgatgtgacagtggtttccactagaatgaacttcaattaaaagttggcatctgcatggagtgaactgaagaaaaaccagttcaaacgaaactgtaaaaaacatgtcccaaggtgcttctggtccggttttgtatttttcacccaaaccgtctatagttcagggtgaaaaatagatcgagtaaagatcaataattaaaaatgaactttacacccataaaaactaatgaggtgtcccttgtttgctctatggcttgataaggtatggaaaagagaaaacaagagtagaacttagtgatttgaaagccgatgccaaaaaaaaaaaaacccctcaaaatcaactctaaaattaagtttgaaaattcaaattttggctatggttgataaactaaaaacaaccaaatggtgaagtactaatgtttttaaaaactattttattgtgtttataattttgtaatatttcatatattaacaaatctacaaaactccatgagtataattgattattattttaaaataaaatggcgtgttaggttttcactttacatggttttacatgttgcgtaagttacttgcgagaaagtgtttgaggttagataaatatctattattaaaaggaaaaaccttttaggttatcttttaaaagacgatgaagtgccgtatatgatgaaaacactcctgtcattagtatttctagcaataaaataaaaaccgtacaacaatataactctagcttcaccaataaccataaatcttcatcgaatgcccttgcattgagggtaacatatcatatgaccagttcacttgagagaaataaatacttaggtgcaatgtattgagaatttagctagttcgtaccaatatacaaacacatggcggcttctatatccgtgattgttaacactattatattgttatatagcactgccatacaacaatatatgagcaagttcatatcgcccttagatcattgtgattggctggattacatggacccgtacaaaagtgcattggttcgcccctagtgttatacagttacaactacaccatcgtagcacgtgtaaaacatcacacgatataaaagttcacgtggaaaaaaacaggagacgccagtttaaaaacaactaatatttcactgctgcaacagttactaaaaacccatcaataatgaaaccaaaccttaggtggactagagtgattaacttaatttggaagtaaataaaggctcctccaaaacttccttttttttcttttacattcctccatgtaaaaatggtttctctttcctctacacccttttgctcttccattcttttgcccttcactcctctctcatcttttcaccctttttccacattttttttcacttcaaaaccccacacaactgacacaagagagagagaaccaaaccaaaaacccctccttttcttccttctcctgcagcgagagagaggatggcggcggcggcggcggttgcggcggtggtggtcgcggccgtggtggcggcggcggcgtccgcggcggcccccgcgtcggccggcgagcccacgcgcgacgtgcggtgggaggtcggctacatgacggtggcgccgctcggcgtctcgcagaaggtttggtggcgcgccatggcgtgcgctctgttcttgatttcttccgagaaatttgggccgccttgtctgatattttcttcttctttttttttgttttctctccgacatgttcttcttcttctctgtctccgttgattctgcgcgagtttctcgggtggtttcaaatcgaaaaacgtctctctctctctctctctctctctctctctcttgcgtggttttgaggtttgtttgatgatgaatctggggctaaaaaatgcttcctaatttttttttcgccggtttgcgtgggcggtttcgatcgcaccgatctcgtctcgtcgtggcggtttctgttccatgttcttgcaggggttgtaaatacgcgttgatcgatctgtcctaataaaagacgacgtaacctcatttcctccgaaaaaaataaatcggatcccgcaaactttgcaattttatcgttgataaaaggaaaaaagatcaacattgcgtacaaaagagaggggaataatgatatcatcttttctgggttggatttctgactctgtttctcgttgattttgatccttttgagtttttgttcatctgcgaaacaggtttgttgttgaaaattgatccatttcgagataaaacagaacacatttacacacaccagatttgagatttacagatagaaaatctggaaaaggatttgcggacacaattcttgtgcaagaatttaggggtgtcatgctcttgtttagttacagtcttatatttttttcttaccatatcaatatgaaacattgcgctatcttatgcgtattgttttaaaaaaatctagtgtaagaattgttttctgatggcatgaatgcaaatacttgtttttttttttttgcaggtgatcgcgataaacaaccagttcccgggcccactcctgaacgtgacaaccaactggaacgtgagggtgaacgtccaaaacaacctggatgagcccctcctcctcacctggtatttactaatcctgcatttcaattgcatagatccaaaattgactaagctggactagaaattttcgttaagatatttttatataaaaaaatcatgtattaatgaaaatttgcaccataattttcagtttctgtttctggtgaatttaaacagcacattcatagtgggattttagctgtacatttccattctgtgggggcctcttgggcttcacattaggcatgcatgctgcatttcggggaatttatgggcttaattagttgtgtcatgtagccaaatattcttatgctatattgagaatttgagataggataggcacaccactgtacttatccactggtttgcccattttctcaagttcatccgtgcaaaatgatcagtttcatcaacagttcattatgttgacaacttaatacattattatgtcaataatgcatttctaataagaataaatttcacttcaatacatgtgttcttcttgaattactgtactactagatcgattactagctaataaaatttgctgtacacaatctgtgttgcactttgcaactgaaaacaaggttagaaatgtgaagccatacataatagtaacatgcaaaatgccaaacactagagggtccttctg

SEQ ID NO: 50113 - DNA, 9168 bp, Oryza sativa
gccgtcgtgccggtccccttcgcccagcccgacggcgacatcaccttgttcatcggtgattggtacaccaagagccacgtcgtaagctccagctctccctctgtctgtctgtctgtctgtctgtctgtctgcgattacattttagtttacagtgtcagtgttcataaatcgtcgaggagaatgatattaagttgctttcttgatatctcaactgtatactattttttcttggtttatgttgcaagcatggttatatgtagtaatgtagaatgatacttagatctgtactctctgaaaagtaagagaattcttgtgttcatcatttaagaattgtgaagtacagtgattttttgatctatggataagctatatggtgcattatatttgaagaaagtttttatctgttcttctttgaatgtgagaaggtatctctgcccaatgtaggaattgaggaaaatgctagatgatggtaaggatctcgggataccggatggaattctgatcaatgggaaaggcccttacagctatgacaacacattgattccagaaggccttcaacatgaaactgttggagttgagccaggtaagcacacttagttttcttttccccatcatatttgccttatcattagttttctgcatgacctattaagcctgattcagtttttacagtgatgcaattgcgaaacattatagatatgtagtcaaaatttggaaaaagtaaataatcatacttcctcagatgaaaaaagacatcatatcaattaccacctccatttcatattataagttgccttgaatttttttcctagtcaaacttctttaggtttgaccaagtttatttaatagaaaaatttggcaacatctacaatatcaaattagtttcattaaatgtaacattgaatatattttgatactatgtttgttttgtgttgaaaatattgctatatttttctacaaactttgtcaaacttaaaaaaaaattactaggaaaaaaaatcaaaacaacttataatatgaaatggagggagtagtaatcataaatagttgaagatcagctttcatcaattctgttattttgtagcagcaaaggacagaattttctgtctgaaatgtcttgctgcatttacatacagatatcaggatgtgaataaatgtctatcactgatcagttatcaggattactgcaaaaatctttcagtcatgccaattttaatgatctgaagatttctgactagaacaatatttcatatacttgttacaggcaaaacttatcgcttccgtgttcacaatgtcggcacctcaactagcctcaacttcagaatccagaatcacaatatgcgcctagtagaggccgaaggaacctacacttatcagcagaattacaccaatcttgacatccatgttggacagtcatactctttcttggtgaccatggaccaaaatgcaagcactgactactacattgtggcgagcccaaggttcgtcacgaacgagtctcgctggcacgatgtcaacggtgtggctgtcctgcagtactcaaactccaaaggaagagcttctggtccccttcctgatggtccaaatgatttctattacaagtcctattccatggaccaagccaggtctatcaagtgagtattaaccactagtactgttgtgctctgtactaacaaatatccttgcattattagtaactatgatgctgttgattaatgatagttttcttgattgtaagaatcatctagtttcaaggttgtcatttccagtgactacatctcaagatgacatgttctccattgataaccattgcaattgtatttttcagaatgaatacaactgctggtgctgcacgtccaaatccacagggatcattccgctacgactctatcaacatcactcagaccttcgttctcaagaacgagttacctttgctcatcaatggaaagcgtcgaaggacgataaacggggtctcatactctccaccagagactccactgaggcttgctgatctccacaacttgactggagtgtacaagactgacttccccacaatgccaggcaatgctccaccaaaaatggcttcatccacgctgaacgcatcgtacaagggcttcctcgagatcgtctttcagaacaatgacactggtgttcagacctaccatctggatggttactcattctttgttgttgggtatgtgatggaaaaccaaaacagtttcttttaccatgtgatcatgtgttatgaatttctggttagtcatgtaaaatgacacagtcctgcatcaccattttgtgaatttcaggatggataatggtgattggactccagattgcaggagtaggtacaacaaatgggatgccatctctcgcagcactactcaggtacacaacttcatgaaggacaatctgatcatatgtcaaatttgtatacttacaaaacatgtgcatccttgagtattctgaacaatgcaaatttgcaacatttttcataggttttccctggagggtggactgcggttctagtctcgctcgacaatgttggcatctggaatctccggtctgagaagctggataactggtacaatgggcaggaggtctatgtgaaagtggctgatccactgggatacaacatcactgaaatgatcatgccagataatgcattgtactgtggtctactgaaagacttgcaaaagtaagtttcaccggatcatttctgttttctctttgtttcactgatagtagtacattctgtttttggccacttaccttgtgttctggaaaaccttgcaggccacagattcaccaggtaaacagcaagtcatcggctcaagctgcagatcgatggggcgcgcgagttcttgcaatggtgttgctgatcattgcagctgtggtttccatttaaatttgttggaatcagatgaggatatcttttagttaggctctgtgggtgatagaaaatcatattgttctttgagtacagaacaacttgaggaagctgtctgtgcaaagtgcaaaacttggattctagaaatgaaaaacctgtcaattttcctacggtttttgttctggctttcacctgagattgcattgctcatgtgcagtaagcaggttttacctccatgtgatctaaagcctaaattgtccgcagtactgttgtaagtcaggaagtacttcattatctaattagttttttaaaaatataatacatcaggaaaattccattaggaatgcattcgcgcacacatacacacaaagatcccactggtttactggactcctcgtagattcaacagaaatagctcaattctagtgctccctcggtcttaaaatatagttatttttaatattttaaacttgtcttatatcagaatactacttcctccacccaactacaactgattttaatttatctaattttaccctcgactccttaaccagcccctcatataatgagggatactatgatattttccttttatccttagtcccaaaaaatgaagattagaagctcttatattttgggaagtcaaaaaagatggagggagtaaaaatcaatagaaattcttggctaaacaagctttcagtctcttcgaagacgtctttcaattttctcgttattctgaggtgtagggtccccatcttattattcaatttcctaagaatgcatcatataagcttaatataagaggacttttatggtataatatactgctagtatatttactgcaagtatatatgatctaacggtatagattgatttgattttttagttaattagattgcagtataaagtttgaaaaggtaattttgtcttttcttcattattctatcatcaaatcgtgctatcatcacgtgcttcgtcatcaaatggcgctcaggatactcctcccttagtgcacgataagatccagtaccgggtactcccaattagattcaatctgaacaaaaaattactaaagtgttattttattttctatcaaattcctagcatgcccttctatatactgctagtatatactagtaggatattgtaccgtaaaagttctctaatataaggccaccgctattaatagccattaaccggtagggcccatttaaacataaaataattctattcaaacatggcctaagtaaattcacttggtactaggccctattagacccgtgagagagtaaatgcaaccaatactataattcattatgttgttccattcatgttattatgaacaaaatgccaagaaattatggagaagtgaatgggagagatgagcttgactccttttaagttgaggttgaagttaacccaacttaatgtcttgcccaaatacgatggcacttatattaccaatatggctctttgcctcccacgagaaattgatcatatcctaggcctagccatctatatgccacggggacaataatatggatggtaaataatcaatttgtgatcctaaagggtatcagtagtagcgtttcaaatcataggatgaaagtgactccaccttatatcgatgagtttgcttaggtttgctgtggtgcgcatggtgagaccatcaaatacttaaaatgtaaaaacaatatatacataggtatgccaataggtgatggcaaaagtgttcacgagaatttccaaaggtacaactaatgtggttgatttttttttaactattgtgatgcgaaagttcaaggtatctatatttttttcacatgatcgagcgatgttatttcgtacttgagatacttttgcatgggaagagatgtagtttagttgaaacaaacgatcggatttacttcaagatctagtctaccagatgttttagtaccgttgctgctactaagaaagcagtacatcgtattttctataactaagtacattttgttacttatttactgaggttgatgagctctactaataggcgagcacctggtgaaaaatgctggttgttgacgagatcttactcatataagttagtgttcaaatacataaatgcaaagttgaatcatacacatgtgtgagagtttttatgtgtgaatacaaaggtagcttgttgaaataattttgatattttgtttcaaccaaactctatctcctcctcttttatacatttccttatcacacaataacataggagtactatctattgagttacatgcactgatcagttcaacccaaaagcttaagttgatggagaaatacagacaattcactttatattccaacgctatgatttgtttcaattttgaaaatggcatgaaaggctaatctagcaataaacaaagccaagaaaaaagaagaaaaaaaacccatggtaattgcgctcacccaaaccccaacacatccgccgcgtctagggcttcctcgcgctcgccgccggccgccgccgtgaacatgggctccggcgacaaggccatgttacgaccccgatcgccggcggcgctgctcgccggagatccgatagaataggagtagagacgggaggaagaagagaacacgagaagcagaggaggggaatcttttcttttttcttcgatagttttggacgcggtatccccctcacacacgcgacacatactcctcaggtcccaccacttagtggcttacaggttacataaataaattacgcaatcttattgagaaaacgcctttcctctgtacgttttccacctctgctctgattcagcacagcgattgttgctcatcagacaaccgctggacaggccaccacctccaagcaccaccgccgcgacaaggacaaggaccccgaccgcgagcgcccctcctcctctcgccaccaccaccaccaccaccaccgcgacgacaaggacggcgagcgtgaccgcgaccgcgatcgccaccacagggagaaggagcgcgatcgcgaggagcgcaaggcgcgggagcgcgacaaggagaaggagcgggcgcggcggcgcgaggagtcgtcgcggtcgaggaggcatggggcgtaggaggaggaggagggagagggggaagatgaggaccgccaccgcaagcgccgccgccggtcctcgcaccaccaccaccaccgcggcgacgcggagccggaggcggcggctgccatggaggaggaggaggtggtggtggtggtggatgaggaggagtccgagaggcggcgtcagaagatgattgaggaggagaagaagcggctcgacgaggagatggagctccgccgccgccgtgtcaaggagtggcaggagcagaagcggttggaggaggaggaggcgaagcgccgcgagcaggaggcggcggccggtgctggcactcctgccgcggccgctggggccgacggcgattccaatgccgggaagaagtggactctggatggtgaggagtctgatgaggagggatacaaggaggatagccaaaatgcagaagatgacggtggcatcactgccgatttgccgagtgaggtgaatgatgcaaatgttgctgctcctatggaggaggatgagattgatccgctcgatgcattcatgagctccatggtgttgccggaggtcgcaaagctggagacggctgtggcatcaatggagagcatgcctgcttccaacatgggtgataagaatggtaaaagtgcaaaggatgctgtgagtaatggtgataagaaagggcaaaagaaggcaatggggagaattatgcaaggggatgattcggactctgattatgatgacgacgacgacgatgagggtggatcgaaagagaggatgatgaggagttcatgaaacgtgtcaagaagacgaaggtagaaaagctggctattgttgaccattccaaaattgagtaccagccattccggaagaatttgtacattgaggtgaaggatatcacaatgatgacaggagaggaagtggctacctacaggaaaaatctggagctcaaggtacatgggaaagatgtgcccaagccaataaaaacatgggtgcagagtgggctgaccagcaagctccttgacaccatcaagaagcttggttttgagaagccgatgcctatacaggcacaggcattaccaatcataatgagtgggcgtgattgtataggaattgcaaagactggatcgggcaagactctagcgtttgtcctgccaatgctcaggcatgtcaaagaccagccgcctgttgtgcctggagatggccctattgggctcattatggctcctaccagagagctcgtggtgcagatacattcagacattaagaagttcgcgaagtcgcttggcatcaactgtgtagctatctatggaggttcaggtgttgcccagcagatcagtgaactaaagaggggcgctgaaattgttgtttgtacaccgggcaggatgatcgatatcctttgcaccagcagtggaaagattactaaccttcggagagttacattcttggtgatggatgaagctgataggatgtttgatatgggctttgagcctcagattactcggatagttcagaatacccgcccagataggcagactgttcttttctcagccatttttccacggcaggtggagatactggcacgtaaggtgctgacaaagcctgttgagatccaggtgggtgggaggagtgtcgtcaacaaagatatcacacaactggttgaggtgcggccagaaaatgagaggttcttgaggctgttggagttgcttggagagtggtttgatagaggcaaaattcttgtttttgtccactcacaagataaatgtgattctctacttaaagacttgtttcagcgtggatatccatgcttatctttacatggtgggaaagatcagactgaccgtgaatcaactcttgctgatttcaagagcaacgtatgcaacttgctgattgctggttgtgaattagatgtgaagtagcttgagctggttgtgaattatgatgtccctaaccattatgaggactatgttcatcgtgttggacgaactggtcatgctggtaggaagggctttgctgtgacttttatttctgacgaagaggagcggtatgcaccagatcttgccaaggctctggagctttctgaacaggctgttccacaggaccttaaaggcctagctgatcgtttcatggcaaaagtgaagcaaggaacagaacaggcccatggaacagggtatggtggaagtggtttcaagttcaatgaagaagaggatgaagctcggagatctgcaaagaaggctcaggcaagggaatatggatatgaggaggataagtcagattcggattctgatgaggaaggaggggttcgtaaggcggggggtgaccttgcagcacaagctattgctgctgcccaagctgccgctactttggctgcagccaaggctgctagtaatgccaatcagcaagtacaaagcaccaatgcagggtccttactttctatacctgtcgtagccaatgctccaaataatgaggccacggcacgtgcacttcaggctgcattgaacattcagcaaaatttagcacggatacaggcacatgtagtcccagaacattatgaggttgaacttgacattaatgatttcccacaaaatgcacgctggaagatcactcacaaagagactttgggtcctattcaggattggactgaagctgcaatcactacaagggggacatttattcctcaaggaaaaattgttggtgcaaatgagcgcaagctgtacctgttcatagagggacccactgaattatctgtcaagaaggcgaaatcagaattgaaacgtgtccttgaggattgtgccaatcatgctctgaaccttcctggttctgcccaaactggaaagtactctgttatttgagctgcggattgctaacagaacagctaattcagagatgcagggttttcttgtgaaggtatgcgagaagagaaaaaactcatagtccatatatcaaatatttatctgcccttgtatgagcacagtaaacaaaatgttgcttatcagctcattacttcattttaccatggcaatagtagttctatacattgaaggttgcaactttaaaaatatatcataagtatatcggtgctctttagtgctaattatagatcacccggtttccttatttaccactgtatccgtctttcatactgacagcttgacctcttgcatagctatatgttatgcttgtactgttgatctataacaaattccttatagaatg

SEQ ID NO: 50114 - DNA, 1667 bp, Oryza sativa
ttcattatgtgataaaaacataattagctggcactgttgtttttcattcaagagattactcctacaggattcacattgtcgcacacaaacaaaaatcaacactgacaacttacaaaaatgtataattaagctattctgaccgtgcttacacatgccagcatttttttttcgggaatacgcaaggagcgcattttttccattaagagaaataaaagttatttacaaagataaaaggaaaacaagcaggggaccgatacaggacgctatggaaaactataggaatatctcgcgctaaatttggctaccacgacctcgtaaaggccaaacagcggggatcccgtgattagctgacttctaaagcatggcctcctccgccattgctttcaccacttcggtccaagacctttgttgttgattgaagattcggttgttccgttccttccaaattgtctaagccaccagtgtcacgacagtgtcgaagcctcgacgatgccgctccccaatcttcatttggctctcacagagccaattgtggaaggatggctcattgacaggtaagcagttcggcctccttatcgcctgaagcgtccaccaccataattgtctcgattcagggcatgctaccaagatgtgatcaatgctttcctcctactgatcgcaacgaacacaacgatccgggtgtggcaaccctcgactgcgcagacggtcagcagtccagcatctgttcattgcgaccaaccacaagaagaagcggcatcgaggcggagcgagtgacttccaaattggggtggaaaggaaggtgacacgaccaaaaaacaaggccttataggcagattttgagctgtattggcccgaactctcccatttccagatgattgaatcaggagtagtaggatcaagatccaccatttggacaagcgaccaaagctttagatattctagaataggttggatcccaagtgctcctcggatgtctttgatccattggcgacctgttagtgcctcagccaccgtccgacaccggcgcacgcgtggtggaattttatcatagatgttcggagcaaaggaccgaatgcaaccctcttgcaaccagctatcttcccagaagaggatagtttgtccgtctcttaattgacagatggtagaggctgcaacgaagttcctttccttttgcgaccccggaatggctagcccctgccaaggtttgcttgaggaggtccgttgcaaccatgtccacctggaacgaagagctatacccataagctccagattcggtacacccaaaccgccgtagttacacatgccagcatcgatcacctttgttggatttagagtttacacggacaaagataagatgatacataaaatatgatcagttctcctatagcttacagtttcatcatcattcaaacatctatccattagcctgctcattgtgcccaatggatcttcttggcctattcaaaatgaaagaaaggtaacgacattcacatattaagttttcaagttccaaccaagaaaggagataagagtgcaattaatcagttaaccttttggttatagaagtgttcctctttgtcacctttaaatatcttaagtttgcagatgaataaaaacctgtatgattctcaaggaaatctaatatatatgcaagaactaacacatgc

SEQ ID NO: 50115 - DNA, 1312 bp, Oryza sativa
tttttatcatcaataagcaaaatgcccgcgcatcagcgcgggcttccttcctaattatcctacataaccaatattttgaccggaccgggtatattgcataaatttactatagaaacaggggtttcctttaaaagaaaactgacaactagcgttttgggattttgaattacatgtgccccaaaacctagaattttgtggtaattactcttgtctattttttggcccaaatatttggttcatcacagtaagctcaactatttaacgatattgtcgctagcttgacccttaccttaaaagtacaattgaaaaggtcagtagggcaagcttgtgtcatggtcaaaattaagcagcatccagcaatataatcaacatggacagcatatattaccttatagatgtagctatatatatatatatatatatatatatatatatatatatatatatatatatatatatatagcttaatcttgcagtgtgagtgatgtgaagccccacttaacaaaatccttgcttgcagattagggaatcaatgcatcaggctattagctgttcttctacagtgctctgcagtaccacattggcccctgcacttgcaactatctgctgtcaataaacagtggtgatgtacattgcaaattatatatgcatgtgtttgtgtgtgtgtgtgtgtttttgcaattaaataattttgttaatttacataatgcatggagccatctggaaagaggacacacacatgcatacaaaagcattgcacagggatagcatgcaagcacacctgcaggaccattggatgacggccatgaggtggtgagatgaaatcaggaccatccgtttaattgattgatcaaataattgaacagttgattgattggcagtgccctagctatgctacaggggaggtccctgaccctgagttaaggtgtgtactcaaagcaaatgcaagtggcttaattataacacatgttttagttatgtaaacaagcagctggtctgatacatgcgtgatgtggagactggataaaattacaatatcaaaataaatgtaatcctttatatttatatagttcatccccactaattaagtgtagttaatgctatttctcttttctctcattaagccacatcactccaattatttttagcctttggacgatagatttatggttcaaattgtgtctcctctttcttctctcataacaccatgtaatttcaattatttaggtctcaaaattcataaatatcaatttgttttagttctaataatcatattgcatcttatttttacatattatacaacttaattttc

SEQ ID NO: 50116 - DNA, 2737 bp, Oryza sativa
  unsure (1)..(2737): unsure at all n locations
aaaataagcaaaaagggttgatttcagaacctctcttcttcagacagctactccaaacaagcaagaagtttatttagcaacagaagaaactaagaattgaaagcttgagtaactcacatcacaaatggtgagtaattttcttcaatcaatctctcatcgatcctatagtccagtgtagtataaaaacgttatttacacaaccataactaacataagcaataataattacacgctagtactctgtgacaatgacctattaacccacatatccatgaacattatattatattagctccccataccattgatattttcttttctttatagaagattgaaccactagccactgggcatgccaagttgccatcctgcagctttagtaaaatgtctgtatatttctcttctcttttttcgcgagtgatttttaattatatcagcgtatactaaggatatttcttttaattacatgaatatacgatatattatattatcaatttttgtggttgggctaattgcaaaacaagaacaatatgtagtatgaagcatttaaaagcaaataatattgatcatcctacaattattgaaatcaaaatataatgtgactacatgcacatgtttgccagctgcttttttccctaaaaatccatgcacatattgagcaacatgataacgtatagcttatctgtcacgtgtggaaaccacaaatttaaaacgattttctgaccacatgctgccattgcctaactttcagccttagcttgcagctgttcaagggcccttctcattataattatttgcctacataaccattagattggacaacaaaatcgctttgtttctacttcaaagatgatattattttacaattttattgttaaagaacaacctagttaaactaaaaccgttcttggcaatgatgcttcacccaactggtcagagatagaagttttgtcacatattggacaaatttgaagaggatggggcaaatccatccggggtaactaattgcgcaaacaacgatcaagaaaacaacgttttgtttccctcaacttttaatttaaaacaacattctagctgaccattaattaacattcaccatatgcaccagcaattttagctagccaaattctaaaaattagcagcatatatggttacatgcacatctctatttccatgtcttcataaatacttgtcaatactccttccataagtatagttttagttttagctagttaatggtataatccctccagcctaaattgaatataagacgcaaactaccattaatacacataaagaattattagcacattctagtttgaatcgctccaataaatgcaatgcatgcacctaatgagattataaatttaaaaaacgaattaaagaggagagggatttgctagttaacaacacatcacgtcttaaattatgaaacatcgaaaaaaaataatggtattaagcaagagattaaaatactactatgcccctcattaataaaacaagttaagggagaagacgaggtggaggagagattaggattaattcaatggctaaaaatgagaagaaaaaagatgaagtaatctctccatttcatattataaatcgtttgacttttttttctagtcaaaatttattaagattgatcaagtttatagaaaaatttagcaacatctaaaatgccaaattagttttattaaatctaacattgaatatatattgataatatgtttgttttgtgttaaaaacactactataatttcctataaacttggtcaaacttaaagaaatttttctaggaaaaacgccagacgacttataatatgaaacagaaagagtactactaaagagatctattggaccactccaaaactaaatttactgaggctaaactctaaactacacttatttgacaaagagagtatttgttaactgttcatcacttcattactagtatttcaggaacatgtactgaaccatacaactgaatcagttaccaagaaattaatcaatacagtactacaaaaccaacatggattcagagacacacattcggtatacattaattacctgaaatgactgtacttaattgctaattgctgttcagttagtggtgatgtatctacctgcaaaaattttctccatcccaattaattccccaaggagagtacatttagtctctctctctctcagagaccctgattggttcctgctgattagttatggatatctacatcatcgacctacgttcttggtactactgtcatcatgcaggaattatattgtcgtctgcaagttgagaggatgaaatttcagtactcaaatgcagcaaattcagtagtacgattttcgattgaatgcgatcagcgtcaccgcggagctaacgaatacagtgaaggccaaggaatcgatcgatcggtggatcaatcgagaggatgatcagagaggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50117 - DNA, 3029 bp, Oryza sativa
ttcctgcagcccgtatgttgtacctatgatcactcacatattctgttcttcatctatttgttttagaacttttattaagcatcggaagtaaacaaccagagataatatgtcatcattgacatatttaactccgaagtgccattatgatatgtaagtgtgcttggaataaaggcccgtaggcctagttgaatgtcctatacccaagtgacatgccatgacaacacgatggaggcggctgccacaaggccaggtgaaacagtgggaagctaatgacttgtttgtttctattaaaagagacgcaaccccatccttataaagatgggatgactcgacccctaagaaatcttatctaaaattaaggaaataggctaaaactcaacctaagttatctctaaaacaaaaaaaaaacaaaaaaaaaaacacccaaccgactacttcagtacttgtgggtactgttcatgtgcatttgcatgtgacgtggtaataccacctaaggtttaggttgtaatgcgttgtacgttgtgcatctaagatgcacatgtttgcatttgtatgatgttttcttctttgagcagggcatcaagtgtttatagcatacttctgctactactccgtgactcaaacaattacaagataaggatgcatgcagctgttgccttagcagttccagtctcacggcttggttggttccttgattgcttttgtttcccacctttggtcaactgttgtccttccacattctacaaataccacaccatatcacactgaagtaatagagctttgttctgttggagtattatctattgagtaaatttagattttattttcccatatcacatgcttttttttccattgttgtatgtgtagtctagacacatctactcattccaaaatttaatttgtgatgctgctcagttgctgcatagttcgtcgtggcgatatttatgtagtggctatgcactcgttctgtcatgatgctgctttatttctttctctaatctgcgaattgatttttctaatagaataaaatgtattccaatttcttatattttccctcttctgtatagattatggtagctcatttccagatgttgttcgaggaatcgagcatgttcttgagtcattgagttccaacagtttatcatcaccttcaaatttcaaacataaaggcaaccttgagaaacaggttagtgtttctgtagtgcttatatagacttttctttttgcatcaaagcagctttatttttgtaccagctcagagcatctatatttggcagcactgttgaagcttttgcccctttattttacaggttacatttactgctcttcatttgtttagttttgtttcaccaaaagatgatcaaagcctgagagattttcttatcaaggtaaggaactattttagcctatggaaatggcctatgtatttagtggttacttatatggtagttccgtagttggcatctgtaaaaatgttgtccaatgaaaaatattacgcccatcagtttgttattgtacgaaaatgtggatgcttagttggctatatcatatatagaacatcgaatttgcaagccctttgtggtcaaattttgagtttatttttcagtcctgcaaaagaaatcatatccctctttgctaattttatttcagtacttactaaatgtaaatggttattattctgcatttatatttggtttggtgattgttagttcacactattcagtggacttggggattattgtcagctaatgtttgttacgttctgtgattgtaccgtctatttttgcttggtaacattgcttgtactggtgcatgtatctgatgtagtccgtttggtgttaacataccaatgcactaagagaaaaatcctaaaccgtatgcagaaaatgaaaagaaattacttaaaatgctgcttggccctgggtgtgctggcaatcttctttttgattcttctgtctctatgtttaattgcttttctagctaatttgtgtgttattttgagcagaaagcatcctttctagaagactggctgaagtcattgttctcattgttcaataatgttgaggaccagcctttggcaaatgaggccataaatgacgaggatggtttcagcccaaacgtggcacaaaaagctatgttgtcttctgctgtgaagtccttgctcgacatatatacaagtgaaaatcagcacactgttgctcagagatttgagcaattggcaagaagcctagaattatagtgtgaatgacaaacaagatggtggtctcgatccccattaacaagcagcatgacagtggccgtcttcctcccggaaaagccaactcatcatctattcattttcaatctccttcataaagagaggcaacatgccctattgcaagtattccatgaactcaatgaagcttctgaatttcgatgataccagacgttggacattatgttcatgaacaagctcctggcagcttctaatgggaagggggggggggattcaaaactgcatctgcgtatcttatttatattgtaaaatagctttacctgttttttccaggtgtggccatgttctgcaccttatgtgtaaattttgagctttgtacaaagatttgcatgatcatatcattgtgagtgtaccatatatgtctcagcattttagtgaggaaatcttccacaaattttgtatgtacatttctggtagaccagatagcttcatgctacttaagatttgtcctgggcttgaatgcctggttagcttgattagaccactagcttgatgattgttcctcactatctattactcctatctgttagtactgaaaaactgatcagttgtcaatgtcttaatgcaacagaaaatgaatgccagccatttcagttggcgctgtcgtttgctttggtgtcacactctagaagtgttcatctaacaaccgccataaatggctgtgcactgttccattgctccaatgtttgaactcatggcattgctgagcagggatgatccaatcaagtgctacattcaactttttcccagcttt

SEQ ID NO: 50118 - DNA, 2885 bp, Oryza sativa
atgtgggaagagcactgtgatctttcctgttcaacggttctatgatcctatatcaggtatgcttctatgatatatctctatcaccgagcaaaaaatgggttgaagtgtatattctacagtctgtgtgctttttagagtacagaagagctagagtttactactttacatgacatgctttgcgtattaaattataatttctagagaaaaataaaaatggcatgttgtcactgcctacaggatccatttttttctaaaaatatgtgctgcatagagataaacttttagatcttgcttttgttaattagatgatgttataatgcaggtaatattcttatcgatggtcaaaatattaaggaacttgatctgaagtccctcaggagaagtataggttctgtctctcaagaaccatcactattttccggtacgatcatggataacttgagaattggcaaaatggatggaactgatgaagagataattgaaatagcaaaatcagctaatgtgcactcctttgtatccaaactcccaaaccaatactcaacggaggtaaagactccatgctcgtgaaaaatgagagttgtaaaaaccttacaaattgaatcaaactatgtcaaacgatgcatacatattcaaatagaaggacaaaattcaggctatgtttcaagttttggaccaatatactgcttttagttgttcccttggaaattcatctcgatggcagtaatgtgttatgttctttttagaggaatatgctgaatatgcccaaattaaatagacaagttttttgagtagttatatactgaacctacaaatagtaagcaactaagcatcagtacaaatccaagcatccccgcttatcttcaataaatgaaaaacttagtattaccaatgtattaaactatggcaatcacttcaggtaggagaaagaggtgtgcagttatcaggaggtcagaaacaaagaatagcaattgcaagggctatgctaaaagatccgccaattcttcttcttgatgaagccacaagtgcacttgattcagaatcagagaagttggttcaggaagctcttgatggagctatgaaaggaaggacagttattttgattgcccacagaatgtcaacaatcataaattcagacaagattgttgttgtggagaatggaaaagtagctcaatctggaactcatgaagaattgctggagaaaagtccattctactcgagtgtatgcagtatgcaaaatctagagaaggaatctggcaagagtgaagaaaggtaagcataattgattgcagtcttttcacaatgtagaatgttcatttatggaatccatcatggcattgtacatatgcaattacgaatgaaaagtattagaaccaatacattctagaagatgcataaatataaagcttaagatgtgttctgctctttgactagagaaacaatacctaaatcggttgctagaattaactgaatagaccagagtatattttactccttattatgatttgtgtggcatcctaattaattttggggaataaattttcagatttactgatcaggtcagagaagaacaagacaatggaagtggaacaagcaatgagccgtcttctactgcacatgaacaagagaagagtctagaactgaacccaaaccaaccgaagcaggatatcagaaacagagcatctgctttctacagaatgttccttggaacatttatgctggagccaggaaagattcttctgggctcaacagcagcagcaatctctgggtctcaaagccaatatttgctttctatatcatgaccgttgccatagcatactttgacccggatgcaaagagaatagttgccaagtactcgataattttgttccttattggattgctcacatttttcagtaacatcttccagcactatatatatggccttgtcggtgaaagggcaatgaataacctaagggaggccctcttttcaggtctgaaactcaagcatagcattttacatatcacgcaagtttgcatttagtagagaagtatatgatcggttgttctttatattgtgacaccatttctctttgtgttaaacacagtcattctgcagaacgaaatcggttggtttgaacaacccaagaacagtgtcggtttcctgacatcacgcgttcttggtgacacctccatgattaaaaccatcatatctgatcgaatgtcagtgattgtgcagtgtatctcttcaattttgatagctacaggattaagcataggagtgaactggaggatgggtctggttgcatgggctctgatgccatgtcagttcatcgctggcctcgtacaagtaaggtcagcaaaaggttttgccactgacacctctacatctcaccggaagctcatctcactcacttcagaggctgttagcaacattcgtacagtggcctcttttggtcaggaagaggaaatactaaagaaagcagatttgtcgctgcaagaaccaatgcagacaagcaggatagagagcataaagtatggggtggtacaaggggtttccctctgcttgtggcacatgacacatgccatcgcattgagttacaccattgtgctacttgacaagagcctagcaacatttgaaaactgtgtacgggcctatcaagcaattgcactgacaataacttccatcacagagttatggtctttgatccctatggttatatcggccatcgcaatattggatcctgcactcgacattctcgacagagaaacgcagatcgtgccagatgaaccaaaagtgcattgtgaagacagaattactggcaacattgagtttcaagatgtcagtttcagctacccatcaagacaagatgtgatcatattggatggattcagtctagctattgaac

SEQ ID NO: 50119 - DNA, 5926 bp, Oryza sativa
  unsure (1)..(5926): unsure at all n locations
attcctgcagccccagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagagcccaacatttcatttccccaaacaaaaataaatgaatgaataaattctaacagaatagcccaacatttctttcttatctaattttttttggtttagctagctcgaagccgaccaagatttataaattttatacagtaccagaattcacaataaaagaatggatctatcagcattaggaggcagtggcaaggcatccaatcgcacgattcatgaactgcaactgctactgcactaaaatgtggaggaagaagataacaatcatgaagaaacccctatcaaatccacgagagggtttggccctcacgaaacgtacagctaagctagaaatcgcatcaaaatcatacggctcgaacagaaacgacaaggattggggaatccatacccctccatataattgccaaaaaaaaaaactcagattaatcgactcacccgcattacccccgcttcggcctagcctccagccgctctcgtccccttcctcctccccctccactgcgcagaccgtggccgcagcgagctcgggcaaaggcggcggagtaatcgccggcggccgccgcggcggcggagaaccagacgaggtccgcgaccagagctgcgtctctcctcagccgtccgatcaaagccttcgctgtattttgcagaaagatccttatcaatatctctaccatttccaccaagtcctcaataagatcgatagttcgataccattgatcgcaatataaatttaggatcttctctactgttggatcagaatcggacggtttgtattaattgtacagtcgatataacacataaacatcggagtaaactttactttgagccttttttgtattaccgtagtgttattttggatctctttcatcaaaattttcactttggactcccttttgttgccattttgattcactttggaccccttttggcatcttcatctctagcatactcctcaccactacatcactgctatcttactggccgagtcttgagtttaaattctgattggtacgtaattaaataaaaactacagcccatttctattccacgttcgaggcttgaggggagcctcgcgtaatggagagtgttggaatataaagtgaattgcccacctctattccacgttagaggttagagagggcctctcgtgaggcggggagtgttggaatataaagtgaattgcccacccttctccatcagcttaaataggcttgagggggcctcatgcaaaggaggcgtgaaggagtgtgttgaaatataaagtgaattgttcgcatttattctaagctagatgtttgagggggtctcacgtgaggagggatgttggaatataaagtgaattgctcacatttctctatcagcttaatctttttggttgaattggtcgatgcatgcaactcgataatagccatgcaacattttccatataatatcttttattaaattattacaggagtagctatatttatggtatcatatttttcataaaaaatagtcaaatcgtttttacactataattatattcacttacacattacaatgtacttacatatttatatatttacattataattttcaaatcttgcatgtaaatcttaaaatttatactgtaatttttctcatctctaaatctaaaccataatcacaatgggccaaacgcatagtcgagtcacatctgcacgggcaaaacaagctagcactaatctcaagcagatcaaacaccatacaaatctgagtgcaatcgagaagaaaatgtgtcgacacaataataatattttagtacaagtttgcgaagagcctgagcacgccgtagcacgcggccatggcggcccacccgccgagaagcaccctggccgccgacctcgccgggctcgcgccgccgagcgccgcgccaagcgccccgaacccggcgagggcggccgaggtggcggcgcacacggcggcgacgcgcggggcccaggggcggacgaacccgccggccagcagcggcagcagcgcgcccaccgtgaacgccagcgccgacgccgccgccgccttgacgggctcggaagccggccgctcccctcctcctgccgtcgccgtcgcagcgtcggcggcgttgctctccctccctgcgccggnngccgccgccnccaccctcgaatgttcgtactgggcggcgtacacnnnggaccacgaactccccccgatcgcgccatcgctgccacggcgccggcgacgaaggcccggcgacgccggagaccagcatcgccctgcccgactcgctcaccgcgccgacgccgatcatcagcgacgccacggacaccagcccgtcgttggcgcccagaaccgccgcgcggagccactgcgcgcggccggagtagtccacgccgccgccgccaaacgcctcttcatccttcaccaccatcaccgcctcgtcgtcgccgacgccgacgacatggacggccgccacctcgccgtgttcttgcttaccttctggaggaggagacgtcgccggcgacggcgacggcgaggtggacacgtgcactaccgagttcatctgcatcgccatggcgagatcgatcgagcttggagctttggaagaagagggagagagagtgtgtgaagcacacgcctagaaatgggaagcaacgatgcccatttttatagccaaaaatggaaggataactgatgatcatctgataatgctttgtgacttgacaacttagtttatttgatggacaaattaaacatagctggaatatttaattaattagggatgtatatgtatgtaactgaatgtttggactctgaagaaaccttgttgcaactgattgagatgagatgtacacacatatacaactatttttttatgccaaagtgtccataaatcatgcatacatgtacatgtatctagctagaaaaaagcctttctttatgcactaatataagtttaattgtatatttatactccatatattatcttcagggatgttaacaaacggaagccctaaaatcctgcagagcatttggcagccaaactttttacccatttttcatgcaaaaaaaaaaaacgctcaacctagatataaagctcctgatgtagatatattgtttgtggaggttttggacacttgatgtgtttatcttggaagcaaattaagattgcttgctcttaaaaaaaaagttgctattttctttgttacatcatgcccaagtacattttatcaagtacaatcagttgatgatgatatattattagcttgctaatttggtcatttacagctgatcaaaacagtgatcacacatgttctcaaagctgtagctacatggccgcacgatccatgtaatctcaggagattcggaagtgaatcacagtggccacgcagcaccttagtcgtcatcatttccatttaagaaatcagctaaatagccatatgcagagggacaagccaataaatttagtttgtgtagaaaatttatttgctgattttgaccaaacattgtgcccggatcgatggggatcatggtgattaggtatttaagtgcacacatgcagttatctctcgattggctttttcaggagatcgagaagaatcacgccaacagttgcggaagattaattaactttagccttgcgatcttgtattgaaaattcttcatcaatctgtcccattctattttatttttaagagaggaacgaccaattaatatccgtctgataaatatatcctccatccattctaaaatataatcatttttagcctttaaaatttgtcccaaattaaatacaacaaattctccatcaacattcccttatcaaccaataacaaccctccatcattcaattttatcacctaccttcacttttcaaccaatcacaatcctccatcatttagttctacctattttcttaatataatactgcgtccaactctaaaactccttatatttcggatggaggtagtagataacaaagaatataggtactcaaaatattatactatctccattactaaatattcccttcgtattttaatgtatgacgccattgactttttgaccaatgtttgaccattcgttttatttaaaatttttgtgcaaatataaaaatatttatatcatacttaaagaacatttgatgatgtatcaagtcaccataaaataaataataattacataaattttttgaataagacgaatggtcaaacgttgaataaaaggtcaacgggatacggaggtagtacttgttattctcactttgtaagtccttttccgtgtggcagcgtccattgttggaaacctaactcagctcttggtggctttgatggctgcggcggtggcaaagatgtggacgaacgactgccacggtcatgtgagcaaaatcaaactggtacaatgatcatcaaacggttgattttagaatttctgtttcaattcatgatttgagttagacaagagcaacttgtatgtcgttgaagaaacaatggttatacagtcgaagaaacatgcaacttgttatctctatcgtgatcttgttataagaacttttcatactttaaatgaaattgtgattttgtaatccaccgtctttatcaagcaatttatgtaataattggatgtatccttttaaagcaaataatgaatattctattaaaaaagatacatattttaactttgatcactaatttttttttaaaaaaaataataaatacttaaaaagataccgtagtatgttacgtccttaatgtaagcactaatctttcatttattgtaatctaaatatctaaaaatattagtcatcaaagttaaaacattgatattcaatagtgataagagtttcccttaccatttgagggggttatccccctggcggtaaggcggttacccaaaaaccacgtgaaattcatccttaaatatttgaattcagaaatcagcggtttcgcggttttggcgcggttaccgccaattgtgtagcagaacagaaacagtcctaaaaaattgaaaataacacttaaatgtgtgtagaaattaaggataatttgaagaatatataggatacttgcgaacctaacttttggtgtaaaataccaaaattcgagatgaccttttctatattatggacttgaagcaattcaacatttcgtagcataataattcaacaagctcacatttgaaagtatgtgtcagaggtagcgcgatagagagagataagaggacccgggagatattttctccacttatgggccttaatgggtcggatattttgtccacctagggctcattatattatttctctttttttattttctaatgtactttccgttttgccctcaaatttgaatttatctcactcctttccaaaaaaaaaaaattctacaccatctgccacttcaaatcaagaaatatataaatggattttttttcaaaattttgaatttggacaaaattcatcaaatcctaccaccggtaatgcctactgtaccatgcggtaagcgcggttactagcggtagggaaacctgatagtgacatgtatttgagaatttaatggacggaatgattgatgtacgttaattttatgttgaattcctgattggtactttagttaattccagactagtatagtttaagccatatatttgacacgcgataaatttcttttattaaaggaaaaagtccattttataccctctaacttttgtgcttgtctaaaatacacccct

SEQ ID NO: 50120 - DNA, 4692 bp, Oryza sativa
cgattttagcttcatgtctatgagcacgatttgatcaacccaagctgaccaggttcctcttgacaaagttggcaactttagtcaaaaaaaaaagttgccaaggtaaaacaacaaaccaatgtgctgccaccattgctgccatcacggtgatccggtcgggatttctagtagagatgccgccggtgctcctccttggcaacgagacaggccatgccaaccctctgcctcactgcatcaatggagctctggtcgacggcatggccggtggcggcggtgacatagaacacaccggagattatgtcgcccttgattgacagtcgcacgccggtggaacaagcagatcgagaaagatgactggctaaggaacaaccagaacgagatggaaatagcggctggtgagcctcccgctgcgtcgtctacctaacgcgaagcccacccccaagccgagcttgaagaagatggcgttggcgccgagcccgcccctttgcccaaggagaagaggtgatcggcaatgagctcaacagagaccgctcccttcgccaagctcaggagaatacaggcggcggcgtgcttgctctccttggctaagctcagggaagcataccagagctctaagcctccgacgagttctcccggagggagaggaaggaagaagatgggccagtcctcctcctccccctcgaccacggtgtagagcctcgcccccgccgaagagagagacatctggctttggcctataaccgctgacgtagatcatttatacacctagcatatacgtgtaccaaaaccaccataaaaacaactcaaggggttaaagtgtctggttttaatagttagaggggtattatatccgattttgtaattcgggaggtattttagacaaacacaaaatttggagggtgtaaaatagacttttccctttattaaatttcgcgtaaattgagttgattcgatttcaaataatttttttctaaaaaaatgatctacgtggcattctaaaaataccccgtgtatatatatatatatatatatatatatatatatatatatatatatatatatatatatatatatatatatatataatacattataaaaataatagatatatatgtttacataatataaaaatggtatgaagataatgatttgagattgtttgtatattgagttctaaaaatacaataaaattgtaaaatgatatattatgcttgtatgatatttaaaatactgtagataataattactagtaggtgttgatgtgcacacttacacgttgagctttagaagttagtacacatcaactatctatatctatatagatagaatgaattgtgtaaattttaattaaaccttaggtatcatgactatcatatggctctttcatttaacgatggttcatttcgataccgatcagtatcgtctgtatgggcccatatatcaatggcccgaacagcatcagctaaccatacgcccgatgacacgagtcatttggatacaatatacataggccaggttagccaaaagtaagaataaggaaagagacatgtataattatagaggaaatttacttcttagagcaaataattagtagtatcccgcaaaaaaaaaaggcagaatcgaaaaaatgggggaaaaaaagaaaagcaagtaaaatcaattaaaagtcacgcccagtgggactcgaacccacaatcgcctgattagaagtcagacgccttatccattaggccatgggcgcttctctgcgtgaaagtttctcactcttttgttattaagttatgtaattctacaatgccattgctcccctctataccatgggagtttggtggtgtttgaatcttgtgaagataaatattaagtgtttcacgtaaattaatgaggtgataataacgtgtgattaattaagttttaattattacaaacttgaaaaatggattaatctgatattttaaaacaactttcatatagaaagtttcgcacaaaacgcaccgtttagcagtttgaaaagcgtgccactttaatccaaaatttcatccatccttttatttggattcgaacggggcctttgttcgatccgctcctaaattttgcctcatcccttatatacccctaagtttttattttgatctcctctgtgctattccattagttgaccatgagttaccgttaaaatatttttaaaattgactatattacctctctctatacttatgtgagtagtttagtgccaaaaacacaattcttatatgaaaaaagatctatttgtaaagaaaagggaatataattatttgacaacaaaatttaatataaatctaaaatttttaaataaatgttaaattaacttttacaaaattcatcaaaatttgaacccgataaataaataattttggttcatgatttctagcaaaactcttatatggattttgtcaaaaaataaatttgttcaacaatttaaattttctttttcaaattttacaataaataattatgccccatttgattttatcatgaattacaatttttcacattgtgaattatgaagtagatagcacgtaagtatgagaaatggatgatatggtaattttagaaaaatctaacagtcaacttacggtcaactaacggaataaggatagaggagattaaaatgaaaactcaagggcatgtagtggatgaggcaaaatttagaggtatagaaaagattgcgaaactttcaagtgtatgtagggaattttctcttgctcttaggtccttgaaaaatgaaaacgtgcttatagtttatctgttaattgccattgctctttgtatgatgggtaaagaacatacaaatttaagatgtgatgatataactcaaaagtatggcatatcaaaataaaataatcaatagtgtgattttataaaactttatggttataatatctagatttatgtgccacgtgtcaaaattccagtggttttgtacaacttaaaccgtaatatgtgtggttcggtgaaatttactctatagttagtttttgacacaatccatttacaaaataagttttacaaaagggccaaagtaacaaaatttcagcatattcatattcacaaccgcctatacatctgaaaagagggacgctccgtactatactagaaataatctaaaccgtttattttaaaaggtagactagtaatgtactaatgtaggagtactaatatagactaggggtaattttggcaccggatgttttgtccgtcaatgggctgtacggactctgggcctgtgcagactcgtgtggaccaactaatgacgtgggcccacgtgtgtatgtgattataaaagaacgtactccgtacgtccgatcagaaaagaacgtgttgaataaaaaaaaacgtgtcaggttatgctacgctacagcgtcaagaaaactggattaaagtttttaaacacaacaaatttcggtttcaattttagaccaaatttatcatgatttcatctggtctagatcgggttgacaacggaaaaaaggaaaaatatttacgttgcaattcattcggttagtccagagcccattaacaacaaaaacacatggtttttcatagtgcacacatagattagagcagtactagtattttagggtaaaatatgctacgtccaaaattcattcgggactattcagaccaggtcgataacaaaagcacgtggttttttttgtcgtgaacacataaattagagaactactattttatgacaaaatatgtggggctcaagaaacacccaatggtcttccggtgagctccgcaagatagtgggctaggcctgacttcgaagcctcacccattctatttatttaatattataccctttcttaatatttgtgtttttaatatgtgaagctcagtcaaaatcgttttaaccgaatttcaaccggaactgtctaaatcataaaaaaaaaatctgttacagtttttgaaataattaacatttaaaatcgttttaaattttcgatggaatttattcgaatttcaaccggaattgtcctgaccgggtctaaatcataaacaactatgttcaagtttttgaaataattaacattcaaaattgttttaaattttagatggaatttatccaaatttcaaccgggactgtccggaccttaatcataaacaactcggtcaaagtttttgaaataattaacactcaaaatctttttactttttggacggaatttatccaaatttcagacaggactatccggactgggtctaaatcataaacaactcgattaaagttttcgaaataattaccattcaaaatcgttttaatttttagacagaatttatccgcatttcaaattggattgtccggactaggtcttaatcataaacaacttggttaaaattttcaaaataattaacattcaaaatcggtttaatttttagacagaatctattcaaattttaaacaggactgttcggactaggtctaaatcataaacatcacgattaaagtttttgaaataattaacattcagaatcattttaattcgagtaaatttcacattgcaccatgtattttgaccaaagtttcacaatgggtaaggtccacaccaaccttttcacttaacaccatatacgtttgcactagttggcactttgaattgggattgagcacatcaaaagaagttgtcagagaaaagatagttaaaatca

SEQ ID NO: 50121 - DNA, 5638 bp, Oryza sativa
cacccctagtctaaactgaaaacttttataattatccatgtgtaaatcatattttagacatgaaactctctcacatattctcttgtgttgatcacccctagtctaagctgaaaacttatgtaaagatgtacggtgttaaggaaaacattgatttaaccctagtccattataaaccttggtcaaaatatgtggcccattgtaaaatttactcctttaattcctagacggaatttatctgaaattcaaatgggactgtccgccttaatcataaacaactcggttaaagtttttgaaataatttaacatccaaaatcgtttttatttttagatgaaatttatccaaatttcaaacgagactgtccggaccgggtctaaatccaaatttcaatcaaaacactccaatccaactatgacagacataaggcaacggaagaataaaccagtatgttttttttttacaggtacttcacaattgcaattacaagtagtatacattcagccacaaaagctatgatatacacagatcgacactttcagaaccacaaacttctcttttccaatattttgcgacgccgtaaccttgttagcatgacgggtttctgctgcaccagagataatataagatgctgatttataggtgaacaaagcgagaacatataacagtgaatattcagaaatcactggaatatgcatgtagagtttttctttgtcttgccactcttctatatattctctgtccgagaagaatgtgcctcactctaccttgttctgcataagttatgacatatgatcacacattgtgctgaaaatatcatcacaagctgaaaaagtttttctttgtattgcctcaccctgccttgttctgcagaaattatgacatactaatcacacattgtgctcaaaatatcatcacaaattgataaaaacaactgacaatgaaagacatttggcgtgaacaaacaaacagaagggcccaataaataatcactctgtctgtaaatgagagaagaacaaccaaagaaacacagtacagggttgcgacatagttaccttaagacggcggcatattcagaaatcactgtaatagacatctagagcatatattgtctgtcccgagaagaatgtccctcacgctaccttgttctgcagaaattatgacatatcactcacaccttatactgaaaatatcaacagtggataaaaacaactgacaattcaaaaacacacatctccgttaacaaaagtatttgttcattaagcagaactcaaataaggcatcgctggtacactgcacactagcatggcatgcaagagaactgaactaattgcaaaatcaagagatagcacataagatcaaaataccggagagaagataaattctccatggcaatgggctttttgcctgctgctcagcggcagaggtgctgctttagtgccggccacagagggttgatgctgctatggggtcgggggacggcggctgccagcctaagcccctgagcccaatggcggaggggctgcgacacggcccggtaaaggcagtgctgcacctgccggcagaggaggcgctgcgcaatgcggaggcgagcggcggcggcggcagcgggagaggcgtccgaggctgcgagggtggtggaggcggcaagtgcgaagaggaagggggacgggtggtggaggtggcgatggagtggcacgagcggcagagacgtgggaagcgattggggccggcggcaaaatacgatcatacccctccgcacattattttctatggacaataatacccctccacatttctactaccatcaagtgtggtggtagtagaagtaaatctcaaccctttgatcaaatatgatccacggttcagattaatttctactgcaagtagagagcaccggagtggagctcatctgaaaaaggaaacgtgaaaccattatcgtacatttaattttcacccctacccaatgccatcaacgctagctcgaatctctggactttgatctgcatgaacatgcaggagaatgagactaaggaggggaggtagcagtactttgtgtctcagttggcgacctgacatctcaattttgtttcctgtgactgatagtctggcattgtaagattaactggattattgtttttatctgctggtcgcacattgctatggcgagaggatggttctatggttgcttttgcaaaaaaaaattaactggtaatggcacttgcagaattttcttttaaatgaagtgagtacttagtattcttttttttccccttgaaatggcaacggaaataaaaaggactaatgagtccttttgcttatttgtcagtgaagaagacccttatttgccacttatgtttcatgttaagttgttgacattgtaggtttacaatgaatttatttttttttaactattaatagaactgaaccaataatttttacagaaacgtgcattgcacgtgcatgattactagtcttcttaatgagagaatagagtgactagatcactgaattatactagttcactaccacgcagcaaaatactactataaagaaaataaataaagagagagagagagagagagagagagagagagatattaaccttacagtattccccaggctcctgaatattgtggagttgatgctgatgatctctacattgcgggaaatgctttttttgacatggaaaatgtagagaatctctaccttatgacctttgcagatgatgctgattgctggccttcaccaatctgagttaatcagatatttacagatatataatcacatatttgacagggataataaggctaaacttattcagttccagcatgaatgcatgatgtgcatcattcctaatctcatgtagctaacattagttgtgctgcatggcttactatttgtaggaattttttccattttctttagtcttcaagagttagaaaacatgacagtgatgttaccattttacataaggcattcaaacttacctcactgttattcctttccatgaccatcttgaaaagatgctctcaccatatgaaacagaaaaggactcagaattgacactttctctatatcttgcagttcatcattggacattggtcggtcctgttttatccaatttgttaaagccaaaaaaaaacacataggacaggtaaacaaaattctactatgaataggcaggaatttaacacaggccagcaaagtcaagaacttcagtttactgatcacagctgaattaaatgtgatatgtgaccaggaactcaggcctaaaactcaaggttgacaaaaagtcatttactattctagaaaatcacaactctattaaaatatgtgaccaggaactcaggcctaaaactcaaggttgaccaaaagtcatttactattctagaaaatcacaactctaggaatacaatattgcagctactcagtgttgggaattggctcatacaattccccaaatcgctagtacctacatgtgataagtaaaatgcacttcatcaatccttccatacagtcttgatatgtattcatgcaccgatatgtactcgagggaatgtgtatattacttgtcacctagtctggaaagcataaaaacctgtcaaaagtaacatcaggaataaatcgcattggtaaattgctcacatgttgactgttgagtgcttcctgtatacagtgatcaacatttttccttgttacaggactaaatagtgctgaatccccataaaaaaatgccagtatatatctgttgtcatcgacattcttcaccagtaatcaccacatgagcaatgccctcctctaaaatggtggaatcgtgtagtatccctcaaaatgatttctcgatcctcgatcttggagatgaccttggctgcattatgacagtctccacaaaccctgagattcttgaaaatcctcaaggtcatcccaggagcagtactaatcagaccaaaagaaatagcaagcttctcactgtgcctcattagcatctgcaccttcagagtttcatccacatcatgcaggacaaaatcaagatctggaacataacccattgccttcatcctctccgctaactggcccagtttttcatggatcaagtaaagctgagggtgcaatctgtcatttgatctaaactcatgcatcacacccttaatctctatccagctatacccaggtgttttcacaactgcattatccttcatccacctccttactctagagacatcatcccactgatttgcgccagcatagatatttgcaagttgtacataggcacctgcgctctgtggatccttttcaatcagttttccagccgcaagctcagcaaactccaagttcttataaactctacaagcagccaataaggttccatatgcagaaggatgtggttcaaagggcattgagcggatcaagtccacagctctttcaagcttaccagctctgcagagaagatccaccatgcatgagtaatgatcaacccgaggctcaattccgtacaattcctgcattccctcgaaacaccgtattccaaaatcacacaagccagtgtggatacaagcagtcaatactgccacaaaagtaatccagttgggctcaactccttcatccttcatcctttcaaataaattgatagcttccttcccatctccatgctgagcatagccagatatcatagcattccacgcaaccacatccctcgtatgcatttcaccaaacagtttgcacgcgctactcaagtccccacacttgcaatacatgctcacaagtgacgtgcccaccgtcaagttcctactcaacggaagcttcatacaccactgatgtatctgcttaccaaatccaagtgcagacaagttactgcaaccaagaagcacgctgcttaacgtcgatgcatttggctgaacattggcctccctgaccatggtcctgaacagcctcaaagcatcatccgcatgtgaattcttcacatacccagcaaccacagcattccatgaaaccaagttcctcactggcattgcctcaaagtattcgatggccttcaccacattgccgatatccatgtaccccgacaccatcgcagtccacagaacggcgtcccccttctccggcgcattcctaaaccactcctccgccgcgctcatgtctctagagcaggcgaacccggaaaccatggcgttccaggaaacggagttcctcactggcattgctaggaacacggccttggcctcctccacggccccactcttggacagccccgacaccatggtgttccaggacacgacgtccctgaccggcatcgatgcgaagagcctccgggcgccatcggcgtcgccgctggcgaagtggcacgagaggagcgtgttgtaggagacagcatccggggtcggtattcggtcgaacaggtggcgtgcgtccgcgaggcggccgagcgccctggcgtagccggcaaggaggcagttgtaggtggccgtggtcttccgtggcgtggatgcgaacgcctcctccgcgccggtgaggtcaccgcgccgcacggccgccgcgacggccacggtggagagtgagcaggtgtgggaccgggcactggccaggaatgggcagcgacataggatcatgcgtacctaaaggctgacgacattgcttgcagcg

SEQ ID NO: 50122 - DNA, 12941 bp, Oryza sativa
  unsure (1)..(12941): unsure at all n locations
gggggggggggggctcgttctcagctccagtcaccggcggcgagaggccaaacggtggcccggcgtgtcgtgtgcgggcctagggaagaggaattctggaagcgcttggcccagaaagacacattgcgctctctctttctctccggtcacctgagctgtaaatagcacatgagcaaacatttagatatcaatgcaccagcgatttattatgagccatgaagcgtataaattattaaaaacaacactgattttgatatatcagtacaaattattaaaaacagcagttaatttgatatgccagtacaaattattaaaaacggtaaattataatttgagaagacagcagcgatttatataaatatctgtcaggagcatcacatatgagtgcatcgatccctcagggagacatccaacggaggacaagagagacaaaatggatacctggacaaagggagaagacggtggtggtggtggcgagaggagctgttggggtcgctggctgcaccggaatgattctgaaaaaaaaggaccacttcatgagaaatttgacaattggttgcttagacaagttacctaccgattattcttacctagttattgaatcaactaaccaaacctagttattgaatcaactaaccaaagcaagtgacacaaaatatccttatatacagcaaaagaatctaattcacctatgcacttatttgcttcaacattaatggtaaaaccgatccatccatccctcaacagaatttaaccgaacacctaatgggcactggatccatatccatccctcaacggcatttaacataactctcctcattggcatttaagcgaacacctaccgggcacaatacaatacgtgcatagggaagtagcaatcattggttgaccatccaagaagtcacaatcaaaggagtaaacgaattcttgcaattattgaaggaacgggaaggggattgagcgatgcttacctggctagcggagtgggggcgaggaggcgcgatgggtatcggagggcgagtaatcgatgacgacttgatggcggcgtgacggagaccgccgggattggggaggaggagagatggctggggggcgcagtggaagccggcggcggtgcgacggttcgatcactgcaacgacaaacccgcattgggcgatcggtgactcgcaagatgggaggagctgccgggattggggagaggggggatggtcggggggcgtggtggaagccggcggcggcgcgatggaggattcgtcgggattggggacggggagggagcacgggtcgggtgaggtggcggcgtcgacgggtgatggcgcggtcggcctcggcgagcgccgcgcggggggctccgcttcttggtccctgcggcggcgcgcgcacgggcgaggagctgggcgccctgcgcgaagtggtggcgagactgcgcggcggcggcggcggcggcggaggaggaggaggaaccggcggaggcggtgggccgcggcgaggatgaagaggaggacagtgacggggttctcattggcggcgtgattggggatttgggggacgcgcgtgaggagctcgtgcggaggggagagggtccgcgacgatctcgacccgttggattcgatgattctggaccgtgggatttgatgaatgaattatggggggagataaatgttcagagctgattgtttgaggtttgaatttccatttttagtttattaacgtaattgacttataattatgcaagcatgcaaatctctatctctactattataaaaattgaagatgtttttgtcggtatttagtaagtcatctgtgcatgagtcggtttttaagttcattcgtttttttggaaatatagaaagattcgtataagaattctctttagaaaaactcgcgtgctaacttaagacgatcgaacttttaattacagctcatgattttctaaaatatatatattcaagtgaattcccacagtgaattttatcttaactagattgtataacagcaataaaataccttaattggaccgtatataacaacaataaaattaaaatagccttcacccattgtaacgcacgggtattttttctagtgtctataaaaatttaaaatataataccaggctactagctaaagcaatagcacatgacggcactgactttatcagttgtcacatatatagtagggaactattgacgtaaaacacgaggcctaggagatctgcttaactccagtgcaggtccaaaactcgccttcgggtatgctagcgtgccagttgatttgatcctgcaatcaacaagaaataaagacaaacaaaccgcggttaaacctataaacgatagccgatcggctaagtgccgatgacgtatcatttatctctgagccgatgtcatatgtaaatcgatcggcagttgcaaatagataataaagaaataaatctattcgatcggctgtagatattaacaatatataattcttatatcgatatatacttaaatcaagtgactggaatagatcggtcgccatgccgagacagtataaatcacttagatcgaaatatatattaataacaggattatatatgttcatagcatagccgatcagatagatctagcatgtatcggctaatactccgatacgactctatgttaagatgttaaaacaagcagaatatactaaacagaagcttaatatacttagatgcaacaatatcttgacataaagggcagatctaacgtgtcaataaagcatataaaacaaatatagttgaatcagataagatcggttgaaacttcgatactactctaatcggcaaccagaaagcaggctagagattggtattctaagcacgacttaatagatcaaactcaattgatgcagcattaagtatgaaaagaacaatatgtagacaatcaagccgctgaaggtttcatagagtggtagatatcttatataatctaagtcaacgttgacatataacctaatcggctactctataccaacagatgttagccgattgtaggttagataacgatattgccagagattatgtaagatatatgataactcgacgaattacataaacaagattagagtatcataaagatggaagtactaatcccgagaacgcaagccatcataacaagttttacctcttgttgaagatcgaaaccgatgcagctcaacccgaaagtaagaactcgtcgaaataaaataaaagcaaaagggtggcgatgcgccgaaattgtattgaacgtgtgtgttcattgattacatggggttcggggtctatttatacccgaaaattacaaactatgtccatgtcggatacgactcttatccctaacaaactctaagataccataagtctttacggcagacttttgcccgaaacatatctctaaggagattatataaaatatcctaattaatagatacaattgccttctcaggactctatccatgtgcggcaatcatcttgaagcatatcaactcaacccgatgttgtataccaagtcatattgtcagaatcggctatatcggctcacccagtctgacttggacccagccgatcctgatcgtagccgatccggactccagccgattcttgctctgttctcgaatcgatctccgccttcgactccacttcgatctaatcctcttttccgatgatgatattaccaaatttggtcgttaacaggaacaagatcgaataaggtccaatgtactaaaaatctgagatcacttctaggatgtgattataggggaaacatatatactatcctaaacttcacctccaaattacaattttctcatttttttttgttagcacgctttccaaatagctaaacggtatatttttatgtaaaaaaaattctatatataagttttttttaagaaaaaataaataaaaatttaaatttataataattaatacttaattaatcatgtattaatgaaccatcccgttttatgtgctgttaatatgctattccaatatatattttcaaagaactagcaacaccattcacaagcatacagcacacaaaaacagagcacaaatcatgcattagtgccttagtttattttaagaggcatgactttttactaggcactaagcatactgtgggtatgcgggttaacctttagcaagtctagttcaactgtacactaaagttgttctcacataccgctatgttgtctgctgaggattaagatccttcgacttaagttatataactttaactttgagccactaacatataagtactctttgttatggacccacatgtcaatgacattaaagtcatctgacctaagatagaagatctcgatccgtctactgagtcgtcgccctaccggcgccaagacggccgtcctttatttagcatttggcggggacgcagccgtcatcgtcgtcgtcgaggtcgtcttcctcgtcgtcggccttgtcccactcggtgtagacgtcgaagaagtagagcgcgcagaccatggcgaggcaggcagcgaacatggggatgggtccaaagagccagaggaagacggggcacgagaagtagaaggcgcggacgccgagggaccagaagtagctgccgcggttgagcgtcgccgtcacgtagtcgacggcgagccccgggcggcggcggcggtggcggtgcgcgtggagcggcacgttgacgaggaggccggtgtggctgtagtaccggatggactgcacgttgaggaggaaggcgaggaggaagcagacgaggatggcgaagaacttgacggacagctcggcctctccggcgacgccgccgccgacgacggcgtggccggaggagacgaagatgccgtgggcgacgccgctggccatgagcgcggcgacgagggagctgagggtgatggcgacggaggcgagtacggtggaggccatgatgctgttgcgcatggtctgcaccgccagcacggcgtgcttccccgacggctcctccatgacgtggcgcacccagatgcggcggttgatggcgttgatgccgatcacggtggtcgccgggcgccgccggatgcggaggaggagccacgcgtggtacgccaccatcaccgccatccccatcggcaccagcacgtagtccagctgcttcatggatcgatctcttctgatctcactgccactctctactgctactgctagtcgccgtcgttgacgacacaagcatgcacaacggtagtggccggacaacgttggactgggtagtatttatatgcagggggagctgatcgccagattgaattttcggtaatttgggactcactggcagggtttaatttttcggtttttaaataaatattggtcaaatttaaacaaaatattaccaacttcacgaaaaagtaaaaaagataaaaattttggctaaaataatatcgtataaggagtccgaaatgactgaaattccggaaattccattccggaatttctaaccctgcccaccagcgagcaactctgtcaatatttggggttttttttttcaatttttttgttaaatttggttaaaatatattcaaatccagagttacaatctgttaatatttcaaataatttcgtgcaaaagagtttggaaatcatgaaatttcggtcacaccgaaactaccgaaatttcggtgtgattctaaagtgtgaaccctggctaagcgtgtacgtggtcgtaaaacatgtctagatacatggtgacagaactcgatcgaccatcatatgtatcgtgcttaattaaattaattctttcgatcaagtgcttcccacgtttgaaaactcaaagtaccttgtacgttggtgctggccacatgcgcaggggtttgtgctggctagctagcccgctgtttaattagatttataaacgcgaatgttgttgctgtcgtcattacacacgttattctccaatttgagttaagttgggaagtactccctttgtcacaattttatttaagtgcagttctggattttcgtatccaacgtttgaccgttcgttttatttaataaaaacataaagaaaattaaaaaaataagtcacacataaagtgtactatttatgttttattatctaataataacaaaaatgttaatcataaataaatttcaaatataacggatatattggacacggaaactcacaagtgtacttaaaatgagacaaatggagtagttaagtattcgagaatccaattgcatgcgtgtagattcatcatcttacatatgccatttgaacggtcatgcaaaattctgaaaagtggaaagttccacaatgcagattgtaatgttatctgtcactccataggcatgcaaattaagtgggtggcaatggcagctgagatatggtactcgctagctagctaaccaatatatagagtagttctaaaaaaacaatatatagagtacacatacagagacatgccaaggtagcggttgtgagatcgatgtgctgtaataaactgtacatctctattatggtgtcatcttttttcatatgcttatacttatcggctaaaatttgaattatcaatcttaaatttgaagttgattttaaagttttttttattatagtttatttttcagcttttaattttagatcattaaaaacatgtactccctctgtattagtaaagaaagtcgtttagaataatgtttaagtcaaaccttagaaatataaatcatgaattgatgagcttaaaaatataaaaattatatgaatagatttgtcttgaaaaatactttcataaaagtatatatatatatatatatatatatatatatatatatatatatatatatatcacttttcaataaatattttttatagaaacaagaagtcaaagttatgttttggagaccgtgccgctgtccaaaacgacttcctttacgagtacggagggagtatatcaaagttttattcataaattatttttcgtttatgaatatgccgtctggcttatttctcgaattggatgatgaattgatggtgctgtggttcttgcaagatctaatcgatggtttgtttgggtatcgtgctagtgcttgagttgcttttctgatcatattcaatacatatccagatatcctagctaactaatataactaaagatgattgaaattattacaacgccgaatgaatgaagtttttaaatgtcatactgatgatctctgctgatattattttcgcaaaaggagcactctaaacggccgcgccctgtgaacaaaccagagcgatgcaagtttgctctcgctttaattctctatctctgatgagatgttcttttggtatcatcacttgtttggttcgtgatccttggtcaaaagattaattggctatttcagatcgactgttagacgccatgtgggtagcgtctaccacactctgcatctaccgaaagattctaaaaggatgggtagaaagggattcaggtacgtatatgcatgctatatttcggaatagagtaattagttgcccacgtatacaaattagttctgccacttcaatttatttatataacttaaaaaattaaggtattataatgtatcagttagcactccagtaattttgtaccatgttaacttgccaatcgatgtagatcaccttaaatttttttccccaccgtacatgtgttgttcataaggaaacacggcaatttattgacatgttttgtgttttgtcgatggagttcggtactcacacacaaacttgtgagtgtaatacactttgcaagtcatgttgcacaatggcagctgcagaggtccacaaatgatgtacatcacgcaacgctggaagcctggaactgaacaggtttatcctaatttttgcgcattttgaattcaataactatgcgtctatttggtagagctccaattaactctaaaatttaactccaagagttgagtttggagtggagttacagctccacctctctagttcattttgtgatagcactccaccagtccacccagctccgctctcattttaggtgaagctgaaactgtttggctagaagctggagctagagcagctatgccaaacaggtctatataattgactcgataatctagatgtaaattaaatttctgaagaattcacattactgcaggctagcattcagcatcatttgcagagtacagaaggtgagaagggtatcattaatgtcatacgagattcaggaggctggagaatagttttcaaaaaaataaaaaaagatgccggaggatacatcatccagaaaaacaaaaggtattattttctctcccttcatttctttaagagtagtactactatataattgctgcatggtagtgaggtgtgtttagtcattttgtcgtctcattaagaatatactccctccgtttctaaatatttgacgccgttgactttttaaaatatgtttaactgtacatcttattaaaaaaattaagtaattattaatttttttcctatcatttgattcattgttaaatatacttatatgtatacatgtagttttgcatgtttcataaaagttttttaataagacgaacggtcaaacatgtacttaaaaaattaacggggttaaatatttagaaacggatgaagtacttatctatagagctttctgaagtctgaacttgatggtctgaggtttgcagttccctttcagtttgttttctgagaaaataacaacatgcatgtgtatattctcctattatcttatatacgacataacgtaattgacttttcacaagatataatactaccagctataaaaacagtattcatgaagtcactgacttgtgtcgtagaaacatgatcgaagaaggtcctaactggtactaagaagtaattaaaaatctgagaccatttgtagaaccaaattactccctcagactcgataatacttataattttgggaaaaacacaataaagacaattgaccactattttttgttacaatatatatagaaatattaataaatatatgattttattgaaatactttttaagacacatatagttttctataatgttatttatagtcaaagtttttagagtctgattatatctttgtccaaagcaataagtattatcatcatgaaagaagtagggcattcatacttaacatcaattcaaagcattttttatgcgaatttgtcgcgacaaatctaggattcaacgagatattgaatcctaggcacggcgattttatttataccaaagtacataaactaattattaatcttgattcaacgagctgctgaatccagatcacctgcatgcaggcacaggcaacaaacaccttcagagtttcagttttcagacgacgtcttgctgaggcgtcaccctgttgccggcggccatcttgggttgttcatggcacgcggcggcgccgccgtcgtcgccatcgccattgccgttgagctcctcttcctcctccggcttctcgtcccactcggtgtacacgtcgaggaagtagagcgcgcagaccatggcgaggcaggaggcgaacatggggatggggccgaagagccagaagaagacggggcacgagaagtagaaggcgcggacgccgagggaccagaagtagctgccgcggttgagcgtcgccgtcacgtagtcgacggcgagccccggtcgccggcggcggtgacggtgcgcgtggaacggcacgttgacgaggatgccggtgtggctgtagtagcggatggactggacgttgaggaggaaggcgacgaggaagcagacgaggatggcgaagaacttgatcgacagcgccgtctcgccgccggcgccgacgacgatctcgccctggccgtcgccggcgccgggggagaagatgccgtgggcgacgccgctggccatgagcgcggcgacgagggagctgagggtgatggcgacggaggcgaggacggtggaggccatgatgctgttgcgcatggtctgcaccgccagcacggcgtgcttcccggacgcctcctccatgacgtggcgcacccatatgcggcggttgatggcgttgatgccgatcacggtggtcgccgggcgccgccggatgcggaggaggagccacgcgtggtacgccaccatcaccgccatccccatcggcaccagcacgtagtccagctccttggatgtcttcttcatcatcacggcggcggcggctggtgctcgtctgaactgaaatcttgggttcgccggcggccggcggcgagggagacgacgaggagaagtagtggactgtgtggagtatttatgatgggagaagagacgtgtactatatggtgacaaattcgacccgtttaattgtctcgcgcgcttcgagtgctctcgatccacctttcacctttgtctcttcttttactgtgtacttctactttattatctgatcctctctccgttccaaaatataaggcacaaccactttaactaaaatactaaaaaataattattatcatcttatagtttggatcatcataataaatataataattggaagtggatgattttaaaaataataatttaatgcagaagatgtcatggttaattgcatacttgcatgcatgccttatattataaaacatctaagaaaaatggttgtgccttatattatggaatggagggagtatttttcaatccatttgacctttgtcttttatttataaataataatatattttttactgtgctataccaaagcatttttaggttttgaccgcactgcacaacgttctaaaacaaataaatatacaggtgcaaatggaatcactcaaagtccagatacaccattaaatttggtccgtgatcctaggccgaggattcaccatctacgtcgatgctggccacgtgttgtagctaacaaaagagtggactttgctactacctccatattttaatgtacgaagtcgttgacttttttccaacgtttgatcattcgttttattcaaaaaatttatgtaattattatttattttaatgtgacttgattcatcatcaaatattctttaagcatgacataagtatttttatatttactaaaaaaaattgaataaaacgaatggtcaaacgtaggtcgaaagtcaacagcgtcatacattaaaatacggagggagtactatgtagatagccacaacaatgaactatagtagtgcctctctgcattcgcgcatgcacgcaacattgcaagtcttcatcatccatgattttcttttcccctttgaaaaaacagagaaaatatgcgttttctgcgtccatgtcgtcgtcattgcacacgttataaacctcagaagttgatccatgatgggaaaatgtccaactcatggcacattctattcgcatgcacatcatgtgagctggaaggtgcaaccgctagtatgagaagtcacaagatagattggtggttataggggtgtaagtgggtgagccgcgaacccacttatatattaaaataagcgggttcacggcttattttagcctataagtaagtttcggggtagccactacacccctacttatattggtttttttcaaaacacggtatcaatgtacgcttaaataaacaatcatttatagtaaatttgatggtcatattgtttctttttctctaaagcacaatcccagcgggcatgcgcgcgtagaatctcatatatacacatgcgcacactgctcagtatgagcagctccagcttcgaagagattagaccggtgattttgagattgtttaaagttcccaaaatttttgaatatcaccagacatattttctaatattgaaataataactagctgtaaatgtgaacagttatactanatcggtaaaatacttgaatctaggtggacaaattctactccaagaacctaactaattcagctagtcgttcacagttatgtttgtttctgatctcaatgattggttgatggccgtttgaattacttttctagttgcattgcggcaaatatatactcaatattgaatatgctggatactattttttttctgtaaatctattgctccctccgtttgaaaatatgtggagtattttatttttgttaggataagactttggtcaatgattactctactaatttttttataaattaattatatttacattcatattaaaaatacgtatgattataattatatattatataagtgatattataatagagtaattattggtaagaatcttctcctataataaaacagaatacgtctcagagacagagggaataatagatcgagtactaaatttatgaggtgtgtgtaaattaaacagcctgaaaaaattcaacggagtgaagatagcatttatttggttggtgatcctaaggtcaaagattctcaatttccatccagtaaagatcatgtgtgcaaactaattactatctccgtttcaggctataagattttttttagtattacacacattcatatagatgttaataaatttaggcacacatatatgtctagattcattaacatatatatgaatatagacaatgctaaaaagtcttataatatgaaacggaggaaatagtgtctagctaccacactcagcgtccaaggccctgtttagatcctccaaaatggcaaaagttttgccattttgtagtattttttgccattttggatctaaacactagtagcaaaagttggcaatttggcatttgctagtccatagtagcaaattgtgccaaaaagtgctttgggaccactcccactctctttctctctcactttagtgctagaatggtaaaactttaacatgcatctaaacaccaactagtacttttacaatgccaaaacttttgtcaccaaaacttttgtcattccaaatggatctaaacatgccctaattaattttaaatggaacaacacaatatatgcgtgtaaccatgcatggatggatggtatatttctcgctgcgtagaatgatccatttcctgttattgtcat

SEQ ID NO: 50123 - DNA, 2609 bp, Oryza sativa
tacgtagtgttttaagagagaaagcttctagaaataccaaaatttggtaagtagcaatgtttgaagccctcagtatgtctagtttgttgttagtatttgcaacaaatcatcttacatgaggaatgtactcattataacattttagaggttttgtagtttattttttttatttaaggagacctcattcagctgtgcgaaagcaaattttttaacatgggcttgttgggcttttgacatgggctgggaaagaaaaaaaaaagaagagacagcccattaattctcacatacttattgggccttttgcgtgcgtggttgcctcactgacatgtggggcctcgtcgacgccaagctaatccgcgtctccaccgcgatgcaccgcttcgcctccgcctcctccctcccgccgccggcgccggcgacggcggcggccgcggcggcgcaggctgcggctctcaggttcggctccgccgccaccactcgtgtcccccgagcgctagccctgaccgcctccacttgcccatggcaccgccgacacctctgctcctcctcctcctcctcctcgtcggcggcggctgcggctgctacggcggcggcggtggaggaggcgcgcaggggcggaagcagctgggcgcgacgacgcagctctacgagtacctcctcgccaacgtccgcgagcacccggtgcgtgtctccctccctccgctctctgcttggttcgtctcgagcaaattttgccgccattttggggtgcggaattcgcgtcatgctctcttgccaatgtgtgcttccgttttatcccgtgctggaaaaatgcatcaggttctcaaggagcttcgtgaggagacggcggccatgagagggagccaaatgcaggtgcgtgccatggataaacttggctactcttcttagagagctcatttaccattttcccctataaaattagtcctaatctttttcaaggtaacattggtccaatgagccacttcatacatgattacttttatttctgaaagtgcaatgatactgtttagagatgtttcggaaatcagttacaatatatacactctcagctggtttctttgtcttgttaggtttcacctgcgcaggctcagcttctagcaatgcttgcgcaaattcttggggctcaacgatgcattgaagtcggagtctatacagtatgtgatctgacctagtgtttgttactttgttttgtattataaattattcatatttccactctaggtaagtaaaaacgcaacattagaaagttattgtttcttgtcagaaccaaagcatgatggttgatcaaaatgagaaataaactccagctggttaacaatatatttgtgagaactcgtgtatctgttgttttccctggaaactataccataataagcaagcactacaacgtttgaatcctatatgcaacaagccttctggtagtactgaggcttgattcttgcatatgttttcctttcatcatcaagcagtctttcctgtctggtacaataataaattaataatccacacggtacatgttatctcaagtgctacaaattgcaatcaaaaccttgtgaattagctacttttgtagaaagccactgatttctgcaaattcaataacttcattatagcattcgtttaatctttgcacagggatattcgtcgttagctgtagcactagctcttcctgaatcaggtcgtttggttgcttgtgagagggatgaaagatgcctagaagttgccaagaaatactatcagcgctctggtgttgcacacaaggtgatcgcctctttttgcttgatgggttctggatcatgatgaatttcttgggctgatctatcacctaattccttaggttgatgtcaaacatgctttagctgcggattccctaaagttactaattgatggtggtgaggttaacaggtacagtaattttattgtggtataatccatcattgaacatcttagttggtctaacaaatcttgtctcttctaccttttctagttatgactttgcattcgttgatgcagacaagagaatgtatgaggagtattatgaacttctacttaagctagtaagattacatagaaccctttcttgcttatagcaattgtggtctgtcaactgtcatcaatgatcataacttttttataacattatagaagatttgctgcaagttttatgatcctatttataagttccatgtatgtagcaaccataacttacatgttttgattataatctgtatgttgagcattatgttttgttgtgttgcaggtaagagttggtggtttgattgtaatagacaatgtcctttggtatggtagagttgctgatccactagtgagtcttttttcccttttttagttttgacatgacatagaagctatatggtagaaagtggatcactctttcctgattttttaggaaattatctggcacatttttccttaggtgaatgatcgaaagacaattagtataaggaacttcaacaagaaacttctggaggataatcgtgtcagcatcagcatggtctctttctctcaccacctctcatatttttttatctatcgcctagatttgtcattacttgcaagtgtttact

SEQ ID NO: 50124 - DNA, 1064 bp, Oryza sativa
tcaagataatagtcacacccaaaactgttttatttaaagggatccactttttgtcagatgatgaatgctagctatatggtagtgaataatggaagaacttctatcaaggaaaaataatgaacagtctccttactgtttttattgcaaccagtccccttcatgctcacttcctttttagctacaattcatttttaaacaaattactctgttagcgggtatctataagtgataccatgtgtatttagtgggcaaataataaagtattctgattttaattctttttctacaattaaatcatggaatacatactatttgtatgtggcagtgatggaagaaattaaaaatccagtacttctgacacatattacagtgtgattcatgcttttttttttgggtatggttctatcacttctctagaggtatatttatctacactgtttttgttccaaaatatcactatttcaatttgagaatctcaaatttcataaaacctgtaccagttcagctaaaacaagatggcagaaggcgtggtattcgctgctctatgcaaaattggatctgtcttggcatcatctgcaagcataacattaggtggacgtttagatgcaaacttgacaataataaatgagattgagagtcgaataaaacagatcgaagttgagctcaagttgatgcaagcattcctgcgccaagcgcaaaaacaagaaggctatagcgagcccactgaagtctacctgcaggaagtaagaaaagcagcttttgaaattgaggacatcatcgatgagtttctttacctgtctgttaagcacaagaacaggtttttcaatggggagttcatgagttacttccgtaaactcggtaaaacttcttggcacaaaattgctagagagctgaaggattcgcaatgtcaccttcagaatctccggaatttgtgggtgcagtatgagattcagcttccaaatggcaatagagtttcaaccgatgtggaggatcaccggcttccgcatcatctttcttacccagctgatgagatggtgggtgttgaacaagaaagaacaatgatg

SEQ ID NO: 50125 - DNA, 948 bp, Oryza sativa
ttttcaccaattgcatcttgtatagcactcatatggttggttgctccagccatgacgtttgctgtggttaggtcagtatcaaaagctccgatatcttgactcagcactgatctcaagtatgccatccgcatgcgtgacatttgtctctgactggtatacatccaacatgtaatttctgcggaaggatcattgtcgcaaaaaggtaagatggtttctttgaatctactccctccgtcccataatataagggtttttggagggatgtgacaattcctagtactacgaatctgaacagcacatccctccaatatcccttatattatgggacggagggagtaacattctaacattattttcatttttttttgttccaatcatgtgatgctcttgttgctgcagacaaacagacaagtagtaacatagggaatggtgttgctatgaattgctcacttttaaagtcttaatctttcgttttctctgcacatttctgtgtcatgatgctctgtactcagggtccaattttctttttcacattttccagacagttatcttcaggtgcctagtagataatatattgttaaggtatatgctacaaatgttgacaatattctaaccaggttggggcatactagattcagtaggttggcctaagctcaaccaaaaagccacttcaccaacctttagccacagtgaaattgctcgaccttctgtcttatattctgttctgtatgcacttatagctgtcaaacaggttatatgatctttggattttgataggttcttcaggcttccactatgctcttactttaaagcataatttaataggtaataacttactttcagtatcttacaaggtacagttccaaatatagaaaatttagaagaatgcactcaccaatcattccaccaggaagtgtaataattgccaatgcccacatataaggaatt

SEQ ID NO: 50126 - DNA, 3674 bp, Oryza sativa
  unsure (1)..(3674): unsure at all n locations
atgatgtgacaaatggttttgaatttgaacccattagaagtaaacatattttttcactggagtgtgaaactttaattatgcattcaagtcacatcatagtgaaatactaagcaccgttctttcgttgtcgtaaccaaattttagtgacaagaagcagctttgttttcatctaacactactgaagcccacctgcaagtttaataacctaaattggcaaagccattttttcactaaagatactctttggaatgggatcctactttagtactttacatattccaatttccttccaaattctagttaaataaagtctacagcttccttgtataaatatgatgttttgccatgtgtctattgaagtttatgttggaataaattattagacctacaagatcaaggtatctggagtaataatagtcaaaggctacaaaatcgtagtccactttctgaggtgacacgtccgcgaagttatcatgtatgattacaatacaaccttgttctccatggcatagtttcgtgcttaaaaatattgtttttatgaaaccttgttgtaaatcttatgctgggtgtttgatcgcagaacttcacttgctgttgtttaatattttttaattgttttgatttggtgctgctacatgcaccatctgaatctgctcttcacatactttcttactgccatgtatcaaactttgtattccttcctactggtaatatggatgcaggtttgaggcaggaatgttcaacaataattgtcacaaattcttattttctttctgtgaaagtaaacaattttttgtttttcctagtttatcagatcccccccccccccaatgacaatattgtcaagtctaatgtctccattgcgttgctctgtcaggttgattgtgttctttgagcagaacgttccacataaaagagatttggctttaagaaatctccaacaaagctacaagtgctaaaaaatgtatattgatgcaaacttaactgcttgagtttgagtgtccatactattttctattgggagtaggcgccaattgttatcttaccagacatacatattacacaaacaaaatttatattgaaaatatgcattttgttaatgggcaaactgtgagatgcatcaatttgttgtaatctgcaaccactgtttggtggttgtcagctgtacataaactctgccaatacaattttgttctccactgttagatctaaaggtacatgacggttttttgttagttgcgtaactgaaggattatgaagtggaagacattactccctctattccataatataaggcataaccacgttttttagaagttccataatatgaggcatgcatgcatgcaagcaattaactatgacctcttctccattaaattattacttttttaaatcctctactcttatgttctctaattctattggatgcattcattatactccctccatctacttttgattgttatatttcatcttggcacacagatcaaggataagtaattctacttatcatctatttaaatatgctactagtcattcttcgtaaacaagcgattcattaatatttacatttctcgatgcccatatgaccaatgttgtgtggaagaatgaagagtcacgcattaaatccaagaaagccattaagatgataatctattggattgaaatatgcctatcaaaaataaatttttcagatttggaaatatgactatcaaaagtagatggagggagtatttattaggatgatccaaactacaagataataataattatttcttggtctttgggttagaggtggttatgccttatattttggaatggaaggagtaatttactgccatgattaccatttggtaactttggtttgtgtagtggtggtatatatgcaacaagtcatacataccctacctagaatttttacattttaaccctttttaaaccttattttacaaataaataccacaaaattctcccaccttccaaaataccacaatgaaaccctattccttccagaaaaaagcacaaatcttaacaaaatgacgcgagggagacaacgctactttccaaagaccaagttgcccctcagcccttttgttcaacctgtcgtatcttccccctttcttctcatacttcaccaattttctcttcgagccttaagtccacatctatggcaatgacgcagggaaaagcaggcacaaatccacctagaggcctcaattttttctcccaaactctagagcttgagctgcataaaaagaaaaaaaaaacagnggctctccctcttcttactcctgtgcagnggttcttgttctttcggtgactcctaaactagtttcttctgcaaggtgatgcttggggatgggtttctagcgccgccatggatgcttcagtcaatttttagggcttggggatggatttatggtgccgccatgtatacttgatcgattgttacggttagggaacaactggtgagcgaggatgcatgatgagaggttgaagaaggagatgcaggggcaactttgtctcggtaagtcacaaaatctattccgatcgatggtacctaatgtttgtggtatttttgaaaggtggaagggtcttaaggtatttattggtactgataaaatgtaaaatatttatgctatagatgaaactttcccatttagagatgatctcgatgggcaaatagactagggtatttcctcaaaaaaatggactagggtattaattcagttcacatcccttagtaaattatctctcttcctcctcaatggaaaacttatgttttttgatcatcttctcacatcttttatttttggagctaaaagtcaaaataacttcttcgaggaattctcttggggaatttacctcattgtctttatactcaggaatctgattcaccatgagccatgaagcatacgccgaagatgttctttcccttgtcattgtcttcaccactctcaagatctgcactacttgattcaataccttcttgagcttgcttggacttccttccattgaacattccttttagcttattgtccttgaactttgtctccattgtcttttttcttggctctcccaagcttggggcagtgcaaacggatgtgatcaagctctccacactcaaagcaaagaactcgacctcctattttcttgaacttgacatcattcatagttcgagacaacttgtttatagtcaaagccaactcctcctcgaattgctcgagttgatcatcggacatgacgttaatagtagaaagagcagtaggagttgactaagaagcaccaatatccaaagaagtcgaaggagaaaccaatgcactagatttagaatcaactttacgagaaagaatatttatctcataagttttgagtctagtgtaaagtgaatctaaagtcaaagtgggcatgtcaacagattcctgaacacacgtaattttcatctcacaaacagacataccaagaccattcaaaaagtgacaatcttagattgtgagtagaagtatcataagatgtatcaacaaatctaagattactcaaaactttgtcaaagcatgcaaggtaatcatccaaagcctctccatgtttcttctcaaattttatgtaatcctttttgaaaacatctttgcgtagttccttgatatttgaagttccttgatgagggctgcaggaat

SEQ ID NO: 50127 - DNA, 747 bp, Oryza sativa
gcaccggtctgaccgcgcctgtgccgttggtctgaccggtgtagatcggtcggtctgaccgagtcgcgtctcctcctcctgtcgtcaccgctgccggtccaacgcagttgtgccgttggtctgaccggtgcgttgccgctggtgtgactgccgtgcactcgccgatgtgaccgccaaaaccccgagcaagcacaaattgaagatctctcaaagtagatcgaactttattacttctattcatgtttacaaagtacaacactccactcgaaaatctcgactaaactcgaagccctaacttttctctaaactcaactctcacacaatcgataccgggaggcctcaccctctctatttatacccgaggtagggagtctaaatccatgaacccaacttgtacaaaaagttctaatcccctaggaaaccttcccgtacaagaaataaactttacaaacttcaatcataaaaaatttggactcctttcaaattcgactccgtatctcatacacacgacatctccattgtatggcatatgaatcttcaccaacactgcattgatctttagcataagcatcccgcatgatatcctgatcgtccaaacgtcatcttctcctaagttgactcccaatccatcaccggcaacactctcccgagacatcaagactcacatacacatgaatcaaccaagaaattatatccgagcaaaagttctctccaacttgactcaacattagcacagggctgcaggaa

SEQ ID NO: 50128 - DNA, 7270 bp, Oryza sativa
  unsure (1)..(7270): unsure at all n locations
cttttgaagttgcttatagagtaagacgtgcatgtgtacgttcaatagagtgaggatgtgtacgctgtgaacacctgcgatgcattgtactgtgtttcttaaaaaaaatgttattacttggacgacaggtaatgtaaaaacgaagccaggcctactgatactaacgatcacggcccatcaacgcacgtcgatgcccattcgaggccatcaacacggcccacccagaaacggccgcatcaatccgggcacgaatctcgaggcagagccccaccgccttccgcttcgcttcgagagccgcgtagcgagagacaaaaacccctctcgtcctcctcccgccgccgccgtctcgacctcgcagcctagggtttgcccccctctcctccttccagaagcttctagacgctcgtggggggagcatccgccgccgcagcagccatggcgtccaccaaggtccagcgtatcatgacccagcccatcgtacgctcctctctttctcccctcttcctcttcttccccctttggtctcagaagccatggattgtttcagctgtatttttcctaatatgtttgctaatcttttttttggtgtttttctccttgtgattttggcgggcgtcgtcggtggcggcagaacctcatcttccggttcctccagagcgtaagtgaattgggaaatttcggtgttttttttcttcttttttttgactgtcgacgtgtggttggtttgaaattaaccaaatttgatttggtggtgcagaaagcgcgcatccagatctggctgttcgagcagaaggatctccggattgagggccggatcattgtgagttcctaagctgatctcttattcagaattttagattttagtgctattcctctagttgaacacacaataagcaatggaagtgcgtgtagtatgaagattatgaatggggaattcttgtaggggatgagttacatagatatatatatttttgaggttaatgttgcaacttaaatcctaaagagcctaaccagtagagaacaaataagagaaccctatagtaagtgcggagcacatcttttggtctgttttgttgaaaccaaacatgcaaatgcatctccgcaaattgtgattccttgggaatccatatgagcattatcgaatcttctgctgatgttatcagtcggaggctactagtaagctcttaatttgatcgctaactgatggcatgagctcagtacactagaagggtctcaacttaagctagatagatgttattagacaggccaatttcaaaagctgaaacatatcgagattcagattttgaaaattaacaaacaactatgcttatatgagttattgtccttccacttgaaccccggaaaaacacacctttttccatataaaagctaacttttgtctcatcagataatgattgaatttccgcaagatgtcatcagataatgattgaatttccgcaagatgttttctataatgtgtccatgtagggtcataggcattatctgagtttggaagagctaggtttatatttactttgattgccattcagactagaaggaaaggttttacagtgaatgccaatcatattgtttatacttatttggtgtttcagtgtttgcaatagaattagaaatgcagtaatgaccagtagctgtattatgtcattgctgaattttctattgtcctagatgaaatagtcctatgggcaaacggttatcccaaatctggcgccacttgcaggacctactttgtagcttctagtgttggctaaatatttgttcttcagtgcagtactcgctgattaatctatcatttgacgttaagctcatgagtaacttggatcaacctgaaccattgggccactattacataggattatctaacaatactatgtacagctccaggaaccttaaaaagctcatttgttttactacttgttacattcttacccttcacctttttatataaccattttagatgacagtataatgcttatgctatgtgcttggttgccttcctgttgtttcatggtttgctgatgtggcgtatacatattttttcaatttctttcgtggtttgctgatcatttctttccatgtctgaattgcattgaaataccattctgcgaataaatttaaatttagaattcgagctaaagatgtggcttgttctttgtgagtgttactgtacgttcaagagccatattcagtttgaatgctttctcagtatgtctgtgctggtttgcatgcatatatggagtatttacgctagctgtatatgtttggcagggctttgatgagtacatgaatttggtccttgatgatgctgaggaaatcaacgttaagaaggatactaggaaatcattgggtcagttaatttgcaacaatatttgttactatttttaattaattagatggaacattctgactataatattgttggaaatgatttgcaggtaggatactattgaaaggcgataacataactctgatgatgaacacgtaaggattatcattaaactcaatatctgaactcctgtaattgcatgtgacgtgttctctaacatctgcaatttcaacttctgcagtgggaagtgaattttctccccaaggttggcgtttgtgactttgtgtcgattagtcccgtgatactttgtactccatctagataatcagagaatgaaatgcatgtagcatgtcatcgtcatcgtcctcaattgaggatatgtaacggctgttagcaacctatgaactctgtgaactctaggcaaggttgttgagataatgagttgctcacttgtgtgtttaagattcctgatcccgtgaatcaatcctgctcacttataacacggacaattggagcaattcttgttgtacctcgtcttcttcccgtatctatgttatagatagtcttgagcatgaatgcatgatcgtgaattactaaaatgcaggatgaacacatgataaacatatgttatgcacagttctattagggacatggcattactgccatattgcttgaaaaggaaatctcatggagatcttgttgatgtcttctgtttatatactgtgttgctagagatatggtgagttgttaagggaataatccatatcgtttaccccctaaagctcaataaaaaccaataaaaaccttatggtgtgggttgatatttcggatctgtgaaataatcaaagtttttctctcacactctctacatgactacacaaattagtgaattaccgtggatctaccattgtgaacttgaactgtgttagataaacatcacgatcatcatctattattgaatataaatctaaattcgcacgaattttgaaatcagagctcaaaaacgtaccctaaacatgtgtacaaaatcacaattgtatatcacatggtaaaaaacattcagaacgccagagtacaaacaagctaggatcaaaagagggagaaccacttggttttagacttgttcttgctcatcatctccttcctcttcctctccctctccttctcaagtttttcttcttcttcctcctcctcgtcctcgctactgacgctgctgctcgtctgatccttctcttcctcctcctcgtcgtcatccttcttggtggatttcgccttgccggcgccggccgtggcgacgtcgaaccgcgcggcgtccatcgcccaccgcatcaccttgtccacctcgtcgtcctcgtcctcgtccgactccccgcccagatcctccagcctcaccctcgtctccttctccggcnccgccgcccccttcagcgctgcgaaacgcgcctccagctcgtccatcccgccggcggctgcggcggagggagcatcgggttgcttcggcttcggatccggcgggcggtgagacctgagcgcgtcgaagcggcgggcgaggtcggcgtcgaggggatctgcggcggcggcggcggcggggtggtcgagcgagggaggaagattcggagcggtggccgaggacgacgaggagacgaggtgggagttcgcctgcagcttgagcatcaccgcgtcctgcgccgcgcggaggagcgcttccacctccgcctcttcgccgccggtgacggccgccttccggccgccgccgccgccgctcatcgtggtggactcgtgggtgggggacttttttctaatttttctccactttgtttgctgctttaatgacagtatggtgggcccaaaaattgtactaggccaacatgagtagagcccaatttagtgatcaatgggccgggccgattttacggcccacgatgccaagctattattaatcccagcctaattctaatccctaccttaattaaaccatttttccccacagaaaaaaaatattattaactaaacaaaaaccatcctgctccactgtgcctttcaatccacgcgtccgtcgccgtcgccgcctcgcgcgcatggaccaccacccgccgccgccgtcgccgccgcgggactccggcggcagcctcgaggtgcgcctcttctacgtccgcctctcgccgcgggggcccaccccaccgccccgcctcgcgctcgcgctgcgcagcagccgcggcggcgacgaggaggaggccccgacgcccctttccctcccgctccgcctcgatcgccgggacccggcctccggcgaggccacctacgtgtccaccgcgttcgcccgcctccccccaccctcggcggccttcgaggtcgccgaccaccgcggcgccgcgctgctccgcggctctcttcgccggtgccctgatgccaagcccgattcctcccccgcctgggcaatcgactgcatccccgccgcgggggcggaggcggagacctccgcgttcgaggtctacgtcgccggatgctgcgccggcgagcccgccgtcctcacgtgcgctcttcggctagccacccccgaagaacagaaagctgccggcgggttggtccgccgccgatcgccgacttcgaacgtgagtatattttaattaaggttatgatgcttgattttatccattagtatgacttgttaacgaaatatctgtgatggacaaacaattatagcaacagaattgggtttctaatatgtttataattgtgtagacttcagaatgtggctgtgtggcgtgaggtcacaagcaaagcttatcataacacaaattggtggacttttgtcctaattcttggctgtgtgaaaatgtttgtttcaatcctgcttatgtattttgcttgtaggttcaaagttactcttaattagcaggggaaccttgttgttatctatactgttgctgtcagcagaggagttaggaaatttttcaagcccgggcaaactcaaatatacctaatatttgctacaatatttctaactttaatcctttgaaaaaaaaataaaaattcaatggtgtatttgacggcgagcctgggcggctgcctgtgcaggccgggtggtggctccgccactggttgctgtgtatagtatggtggttatggttggtaatagtagagctatctaatgttaacatgcttttccatattattaaaagaattatcttgactatttgtgtactacaactatagctttcttgtgttaaagacttaaaatacataatcgaactgttgaacaagacctgattcatacttctaagtttgacattcatactgtagaatatacaatgcttacaacaagcttcaactcagcctttggttgtctgtgctgatttttaaattgtgttaaaaaggttgtgaaaaaactatcattctatttggtaaatcagcgtaagatagataattgtttttcctagaaaagtataacaagtggcatatattatgtatgaacggtataattgtggttttgaagtgcttgtctggaagttgaaataggtattgttatacgaggtttcgacatttcacatttgctgataacacaccagttacagttagtaccttaggtttgtaaaatcagtctcttagttcaaatgccacaataggtaatgctggttttggttgatccttgttggttcttcatgaattatatgtggattgtggagttttcttttgacaatgcttgccaagttatggtcaagctagacagaggtcattatcatagcctcatatgcatgctaatgtcagggatgtttggttttatcttctatgactggatgctcagtgacatttgaaatgacaagacattggaaagttagggggtaattagactttcttatagcaaatgcgataatgtttgctttgatcctttgcttgttggatgaccgaaacaagatggtttacgaataaacatgtgctgtttaagcttataattcagacgttatgctcaaattcctattaattagtataaactgctttggcaggctgctggtgatgaagatgtcaatggaagtatacagcatccagaaggttggtactccgacgatgatgacgggcaactcacatggttcaatgctggtgttagagttggtgttgggattggcctgggagtttgtgtgggtgttggtataggtgttggcctcctcatgagctcataccaagcaacagccagaagcctgaagaggcgattcttctaacgccgttgcgttgaatacacaaacttttgatggccggtagcagtatagagttggtttggttctgtttcaaagggcagaaatatcattgtatagttggtggatgtgttgtttatgtgtgaggtgttgtgttgcttttgcttgtgcagtttttgagcccctgtgcatccctctcagttctatgtgaactgtgaatgtcctctgacatgtgaaaatgttctcaactttcaacaaggagaaactgatgaatgggaatgatggattgccaattcagtcatctacgtttgcataaggctggaaactactggaggtattatttctctctctctttgtaatataatgatcagatattgtgaacgaaatggaagtactttagtgaacaactttctactagtacttactagtatttgccagcaccatataattattaacacttctttttttttttgcgcatttcttgtgtttttttaatctgtgcagttaaacactgtttagcaatggcagaatgtcaggattatatatatatatatatatatatatatatatatatatatatatatatatatatatatatatatatatatatatatatatatatatatatatatatattatataaactgaaacaaccactcactgaatattttggttttccgtaggaaattttgtggcaatcgtgtatcacgctgaaatataatagaaaatggaa

SEQ ID NO: 50129 - DNA, 2212 bp, Oryza sativa
aaggaatcggtcaggagggagaaagaatgtgttcagcatctgctcaatgcgaaaacagaggtaaaatcgatcgattcagcacctgatgtttgatggattagtggattgatgaaattgcatttgtacttcatgacaggaattgtcaaggaagtcatcagaatgtggcaggttgcaggagaagggcctctcattggcgaaggaacttgcagcattgaagctgtatgtttgttcatttccacctgaaagatgcaaatgtttgtgtttgataagtggaatgtatttagtttttagagtataatttgttttgtccattaggtcgacagatatgaaccttcaggaggaagagatccttaagttggcatcacttggtaaccatggaaatgctgcgaatgcggttgatgttttgacgagatctcttgctcttcggaacaagtaaaatttcctctttattatacttatcttgaagcggtgtgtttatggttaattgcatgcctttaagcataattaactgatgatagggtttattaaccacttatgtacttgttatgctggtaatagttgaccaataactgaaagcatgctatctgctttagctttctgtgtcgaatagtatatgcaaatggatgcagagctttgtactttatcgaagtgtgaggttatcaaacataaattgtagtgagtgcttgtgttacaagatttatgggggttttatggtcaattttgagaatgaaataaacattctgataagcgaaatagtttggattgtatattgattagtgatggtaataggctaatagcacttacagaatgtactgagggatgcagatgatttttttcctagtacaattagatgcacatactcaacacacaatacaatgcgcacacataggcatgcaggttatatacaggccaaagaacatacttaacttcattgattgttcaaccaagctgttctctatgccaattggatgtgtttaacactagtgaaaattttactgaacatgatgaagcttaataaggctactgctccatgattggaatgcttcagtaacacgttattttccctctaaaaaaagtaacacggtctttttaggagctacaaagaattgatgatccaatgcaatgttctgggaagatcagaatctcgttcccagcagaggtttgagaaggcaaaagaactcattaagaagttaaaggtaagtccatacggggggtatctttttgctggatgtgtattttcagtgcagataaccctttttaactacaggcaagagtacaagaccttgagaaggaacaagaagaaaaagaaaatggtgtgattagggacctgaggtctgcaaagaaatttaaagctgaccagacaaattcaggaaataccacagttaataatggtttctcgggtcttgctgctggatgtggagattatccgatgaagctcgatgaagtggtgcaggatccatgcgacaagcctgggccatcacctgaagctaaaaatgacctgaatataaaagacaaaatggacgacaagcatgcggatgtgattgacttagatgctgatgattctgtcttccaacatgaacacaagaaaggactttctgccaaaccatttgggaacgatggtaacgatttggatttcaaaagtcggtctagtcttcaagaacattataggaaggaatccataacatgcaagacatatgtagcagaggaaaattcctttctaaaaccttccatggtaactgaaagatcagcacttcaggagagctttaccacaaacaaacttcaaagctttcaagaaactcctgttctaagaagtatgaaagctacaacttcgacatgggagaaagaaacactgacgattgatggcatctctaaacaagctactagaatggctcctggcactggaccccagcaggttcacaatttcaattctctttcaggtaagttattgtatggtccatcaagcagagataacttctgaatttaagttgcataataatatgcatattcaagttcacagggctatttttcttttcaacattctaattttcagggggaagaggcatagaacataaatttgaccaatatttctaatgaatgagtacttgattctgaaaaaatgcttaacaaactttctgtttaatgacctccttttcttattaccaattctttgaatatactgatgttcctttttcagcacatgtacttaacaaca

SEQ ID NO: 50130 - DNA, 7865 bp, Oryza sativa
aaaggaatctgatcgccgtagggccagacggacgtgggggaaaggtcaaaatttgagagatcttggcaaattccaagtcagtttgataagttttcctcatctccttccttgtcagacagtaaagtagttttgtctcataactaaccacctgcatcaatctctgcaatgtttgctgcaggatagcaagactcaagcactatggcctaaggcacagaaggttggaagcagaggtgggcaatctcagatagatcatttctttgggaagagatgatcctgctgcgcaagctatgctaatatataccactttcaaactcttgcctctgttgctgcggtcaaattctgtttggagaactatttgatgtcctgcatctgtacttgtgtaaaatccattgcacttaaggtgaaagctgaatccaaatttcgcagtgtcatcactattgggcctgaggggatagatagagcttgtaaacaatgagctgtgtaggaaacctgaattcctctgttcctcagaggctcaggtggtcatgtgtaccacattgctaaacattgtgtattgatagagctgaggagataacaggtggcttagctcacttgatccacatgcaaatacattgcaagctgccctttggctaagtctgaaacctatttgggtttcattgtactgccaactactccagcaaagcaaagctgggaatcacaagaaagttggacactgggttgaagaaaatgactgcaagttttccatctgccaaatgccaaatgttctttcatggtaggcactagagtagtatatatgttctggtgttatctggagtctggagactgcagaggctacacaacagctgagcaaaatccaatcatggtgagacaccaaacatgatacctcagtccctctatttaatttgtgtttgctactgctagtgttcaacctctagattcattggaaatgatgtttagtggtcagtggatagatggactactagctgctttgtctctctcccccctctcaaaagtacaagccaatttttctttctcaaattcaaaatagcatgaaactgttactcactcaccatacaaatatatatcagcaaacaagtgacgaatcttcgaatgctgatcttaccctcatatgaaacatagaaaacttttccaaatcttaaagaaaagaaatctctcttttcgaatataggcatctcaccaaaaactcctctgttccaaagatcaattttttttaaaaaaaaatcataactacattcaaaccatttacactcttctctgtaagaaaaagttaagagtagcacgcttcctaaacttctaaatagtatgatttattatataagagtttagacataaaagatcaccttagagaggtgccacaggaagaaaaccaaatgaattacagcattttgaggccggcgtacaatcattaaacagtttgggcatcttcatacgctttgcacatgttaataatggaatcgatcacctgcaatgcaacaccgtgccataatcaccattgaagattctagcatttctttgaagcaataccgtatgattttcttttaaaaaatattttttatatatcaattatttatcacaaaatcatccatccattctttagttcggcatgaagcaaaatacaatttcctagtagagcatatatatgcaaaagatccaaagaggagagaaaaaaaaaacaattcaattctcttctcaactcgacggccatcttcttctttctctctccactccgtcgccgccccttggcctccctcaacggccaccgcgcccctcctccgccgccaaatcgcacccaaccccttcccctttaaactattccacctataaggccgcgccgccgccgccgacgagagagacggccatgacctcaggttctccctcctctctccgcccccccgcaacttcctgaaattgcatctaggtccccctgacgcagcgattgttccctcccttggagaggtggccgtagctctccggcggaaggcggcggagatggcttccacggccgcggcggcgtcgtcgcaggggtgcatctcgtgggcgctgcggcagcgtgggcttggtggtggtggtgcgcgggctgtcccggtgcttccccgccggagattctgcgtctccgcggcggcgggtgcggggttcgacaacgagaatcgcgagtgggtgttttgctctctggttctttgatccgagcctgatttagtgtttttttttctctggttctttggagtgggtgggtgggtgggtggtgtgtccaagcccaagaagaaatgggatgctcatcaggtgtttgatgaattgccgaacccgagtcgcaggtatgtgatcgtgggtggaggcaacgcggccggttacgcggcgaggacgttcgtcgagcacggcatggctgatggccgcctttgcatcgtctccaaggaggttagtgcccaatctggttcagagtttcggaacacgaatttttgctactatgttgattagagaaccgggttaaaaggtttctgtgttcatgatatgaaaatgaatgcgttgtttggtcattgttctcatgtaactgcaatgtattgattggctgatttttttttttgagatttatgatggggtttgcttactgtaatgcaggcgtatccgccatatgagcgaccagcactgacaaagggctatcttttccctccagacaagaagcctgctcgtctacctgtaagtaatcaggacaacttaatgatgataagtagcatttgttcatgctatgctagtaggtgatggtgtgggtgtgcgctacctaaggccttgcctactgtaaatttctgtatgatggcttatttggacttcagtgaagtctgctccagtttgttggcattacactttctgtagtgttcttttagctgatatgagagatttgtacgcttcacactgaaccattaagggtacagcccaaagccacccatttaggcatatagactcaaattcttgagattcgtcttgttgcagggctttcatacctgtgttggatcaggtgggcagaggcagactgctgaatggtacaaggagaacggcatagaggtagtcttgacactattgttaaacattattcaatgtgtttgaaaatacagtatgacctctatctgaagccattgaactcttattaaggtattgtatgaggatccagttgtagcgtttgatggcaaaacacataccttaaaaacttcatcagggaaaattctgaagtatgggtcacttattatttctactggctgtgaagcttcaaggtaaccttcaaacagttgaaaatttatcttttgcaaggcccttatatgaattcatgattagaggtttcatgatttttttcactcagaattcttaagataaacttgtatgctatagtaatcaaatgaaaatttcttcactgagattgtatgcatggaatggatacaggctttatattaaacccagaagttgtttgttgccatctgtaatgttgatgcttcctttcaggttacctgctaagattggaggaaatttgcctggagttcactatatacgtgatgttgctgatgcggattctctagtatcttcattggtatgtcctgtcaacaaatagtgctagatgtttcatgtacaccagaactggattctctcatttgactttgaagaaataatctcaattttttccctgcatattctcaccttttaacatttattgctgaaatcatagtttgttttatctttatagggaaaagcaaagaaaattgttgttattggtgggggctatattggcatggaggtagcagcagcagcttgtggctggaatctcgacacaactgtaagccacagtgtttccttgttcagttttttatgaagactcttatttgtacaagcaattttctaattaaagctgcttatagattatattcccagaggaccacattatgccaagactctttacaccttcccttgctaagaagtatgaggaactgtatcagcaaaatggtgtcaaattcattaaggtaatagcttcgtcaagttcatttgtttaatttattttgtcaacatatttgagctcatgtatattttgttccaaccagggagctcttattgataaacttgaagctggctctgatggtagggtgtcatctgcagtacttgaagatggatctgtagttgaagctgatacagttacgaccttcttcttcttcttcttcttcttcttttgtgcaaatatcttgtttcatcatcttaattatttgttgctcaggatgaaagtatgttatcaaaaattgccttgaatatttgcatatgctgtggattatcaaatattgccttaatcatgagtcacatatgttgaggagtggtcaaatacttggcgagctgatgtaaactaagtgaagatcagctcattccaagcagcatcactgagacatttaaactagttttttttttgttatatttgatcatccgtgcagtcactgacacttctaaaattattttaacaagaacatttgtcaattcaggttattgttggtataggagcaagaccagttattggcccatttgaagctgttggggtcaacactaaagttggtggaatagaggtttgttttcaattattgatgataaagttaatgaatcttgttttattctcatattagtctgtagttgttttacttttgtactagtagtctgcattctgcaatgtgatctatggcagttattcctggaacaaaaaataaaaaaccactacattccccatgaaatttccgagcatctgtgcttgttttgatcttcatgtgcgaaacttgagtaggatcgattttacagcgcaccaactgactcatatagatgattttttcagttaaagccttggtattgtattctttttttgctttggacatgttaatatgttatcctacacgtgtttcatagatgtttggcatcctgataatcaattgctatatcttactttctccgtttcatattataagactttctagcattacccacattcatatatatgctaatgaatctagacatatatgtgtgcctagattcattaacatctatatgaatgtgagcaatgctagaaagtcttataacctgaaacggaggtagtatttcttaatagagctaattaagtacttcttttacaggttgattccttgtttagaactagtatacctggtatctttgctattggagatgtagcagcttttcccctcaaggtaggagctcactgcgtttatcttataatcatgaagaattggattccagaatatgatgttctgtcaaattctttggcagatgtatgatagaatgactcgagttgagcatgtggatcatgctcggaagtctgcacaccactgtgttgaagcactcctaacatcacacacaaagccgtaagttaatgggtagaaagtgtactgcattagttcatctgctagtgctgctttaatttgccattacgatgcaggtatgactaccttccatatttctattcaagagtttttgagtacgaaggaagttcaaggaaaatttggtggcaattttacggtgataatggtacagtatataacataagtaattcctactacataacgcatgtcctgttagacttcaaaatcacaaactcaataccctctctgttgtgctgagcagttggcgaaacaattgaagtgggaagctttgaaccaaagattgctaccttctggattgactctggtaatcagttgtctttcactctagagtatctttgtactctcatttgcacatcttattacctttgccttcttgtactgtgcagatagtcgactgaagggtgttttccttgagagtggtagctcagaggtaataaactactggcataacttctgtcataacaaaatactacctccgtgcccaacgtttgaccgtccgtcttatttaaaaattttgaaaatatttagtcacacataaagtattattcatgttttatcatctaatagcaataaaaatactaatcataaaaaaatttctaataagacgaacggtcaaacgttgaacgtgaatagtgcaaaactgcacttattttgggacggagggagtatttgcttatttggatctttcttttctgttcctttgaacttaattctgaactgcaagttatttgactataagcagcatacctagttctgatgaaacctccaccatatttcaggaattttcgcttcttcctcaactcgctaagtctcagcccgttgtagacaaagctaagctcaaaagtgcaacctctgtcgaggatgccttagagatcgcaagaagctctctccactctggttcttctgtttagctctcaagcatctagaaaaattcagtttgtgtcctgttacatcttttaaaacaccgagacttcaacaataattctccacaatcccacggcattcgtttatgcgggattgtaaaattcttagatgtacctacgttcgcatttccaatttgaaataaacttggttgccctttgaggggtttgataaagatatgataatgaaacccatggaatgttactttctctcattctctccaaactgttgttaccggttaaagaaggggtcactgtaagtggggtcagcatcctggtagaagtttaataacgggtctgcataccatggcttgtacgaaaggacgatttcgttttctgagcagtgcttcactgatattcttgtttatgcagtttatatatatatctaacctacacaaaaccaggaattgttgtcctagtagtattctctgtactagtttatgacaaggccaagcccaaatgatcaccatgacaacgtggtggaattattcttgtgtcatttatttaatcatggctcatgtatctgataaatacttgacttctcttattctgaatcatactactgcatttttttttgttctatgaaatggtcatgtactgcatgtgagcagagttgcaaatggaataaatcgtattcatgcgaacagagtttcaaatggaagtcaggcagccaataataaatcgcattcaaatggacttcgttgggttcatacatccaacggcttcatagtttaaagaccacaattaatcagtttgcttgttctgcagcctagctttgttttctgctgattattgtaaattaagaattattaatcacctgattctgttagtacaggcacaaataacgctgtcacccgcaggacttgaactgaaattgggattcaagtttttaagttacaaaacatagtaaactcgtattttcttcctttattataaggttatataatcacacgtgcttgatatatttttattctggtgttttcacaaatattgtttctgctggataggttatgggttggatgctgatatactagtaaaagagttgatttagataagaaagaaattacagtactctacaaacaggcaattcttgcaagttaaaacatgttgatcagttcatatgcatatgatccataattcaatataccattcaatatctatggcttggttcaagagaaagtgttgtgaaatttacactccaatacctccatacatgcaaaaatatgatgtgccatgaatcttccttacattactatcattttttaaaaaaaaaatccttggaatatgcacaagaatataatctatttgaatatatgccttcgtcacatccaatcaaactcttcctggcaggaggccacaagacaatgcaggtaaaacactgactcaccattaatctccttgttgatacactatctgattagcttttcatccagatattcctcatcatattctcctaggctctaggctcagacaaatgcttccaatgcagcactggactttggtgactccttgtttggactat

SEQ ID NO: 50131 - DNA, 3332 bp, Oryza sativa
  unsure (1)..(3332): unsure at all n locations
gtatttttaggatttaagtgtattccaaaatagttgtcacaatagagtattaattgtctcatcaatcaattctcattcaaatttttttctattctacccttaaccactcttacctatatttcatttaatgagtggcatcgtaatctttttttaaaaccttaatatatgatagtaacctaaaattacaattattttagtatggaggtagtatttatttttttctttgagaaacacagtacaaacgtaaacactcacaacgtgcgtaaatgcacgcatgcacgccgtatccctattagcaccttttcggaaatttcggtctcctgatgggaactaaaaacacaatttttttaattaagaaaaaatattcatatgtttttaccggaaaatatacttttgagtccaaaaatattaatatgtggccaaaatcagttcaattgaaccttttccgtccaaaattccgagttttgtttccattgttgcctggagatatatatatttttagtggagtgccggaaatattttggatttcccacatagagccctcactacatgggtccaataggttgttaaaaattcctaatttgttcgaattcggtaaacataattgttcaaattcagccaaaacatgctcaagttcaaaaactgcagcaaaacatcattcaaaatttccgaaatttaccaaaatttcatctttttttttcttgcaataggctgcggcggagttcatcggcacgttcatcctggtcttcacggtgctgtccaccgtcgtgatggacgcgcggcacggcggcgccgagaccctcgtcggcgtggcggcgtcggcggggctggccgtcgtcgccgtcgtcctctccgtggtgcacatctcgggctcccacctcaacccggcggtgagcctcgccatggccgcgctcggccacctcccgccggcccacctcctcccctacgcggcggtgcagacggcggcctccctcgccgccgcgttcctcgccaagggcgtgtaccggccggcgcggccggccgtcatggcgaccgtgccggccgccggcgtcggcgccggcgaggcgttcgtcgtcgaggtggcgctcaccttcgtgctcgtgttcgtcatcaccgccgtcgccactgacccgagctcggcaagtgctcaatctttaatatttttcatcttttaccgtgcaattgaagagaattttggtcggataatttcaaatttggagatatttggaatttactctatttgagtaaattgcgctttgcaccaggtaaagtgcatctagtttcactgtatgaaacaaatcgaaattttatcaaattttataaaatatggatgaaactgtatgaaacgcggtctaaattaaaaaaaatcacaagtttctctcatggtttataagatttttcaatagttatatgacacaatcttgtgcaaaatggaaattattttgatatacttggtgcaaagtgaaaatctatattactaaagctaaacgggtgattgaatcgtactcacattgggagggagaaccggagatgttctagagaatacgggaaaaaaaaaacttcaggtgggcacacacctagccctgacaccccattcgcgtgcgcctgtccatggcatcgctaaccacaagcgggtccagctgaagcccaggagccccgatagccacctgggccttttgaccatagctaggtttgctagcaacctagcttacgcacacgcatgcatatatgcaatatatgagaaagaaataatgaactgaaaaacagaaatcttaagtgggagttaaaaaattagcacacgccccagttaacacccttccaaattttgtgtttacaaggaatgtcttttattccctttgagagcaatatttgacatctcctattctaatagagaactgctacatataccatgaaacctcttacgatcaacgtatgatgcatgtggcaaatgtggggcccagcatgtttccatagcccaatcatacgcatgcaagacatgatcgtaaaaaaatcgtacctattctatcgtatgcatagcaatttccattctaatattattgtcatccattcattattgttttctccgtatttaaatatatgacattgctaagatatgggcataatattaaacaatccggcactaaagaaaaactataaatactttattcttaaatattctatatgcgaccacacataaaagactattaagtacttcttccgtttcacgatgtaagtcattacattgtgaaacggagggagtagtatatacaggctataaaatagaaagcgtgtcaggcacgctaactttctagtatatattaaacctggtgcaaaatgaaacaagaatacattctacccggtgtaaagtggaatttactcaattttgtttgaatttgtgcagagcaaggagctggtggccattgcgattgctgcagcgatcatgatgaacgctctcgtcggagggtacgtacgtgagaatgacaaattaatcataattttaagctcattacatttgctttatttggatcaagaagaaatgctaataatatttgggaattattcaggccgtcgacggggccgtcgatgaacccggcgaggacgatcggggcggcggtggcgacgggcgagtacaggcaaatgtggatctacctcgtcgcgccgccgctcggcgccatcgccggagcagccacttacactctcatcaagccctaatctcatcttaatttcttctcatttcttcttgtagatggtggtgaatgtgttcttgtgtagtattaatattaaattagttgtattttttcgattgattctagtattatgaatggttggattcttacatttcagcataacattgatgagctagttagtggtgatatgataattacatgcataaccaatctcataatgcatgcatttataatcttgtggttgttatttctggagattgggaactaccagatggtgatttgtcagtgtgagagacagacaaactgatctttcaaaaccaggaaacaaaacattatcgcaacatgagaacatgagagtgttaataacaacactttgaatcgcatagattcagtgagttgcagttgtacgtttaaaagaagcagaaggatagatgtattaaacacatcaagttgctagttgatggacaacgcaaatatttccttaaaaaatagagtaaatttcacaaaactacatgttttatagtccaaattatagaaaactatatacatattgacacgtggcactcaagtacatatattttggtagtgtagttncacaaaaccacactatccatgaacagattcacatgtaagatgacataattg

SEQ ID NO: 50132 - DNA, 5119 bp, Oryza sativa
gtgcgatggctggtaataggatgccacgttcttgttctaagtggaacacccacgtcatatcacggctgaatccattaattgatagtgtggttttgtgaaactatactaccaaaatatacgtacttaagcgccaagtgtcaaagtgtgtgtggttttctacaatttggaccacaaaacatatagttttgtgaaatttactctaaaaaaatgaatgtacaaatatcagaccaacccaaaattaaaattacattggtggcatctgcactacagcatttcctaacatgccacttggtcatgaataaaaagaatttgatgtatttacatttggctgaaattcatcgatcggtaagttccaagaaccatggaactcctgctgcaaaagtactccctccgtcccagaatataagaagttttagggttgggtatgattattaagaaagtaggcttcttatagggttggatacgattattaagaaagtaagtagaaatgagtggtagagggttatgattggatgagtagtggaggtaggtgtaaaaagtgaatgatggaggatggtgatggatggtgattgattagaaagagaatgttgatggacaatttgttatattttgggacaaatcctgagggctaaaagttattatattttgagacagagggagtacatcgtttcggttagtcacaagtatatatatatacagacatatatgtacctagaagaaataaatttagtaatttgcatgaatctctccataatttttgttctacgtgtttgtaactaaagtttattccaacatatgccccagtgccagcaattgatttgatggcaaccctgttgctctcgcttggctccattgtcggcacaccaactgctgcaacactaccattgctttccttctcttccctactcatctcaaaggccatgagcaatgtctgaatttccgaacttggatcagtggtgtggttgatgtttggatgaacagcacggtgcagtgaactgtactatatactgttatatgacactgttgattttcgcacaaacgtttgacccattcgtattattaaaaaatttagtacaaatatgttaaagtataagttaggattatactctatttaatgataaaataagtcactacaaaataaattatatttatataattttattaataagaccaatgattaaacgttatgtaaaaagttaacggcatcatacattttaaaatgcacggagtatatttgtgccttgacttccgcgcactaagagcgagccgtgtgtggcatgcatggtgctaactgttaatagttgataccatcaaagatcagaatttgcagcggcaggcagacaccggctccggatcatcgtctgtctgcaattctgcatccatggtttttggaaaggcaggatttggcaaggtcaacgcatgcatcctcttggccttgagttcttgcatagaagcttcaagctgctgctggaaaattatccctctaacagcaaggtttaactaataattatggttgtatcaactctctaatccagctttggtttgcagggattgatcaattaatataacaagatcaaaagagaaaaattaacacgttttttctgctaaaccaacaggtcaaacaatctcatctacagctaactgcagaatattaattcaaacgttaatcaattaattctgtcttaaccagagatcaattcagagctgacgacaacacacaagaagaaatactataattatttgacagatatactacaacaactggtgcttctcatttggtgctcgaatactcgagaagagggtaagttgacattttaatttgaacaattaattaattaattaattatatacttaactaatcacattgctcttcttccccgcggcatcccaattccatttccgcttttccgaaatccatggatagattgattcagcaggtgcttcggcggccacagcctccccgtgcaaattttcagagttcattggtttcaaagattcaaatcttttttttgcgcatgcgtacaccgagctgtatttcataggcctatatatacagcatccctcatgcagcatgccatgctcatctcatccaagattcagacaaaaacattcttttgtctacaacaagatcaagaaacccaaaagctaagcattagctcatccatcttaatccatcagagttgattagctagtagttgagagttgattagtagcttgcctttgaacatggaagggggcaagatgagcagcatgggcatggatgctgcttcagcttctgttactgtccctcccatgcagatgcaggcaggtgatcagagcaacaggatcgccatcatcatctctccaagagccgggagctccaagatcctgccattcgagcttgtcaatggtgccgccaatgccggctcgcaacggcacgctgatccagcagaatccactcctgaagctcatcatcatctatggcatccagtagacctcccaaagataaaaccaccagttcctcttgtcaagaaggtactgaaactttgacagaaaacatttcttcagttcagagtatttatgttcttcagatgaagaagctctgaatttgtgacaatattgttgcttcaactttcaggtgggtgcagagttctttggcacattcacactgatcttcacagtgctgtccaccatcatcatggatgaacaacacaaaggtgtagagtccctcctcggcatcgcgacatcggcaggattagcagtgacagtactggttctgtcactcatccacatttcaggctgccacctgaacccggctgtcagcattgccatgactgtctttggtcatcttcctcctgctcatcttcttccttacattgctgcacaaatcctcggctcgatcaccgcatcgttcgccgtcaaagggatgtatcatccggtgaaccccgggattgtgacggtgccaaaggttgggacagtggaagcattcttcctggagtttgttacaacgtttgtcctactgttcatcatcactgctcttgccactgaccccaatgcagtaagtaaatttcctagctacttttatcacattttattcctttttcttgtatctctttgtctgaatttatgttgtgctcgtgtgctgatgatgttcaaataatgtttgttcaggttaaagagctgatagcagtggcagtcggagcaacaatcatgatgaacgctcttgtcgcagggtatgtacacatagatcgattattattcagaaatgatccgcatactaaacatgcagttgttttctaaaaaaatattaaacatgcagttgaacacttgttaaactttttttttaaaattaataaaaacacttgttaaagtagccgtgctaattaattaggttggctcatttttctctttttgtatagttaattcctaagcttaattgtttctgttttgaatatttttggaacaggccatcgacaggagcatcaatgaatccagcaagaacacttggcccggccattgcaacagggagatacacacagatttgggtttatttggttgctaccccacttggtgctgtagctggagaagggttttattttgcaatcaagctgtagttaccttcaggcaagaacaatattcaatcgtagaactagtgtaaaatcggtgtgtgtgtatttgtatgtgcagttataacataaaaaaatgttttcctttttgcagggaaaaaaaagtgatcattggagcatgttaaactacctgaacttaaatacagcacattctttacaaattcatgatattgatcaagcagcatgttaggactgcctaagatgtagatgtatacacaaagtagtagtgatgatgaattggtggtctctcttgtactgaaattgtacagttcattttttttcattttaatgtataaataataaaatatatacagttcaatttgaattgctagtattcatattcctccagtggtgggcagtttatgttttgaaatgtactccctttctctaaaaatataatgtgtgtatgcttttattaaaaatcagcatctgcaacttttgattagtgatcgaactaacaaaatgtttggtgccgcgcatactattggatttttgtacgacattaattccgcaattgtcaatgatccaagaattacaatgttacaggccctactaaaagctaatacgtcttatatttggagaaggaggaagcatcgaatggggtgggcccacttcaattcatgggtattcaaatgaatacccaagatttttgcacaaaaaatacatatatgaagtatatattccatatgcatatatgaaaaaaagggaaaaaggcctacctattcaaaagaagcccaactaaaaacgatttctatccctcccaccatctttctccccactatttcaggcccattggccaaataaagaaaagcccaaacatctaaccctatctctccacctcaccaccatccaactctcccctcccccgtgacagccgccaggctgaggcgtcagccgcccgactgcccggaggagacgacgcgccggcgcgccgccactcgctggtccgcgctccgccgccggcccgcccgaggagacgacgtgccggctgcctctgccctccagcctccagcagtccagccgtcggccgccgcgtaggcgcgcacggcgccgtcggcgccttggcggctcgggcgctcggcgcatccggcatccccctgcggcgcccgtctccatgctccagccgccgccgcccgccggtgcggcgccgcggcgacgagttgccgcctggcgcctgcctgcctgcctacgctccaccgaggcaccgaccacggcagcctgccagcccgcaatcgcaggggcgcagggcgccgcgccgcgtcgccgccaccggccaccgacctgccgttgccgtcgacgacgaggtgacgaagtcggtacctcactgagacaatgactcactaactcttccctagttggctaagtaggaactttggattagaaatttatgatttaattcatacttgaatgactgaatgtctgaatctagcatggatattgttcatacatttttgatttaaaatttgaatctaggaatgatttatggttatcaactgaaccgctatattagtgat

SEQ ID NO: 50133 - DNA, 6998 bp, Oryza sativa
accaaacaccctgaaaagggattcactttaatccgactcatcccgttgctccaaccagacacatgcttagttgtgtgaacaataacttttgatcttgtagatgtgtcaaattaatggcaaaaccaactggtaacgtcctattctattagctagttccattttatgagaaatgggcaacttagatccttcttgttttcctctacgacaagagaggaaattcaaaggatttcaatccttgcgaaatattttcaatgaggtccttgcaataaaggaataaaatcatatggattggttttctaggccttcattccataggaaacaaatatgagattcgtgctcatgttttcattcccttatatagaaacgcaatgcactttctctctctctctctctatgctcagtgtaaatcctctaagattctttgtgttctattttagtacgaactattcaaattaagacattgcttacaaaaattcatgtgttttagaatccggtaggactctactgtgtatgacatcttatctctacggtttttttcatgtgttccaaaggagcagcatttatctaaagctagcttgcaggtacttcctctatccacattagttttccatatgattccaggtacacgtgcgtaattgaaggtgtgttcaagttaaaatatttgagttcaattgtgagttttgaggttatttttgtctagattaaccccacggcaacaaaagtcgacaactgtggtattttgtcaaagaaatgaacacacatcttaatcttgtgatatactccagttccagctaaaccaatggttttttccttcaaacttagccggagagagagagagagagagaatatttgtaatatttcttcaaacttatgcagaatttcagcggctgccggagctaaaccatggcttttttctgcgaattgatgaaaaattgcgaccaattcacgcgatgacataaaggggaggaaaagattagcgctgaccactgagctattaatgcatgccttgcaaagacgagtaattaattaacacggctaaattatttattaccgcgcgttgtaaatcaattaatatatatacttgcttctcgtacacatctagtagtaccaagccacagaattcgattggtttaactaaattaattaatagtagaaattgaattgtatgtgtcatacatttactatcaagtaactactccctccatactcgtaaaagaagttgtttaggacaatatttaagtcaaaccttagaaatataaatcataaataactctaagttgttgagtttgaaaatataaaaatcatatgaatagatttgtcttgaaaaatactttcacaagaagtatacatatatcacttttcaataaatatttttatagaaacaaaaagtcaaagttatattttggagactgtgtcgctgtccaaaacgacttcctttaccagtacgaagggtgtactacaaattaagtaaaagagcttattttcatatatctgctgagaacatcagctaatccactcattaattctgatcgtacagttttgagagacatgcattgcatgtaatcaagcatgcattaagtcaaatgcccgtgcgctacagtagattcagaagaaatatatatcattggttttaaacttaaaagggcaggaaagtcgcacatagtataaaataaaatactagctccatctattttatattataagtcgttttgatttttttctaattaattttttaagtgatcaaataaataaaaatatatagcaatatatttgacacaaaacaaacatattatcaaaatatgaacagaggaagtaatatattgataggcaagctccttgttgtaaccaaggttaggggatggtcactacatagtacaaaatagattttcgtggacacttcgctctgaactacaccggcggcctaaaagcacaatagcatgtataatacacgggggatgtgcacggttaaaagaagatctattacaggcagttacatataaaaataaacatatttacacatacggctatcatagtgcgcccgtgtatatagtgtaagtaaaatcttggcattaatttcaattggcattttagactttctatagcatttgaaaaacccttggagcgatcaggatcggacaatgtgagtatgacacccccacttcatactacttgtgttaggtacgttcatggttgattgctgatctctcaagtggcatgtatatgtcatctgcatttgacatgccgcagctcagatcaaacttaaaaacagctattgtacccattgtatacatgactggagtagctgttgctttgacagaagagaggtacatggttgacatggctgctagcaatatacattgctcttcttcccctgccacatcatccggtttccgcttttcaaaaatccgtgaaaatatacatgtattatctaaaaaatagataaaatgattacatttaattcgatcggcagcagcagcttcggtggctatcacctccgtcgctgcaaattagtccactggttttaaatcaaatatatacaatttaacgcacatgtgaaaaccgggccgcattggagatgcatgcctatacgccttttttaataataataataataataataataatagaaataggttatatcttcggtcttgccattatagaggtacatggttgacatggctgctagtaaaaatatacattggtcttcttccccagcggcatcatcccgtttccgcttttcaaaaatccataaaaatatacatatattatctaaaaattagataaaataattatgtttaattcgataggtggtagcagcttcagcgccatcaccttcgctgctgcaaattagtccactggtttcaaatcaaatatatacaatttaacacgcatgtgaaaatcaggctgtattggagatgcctgtacgccttttttaataataataaaatgagttatatcttcggtctttacccgttagacacactgtcatccagaggcctatatatacagagcacctatcacactgcatgccatgctcctcatccaaagttcagacaaccagaaaattaaccaagaattgctctgcctatagcaagatctagtagcaaagcttgactctgagctcaggaggaagaagatggaagggcacaagagtggcatggaagctgtagcagttgccatccctcccttgcacactggtgagagcaaccacaggattgacagcaatgtcagctcgcaatgccatgctgatcctgcagagctctctgatgaaactcagcagcaatctctgtggcatctaggcctaagaaagataataccatcatctgttcctctcctcaagaaggtacacactttttttaccccatattttcacctctcatcgtctgttttttgtcttatcagttgtgaccaaaatttgaattttaaaatataattttagagtaaattttgaggtttatttttcagtactgacttttaaactgctaaaaacataggtattataaaagttttgcccataaataatgtttggttaaacgttgttataaaagtttatttttccacactttattggccatagattaaacaataagagcaaaattcttgaacttcctcatcctctttctcttcttcttcagaaaatgtacagatatctgacagacaacaacctttttcccccgtaatctttttcttcagatgaatctctgaaatgtttcaggtcagtgctgagttctttggcacattcatactgatcttcaccgtgctatcaaccatcatcatggatgaacaacacaaaagtatcgagacgctcctcggaatcgcaacatctgcaggcttagcagtcactgttctagttctgtccctcatccacatatcaggatgccatctgaaccctgcaatcagcatcgccatggccgtctttggtcacctcccttctgctcatcttctaccttacatttcttcacaaattctcggggccgtcgccgcctccttcgccgtcaaaggtctgtatcatccggtgaaccccgggattgtcaccgtgccaaatgtcggcacggttgaggcgtttttcgtcgagttcataataacattttttctactgttcatcatcactgctcttgccactgatcctaatgcagtaagtgtggttttctgatgtattttgatcagtttggttttcttttctttgaaatgtttgattcaaattttgtccttttgatcaaaatcttcatcaggtgaaagaactgatagcagtggcagttggggcaacagtcatgatgaacattcttgtggcagggtatgtgcgtatggattgattaggaacaatacatagctttcctgggtattttaaactgtcatgtaatactatttgtgttgtattttacaaaatataatttagatttgaataatttgaacaggccatcaacaggagcatcgatgaatccggcgcgtacaattggcgcggctattgccacagggagatatactcagatttgggtttacttggtggcaactccactgggtgctatagctggaactggggcttatgttgcaattaagctgtagtttacaccaggtaaagtaaaacaatattgtaaaggaaatcaaaacatttatcatattgtgatatatgaccattacattttaaataagtaataactctgtctttttacaggtaacttgtgactctttgagcatgctgatataaccatttcgccagaatgtaaataaacaaaattctactagctccatgatcaagtatagacactgtaattacttctaatagctgtttttttactatctccgtgaccaaaatgtcaataattacttgtaatagctgtttttactagctccaagaccaaaatgtcaataattacttgtaatagctgtttttagctatggtaagaagaacacttcagtgtagatacccaataaagtgtgatttctccaagtccatcaattctacaaactaaatcacttctatgaaaagaacaattgaatcactccgaggtctctgagcaaaacaaccctcattaagatatacatttttttcctgacagcatcaagttacagcggcaaattggatctcacaactacttttctatatgaacaattatgaaattaagcagaacaaggtacaagattacttttattaataaagacagagttcaaggggaatgaatcccagtacatcgccgaacagatgttatgtggcactaaaccatccttagataggaaactgaggataggaaccagacttcctaaggaaaccaagcagcaagggagaagcagatccacagggagcccgcgacgactacatccttgagcctcttttaacgtgcacaccgcttgacaaaccggtaatacccttcggctgcctctacgggaacggaattgctaattagtagcatgatcagcaagagaagccaatgaccgttcgggtgccatcgccatcgttgaggtcctagctcgttcaagctgaacccgtgacggcggcggcggctgatcgcagcgatcgccttggacggccgcttcatggcaacggtgagacggccgtctcgcagaaggagcgcaaccttgtctcgctctccttggtttgctcggtgggagacgggaactcggtgttgttctgggaagattgttggctgcagggcgcttcaattcggtcgctggcactggctgtttgggcggctgtcccagggcggttgcggggcaaacgcacggtgtctgaggcgctacacgacaggagatagattcgtgatatctcctcggcgttagggatgcaagcgatccttgaatacttcaagctctgggagctcctccgatcggtgcagctgtctaacgagccggacaagctttcttggtgttgggagaactcggggtagtactcctcccgctcggcttatcgggttctcttcttggggagaactcaattccaacacaagccaatctggaagtctttcgcccctcctcgatgccgttacttcctctggctggtcgctctcaaccgatgctggacggcggaccgccttcgaagccgaggtctgtcgcacccggatcgttgcccccactgcgatcaatgcgacgaaacgattgatcatctcctggtcgcatgcccggactctcggcagctttggtggattgctcttactgctatcggtcattctgaatgtctacctctcaatgagcagttctttcatgcctgttgtgtgacagtcgcaaaaggatgattaaagaccatcgccgagggttcgacacaattgcggcactggtagcatggacaatctggaaggaaaggaacaaccgggtcttcaaccagaagatcagaccttggatggagatagctagggctatgagggggaagcggacctctggcggatggctagatcagccataccgaccatgacagtcccttcgcttgttctttggtcgccaaatcattcgagagattaggcttctacttttctcttcccctctcctgtaccctgtccctttctttttatttttcagtcccgttctgtaaatacatttattcctcttaatacaaaaatacgcgtctcgcgacggtgaactcgagcatcttctcggtgaggtcgacctcgtcgccggcgacctcgcgccagtcgaactcccagacgaggttggcgacgaagtactcgaggtggagcagcgccagcgccatgccggggcacaccctccgcccggcgccgaacggcatcatctttatctccttgctgccggtgaggtccacgtcctcgccctcgccgccggcgaggaaccgctccggccggaacacctccggcgaggtccacacctcgctgtcgagcccgatctccctcaccgcgaagttcaccggcgtgttcgccggcacgcggtacccgtccagcgtcgtctcgtcttccacggcgcgcgggagcgcgtagaggccgggcgaatgtcgccggagaccttccagcaccaccgccttgaggtacggcatcgcctggagatcctcctctcgc

SEQ ID NO: 50134 - DNA, 14470 bp, Oryza sativa
gaggtcgcggtgcatcgcctcgatcgccctcacccgcgcgtcgccggggcggtcgccgaagcacatgtgcaacaggaggcagagcatcgcgtaccggaagggctccatcacggtcaccggagcaccgccctcgccgcggacgtgggagacgagggcatcgagcacacagcgtcgcgcgccggagaacgcgcggaggcgggccggccggagggccgtccaggtggggccatacggacgccgggctgacggcgcgggggcgcgacgcgaacgccgccccgcgctgcaccagcgcgcggtacgccgcgccacgcgccgccacgaagatcgtcggccccagcggcgcgaacgtgaacaccgggccgtgctccgccgcgatccgccgcagcgtcggctcgacgtcgatgtccctccgcgcgaggaacagcagcgggcccagcaccggcaccgtcctcggccccggcggcagcggcgccgccgccgccgaggcgcgggcgcgcagcagcagcgagcacgcgaggcagagcagcgaggtgagggagtagaagagccagtcctccatggctaaacctctcggattatttttttccactcccgctgctcacagtggagggatatttatacgggagggggaaaaaagttcggcgggaaatctaaatcgagagagctatctcggttttgtgttattgcacgacgcgtctggtagccgtacgtcttcgtgctatcggagagacagacttgctttcactgcaatggcaacacaccaccgaccacatattatatttcactttcatttatatcatcatgttctactcaaaatatactatagacgagtccaatattgaatatatgcaaacacttaaagagtttacttaatttaaaagtaatttatttaaattgtagaaataatttagctttgcaatagaagtaactacctatagcatcggaaatagttatcctaaccaatcagttaataatgactgagatacgaacacatggatgttgtactgacaaagaaacatggaaacgagaccacttgtcagaaaaagaggacaacatgctaattgttagttgtcgtgtcgattcacgtgtatgctaccaaggctaacaacactaatatattttctttttttatagaacctttgatggtctatatttttttaagaccgtatgttatttttatgatctgtttgaaccatcatactatacttgaaacatgtgataaatgagtccaatattgaatatatttaatttttttttcttaattcctctataagtgtagttacttctaataatatgaaaagttacatccttatagcagtgtagttatttctaacgacgtgaagaactaattctctctagcagtacagttacttctaatatcttaaagagttattttaattttattttttatagttacttctctctagaagtgtgtttacttctaatattatgaagagttacttctattactttaaaagttgcttccctctaatagtgtagttagttttaatatcatgaagagttaccttctatatgacgcaagattttattttttaaataatatagtgattagtttaaataaagaatatatatatttacttgaaaatatcttctctacattgtgcttgtggatttactccacatagtttcttatttcaactcatcatgatgtaattacttctaatgctctaaatagttactcctattgcatagctaagttacttttgcaattttaatgaactacttttagatcaataaaatgtttgaatatattcaacattgaacttgttttatcacatattttaagcagagtacaatggtaaaaaaatatcttaaatataatataaggtttaaaagatacactagtgaccgatctatattagtggcaaagaagtatttatacatcacatgggataaagtggtcgatggtttaaccaaaccagcgaccgtgcactgggtagtcgtatctaaaaaagtctattccttttttataggcccaaaagaatatatttatccatgctgacattaccactaccagaaattggagtgtaaaatacaccaaaattctactactccatgatcaagtttagatacccaataatgtgtcaataattacttttaatgctaccttccatctcaaaatataagtaatttttagctataaatttagacacacttttatttagataaataattaaaaattattttattttatttgtatagctgtttttagttatggtaacaagaattcttcattgtgcatacctaataaagtgcattttctcttcttttattgtgatacaaagatatgttaatgtaaatgcaatttttccatgtctcatcacatatctattttcagtaattatatcggtggcatcagcaaatgtttaacattaactagatgaataccccgcggcgttgctgcgaaaaattaatttgcataatatgtacaaataaaaagtaatttgattattaaaactaaaacaaatttgaaacaattttgggcccaaaaataattgatattgcatgtttttatgagagaagaaagaagagacaattaagaccatagatctatcatctaaaggctagaaataattgaggtgatgtggcttaatgatagaagagaaaaataacattaactatatttagtgaggatgaactatatatacttatatagatacacccattatcttgtacccacgtctgaatatggacagctgtcaggttcaaaaaaaattttagtacacgtgaatcagaaaatacagaaatagaaaaaacatataaatagaatattatgcattgttgaatcctaaaaaaatattaagatgatccaaaatacaacaaaatataaagttatatggccgaaagtaaaaaaaaaataatcgataggtggtcaaagaaaaattttacaacaaaatatggcccaaagtgtaattcactaaaaacaatcatacagtatatacttcttccgttctaaaatataatcatctctaatattcgaaattcatctaagaacttctctactcattcaacttagtcaattataatcatctctcagttgcttctccagttaattgctcatctcagctaatcaaaaccatttttgatttaatttcaactatctccttattctctgtttctatgaaaaatacatatgctttgggaccgattaaaggagtagttagcaggtaaaacatataaatttcttgcatgactcgtgatgttgtttcttgccttgttaaacagtcaaataataagggtggttgccgggcaaaagcccagtcttggctcttttgaaaccctgacggacggcagcggcagttttcctgtcgcttctctccttggagacgttgtttaagcatccccttgccgaaacctctcgaacgattgatgcaagcacgctctaggatagagttgggctttgtgttggttgtaagggtgtttttttggcgatctcgtctatgttcctttgttgccctagcggtggtaggtcacacttagcggcggctggtccggtgctagccttctcccggacctgtgtattggcgctgtttgtgtgtgggtggtggtatttttttcctttttcctggttacgatcttccagggttgtaatcttgtaattttttttagctctatcaatagaacatcgttaaaaagaaagtcaaataatggaaaacagtagtgcaatatctgcaaatatctcttattgggtcggattttccaaagacattgtctattttttgcgaataaagtcaagtatttccccaatgcattcatgcgatagatagataactggtctgtggtcacaccactcaccacatcaaacgtgaccgtgatatacaaccgaagtatataaattacgcaaaattctcaggagggtccaatatttcccaggataatctcactgtcagaaaatcaaaacattggtgaattttatcttaatttttttttgcggggagaattttagcttaattttaaacaacaaatttcaaccatttttttaaaatataaattaatcctttttttgtccgtttccacaatttctcggtgggggcataaaaaaagatggcagatatcctcggaatcctaatgacaaacatatgacatatgacatgagaaaggttgtcgtaggctcgtcctccctccgtcgtgattgtgagtttttcaaagtttgactggccgttttattaaaagaaaaattgtcattagtatttgtattgttactaaatgataaaacataaatagtactttagtactttatatgtgacttatttttaaattgtttcataaacttttcaaataatacggacgatcaaacgttagacacgaaaacttactatcaaacttaaaacgcaacggagggagtagctttcttttctttcttcttttttcttttgacatgaatgttcatttgttgttaatttccctttcaacactgttgattccaacgtcaaatcaccatcatttttggagtcctctactctacccgtcatcaaacatgtcaccacattcattaatcataatcatcagtacaaatgctaattagctatgctcattattcattgagaggtgcagtacagtccatactgacaaacgcgttaactacgtaaggttgtggggtagtcagcctgggtacgaaacattaccctttttatttatttgatattagattattctctaatatttatgtttttttttcagtcagtccataaccataccatgcaagtgcaacaaatatttccccatgtattttttaattcgtgttttttttcagtcagtacataaccattttttagtcagtccataaccatactccttccatcccattttaaatgcagccatgaattttttttatccaacgttgatcatatgtcttatttgaaaactttttgaaaatattaaaaaaacataagtcacacaaaatattatttatcttttatcatctaataacaatataaatactaatcataaaaaaatttcaaataagacggacgatcaaagtttgacatggaaactcatgactgcacttaaaatcggacggagggagtcccatgcaaatgcaacaatattttctgcatgcattttttaatggttttttacggtgatatttacgaagacaacagctattccatccttcacgttcttattatcagcaccatggaattctttttggctcattgttcacaaattttaaaacttaatttagaattgatttaaggtattttgtcgtagtttatttttcagcattcgtagtttttagatagctaaaaaatttaccaataacttatttcgtgagttctataagccgtttttatggcctaccagatttacgtgaaacgatttaactaagaagctatgcactctttctattttcttttacattatatcggttcaatttttaactaaccagcaacagaaaaaaaaacagagaacccctcttctgtttttctccgggcatacttatgtgatgttgcggcattaatcgaatttgatttttcttgttctattttagagcattacttattatttttgaacaaaaatgctcagtacttattattgtgtcatctgatcacttattgcctttttttttctttcaccaatctggtgactttcttggcaggtgactaatacccaggtaattaaagttataataaaagtaaattatccggttaaaaaattaacagccacataatccaaccttacctacgtgttcatgactccaacactcactaccggccactagctacacaccaaaaaaaaaaaaatccccgtgaaattattcacccccaaaaatatcccagccacccacttcctaccagcatccaaacattctagccaggaacaaaatggataaacaaattattttcccaataaaaaaaggaataaaactttttttccctcccgtataaatatccctccactgtgagcagtgggaatgggaaaaaaatccgagaggtttagccatggaggattggctcttctactccctcacctcgctgctctgcctcgcgtgctcgctgctgctgcgcgcccgcgcctcggcggcgagccccaaggcggcggcggcggaggcggcgccgctgccgccggggccgaggacggtgcctgtgctgggcccgctgctgttcctcgcgcggagggacttcgacgtcgagccgacgctgcggcggatcgcggcggagcacgggccggtgttcacgttcgcgccgctggggccgtcgcggccgacgatcttcgtggcggcgcgcggcgcggcgcaccgcgcgctggtgcagcgcggggcggcgttcgcgtcgcgcccccgcggcggcggcggcccggcgtccgcgctgctctccagcggcggccggaacgtgagctcggcgccgtatggccccacgtggagggccctccggcgatgcatctcctccggcgtgctcaacccggcccgcctccgcgcgttctccgacgcgcggcgctgggtgctcgacgtgctcatctcccacgtccgcggcgagggcggtgcgccggtgaccgtgatggagccgttccagtacgcgatgttctgcctcctggtgtacatgtgcttcggcgaccgccccggcgacgcgcgggtgagggagatcgaggcgctgcagcgcgacctcctcggcaacttcctcagcttccaggtcttcgccttcctcccgccgatcaccaagctcgtgttccgggagcggtggaacaagctggtgtcgctgcggcggcggcaggaggagctcttcgtcccgctcatacgcgccaggagggaggccggcgccggcggcgactgctacgtggactccctcgtgaacctcaccatcccggaggacggcgggcgggggctcaccgacggcgagattgtcagcctctgctccgagttcatgagcgccggcaccgacaccacggccaccgcgttgcagtggatactggccaacctcgtcaagaacccggcgatgcaggacaggctcagggaggagatcgccgccgccgtgggcagcgacggcgaggtgcgggaggaggatctccaggcgatgccgtacctcaaggcggtggtgctggaaggtctccggcgacatccacccggccactacgtgctcccgcacgccgtggaagacgagacgacgctggacgggtaccgcgtgccggcgaacacgccgatgaacttcgcggtgggcgagatcgggctcgacggcgaggtgtgggcctcgccggaggtgttccggccggagcggttcctccccggcggcgagggcgaggacgtggacctcaccggcagcaaggagatcaagatgatgccgttcggcgccgggcggagggtgtgccccggcatggcgctggcgctgctccacctcgagtacttcgtcgccaacctcgtctgggagttcgactggcgcgaggtcgccggcgatgaggtcgacctcaccgagaagctcgagttcaccgtcgtcatgaagcggccgctcaaggcgaccgccgtgccgctgcgcggcgaccgatcggccgccgtcgagtgaacaaaggcctcaacgacggcgacggcggccggcgttttctctgaatgttgtagcatggcaattaggaagagaacaagagtaggtcatggcttctctttgctaatcatgctactaattacttcctccgttttacaatgtaagtcattctggcatttctcatattcatattgatgctaacgaatctagacatatatatctatctagattcattaacattaatatgaatatgggaaatgttagaatgacttacattgtgaaactggaggaagtagcaattaaaaatggtgattagatttaagttcctcttgttcttttggggtattagtagactgaactaatgctgtgctagtgcctatatgtacaaattactatggggagaacagtttggtacttctttctcataatcttgtactttgttgagcttaattacttaattgctaatagcaatctggttgtgttgttgagcttagttacttaattggtaatagcaatctggttgtgagatcccattcgccactattaacatgatgccgtcaagaaaatctaaaagaaacatcgtgcctttcatagcacagtctgcaaatgagtgaatagtgattagctattgcaggtttgtaattatcaggtaaataaatctgcaggaaccttcagacatgcagatttgttcatctgcagaaagatataaccaacctgcagtagttaatcacaaaattgatctggagggattggttgtagacgaacaccacatcaatgtgatgtgttctgaagattgctgcaaacaaaggttactgtccctgaacttgacaactattcatactcagatactggtactgcaaaattaaggatattcatttgctgatgccaccgacatgattaccgaaaatagatgtgaagagacatggaaaaaaaatgcatgatcaatagttcaggctattctacagtacattgatgatctctgtgccttggcaataaataaatcaacggcaaacagagtatggcaatttacagcgttccctaataggcagataaattatgtacctcatcatgattacaagctctgcttcataaacagttaccatctgaagttctggaagtgcatcaagtaagcatgtataggatacaacatggcatggtatgtgctctagcaaatgtactaggttgcaccagctagaaccacctcactctttattatcatcagcttcttcagactgtctaagccattcttgtagtttgagttcttgttcttccttgaacttgttataattctccaccgatttggagatatcagtcgaagagctctccttcatagtagctgtattgttatctaaaagctggcttgaaacaggaagatcatccttctctgtatctgagggtgtcgatgcaccatgtccaccagcttgtgatgattcaggagctgcagatgactctgactcctcagtggtgtcatcttttgttccgaaatcaggctgtggccatctgagagtggatgccttctgcttcgcagtgttgaacatggaagagaaataattacggctgcttcctccgtcggttgtgcccaaatcttcttcccatgttcctgagcttttccctgattggaacccccaagtggggttctggattaacctgagtgtagtgattttttctcagaaccaatgacggaagatgaactatatgcatagaaattatactttacgggaagggcctgggatgatcaagccagagctgtagagtggtctgttagttactaagtttagaagctataaaaaaacttgaacgttagtggaaagaacaggcactatcagagaggcttgaacaactttatctttatcttactaattatatataacatgttctgctgtcatgcttcatacttcatgaaaaaaaggaaaaccaaaaggtcattgttctataaaggatggtatgaatgaagctatttgggtatagcactgtattaaacaaacaaaaaagttagaaaacatgtaatgcaaaggaggttgtcaagataggtagaatacgaaccccctctttggttgggtctttgacattatcttgagagatttatttatgtccttgatcatatcatcagcaattggaagtccaaactctgccatggacctcactgcacagatagagtcctctatatcttcagtatgcaatgttacctcatgaatcttttctgcaacctttccctgatgagggaacagggctcatgttagaataccacaaaatcatatcgttaggcagataactttgatatttcctaataagtggtgaccactggcaggaacaaatgaaattgtcaaacagctgagaaattactaattattagtaggtatcagcttattttcaaacttaaaactgcttgaaggaatgcaatattgtacaggaccagaaaaaatctgaatggtaaataacgagcattgtcagttgagaacaaagtttcagcctttcaggtataccgtgttcatctgttcttccatgtttttgtaagagcttccctttaattgttgtacaatgtattggtaaaaaacctgtttcacacaaataatatgacctgcgatcccaacctgacccttgactgaaaacaaataaaaatcaaattttagatgcttaactggtttacaccgcatcagcttctgccaatgctaatcagaatatttattagctctggacttgttatcatgttggaaggtgtaggaggtggtctgtcaaaatctgaaagaagccactataacttgataatacaagatgcacgcacagaagttgataaatgaaattccctgaagttcccttgggtgatggattatatggtgacatgttcaaaaaaaaaaaattctgactctgaagactcaaaattgggtatataacaaatcagctggatccctttaataatgcaactaacacactgtaacaatagttatgccccctaaccaagtgtttaatgtgttgttgctctacttttctcttaatcaagcatctctgaatttcataccaatcacaattctgagataaggccgcgctgatgatagatcagtataacatttcaatcccaacgcgcaacgcagcatgtgcaaaagaatcaaatgccctataccggtagaacattaaggacaaggaggagatagagataggaaggccatggaccttgacgtcgaggaggaggggcatggacgcctgcgcgtgctgctggacgaagtagagcccgacggagggctcgttggccacgtacttgatcatctcgtccaccccgtccttcactgcaaatccccccaagataataaacaccggaatcagatcgctacgcaactgcaggcgaggtgttcgacggaattcctccaaagaatcaggagcaagaacagcaagaaagaaacaagcaggccggcccgcccgggatcgttaccgcagaggaagccgtcggccggtgagagcggcgaaggcgacgcggcggaggaggagatggaggagaggttgcgctgcatgtccgtgtccgccgcagagcgcggcgggcgaccatcacggaatcaccccgccccccacgacaccaccaggagctcggattcgccgccgccgccaccgctcaccggagggagaggaggaggaggaggagaattcaagcaagggaatctctcgcagtagaggggatcgagagagaggaggaggagaaatcgagcgagcgcgatgacgaacaaggacgaggcgagaggcgagagctggagaaggaagaagggtgggtgggttcagaaaattcagatgaagggtggagatttatttatttggtaaaagaaaatagtaggattagagcgagtaaaataatataatatatgatgtaagcggtttatatatattgccacatcatatttatgcttatgtggataagatagaagaggagagagaaaaaagcggactacaagttcgtagccggctacaacacgaaatccaataacctatgtgagagaaatgtgaggaaaacattaatgatgcagtatgtatttataattaaatattatattagtaggctattaagttagctagtatacatgatgtgttaattttaagagctaataattagctatattattaaactcgctcttaggaaacaacaatgtatggattggaagtacttcgtcgtccatgaatactcgttggttttgacaaatggtgtatgaactttgctcgttcaattttaaacgatattagagcaggtcgttttaaataacatatggaacattgtagatataatgtacatatatggcatgaggatatatgtagatgttatttttaaaagttggacaccaagaaaagacttggtatcaatggttttaagaagataagcaaatattcctagtgagcatgttcgaggagaattgaacccggacgaatggggtgcatgacagcaacccctgtcactacgctatgagcgtatctgtagatgttattttttaagtttcaactagcattgtttgcatagttttaatagtcgaagcaagagttctatctagtaataaagttgatggacgaaaattaaaacctcatgaaaagttgagagaagaaatataaactttttcgttagttgaaaatagtgtcttttgcgtttttccccctcagaaacgtataggagagagctgtctattttgcgttcacatagagagaaaatcatgtactatacgtaacagcatgacgtgccaggtaatccatgtaaacttttttatgcctaatcacagaaatttctggactaaaacagatgcccaattttgtctggaccgatcagaagctctcatcatcaggtattcaggtccctgatgtgccgtcagtttacaccatgatcaactttagcattatattgccgccaagtaaacgctagcatgatgtagttttcatcttgtaatcagcatcaagtgcatctctctatacacagccatgcatatacccccatttgattccataaaacattcccattcagtttcatgtaattcagatttatgtacaatttgattgcattcaatgtacaattttctgaatacccccatcttctctgcatttgattccattcagtttacatttttttccagacgagaatgggacacacataacaatttctgcatttgaatgtaatatgtacagggtaatggagtatgcctaatttttacaacagatgtgggggcacacaagaaagccccagtcagggtcatgataacatggagaatagctacctgagcctgatcatcgtttcaacgaattgcaacacaatggtggactaatatattaaccccaactaatgaagatatcctttttggagtttcgacgacagtgcagctgcatcaagttccactggtaggagattcaagaaaatctgcagaggattataatcatatttcattatatccctaagcacgagaaaacgttatctacaacctctctaaaatgtaactctgataatggcaacatatagggatattattgatcattgggtaacctaacatcattagcatagataatggtagtggaataaactgttcataactagtaagtagtcaataaatctccttctgttgtgactgttctgctagcaatcatattgcagttgtttttctatagaaacattgtttatctatgaaagttacgacaaaaagcaatttgcaggacattagctaattgcacaactgaacaccattgtacttaccatttagtgttttcatcagcatctccattgtgcaaactcccgttagagtcctcttctgtatcttctttgtcaaaactcccggtagcactctcgtacccatcttctttgagcaagctcccagcagtattgtcatccacatcttctttgtgcaaactttctctagtattctcatccgcatcttctttgtgtaaactcccattagtgctttgtgaagtagaggatggctccctggaatttccagggttatgtaacatgtttgaaaaaccctgccacaatcttgccggcagaaaaggcgcactttcttgttgctcctcagatggcacttcatacacaccagccgaacccggattcaactcagagaacctcacagctccaagaagtctctcggggagctctgattcggtctgaccctcaataaggaatgctagatctactgttagcgtctgcacgtaaccaaacgccaaatgaacaattgcgtttgcgacaatagaagatccaacatccacatcgatttcaatgaagtttgatccctgagtatacttgcacgtaagagccctacccaatatgcaaatagcttgttctcccacagctgttcgaacaatccaaggccctctaactatgttcgcgattagcttaagcctagatttccggaaagcctcatctcctttcaagaactgatccataagtgagccttccggtaccggctccagcgacacaaagtagaatatagcactgtaattatccttgctgggcagttgcaggttgaaagcccagacgaaaggctgattaccacgcaaaacctcgccgtcgatggctttcctcacacgatgactcttgttattcagaatctcgcatatcttcgcggggcttttcatccaatcaaacccgagaggctttagaagatactccccacctggtatcttcaccttggttgcaagataatcagggcctctgaccatgaatgtgtcccctgggggagtagcccagccattggggcagttgtcagggtcaagaaatgggactgctcctcctgacttgacatcctccatccactgatgctgaacctcaccattggaacaatccatctatacatacaaaaagtgctaactctagttagttattactactcaaagaaaccaaactgacagcaatgtaaatggacagaaaatagatgctcagaagattcagagttgtagattgcagatgtaagcaagagcagaacacacacaaaaaaaaagaaccaattttgccccccaaatcgggtccgcctcttcaa

SEQ ID NO: 50135 - DNA, 4698 bp, Oryza sativa
  unsure (1)..(4698): unsure at all n locations
cagccggagaatcaagcaatcaagttagtagctttctcgattgaacaccgtgatttcagcaacatatcctctccggattgcacccggaaacgcatctaatcaagaacccggacaccctccaagcagaagcaagtcaagcatcggcaaacaagacagagctcacctcacctgtggatcttggttgggccttcggggtggttgcggatgaggaggacgaacagaggcgagcgttgtggaagggagggagagagagagagagagagagagagagagagagagagagatcttggatgctttcttggtgttgcctttgcttgctcgcctcagctgctctttgttcttcttccggggaaggagagaaggggattgtgttgcgtagggggattagcagagcaggcaggcttagcgtgtgatgtttggcattattggggaaaacaaaacgggtttattactattaccccgttaaaatatagcaacatttaaacggacgccaaatactataaatctgaacgagcagtaatctctctgtcccataaaaaaccaaccagaattcatagtacacatgaactatccagatttattatacaacaaaacgttatctgtgttcatcatatcatattttaagttgtgtttattggatgaagcgaatattttttttccttttagtgttacccattacttataatttactgcttaacgtttttggcacgaagttaaaatgtagggctgtttttttttatttttctttgcatgtccacgttgttttgtgctacatatggctgagtagctgaataatttatgattattgttaacagttataaatgaatgattaaattataaagtgaaatggatttaaacaatattgtaagaaattcacatgtatatatatatttttaaaataattataccatttatgagttcaaaaaacatgtggtttaacatgttattcatactataaaaaacatgttatgtctacttatttatcacgttttgtattatccaacccgtcaaaatcctaaaactcggttttttcttcttctctttccatgtcctctttctctgctttttaaagcttggttttgcgatgactcacctctagttggagaagaaaacgaaatagataacatagaaggaaaaaaaagattgatgagaggagagcatatataccaataaaaaaaatctttgatataaaatttgatatttaatatttaggataatctttaggataaagttctcgtagaaatttaatattcaggacaatatttggtatacaatttaaaactttgaccataatctcacatgcttaagttcatataaaaaatgtgatttgccacaatgtcatacccttcttaaaattttacaaaatatttttacaaatattgatgactatcaaatctttaggaaagccagcaaagtacagcaaactacaggcaaatatagccgttcattttccattttccattggccatcgcatttgtgaagaaaaaaaaataaaaaaaaaataaaaatccccttgccctattccccacccaccaccagctcgccgctcctcgccgccgccgccgcggggcgtcattctctccggtgcgccgccgccgcgtcgggccccgaaatccgcctccccccaccactgttcttcgagagaggcctcccgttaactcgacggctgcgcccgcccagtcggagatgaagcaggtgagtttcaaccaaacctcgagccgttcggagatgggcggattggagatccgttcgggatttgacgatcggtttcattccctccaactaacccgtccaatttcgtcttgattttgctcctcttcgggggaaatttcgtctccccagtttaggtgccccctgcttgtgtagggctacaaatgttcctctcgcaatttcgtagtgcttagagtactttttggtatattatgcaagtgatttcagcatgcagctaactgtatctctttttaaaaggaaacggattatgtttggttaagagtttgagtttgtaaccatgccaaatctccgctgtatcagacatagcatcagaatatggttgaatgtgccttttaggattgtatgcatcaaagttgtctttaatatatatatactgacttaatcatacttattaacaagtctgaagtataatctgttcatcgaagtccctgccttgcgtattcctgagcttcattgttactatactactcaaagaggtggactgcgcgttttttgtttcgtgctcgtgttatgtaaccagctaatcattttttttttgcaggtgtcctgtagtgttgtaaataaatgttggcctacaatccatgcctctcaagaaactactatcaacggtctcataccgtgaagttgcaaagatcacaagctggccagataattttgcctcgcaaattgaggaaatctacgctatggcagaccaacttcactcagaggcagattgcaacgcattgttcctctgacctgagtacctcctgcagagaagaattgcccagctatttaacagttaatgttttgaaagatcagtcatgtgcaagacaaggaatctttcgtaaagtgattgtcatcttgaatcctaattctggatttcgcagctctcgtgaagttttctaccagaaagtacaaccaacattggaggtaaatgttcctgtttttcatttccagaaagttctttcagttgaactcgcaagaaaagggttttatttcaagtgcaacctgaaaattttaatttccttgaaatccagtggaaagcattgaagtttgtaatacgtgtgattttagatggaggggaagacattttagaacctttaatgtgttatttatatatttttgcatntgaattttgatttggtgcagctttcaggctttatgatgcaagttgttgaaacagcgtatgctggtcatgcacatgctcttgcttctactgttgatctcagcacatgtcctgatggtaatatcaattttgtatctgtatttgcagttacgtattgtacccttctatttcactatttgatttattattattttattgtttacaggtatcatatgtgttggaggtgatggaattgtgaatgaggttatcctctttcctatgcttctttctttccacaatctgatctgctgctctggtagcttattttgcgttattgctcctaggtgtaccttgtacttgttatttgcagtcaatacatataaattcatatttgttaaatgggcctgttgccactgctcttacaaaatttagcacttttagctcataattgcatttccatactgctaattagatattctttataattagtacaggttttgaatggtctacttggtagagatgatttggaagaggctattcaactgccaattgggataattccggctggttctgagaactcgttagtgtggactgttcttggtatcagagatcctgtttccgctgcaactactttagccaaggtaatttggtaatgttatattcaaatttgtgcgacatattaatatgtaaggctattattggaataaagtttcacacaggcaccgttcgaatccactgaaaagagtggattaaattttggattaaagtggcatgcttttcaaactgataaacggtgcgtttcgtgcgaaaactttttatatgaaagttgttctaaaatatcagattaatccatttttcaagtttgtaatgattaaaactcaattaatcacacgttattaccaccttcttttgcgtgaaacacttaatcttcatcttcaggagattcaaacaccaccacaatgtgcaaattagagagggtatacttaaattatgtactccaagaaaactcgttttaaggcagagataaatatagtgcatcattaccatatgcttttaatttggatttgttttggacagtccagtttatgtcatcacatattttggcagtagaaggtcctgcatgatacttaccatattttctctttatttctttccgctcccatcggatggcccaataagccaaagaataagccaaattttgaattttcaaacttaattttgagattgattttgagatatttttaacgtagttttttttcagcattggcttttaagttacaaagaacacatatataaaagttttacctacaaatttatttttattccctaataagccgttttggcttattagaaaaaaagccaaccgatgggggccttcatttattatatatctgtattcttctgagcatgtgcaccattgattttcaagctagaaagtttacgacctaaacaatagtataaaaaatattttatatttttaaagttcactactgggataaggattttcgtttggtctcacataggaaatgaatctcattctgtagggtggtatcactccaatagacgtgttctctgtcaaacggacccaagctggaattactcatttcggtttgacagcttcctactatggttttgtggctgatggtaagtcttcattcttctgcacaactgcacatgtaattcttgaagtgatacatttgaatttgataccttcattctattttagataattcaatcattagatgatgttactctatgtaagaaatgagctagacaatcgtatgcaagctagggcctacatgaattcactgtagattatgttagtaagaaaggaagaaaggtgaaaatagcgaatacttataatcatgcaatctatttaggat

SEQ ID NO: 50136 - DNA, 7770 bp, Oryza sativa
aaaaaaaaaagaagaaaaatctctacttctgactttacatggaaacacagaagcaaatgtaattttaagcttacaccaagtcattgttctgatcgttgatctgaagtatggtttgcataccatgttttattttgcaaatgcatgcaagaaattttgattgttcatgctatatctagtttcgattagagttcatcggcacgacaatgttgtagcctttgcacgctaacctgtgtaaacttgaatatctggttcattcaaatgttggagcaaaacaaatcatcgcaaagtaacttatcaattatcagataatggggaccacgcattactaacttctggacaccttgtttttttttttaccaagttaggctagtgtttggttcactgccacacttttctagctcatgtccctacacgtcatacttacaaacttttgccacacttgtggccgacaaatttggtgccacaaaaactatggcatgccataaaatgtttagcaaaatagagcatccaaccaagcatgccctttgtgactaaaattccttgtcagtaattccagggtgtgcatccaaaaatattttcgcagattgatcgttctgatgattaccagatgataattgacaatgcataaaataaatttgggccaaacatggggtgacattgaccaatgatccaattaaataggcacacatacctgtacagactgtagtcacagctaaagaatctcatgagaagagaacaggataggccacatgctaatgcacaacttcacatgtttggttctgacattgcaaatctcacaataactatactgggaaaattttgctacatgttacagtcctaagttcatctagtccacctgatggctgatgttcagaacaaaagaaaaaaaatacacaaaacatgagcagtttattcttgattacctcaacctgagaccatcagcaacctaatcatcagctgattacatgagtatgatctttgacagagacagtcaggactaggagctggtggccaagaaactaatgctttacaatggtagtaacaagccctgcttgaacatgggaaatgttcatagaatggagaatttttttccccggatccatatcaagctctggcagttgagtttgttggtgataggccagtcggtgagttgcatgtgtcaggatcccgtttgcccctggatctcttctttgctttgaacctggacttggccatcagcgtgtccactgtatttgcaaaattacctatcgccattgcgatcagtaggactccacagaccacaacctgtgagagcatgcataggttatgacacgggttaagtatgatagaatcttggttgtattaagagccaaaagttcttacctgccactcagggacgatgcctgtatgagcagtacgaagaagtaaaaatccaacgtaaccctcaaaaccctatacaagtatgtgcgaaatcagataattgacttgagtgtctacacatttatcagaagattataatttagtgttacataaagtcagcatgtgctaagtagatcgcattaccatttagataatagacctggatactacccttcataggaattttcagcacagcattgtgtatttaccaaaaaaaactagaagtatcacaggataaaaaaaaaagagaaccgatctgtccttgatgaggttaactaggtattggtatgctcaacacctgctatcattaaaaaaaaaagtacctgcaacagaaagaggacagggcatagtagcaacaattgaccttcaacaccagcagtctctccccacacaacgtccattcttctagcctaccaaaaaagaaaattcagttatgcaaaattacttggactaaaatgaaggaaatgacatgatctcacaggtaagtgcatatagccacatgatgcttgaaatgccataaaaaagcaaatagataccagaaagttctttggaacagcaggaacatagagtatcagtttgttttttgatcagaaaaatatgttacctttcctaaagcaatccgagtatatagtctttggcgttgatatctgttctgcaacatcatggcgaaaccttgcattatggcccagcacagaaacagctcgacgcctctctgtgaataagtatacaggttatgcacattcattatgtacagtatatagtggaaagaaaaaaaattgcatacctgttttcgagaacaatcaggttgtccctttatctcccatgttagactaataagagacatcagcatggcacaatagtgatggcacatccaccttaagaacaaaagcaatttccataagttccacatgtatcagagtatccagtggtattggtgcttacatgtatagacatatagtgactagaaaagagcagacaaaatcttaacaagcaaagaaaggctggccacctgcatgttataagtggatagacagtttttgaaatttgaacaacacaaaatatttagcatcatttacagtctatataagataacttaaggcttcagaacattgaaatgttcccttgaaataagaggtgaaaatattggtaactactgacatgcaaaaattagagaacaagaatggctacaccctcttcatttttgtatatgggcaattccaaattttgtttttttttccccttaccaaggacggatatcacttccattaactcgtaatatgttctctcgcagagctaaagttgtatacagaaacaacaaccaagcctgtaaaatataaggtatgctcactgtcagtttagtcttttggcatggcataaaacataagataggttaaactgtttgcaatgtccatgaataagcatcagtctacctggtatagctgaactggcaatactgggaagcatccattccataaccatgaccggagtaccaacagaatcattgggaaaccaagaaaaagcaatgcagtcctatcctggaagaaagggggaggtttatttatgaacaggacaaagagttattgctgtttatggttatctatcagtatactctaaggtgatcactcactgaatcgttcaaacaatattgtaggaaatattctcatttaaaattcttgtaacaatcttggcctcagtttgcacagaaaggctgctaattttggtgtcatcaccattgcaagcttgaaaaggcatttgaggcaagagttttttttttctacagggatagaacatcaacaagatggatgatagaaaagtttggaggtacaggatttctatgaaaaattaaaagttacactgctgaaatcgccaggtgtttcacttccactaggaagagtgaagaagtcatgggtgcaattccttgattgttatgtttgtcatttatgtaaatttagataagctatgatgttatagttacatagacaaataatagtagattagtttgacttgtttattaacttgaaattaattaattgatcacaatttgcacaagttaggcttatgtattgacttgacaaaacagtttcaaagaaaacataacgaattaaagtagtatgtgaattcaatcgatttgtatatgaattctctaacacctcagtacatctcaagctaacttaaaattatttgaggctcatggtaaaaaaaaacttgaacactaaaatgtgtgcagaattattattattttttttgtctagcagtgcagaatttacaattgtaaaagctttggacaacacaaagacactcttttcttctaaggtacttggatcaatgtgcaaattaaattcctgaactctttatcaaatggaagctcaaagacaccagaatgccacacccaaaattttcatttcaaaacacaacttgatggctatagattatcatcaatagtacaattgtaacataccctgtagctattatactcttccttcaccttgagctgcacctccttcctcggtgcccgcagatttactggtcccaggaacatcttcaggaaagtaccttccaagcccaaaaaccaaagcaaaaatatcagaatcccacatcgccaaaaaaaaaagcaaagcaaaatatcagaatcccacatcaaaaaaaaaaggaataaggacagaaaccaagaacaagttcaaacttttttttccataaaagggaacaattaccatgtgtcttgctcgggagcagcgccgcaatgtctccatcgcttatgaggcacgtcgctcgatccaagtcctcctcaacctgctctcaagcacacacccacccaattccacatccacagtcacatcagcaaccaccaaatgcatacgcacatgcacattgtcatgatcaatcagcagcagatacacatatagctgacagaatgatgattcagagaggcatgaattcccatgttcccacacatctccacactccacagccgcatctagaaactcacaaaaactcgagattgttttttttaaaaaaaaattacagcataccaaacaacccaaacagcacgcagatctctccccagtgatccggcgcccacgaagcatccgcccacgaagcccgaggcgcacccacccaccccggcgatccactccgccaccgacgcaccccacgcacccgcgcgcgagcgcgcgcgcgcaccaacgaggcgaagcagcagcagcggtagagagtaccttgtcgctgtcggcgtgggcggcggccttgcggagcctggcgagctcggcgccgagcgcggcggcgcggcggcggagcgcctcctcctccgccgacgacctcgacaggaggcccgccgccgcgtcctgcagctccctcgcctgctccgccaccctcgccgccgccgccgccgcctcctcctcccccatctcgccgcctctctctctctctctctacactgctcgcgcgcctcgctttctctctctctcctctatagagagagaggaggtggtggtggaggcgggggccagaggctgacaggtggggcccacgccgacgaagggaggaggagaggaagatagaagatggtttggtggtttgatttggaaggaatcaatccccctgatggaggttagtttaatggggtgtttgtgatgtgatttgggagcttaattgtttagtgtaaagggggagaagaaaaaaggagtgctgggcatgtttgtagatttggatgggatggatgattaggatttgatttgttgtttcttgcttttttttccttttctttttgacatgtttagttgttttttgctctcttttattaaggtgagtttgccttttttttttttagggatgagatttttttttcttttcttgtgggggtttatttgggggcacaaatggatagcatgacgcattgggtgtgattttcttttgttgatgtgggtatgtaccctagcacggtgttatatggctttatgtttttaaaggttggtgtgcttacgttggatattaggcatatgtcatccaaatttgtatatgcgtctgagttgtaaatgtgcatgaagcgatagctatggtggataagatggtcgtttttgtgctttttttagtcgtatacataacaaccttataaaagatggatagtatcgtgtgaaagaaagttttataacttgtctaatattacacagctttttacatgagtacgtaacaaattgctataatatggttagtgtcatgatgagaaaagtttcatggcttgagtacaccatttatcgtatttgcacacgacaacacgttaagatggtgcaaatggttggagtgatattaggacgagggagaaggtgaagcaattgaagatggcatttatcttgttttgcttggattgtcacattaattttgcgtagtggttatactaaataaccactacaaaatgaatgtacaaatttacatagagattgtcagtggagagcaataatttgaagcatgccaaccctggggacacactatggccaaagttatgacaaaaataagtttagaatgtatttgaataatccataataatttcagcaagttatctgaactttggaaagccactccaatattacattttttatcaactaaaaatatttgttagggatgacatgttcatcacgagctaataaaaatttatttccctagcaattttttttaaattttagtcaactgactatttgggagtactatagaagtacttggttaattgccctcctacaaatttacctgttcaaaacaagaactaggttggtcatattgatttgacacctaatcatctagatctacctaacaaactttcaaggactaatagtaaaaaaaaaggagagagactgacacatcacaaatcaatgctcactaaacaccataagatactagaatgaattatgtcatggctagggcacatatagatggcatatacacaacatcgactctttagaacaagcccataaagaatgacactcaaatagtcccaatgttcgtaccaaatgttcttttctcttgttttcctttgcagaagacgacatctcatctgttgatccatgtttggacggtgacagatgcaaaggaccgcagacaatgtgtttgttagctagctgttcaattatcagcatcaacagggtagtaggcgataaccatcagtggtacgatgatgattaattggcaggaaaattaaaaacaacgaaattaaaatggagaggataaggcagggtaaaatccacaggagtggaggcggattaatggagctgctaatctttcggccatgggttcatgtattaataatgtctgttgttgctatctactgcataatgtattttgtgtttcatgtattaatatttaataataaccgtaatgtatattatattttgctagctgatgcatgccttatccgttcgccgtttgctactggttgctactattttctcaagtacaaaagtagaaaaaaataataagaaagaactataaaatttatactaaatgctattttaattagatggtataagattaaatgtactggttataggacagaaccaaagttaatatccagaataattgacttaacttgttcctattgttctaggcgcacaagaataaagtggcatcaaatttggacttgagttagtgtcagtcaattggtcttaccctagtatatgaaaaataatccctggttttcttgaaaaggttactgacttggtaggttagatttattttttctattctaaaacagcaggtgattaacaggaacctggaggtaatggtcattggtcaacactccgtggagtgactttcactccatcagtatgaaaaaacacacaatttgtcccccaggttattgaatctaatagtgtttaattatttaattaacacaagagcactgcctactggcacactcctacaaaagaacttgaaaggaattgaatacctgttgtgttaatttcagaaacggcatcaatcacttgtttaccatgatgtcacctgcatgcatacatgtcaacctgtttaccaaaaagaagaaaaacaaggttgcctggaaagtacaaacagaccgttccaagacgcccatgctgaggcttatatgcttgatatgaatgaatttttcattggacaaactgatttggagagcttggagaagattttgatttggagagacatcaaatttaactatagagttatatctatagaagttgtagctagacggttaacaagtagtactctgtacagtaaaaaatatatttgtcatttagaataagattgataaaacatttaaaattggatcatcaataataatgttgctagtttaaaaacaaaggaaataatgtacgcagatttgtctcgaaaatactgccgtaatatcacaaatct

SEQ ID NO: 50137 - DNA, 1384 bp, Oryza sativa
ttcctgcagccctgagtgagaacttcaaaaacatttgaagaagtggttcttttgaaaatgctgcttccaagcaattcaggacattaacctgttcatactcgtgtaaagtaaaaggaccatccgtttcctgaacatataaataaagtgttaaaaagctcaccagcaaagcatagtgctcattcttatttgagtgtctgtccaacaatctcctgcgcatatctgtgattacagttggcaacaactgcttcggcatgcgggcatacctgttcatttaacatatttacatagtaagtcaagaacagggaagagatacacataggagttcagggatctagatcatacggtgtaacagatatcaaaaggatgagaactttgaacaatgctgaaagcaaagtagtttgagtttcacgctgtatcaaatacaacattcctgccaatcagaaaacaaaatatgtcatataaaactttaaaaatactacccccgtccctaataagtgcatttatagcacttgaaggacgaaattactattgagagaaaatgacttagatgcccccaattaaatgaggggtggttggagctgggagggtggttggagacttgggggtaagatggatgaatgagcggtggttggacagaaaagtggtaatctagaagtgcgcttattttgggataaaatttgaaagctagaagtgcacttatttagggttggaggtaatatatctctttgctgatagcagaaggttctgaacatctagtgaaaggaagtgtccagatattggaaattgagaagtcaccgagcctcctacctgtatgcagctgcataagaatttgaccaagtgaagaagatagcgtagtgaaagatccccgtcttgatgactccttgtactcggcaacttgtgtcaaaactaatgcttgtccttccagcatggaagcaatggttgatgctgcctcaatacgcacctgcacatagacatccaggtaaatcaagagaattatcaaatataaacacactaatttgatagaagtatgggctataaagagtctgcacacattaaatacttttattttaacttttcaagtgtctacatcgactttttgcaaacatttaatatatgttcaactagcaacggtgtcaagacaattgaacaccctcagtcaacagctaaaacacaagctagcatgtaatggataagcacaatgttgtttgaaggtagaattaccagaaaatataaacactaaaaaaagattatataaatcccaattaggtcataggtagcctatagttgagaaacttcacactgaaacatgaaaataaatgtagatagataattacagacttgtacctttattataggatcgaaaatcaagcatgtcatcagagta

SEQ ID NO: 50138 - DNA, 3077 bp, Oryza sativa
aaaaaatatacctgttttccgtaatgaaatcaatacacttcccttttatacttacatgtgctgaaagtgggcctttggggtctgaaagaacagaatgcagacaacgaagaaatgaggtataaaatctgaaagatagtgaatttagcttgagattagcattcattcatttcactatattcaatgacaaaaccagagtactaaccttgacatagtgctactctctatgataaagttccttgctgtcaaaaaatccatcaccttcctcaaaacctacaaagtgcaagagaggagatttgacaaagagaaaatgaatactaacaccgtaaacttctagcaacaaaacaaatgcataaaatgcatcagccagtggttgtgtagtaagtattggtaaagtgtatcatcaaatgacaacagtacagcacaaatcttggaccaatggtggaagaaccaataatgctgtttgcatcccagatactaaacagctacaaatttccttgctacggtacttgctatggttacatcgctcaatgatatgtgacaaccaaccagagcgaaggaaacacaaaatactgacctcaacaatggactgccacaaatcttctgataaacttgaggctatcttagatagtgcatcttcaatcatggaaaatgcagagatttccatatcccagatatttggattcttattatttattggtccaaatgtgtgggaagaaaaaccagcaccattaggtttatctgtgaggttcagctcagattgcaagcatgatacaattgatatgagcactcgaagcaaatgtgcattctcaggtaaagaagtacttccgccaaaatctttgctcaaaaacctggccattgagaagaagactacaatgagaagcacaaaaaagattgtacatgcctgatgaaatttcattaatagtggtgaattcctaaagggtactagaatagaggtgtcacatcaaattattaaattaccaattcattcggtaaagctaaaagcagtatcttttcatgaaataatacaaaataatatataaatttgggaagatcgtacttctactatggcaattcaacacctgtacccttgaaatgatgggtttatagatattaccatatttactttggttatggcaatttgcctacgtaatttagtgtagtttaccgcatgtgcaggtagcaattctcttattcgcaccagtataggtgaggaattgccaatttcaaaagtactggagggattctgaaaacttggaaaagaacatttggtgctgtgaattaacaaaagactccaattaaaggattgagctagtatatatgtacagaaaaaagatgataatttatcgagtcctttcaataaatgtcggttaagcctaaaagactgaagtaaataaatgtagaagccattctcttgaggcgagcaaataagaactaaaaagattattattacaaaagtttagctaaaaccatgggaacacactctacattgttgatgtactaggtcattagtacttagcacaacaaaaacaagcagagaaagaagatttttaagcattttacactaatcttaagctcacctgaggatctgtaaacattcagatacagtgtccaatgcggttttcctaacagagaggcccttaccacatgaaccctccaatgaacattgcataagaacatcaagaaacttcagcattgccagtaaacaagacgagtcgatctccatatttgttttgtacatgatatcatgaatctgcatgagtagattttcagaaaaatcagagcataagtattcagcaaacaaattgacacggaggaacaaaaaccaaatccgacggttttaattcgtcagtcacattgatcaacaaatattagaattccatatcgcagcacgatatctcaccaaccattagagcttagagtaatgagaactaaaaatgccatacattttgtgctaatggtctcccatctgaattctttttttagataacatcaaagtgatacaaccgtactgagaacactcccagcctctgcacagcaaagatgaacacagccaaaacacccacccacgtactagtttgaaacgaaggaaaaattaaacagggacaattaagggacatcaatccgtagacaatctgaatgttctacactatcattgtcagtccacattaaagcaagatctcgagcgagtggaatcagaatcatcaccagatggcaaacgccacgcagcacatcatcggcgccgtcgcagggggacaccgccgcggccgtctccgcgaggaacgccacatccgagcccacctgcacacggtcacagcagcagacgagagtgtgagagagaccgaaaccagagcacacgcagagcagagaccaagctgcgcgggagcgggggggggggacctcgtgggcggagaccgcggcggcggacgcggcgagggagtgcggcggggcggcggcggcggcggagaggaggaggacgcggcggaggagcgcgaggagcgccggtggggagggcgagaccaccgactcgtcgcggagggtgaggagcgccgtgcgccactcccgcgcgccgccgcgggatggggcggcggatgtggcggcggaggtggaggccatcgccggcgaccaccgtggcgggcggttgctggtgaaactccttcgccgatctactccagtgaagagaagagaaaaatccttcagacccaaaggagggactaagggaggcctgcttagttcgcgaaaacaaaatttctaggtgtcatgtcggacgtttgaccggatattagaaggagttttggatacgaataaaaaaactaattttataactcgcctggaaaccgcgagacgaatcttttgagcctaattaattcgtcattagtatatgtgggttattgtagcacgtatggctaatcatggactaattagactcaaaagattcgtctcgcaattttccccctaactgtggaattagttttttaatttatctatatttaatactatatgtatgtgtccaaagattcaatgtgatgtttttgggaaaaagtttttggaactaaacagggcctaatttgcataaaact

SEQ ID NO: 50139 - DNA, 2090 bp, Oryza sativa
aaagaaaatagcgataaaaataaaaaaaagtccgactcctcgttgctattccctctcagaaaaaaaaagtccgactctagatccgagtcccactcctctcggtttgagtccgagatactacgcaccgcttctctcggttttaatctctaccgtgatattccatacatcttggtgaaaaaaattgatgtgtcggattgaagatctgtttgcaaaaacggaacctacatgtcaagagcattccatttttatatgattttaatttttggatttgtacatttgcatttgagtccctataatttttatatttatatttgagtccctgtaatcttgcaataaggtgcttttggtcttttttttaaaaaaacaataaataaaagggatagaacaaaggcagaaagctgcataaaaagaaaaagccacacaaaaaaaaataaacaaaaaacaacaacaacaaaagtctatttcccctaagtggcaaaaaaaaactgtagatgcaaacggaaaaaaaatccgattcctataaaaggcaaaaaaaaaagtggtgaaaaaaaacgctagatccgattccattaaaaatgaaaaaaaagtctaattcctgtaaaggcgaaaaaaatccgaaaaaacatctaaaaaggttcgtccgattcactaagaaagtggcaaaaaaatggttcgtaaaaaataaaaagctggttcgtataaaataaataatgcacgcgagaaaaaaaagaaaatggcaaaacaaagtccaatttctaatcagtataaatctcttctctatctctaatctaatctaactatttaaaaataaaaaatgcacgagaaaataaaaacgataaaaaaaaacgtgtgagaaaaaaagtcagaaaaaagcgtaaaacacgctaaaaaggtttttccatcttcttaaaaaaaataaaaaaacaagtgagaaaaattatttccattgtcggcaaaaactttttaaaaaaacatgcgaggaaaagactgtcagaaaaaatgcaccatttctaaaaaaaatggtatgaaaaaaccacgcaagaaaaaaaacactatctatataaaaaaatcgctctgaaaaaactattagaaaaaagttgatggacgcttgagtcggataggatccatcaattttttaccatgtactacacggcttttatttcgtcatatattctcatgtatgggaaaaaagcaaaaaataacattcagaaaaaacaggcaaaaaaaaccacgtgagaaagtaattgtaaaaaaaaggcaaaacacacgcgagaaaagcaaaacaaaaaaggggagaaaaatatggttttctgcatccactgtggtttgaaagaagagcttgttcatttccttactgttctcaaccattccatacctaaatttgataatgaaccaaactaaacatatcactaccaacacaaccttgtcaaattttgtatttttataactttatactcacaagactactctcaatatttagttaggaatcaaactaaatactacccatcttcatcttatcttaccaaaatttgataatgccaaaatttggcaatgccaaagattgataaggatttttctttttctttttctttttttggtaatgaagtgaacaagcccgaagtttatgtgataaacaagatacagactacatgctagagttatacattcatgatagctgatttcgaattagctctattcattgtagctaaagtcttatcatctacatcacaccatgcctttcatgccattggcttccatttcaattagtctcttgttcatcaatattgaggacttagtgacaattttttttcgtaccaacgatgcagtgacaatgtgatagacatggatatgaggacaaaatgtaagtattttaccaattcagttttcaagtagacaatttgacaaaactaatatagagatgaacatggaacattttacatctaaaatatatatttaacagggctatctaaggatgtaagtgggttgacctagcccaaaaggtggatagcccatgggtcctataagtgtatttgtgggtcgatttacttacccttaatctatgctgtattgctgtctaaccgggtaattcc

SEQ ID NO: 50140 - DNA, 5015 bp, Oryza sativa
taattaatcacgtgctaatgaaccgctccgttttccatgcaggaaggatatgttcccatcctccaataccgaacacagccttagtattcaaataggtaatcgtaccgatatgtcattataaaacaagcaaattttatactacctctgtcttaaaatatagaactggaaaggtagatatattttgagacaaagggagcgccattcatcccatgtatgatggcacagatacaaattcacaacaaatatgtcggttcaaacatagcattctgtcatctccaaaaagttcaatcaggcaagtcaaccgtgcaaaatgcaagagtgaacaatggagatgttacataagattcattttttttttaaaaaaaaaggaatttgaacgagtcatccttgcattcccacaagacatcatccgaaaatccggatattctctcctgatcccatcagtgaaaatgacatggatggtgcgatcagaacttacatttatgtatcttcatactcgtgcctaatgagaacaacaacaaaaaaacaaaactgaagtagcatatcctgctttggacgtctgagaatgatctgattagtagagcgaaggatggaacaaaatccctctcggtcaagaaatgttttttgtagcttcaaatctgggaggtttttgcgcaaaattctgagaagaaaccaaattggcccttttcttggagaccattttcgcagcgtcgacaaagattgtcgaaaatcgcctggagaaccgaccaggtgtcagtgtgcctcccaattgcagatggaaacctgcacaatgcgatcagatgcaacgttagtttctgtcagttttttacgagcaccaagcaacatgttcagtttgcatgagacagggttaagacttaagactatcgaatgattctctggcaatgatcagaagtaatgcagcattttcccttgtatgctctccctcttggacaagtagcatcagcaaacttcttcaggtgcaaacaagcatccggagatggctgcaaatttcggagcttttcatgaaaatttctgataagaaaacaaataggctcccttcttgaaaatgttcagacatgatgcatcattttgtttggccttccaaccatgtggcaaattaaggagaaatttcttcttcttctttgtcatttgaagattccaattgactggccagcctactgagcctaaaaaaagccaggcatgcaaattcggcaactttttgcgcaaaattcagagaacaaacacagatctgagctcttattggaaccggattttgtaggagcaaccagcaaaatgttaagaaatgatgtgtcggtaaacttattcaagaaataggtacaactactctcatctgcatggatacaaagtcaggacaaacatgcactatgaggagagtactctggcagacaatataatcctcaaaaacttccaaaatgtaagactgaactcaaaatttttaaacagtagtttgaaccagtcatccctgtgtcccacaagacatctgaaattccggatattccctcctgatcccatcagtgaaaatgacatggatgatgcggtcataacttgcatttctctaacagcatgaatgttgctaatgagcacaacagcagaaagacgaaaactgaagtagcatatgcatacgctggtgcttcaatcaagaaaacgttttctttgtagcttccagttgactggcctcccgagcctggataataatccaaatttcttccaaactgcaaatataggagctttttgcacaaaattctgggaataaaccaaattggctcttcttttggagactacctttgcagcatcaacgaagattgtcaaaaaccacctggagaaccaaccagctacccgtgtgcctcccaattgcaaacggcaacatgcacaatgtgatcgatgcagctgttatttttcatcaggttgtatgactaacaggcaaaatgttcagtatgctggcaatgatcagaaatgatacactatttccccttggatactccctcctggacaacatacataaacaaacttcctcaggtgcaaacaagcattccgggttggttgcaatggcatgcgacatgacgacatcgacagccttgtgtatgatatgcagtattgcagtctaaaacagaatatgctcagattatgccacagttattcccagaaacccaccttggtcatgtaagcacagcttaacataatctgcagatcaaatcttttttatcttaattaacaagtcatcatccaaggaggtgagaaatgcatttgattggtcaaggttaaggatcattaaagtgagatccccagacattgatttggcttccagatgaattttttagatcaagataaaaggaacaaatcaagtggcatcatgtgataatccagtttcttgatggtccacacaaaaaaaatgtaaaatataatgtgaagtgtgcagactctcctatcatttctcagttttctcttagcttcactgattcagtcaagcagctaggcagctttcacatgttttgtttaatcaaacagctaagtttgtcaaagacaactaacagtgtcaaagcttaggcaaacaccaccactaatattgacaatttgacataatatgctgatccctttaccagttcagaaatattttgtttccaaccttgagagtacctattgtgtttgtctcactccattttggaagacatgtttgtcagtatctacacgtaaacatgcaccagtatgaaatgtgcatacctctaatactaatgccatctatgaatctcctttcagtgccactctactgcaaaaggggtcaccaagatcatcactgaaaaaagatgtctacagtccatgatgaagaccactctatttcatcatctcaatttatgaaatggatgaaagtaatagcacaatcccagttccgtcagaatccagcaccgacgagaagccatttccattcctcgggctgctttgctacgccgatgcggtagactggctcctcatggccctgggaactgttggatctataattcatggcatggcattccccgtcggatatctccttcttgggaaagcacttgatgcttatggaaccaacataaatgatcaggagggcatggtccatgcattgtataaggtggttttctcaattctaaaagcatgatatccatgtacatcattagccttttctctcattttagtcctttgaatatcaatatgttgatctgtgatcgttttttatttttacaccttttttcacttcttgcttgaaggtggttccgtttgtgtggtacatggcagcagctactcttcctgctggaatggtcggtaagtcagaaacaatctgtccttttatcttccatgatagatgtggcttttcatttggttaaataaataccctggcatagaattctaaatttagttatttaaacagaataagcatagacataggaatagaaaacagggccgtaaattatgttgaactgcaatattgctcatgaattacctcattaagtataaaattagggcataaaactcataaatgtttttacagcctcacaagcacgcttgtccagctattagggatttagtgccaaactcgtatttttgtttcatctgcaatggcataaaaggcacttataaactagtgaaacataatagcatgtcagagatgaatggtattgttagagaatatgttttttttacggttggagcctaattttaccctatttttttataagtagtcatatatgttcagaaatgataattataggagatcttacaaaaacatgcttaccttatcctcttatcatctgcatgcagagatctcatgctggatatactcaagtgaaagacaattagcacgcatgcggctagcatttctgagatcagtacttaatcaagaggttggggccttcgacactgacttgaccactgcaaaaatcatcaccggagtaaccaaccacatgagtgtcatacaagatgcaattggtgagaaggtaatggatttcgtgatttatggaacattgcacataatatttgtgaaactgtggtccaatgtgcaccactactgcacctgaccccaattttctgcagctcggtcatttcgttgcgagcttctccactttctttgctggtatcataattgcatttgccagctgctgggaagtcgcattgctctcctttctggtcattcctctgatcctcgtcattggagcaacatacacgaaacagatgaatggcatatcgttatctcgtaatgctatagtctcagaagcaacatctattgtagaacaggtaaatcatttacatcagctcaagccaagttaattggaagtataaacgattgcctacaagatttaaattcttaatcctactacacctttttctgagcagactttgtcgcatattaagactgttttctcctttgttggggagaaacgggccatgagatcctttgtccggtgcatggataatcagtacaaactaagtaagaaggaggcagtgataaaagggataggactgggattgttccaagctgtgaccttctgttcatgggcactgatggtttggattggggcagtcgcagtaaccagccgaaaggcaacaggaggtggcacgatagctgccatcatgagcatcctcttcggagcaatgtaatgatacagtaacatcctgactgattctcttacaccaaaatttctattcaaaaattaactttccgatgttaaaagcagtcaatttgaaaagaaagcaaagtttcaggtgagactcttagttcaagatatcactgaaatactttccgactaaaatgagtataatacacgtgtgtgataatgtaattctgaaggtccaatgcattatttatttcttgaaaatttcatgaaaagatactcacatgatttccaccacatggattcagatcaattacttatgctgcaccagaccttcagacctttaatcaagcaaaagctgcaggaaaagaagtattcaaggttatcaaaagaaagccatccattagttatgagaaa

SEQ ID NO: 50141 - DNA, 1238 bp, Oryza sativa
gacaacttgaggattggtaaaatggatgcaaatgacgacgagataaccaaagcagcaagaacagctaatgtccattcatttatatccaaacttccaaatgaatacttaacagaggtgtgtatgctttcagtagaaatgcaaaaaacaagggggaattcatatattcgccggaggcttatccagtatctagaaaaaaaacctctacctacgattttaattaggacaggcaagggcagatgaccttttaaagttaaaaacaaaaccataaatgtgggtattgttctgatgatgaaaaactgatttgtttttttcaaaattgatgactgacgacatgcaaattacataacagaaaaataaataaacaattgctaaagagagaataacaagtattttagtatgcaagtgacaatatcatgtaaattctgtgttcctattggaaaatcattcatgtttccatctttcattatatacatgaccatttcttttttggttcaaacatactttcctagtgcctcacaaaaatctttgttgattcaggtaggagaaaggggagtgcagttgtcgggaggtcagaaacaacgaatagctattgcaagggcaatgctcaaggatccaccaatcctgcttctggatgaagcaacaagtgcccttgattcagagtcagaaaagctagttcaggatgcgcttgagaaggccatgagtgggaggactgtcatattgatagcacacagaatgtctacaattgtaaatgccgacacaattgttgtcgtggagaatggaaaggtagctcaaactggaactcatcaagagttgattgagaaaagcacattctactcaaatgtatgcagcatgcaaaatattgagaaggaagctggaacgagggtcgcaaggtaaagtaaaacgtagcaaaatggaaagcttcatttcaccaatagtttatgcttaccattgataaaaatagcgcatgcatgttgggtaccgaaaggatcctttcctgcagattgtgcaagctgaaagtgaatggtttgaaatcatcagctaagtctcactattaaaaagatctagaattacaaaacttaatgaaaacatataaaatcaatggcacaaagtttagtgaatataataatactatatgccagtaggattacttcgctcaaaaaagaattagtactaatttttacatttcggttgattaaacagctcttctgataatgtcatagaagatgaaattgatgaag

SEQ ID NO: 50142 - DNA, 2720 bp, Oryza sativa
gcaccccgaccgcatggtcgatttcagaaggatgcaaaatggacttcaacggagaaaggaaacaagctagatacatacaatagacacaagggagggaatataaactttctatactcagcccaaacctgaaagggagtattttgattatttttgtaattaaataattgttaaatgagtttgtattattaaaattagcaatcatgttctgaaaattccaataaaattccaaagagcgtaactaatcatgaagaatttaataaaaatagatttaacctgttattttatttctcacttgctttaacgcatacacgcaaaccctacccctttgagcctcttcgaagaccgggccagcaaataagattgacgaagtcaccacaggtgtctcgctgtcgacgggtacgtcgtctaccactgaaatcacaaagctgttaaatcttagaaaattagctctcatggggagtcggactcaggaccaaaggagctactgaggctcttgtatccattagactacaagcccttttgctacttgtaaattgatttaattatacacatacctacttaaaaataccaaatatttcatcaaattgttctcaattttctggtctgtacacttcccgttacaacgcacgggcacttttgctagtagagatagagatatggatagatgaaaataaggtcgccatgtcatctgaaggatggaactgaaggatgacgtgggacatggaccgatctggtcttaggacgatgtgggacatgggccgatatggtcttgggcctgcatgcaataaatcctggaacgcgtgggaaggaaatcacacggaaaaaaaatcgatcccataaaagaaatcgaacgacgatacgtaggatcgcacaagaccacataaacctaccagaggggggtaaattgtaggaaaaaccaaaaggaaaaagtatgaattaccctccccccctgaactatcacggtcgaccgaattaccccctgaaccacaaaaccgggcattcttcacccccaactatgcaaaccggacaaatcaatagagtgagagagagaagagacaggaagagaggatgaggagtatgacaggtgggtcccacattttttataaaaagagtgctgactggactgccacgcgtacgccatgtagaccaaaaccaccacggatttagtcgatgggagtaatttgtccggtttgcatagttggggtgaagaatacccggttttgtggttcagggggtaattcggtcgaccacaatagattggggggaggggtaattcgtactttttccaaaccaaaaacctaaaaatttttagcggaaataaaagttaccttcaaattgatggaggtcttgacgtagtcctgtggccgccggtcgaaccgctcacaagcctccagtcggactgccaaaccttcgccggtcagaccgcccgaacactgccggtcagaccatgcgcacacctgcagttagaccgtcgggacccagaaacaccggtagatgacaaactcgaagatgtagattgaaactttttgactttattgcatcaactagtgtttataaagtgcaacaacagcactcctcaccaaaatctcgaactaaactcgaaaccctaattttctctcaactcaagcctctctaaaaccgataccgggagacctcaccctccctctctatttctatatgaggtaggctgtgcaaagcccatggatctaatacaacttaggactcctaacccacgtaggaaaccctctctctctttccttatctcaatcaatcttaccgaatttagactcctttccgaattcgactcctcttttcatacatacataatccttcttgtataccatatgaatttcttcatcaccacgtgcattgttctctagcctttagtatcccgcaggatctcttgatccctggacatcaacttctcccaagtttactccgatcattcaccggcaacactctctgatccctcaagcaacacctgcacatgcaacaaccaagaaaccatattccgagcacaagttcgtcccaacttgacttacattagtataacaatagtatccgtacgcatagaaaccatctagaagccaaaaccccaaaggaaacatccaaatctaacaagacaacccgaaaacaataacaatcaggatcatgccggtcagaccatcaggtaagctggtttgaccgccgcaacacctgtgctctgactggcggcacatgaccgatctgaccgccagggtcaaccgaaaacacccacttcacaaattcaaccatctattaaatctccaaaataacaatagcaaaccaccaatattttcatcacaaaatctaaatcaactccttgattttacacgatatacacttacgcgggtttaaaaaaaggacgaaaaataattgtgcatggatagagtcgaacaacgtacgaaaaacttagcgagccctccaagggcataaccattatcagatcgttagatcaatatacatccggcgtatgcaatgttcaaataggagtaggtacctctcatcgagagggcttaaacctatctaaatcctcatctctggatctttttaagtctcgttcgctacctctatcgacgtttgatgtcgcgatttcggtatttgcatagtatggggatcgttggtattaggatatacgcgagagtaaggtaaaagagatggagacagggatttttatacaggttcgggcccctgaattgtca

SEQ ID NO: 50143 - DNA, 1041 bp, Oryza sativa
taggtatgtggtatccataaccctgacaatctctttcattatgaccgatttccagaatcgacaagattgtccctttatatggaaagcaacgaatataaagacaaatgatataaaactttttaatgttactggccagtagatccacgcgtttgtgcgacaatgacctccctcgctactaaatcatctcattcgccgaaaaacctaactcagcctcgccaaagaacgatgacaaccaagaaacggaatcatcgtcttcctcatcctgcaattgagaaaaacaagaacctaacgaagttcgagcaacgtgtgcagcatggatgtgagtcttcagtcgggaagcagaggctgccaccacctccaccaatcatgacatcctttctcacatgcttgggcatgacaagcttctcgtgatcgatcatcatcccactctagcaaaggagtacgttgttggtagtacaggcgagccctacgccccccacgccttagccggtgccagtgttagccagcgatgcacgcctgatcccttgtaacagccttcccaccagaaccgcgtagccagcccatccgacgggcgggcccatttacacataccacattaccactccacatagtgtgaaagctttcatgtgtaaataaagaagagtggctagctgtgatgtcctacgatccttttgttccaaccaaattatatctcctgtgcatagaacttctcttttatccaacacaggttcgtaactgcatcactgtcggttttcgaaccaatgggatggaaatggctgtaacgacactaattttgctcaaattaatttggtttagagtagccgagaagtgaagaacttctgcagtctgctagatcaggctctaattttgtcttcatcacgtcggattggaggctatagctacaacatggttttagtggcacaaaaatctaaattttgtgagcttaccctatactcgaaacaaattgtcccggtcagtaagtttgtggatttgttgaatagagagcatcagatttgataaagagtgctatgccggttcgag

SEQ ID NO: 50144 - DNA, 2841 bp, Oryza sativa
  unsure (1)..(2841): unsure at all n locations
tagtgtagaattagttgataatacttgtaacgatactcgatttctttcacaatatcaatttaatcagctagaccaaatacataaaagcctaacgcaatatgaatgttagtttaatctcacaaccagccggatcgtttcttttattcttatacttataagccgaaagtgtaaaatgattttgtggttttcttcaccatagtttcttttataatatatttgttgtttaatcgccaaggacacggatatgcatacagaagttttacccataatctttttataattaaccgtgagaataagtatgagcagtatgagtagaatgttaaggctcaacttcttgttatagatttttttaattgtagagtgagactttaattttacttttttaaaaaagagtagaacagaaacctctcgtacgaaactggcaataacactgctacttattaccggcttaatcgagactcgggaggaaacaagaaagaaaaaaaaacataaagcaaaagggcctcaaatcctcaatgcttcgtgccttcgtccctaacgctgctagtccccatcgtggcccgccgtgtctcagtgtcgttggagtgaccatggccgctgaatccggttggttgaaggatgccggatctactggcttagagacatgatcgacggatcctatgcatcggagctttacctgtcaccttggtgctggaagggaggcaacagcagttgaggaagacggcgccgacgagaacaaggagaagaggaaatgtcgatctcttccctcgatcatccaaatcgacgagaacaaggagaagagccctttctttatctggatatgcccaaacttgaggtcatggtcattgctaatgtnggatggcgtggacgtgcttgacctaaatgcatgccgaagggtgtcggccatgtgcatcttagttatggatagaccggaagtattttcaaaataattgtatcaccttgatataattgactaagttcaataaaactttcattatctaaacagacgagtgccggctggttacagcctatgcgctcacagctggtatggctcgacgccctccgtgtcacgaacactcctcaatctggcatatgccagctctagtagtcgtcggattgggtagaatcgagaggatttgggggtagttaggaggaagaagaagaacagagacagggaagtagttgtattgtttgatttctcattgcataactctggcctgaatggcacccaaagtatttaaatgtgtcgacctgtgtacagttgaaccaccactagcccgacatgggatccacacatgcacccaggtcatcacaagatagtgtcgtgctcacatgagctgaaccagtcacatgagaaacagggtacagaaacagagtacataacagagtacccccaaatgcaaacaccccgcttgctccatcaggtgagaggatcttgctcgttggctatanctctcgtggatccaaanaatgtcacgacaaacgtcttcnttgtccctggtttgcggcaactaacatcanctcgccgnttatattttgtcttatccatatttttccccgacctgcaatccttttcactcattgtatccgttttctcgtgttatttttgtacggagtttggaatgctctggatttttcctttattttatctggagtcttcgcactcgtgcacaggaatggaacggcgctccaccttaacacgggaatagaacgtgctcttctggacacttggcacgttttatcaatatgtaaacttgcttttaggtttggccacgtggcacaatgagctgatagaatttgcaccctgaattcggtcttttagatagatagattgtttaggtaactgaactcttgaacaggacttgtctgggatgttatacatgttcaaacgaacttcaacccacttttctttttgaaaagaaactccaacccacttcgtagtacatgctatggtaacgtctgcacgtttaatccgcacgtctttgcacaagtcgagcagggtagcgggctaagctaatctttgggctgggctatatgctggccagaggtgacaggttaattagtaatacagagttggaacaggccatcaccggtgcaattgtagagtagggatgactgtctttatttgtgatatgcaatgtaattattttaaactaactagtatggacaaatgatagtgaaactcaattggcatgatgctaattcagctggatgtcaattcagctagctataatttgattttgtagtctagctaggatgtcaattcagctggagtgtctgaggattgagatgactgtcaagcgaggaaactaaggccatcgagattattgtatcattcacttgcatgtagggatgaaaatggagcggatacggacggataatgctcataccgtattcgttttcatagtttttgcctcgtacgaaaatgaatacggattatctcgaatacgaataagaatcgaatataatcggacatgaatacggaaacaattttttctcggaacacgaaaaccaactcaacttataatagaaacaaatatcaacctatataattacctcgttttatataaaatgtagtataatttataaatattttaaaaaatttaaataatgttaatattgtgggttagtgttaagagatgagctactattaaaatctaaaaaggtatattgaaggttatagatttataaagaaatgaagtatttctcatgacttcggcggttatccgaatagcactgttcacgggatatccgaattattatacgtatccgaaggaaaccccgataccatattcgtatccgtatccgggaggaaatatccatattcatatccatatccaa

SEQ ID NO: 50145 - DNA, 9468 bp, Oryza sativa
ctctctctctctctaccttatctctaccttatctcttccttatctcagccacacaccttcccccactcctccccacttgtcacgcccggaatttctatccaaaattccaaacgcttacatgtgtgtgaaccctcgtccagaaatcagccgaggcacacaataacaaattgataatagagtacaattattactctaattaataagcgaataaaatgtcattacagaggtagatagttcctctcaatcaataaagatctaagcagcggaaagataagataaacggcgcagacgactccactccacaggcagcttgaccagggctacacctaatcctccacaccatcagcttcactatagaactcttcctctgatgaatgattgcaaggtgagtatatgacatactcagcaagtcacgcagcaaatatgcaagtgcacaggataacaaaggatggcatagtagggtttcatttgcataaacagcatttaataaacatttcagaattttataaaacagttaagtaataattaaacaatattaatccaacgctatacaacataccctgttgtataggcccaaccattctgaacaaccatcctggctgcacagttctatctccaaaccaggaatataccattccaaaccaggagctaatcaaattattaccagttatagcatcttttattatgatgagaagtgtgagactaatcacgaaagacattgttagacccgcccataaccgcgggtacggctatttgaatagttttactctggccagaggtgtaccactgtacccacaagacacagcctcacaacatgtcaccatgtgcctcaataccaccacggtacctcggaaaggagctgtgacaatacccctcgcacaacacaatccaccacagggcacctttcctggatgataatcacccccttataaacaaggcatggactccccagcgacccccgtgggcttatctccgccacttctcagtctggtgctccgcaatgaaccatgctatataaaaggtaaagccgttacccatgctggcttgtggttggcacggttaatgtttcacaaccgaaactcgtgaacacgactctcaaaaccatgtgctcacaacccaccattatcaagttttagttggccagtaattaattaacctaatcacgattgaccatcgtgaacgatcattaagccatcattaaataatagtgagtcataagttatcccaatagtgcgctaatgtttctaagcatggctaagcaatcatatctaatatctagctgaaccaatatatatagcccaactagtcaagttataataacccaaggtatcaaggaataaagtaatcaagatcaaaaagggctataacaaacaataggttaattccacccaatgacattcgaaaataaatgcaatatttgaatagaaacaatagctttaaacgggatcaacatgctcaaagggttgtttgggatctgtgtgacttgccttgctggccttggaactcttcaaattcttctcctgcaaaaacggactctccggaaacgtcggaatctaaacagaaaagagcaaaatcaccaaaacagcacataaacaagcatgaacagtacatgtggatatttttaacaggtagatcttaattttagaaaaatttagagacttgaactaactaaatccgagctaagatgaattagtaatgaatttttaaagattaaatcggattaaaacacttatatggattttaattgaattatgacgcaataatgaattatttttgaaaaggaaaaggggtttattgcgtcagcggctagggtttgcggtggaccgggcgcacggcagcggttcacgggaacgaacggccgagatcgatccatccaaaacggacggccgagatcgatcgggtctacggcggctcacggcagacggaccctgatgacgtcagtggtgacgtcatctccggcggcggctcgggcgcgcaaactcgccggcgaacgacggcgcgaggacgcgaacggagggcaccatcacgtagagagcgacgcggcgaactcaccgatgaccaaaacggcggcggaagatgaacggacggcagcggcgtcgaggaaaaggcggcggagaagatcgggccgacggcggcgacggtgctccggcggttgacagcgacggcgaaggggcagacgaggacggcggcgacttggtgaccatgatggcgatcttcccgagcgacgacgacgaccggaacggcggcggcgcacggctggagcggcggcgacgatggcggcgctaggtcacacgacgctagggctcttccgacggcgagagacgaaggcgagggtggcgacgggtagcggtgggcttggggatccttttataggggttggagggcgacggcgaaggcccacggcgaccggcgacgcgaaggaaacattggggttcggaggaaagagaccgatccgattcgacctcgaatccacgaatttccaaagcgatttagatgatgattccaaaagagaaaaggtagaggagatcccgaagatcatttcccctctattgatttcaccggatcgggaaaggagcggccggatttggaaggagacgacggcggcgcccgtcgtcgtcgtcaaggcggcggacatcgtcgaggcagcggacatcgtcgtcgtctccgcggcgaacgtccccgccgccagctgcctcctcaccgccatccaccaccacccgctccacccctcgccgctacccctcgccacgttgctcctgggccacctcctcttgtgccgccgcgcttgtgaggccacctccatcgtccgttggctctgccgcccggactcgccctggcggcccaacagtgccaccttcaccttcaccatcacggcgggcgggcttgacggcgacgatggtgaccggcgaggcggcggtgagcgggcccacccagatccgacgagttgtagtggtcagttgcgtgtgggccagcgatttttgttttttttttatttttggtttttttggtataacttgaccacataggataatcgattatcccgtgcggtccacttaagtgaaccacaagggaaaatgattatcccgtgcggttaggccgcccgcacgcgaaaatcgtgtagtagtgcgatgtctataatatactgcacctaaaaaccgagacaacagagcgtaagtcgccattttagccggtcgcctcccctcccaacccacagtcgatatccttatccacactccatatccttctcctttcccatccctctctccttcctcttccacatccttcgcctcctttcatgtcctcccattgaggagaccctccaaacccctttcctataggtgcgggccaagggtgtggcattgccttccccttctcctcgctgtcatggttgctgtgcctgcactacgtggttcagcactatgtgtggggctgacacggggaggcctccctgtcgcatgcctctctggatctagcggcttagtgtcctccgccagatccatgcatcttcaacagcatcaacgacataaagagcatggccgacagcgagtcatgttggtgtcaatcgaactcggagggcttgacgcatcagcttgattcaattgtatgcaattgagatcttggcggtgaccttattcttggatgttagtgtcagtcgaatttttttggggggcgggggcggggggggggggcctcgatggttcaactcgattcaagcctatatttttattcgtggaacattaaatgtgtcagtttagaacttttctttttttttattcgtgaaacataaaaaaaaaactctaaactgacacctttgactcttctcatcaagtaccgtcaatggggtgacagttgagaaattcggtaatacctataagaaatttccaaccaataccaaggtcctttcctgtatagcagtgtctggaagcgctcccctacaatacatatgaaaatccaataaaatggttaattctttgacaagatcatgcgcgcgcacctataatcgaagtagttgttgtctttaaagatcctcacaacccagttgaaatcacgcatttgacagcttaatttactctgttgtttcccatagtcaaaagtttagccaaactttatcagccaatatgcagattagcaagttaacgacaaaatggagataacatgcatccttaaatatatactccctccgttttacaatgactaacggtaggcactattcacgtttaaatttcaactactcatgttttttattaaatatttacagaccctaaatgatgctgtgttagtaaagtaggatatgtcctaaaataaaaacataacacttttgttcactttgatctaacaatttaagcatgattatgatcaaagcttaaatgagaggtagcatttttttctatcataccacaacaagatattatttgccccgagaagcaggtgcaatagaaatttccagaaagttactcaatggtgagagctagttaatatggttaccccaccataaattgcctggccaaggtggagaatccacaggctaaataaccactgcgcactgacaaatggaaattcgtttatggacaaaaaataaataaatagacaaataattaattggtttacacatctttatcgaaccatgtacatgatctgtgcctataaataacatatatatcatcagcacctctcaagtcttaacccaaaacaagagaaccattagtcaaaccaaattaccaacaaagtacacctctcccttgctagggtttgttccctctcccaatctccaaagtgtcatttcacattgacttcattcttcttcccagatcccccaatttctccctttcaccatgaagcttctccctcttctcatcctcgcaatggtcatggccaacgccttcggcgccgtcacttctcgcacggcgccgggggaggaggcgctgctggcgcacggcgtggtgaagacgacgacggcggaggggacgtccatcgacaaccaccacgcgataccgcggccggagtacgacagctggagcagcccggggaacatgccggggagtggccatgacattgggagcgaacaagctcagccatgatcgagctagatgcagcttacccagctctacccatgtcctgtacgtatatacatagcaagcttgcaagccatgggttatacacttattacgtacgcttgattgcatgtagctagtatccatatatgtacggttgtggctctagttgtggttgcatgataattcgaagatgctttgtagtttctacagtgattgtatatttgtattgctcatgtaaaagtgtttaactgtatttaacctcatcacgtgtactaatgttaattaattaaatactgaataaaatttatacgtccctacatgaagggagagttcttgttttctcatttggggagttcttcgtggtgatcgatcgatttagttatgttagtagagccatactgttgctacttgtgaacttgaatgatctaattataaataattaaatacaaataaagcatgcaattattagacagttgatggatcaattagttatattgctgcttcacgccatagcatctactgatttgcgcccttctacattacaatattataccgtacacagataaaaattatgatgaccaatttgtagttccatgcctcttttttttttgcatcaattccaaatatgcttggataaatatttacatttcacattaaggacaaattatttttatcgaggaaagaacagctgagggaagtgctccccctccggtagtggactaaattttcatcgtttcatgatctaaggggatgtttagatccaggggtgtaaagttttggcgtaccacatcgggtattatacagggtgtcgtatgtggtgttcgggcactaataaaaaaataattacagaatccgtcagtaaaccacgagacgaatttattaagtctaattaatccattattagcaaatatttactgtagcaccacattgtcaaattatggagcaatttggattaaaagattcgtctcgtaaattagtcacaatctgtacaattagttatatttttagcctatatttaatacttcatgcaagtgttcaaacgttcgatgtgacaaagtgaaaaattttagggtgggatctaaacaggacctaaatctcgatcttattgctgcttctgtgataagaaagttcatatagtgccagcagaccattgggaagggatggggccttctaatgcgatgccccctccgtacacaaatatagcaagagatagtattggattatatacatattaatactacgaatctacatgagtagcaaatattcaagagttgtgactctgttcattttgactatcaagcatacacatggtatatttgtaataatcaacaggtggtgtaaaaattaatatataaattgttgcattttaatataacattaagcaaacgcataacattataatagcaatgctgtgaaattttctgaattaattactaatattgtagttcggtatgcatatatttacagttgtctatctacctaaaaaccatgaattatacaagatagacatttactaacgatgaatatatgtacatgaagcacaaatgtggagtataaaacagccataattctcaaaaaaaaaaaagccattcttaccttagtgaataaacaaattaatgattcgcttgcaattaatggatccgcaattcgcagtttgattatggcatgatatatatgcatattctttcggtcatttattcaaaaaaacttgttcgcaaaatcatcagtagttttgtttttccagtagtgtccaaataaaaaaaatgatagaaattagtttgtccagagacaacgccacttacctaactgaaaggaccccacttgcgataagttgaattattatatggtgagatatatattagccaataagtgatgtgtcattttaggggtacagtaaaccttatatctctaatctataatattaattaattagataactttgtaattaaccacgtatatatattttttactggttaagtgtttagtggatgcttaacatttctgcatttacctctatatgcttagatgttagatcaactgaccatgacacattcagtggccgattgaaacggtcgggttaaagtttaggcactgatattccccaccagtaaataaaatattaagttattgctaagcaaagcataaaccactaacttagtgggaaatactatcgctagtgtaggatgatttctgcataatttattatttcaacgacaaagattgggccacgtagtcaaacgaaatctttaaaattacgatattatgacttattttattttaacttgccacagtaaaaagatgaaaatttgggtgtcattttgcactaactagattctactggtccaacagaacaaaaggagaacctttaattttacatcccacatgaatgtttttctatactagtgtagcattcacgagccatttttttgtaagcttttctcactatataaagtgtagctgaccgaacccgtagccttcactacacagttgaatccgaacgaattcttcctctcctacagtagtagagatttttccaggtttgactcgatcctgttcttgttaattagttcttgcttgcttgattacgatcaagtttcaaatgtctaattaaacattttttatccctgtaatttctctctctctctctcaggcagctataggtttgatcaccatgaaggagaaactgaaggcgaggtttcagatcatcgccgtcttgctcgccttcgccatggtagctcaagctatggcgattcgcggcacgggtacgacggcggagcaggataacaccggagggagcacgagtgcgaaacataccctgcctcaggctgttggaagtggcacctctgtggacaaccaccatgccatccctcgtgatcagtacagcaaccatgggggtgatgatggaggtggcagtactggtactggtgatacaaacaactagtgagttgatgatcatggatgtgtggagattaatttctgagcttgatgtgaggggagatttaaatatatatgttgtgttaattaaggtactaagtactggttgtgatgttgttttgatatcagtagccctaatcctgagaataagctgcttctcttcatggggatagaggagagcttctaaatatcaatgtatgcaatatttctgttgtgtgccataagctgtttactcttatgacaaattaattaaatctattgtccagaaaacgaccagcttagttcatatgtgcttccaaattagtatttcgtcgtgttgtcttgatgtatttccaaattagttcatatatatgtgcttccaaattagtatttcccaattagtatcatcacctaacaagtaactacaaacaaaggcttgtaaacttatagtcgacactaagaaaatacatcatttccacaacataatttcctgataccctagaccatcaatgtaccctttcccttactttcacttaatcttgtatcagaaaaaattcaccctatcgacgaaactcttgtacttattgcatgctctggtattactttctgcattgggatctccattgaaatttgcctttgttatctattggaagcaatctggcaaaggatgtgggtgtagggatcgagagggggatgacaagccatgatgatgggaagattggttgctcgtcgactcaactgttgtgttgttgagagctgcagagctccatgtggccgtgagactgaggagggaggaagaaataagttagtgcaattgagtggtggtaactggcaaggcattataaatggaagggagaagtgatgggaggggtaatgtcatgggaaactattttgatccctcgtgaggatgtccccttattgtttgcatgttattccaatggttataaaaatatttgagaagatgtaataacatgtgatatatcactccacaaatatgcaaggttaaattcaacttctatatatcagaacgaaaaaaacaaattaaactatagcgagttaacgcatatttacagtcaaatttgtttttttcgttgcaaaagatagaagttgaatttgaacttgcatgtttgtagagtgatatatcacatattaatatatcttctcaattgttttcaacttttttcgtaactatttgagtgacatgcaaacaacgaggggatatcccctcgagggatcaaaatccactcctgtgatgtcattagagaaacaaggggaggtgagagtggaactatatttgaagaagttagcttgtacttatttccctagttttgttgattggtttaattcaaaacagagcgtacattttttaaaaaagaatgaagtttgatgttcttccctatgtatttataaatcttacttcgcatttggacaaggacgttttatttaatcagcgcatttggatatggagtttttaatttctcagacacatagaaggcaatat

SEQ ID NO: 50146 - DNA, 1534 bp, Oryza sativa
atcgttcactaaaaaccggcacatatgtaataggtgcaagttcttaattagaaccagcacctattatctttgtgacgtgtccgggtcgagacaataggtgccggttcatagtaataggtgccggttctcattacgaaccggccctattacattttaacatggctcgggttatcggtgccgacttttcatgtaactgtgcggtacgagcgtgtatcactgccctctctacaaaatctgtagagctcgatgagatctacaactttgtagttggtaaccttttgatttaaggtcgtttgagtgtccgaaaatgtgttataatgtgtcgaatctatttgcgtaagtgaatatttaaaatttgtaaacagtctcggatcgagacaaagcatatataaaagttgtagatctagatgagatcttcaattttttagttgatgaaaatttcatttgtgctcatctatggtgttaaatatggattataagttaggacaacaatgtctcaaaagattagcatttgtttccaagacaacaaattttcgtaggtgagatggtaaggaggctttagatggagttcgaaattttgagtttgaaacttgcttgaggcataattatgaatatgggttgaaaaaatcatgggatttctgggaagtgaagtgtgaccgtatagatgctaaataaattgcaaatatttttttcgggttttaatttgtagcacctacataaatttcaaatgggtgcacccctataatttgtcggttataaatttagaatcggcacctatagtatcacataggtttgtaattagaaccgatacctatagtcaccaataaccgaggttattggtgccgaccaatatgtgtcggacctaaaaccggcaccaattggaccatggttgtatgtagtagtgattataggcaagattcagtaattaattacatatatatatatataatagtagtgattatatatagcctaattgttttctggaccactgttcttgtctatcttgaaccactgatcacctaaatctttagaacttctagtgtttccataagactaccttaaatttaaaaattaaattaaacctcaaataaattgtttgacatatagatattttgcccacggcaccgagatggcatagaaggtaacattgcaacatgaatgctcactgttggctgtgtagaaacagtattttgccacgctacgacggttggcgtggtgaaatctttgccacatatactatggttttcaaccagcaacaattttatatatatttccaataccattgaggtatgctgtgacctaaattttgtgtagaacttttagagcatttcatacacggcgatgttatacttcagttaatgctagccagcctgattttactgtggaaatgacagcaaaccaggcgctgcttttttactgcctctggtagttcatgtcactgtatgatatttaagtttatttattatatgtgatagattgtagggacaatcatcatatatagccaacttgttgcaacaaaacattagttatgcaa

SEQ ID NO: 50147 - DNA, 2936 bp, Oryza sativa
ttcctgcagcccataaaatgattcctagtctaatgaatctggacagattcctgctcagattctttggactagaaaacatcccatccaataataggttggtttttttgggacggagggagtataatttgcatgattttgtatttacttttacatttttaatatatagtttacagtacaatttcatttgacattttaggtcagagtagggctgcagcgttagctgccgtactgctatatccgcctctcaatgcaccaacgaagatacagtaggacttttattactaccggagcatgaccttttctaattaaggaggctgaattatcgagcgcgtccactctcctaattatccgtgtgatttgtaaaaaatattgatttattcatcctaattttctaaaaaaggaatatcaacttaccaacttctaattaatatttaatttatttttatccatatcatgcaccagaattttcaaacggatcctgatgggagtgcaacaacaaaaagttcatatataaatgaaaataacaaacgaaaaataatcaaaattaacataaccacataaaaacaatatgtcaatgctaatcctattaattaatagtactattaagaaaacagttgtagaatgtcttttataggtgaaaagttttcaaatataataatactataaattgtagttaatgtaattgcagtttaacttgaatgcaatcataatgtaaataggatatagttacgttgtgacttgaaaggatatgccatggcataatggtggaggcacatgcctgggatgcccacatatcgtggtttgaaattagaccacgtagggtttattaggtttatgtttcgctgcacacaaatctcaaagctaatcctgtgccaaaatatccaaagttttctcccttgtatagcaaatcccttaattgaataggctagatcagtcgatctaatgcaaatatttccaagataaccgtctcaaatgggcagcttgccatccatgatcgatgttatttcctcgttttgtctttgtgctgtagtagagtgacaaataacgaaaccaatacattcccttcaaaatttaaatgacgtccatagaaataatatgcgtccggccgaggcaaacgttcgtgttttatctctcgacttaacaaattataacttgattactatacgatgacggaaccaaaaattatcaaagtctaaggctgtgttcgataccaggagttctcaactccccctctcgttttccgcgcgcaggcttttcaaattactaaacggtatgcttttaaaaatatatatatgaaaattacttaaaaaatcatattaatctatttttataaaaaaattagataatacttaattaatcacgtactatggaccgctccgttttccgtgctcactttggaactggctagaacgaatgcagccttaggcagccctaggcttgcctccggcgctagacgtatatgcaactcttgcttagtcatatattaaagcataattatgtctattataactgggtatacattgttactattttgcagtttactaaattaagatggttatggctatcgtgttacatataaaatattaatacaatctttatatggaaactataccgttatctgcaacgtaacagtccgtaaggtatgtggggttaattatatatttatcacatcctgctggtgtcttattaatatatctcacgaaagtactcacctttctgcaatccatgcatctttttccgacaaacagtttaaaaagatgagcggacaaatcaagccagcaatctattggtcgtttcagattagacaaatggtgataatatatcagtaagtggaagatctacttttcatcatcagtaatataatatatcatcattaacagcaatatattagataacaccgcacttgacttctattgactttggtggatttcagctagatctccaacaaaatcctcttttggaaaacattcagctgtccctctagatgtatacatgcctatttttactagtttattgtactgtttgcatttcctagaacatttgaaagtgccacagttttcattattacaaggacgagattataaagtcaatatagtacgtgtggaattatctatttattttaacttgataatatatggccagtttacttaatgtcagttttaaattttataccaaagttgctacaaataaaattactgaggttgctcaaaacgtatttagtccaactcaaacaacttttatacctgggagaaatatcatggaaggacttgttatattacatacatgaaatgcatcgaaaaaagaagagtggtgtgatttttaagattgattttgagaaagcgtatgataaaataaaatggtcatttgtacaacaaacattgaggatgaaaggtttttcacataaatggtatgaatggatagcttcttttatctaaggtggacatgttgcgataaaagtaaatgaccaagtgggctctaatttttaaacatataagggtctaaagcaaggagatccaatgtccccagtcctttttaatatagttgttgatatgctagctatattaattagtggggtcgttccacatttggtggacgatggtctatccattttacaatatgcaaacgatactcttatttttcttgagcatgacttagagaaggcgaagaatatgaagttgttattatcagcttttgaaaagctccctggcctaaagattaatttttacaaaagtgaattattttgctttgatcaagcacaagaatgccaggaactattctaacatttttggttgccaatagggaattttccatcagaaaacttggaattcctatgctttttagaaaacttagtaacaatgattagaaaacagttgagcaaagaattgaaaaaaaaaaacttagtagttggaaacgtaaacatatgtttgtacggggaa

SEQ ID NO: 50148 - DNA, 7474 bp, Oryza sativa
ttcctgcagccccctaaagcaaaagataaagatactctacatgagcttaaccatgttcttcaaattgaacttaatctaaactataatgtaactcgtgtattgtaaaatactatctcaaaagaacgaatgcaagattactgtcattactattcgtctccccttgagttgaacatcaaattcaaatacaccaaattcctttccttccacaaattttgagttcttcatgaacatattaatagtacaagtcatatatgtgcgtgcaaatgcacatgttgacagtaatacaacttcttgtgtatcaattctaacaactaaacatgttgcatctaggccaaaattgcttcaaatacaaatgaccaatttactcaaaataatttgcatacatccataaaaacaatacttcatttgtaaattcatttatacatagaagatggacataacattatcaatcaaattaactatagacactgcataggtacatagtattttgatagataattttggtgcagggcatattggcatatagacttcttgtctatatattcgcaaattcgatgacattgtatctacttggacacaattaatataaattagttgtagcttatcttctctgatagtcatgcactaataaatatctctaagtcaataatatactctcttcatgatgagtgtatacatttattctatacggagaatatataattgtgcgttctgcaaatgtggcgtcaattagacaaagagaagatatatgaataattttattactcatttgcccaataaatgtatttgctacatgcaactacttacatgatgtccttttatgcaactttctaccggtttacttcttgtaaataaagtgcacaaaacgagtacaaaatagtaaagaatggttttctatacacaccttttattacaatcctagcaattaacatgattttctaatattcaaaggtatgtgtaatttacagaactactaacccacagaacaatcaattatcccaaacaaacaattgccaggaaataaaccataaaatattatgcttccaaaaggggtgctaaaacaaaggtttcacaagttcatggaagctcttttgcctaaaaacaatgtttctaggattaattatggttattcaagaaactaactaaatagttaaagcaaatacatagaaatacgggactaaggaataaatccttaattcttctctatttggcgtaaacccaattcatgaaggttcaaagtataaatggcgaatgtatatttcccttagtttctaatgtctcataggacttttccgcataatttccgagttccgcataatgccttggaaaccaaggacttttgaaataaaataccattttcggaccaaaatcacggttcgtgcccgactccttttaataggccaatttctacttggcccacctccttatactggctagctttaaaacctggccagcccatctcatatgtcgcctaatgggctattacgaccttcccccacaagaagtgggtgaggtatgatccaattgccattcttcaatggagacaatggatggaaccaatggcaaacgtgctagtgagccctcggtagagatggacgtctatggaaagttgccatggtcagaggcgaagcggcgatgcaacatctagtagcaccgacactggcattcgttggcatcaggccgtgtccggcgtccgacaatcatagctccatgttacgtgtcgatgaaactcagctcggcatataggccggcatggcggacggctatcgacggcgggtgctcacggcggcttcgaccctcgtcccggccgcgtgcggtagcgtgggaggcaagccgtgcgtactggcggcgaggggaggcgggcgtgctccttggcgtcactacgggcggcgaccgtcaattgcgttgtggatggcctcgaaaggccgtcgagtcggcatttcagatggcggatcgacgagggaaagtctctggattgattcggcaaccgttgacaaaggggaagacgtcatgcggtggcgtccgggtgtcgctacgtgcaggcagcggcggtggcgcctgcaggtgccgatgactcggatttgttaccatctacttcatacagatagcaatatgatggattattaacatacaagtcacaaccgacagagtatcccaagcgcgctgatccataagatcagcgatgacgagtgtgttaatatattcatagattaatgactatgttagccagaaagacgacaacttctaggtggtgtcgtgtgttactgagtgttaggtgtcgtcgttcgggacaacactccgtcgttcaattcaacggattatgtatgtgcaccttcctgtgtgcatggtaagcgcattcgggcgcgtggtgccaaacttcgtggtcggcgatataacaagggaagagtcggcgcaaatgccggataaatacatctattcatgcgagaaaataaaacgactagaggcatgatctagcatattactctcgctactgcaaagtattagaatagataaaaccgatactgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgggtgtagtatagatctgacgatcaggttgtctcatcatgcccctagaggggctccctgccctccttatataggttggggggcagggttacaagatagaaaccttaaccaatacggtatcggtttcctaaatctactttacaatcttatcaaaccaggactttaggctgttccataatatacagggaaacgtaatacccaagtcatgatctgttacatatttcatatatataagttatcccctataactagtcggataaccatgccgtgtgggtatggggtacccataatctccacagtagcccctgagaccttcacagtcggaaagataatcttctctcgaactagattactccaaagccgagtgcttcaatcatcttcgccatgatctcccgagtactttttccaagtcagaagactgtggagggctgaaaaaataaagtcagatgcatcgactagatgcacctaataggtgtaacccccgactatgtggttaattgaacaaaccaaacatatagtcaaggaataagtcatccaattaaccgagtggtttttgataattatagtcaaccaagtgacttgataccaatatatagcatatgcggtgtgaatccccgaataatatgatccaagtgatataccgactgcttggcaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcggttgataacctttacggggaataataattggtccagtctttgagcatagaagatagactcatgactatgaatccatgtggaatgtatccggaacaagtccaaattggagatataatcctcacgcttgagttgatgagcccctgagcatatagcttgtccttctgtcatagtcaaaattgtctattggcaatagcatggaggcgaagaaacagtcggtgatgacaaaagcaaaccgacgatgaagacgtagacgcacatcaacagtgatggcgaaatccaccaatcatgaagatgaagaaaatagttgacgacgacaaacgcaaccgacatgatgaagatgacgatgtcggtgatccagccaatagcagtgtagcaaccaatgataatgacaaagacgctcatcagcatttgcatagtaggtcaaccgtcaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttgaggagagttgatgttgttgcccaactcatctaaaccgaaatatttgaagttgttgaagtagaatgtctgctccgaagcaaagatgaagataatgactcctggagttgactcggggttgatgaattgattttgtcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgtccaagtagaaatcctgaatattggagagcctcttgttgtagtaaaataacatggcatcgcatgccgagatgtcgagattcacaacaacgtcatggttggtgatgtagcaaaacttgtgaagtagcagcaatagagtttgctggtaccgaagataataaagatgaagtcgctccaccatgatgacaaagttgtgttgccgtgatgaagtgaacacgagtcggcggcaacagaagcaaaccggtagtgaagacgcgcagttgtgaagataaaagcaccagtcggcggcggcataacacgagtcggcggcggaagacgatgatgtccatcagtagtggtagctgtataaaccagatgtagaggcgagggcactagttagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcagatgcggcggccggtcggtgaagacgtagacgcccaacaacggcagcatagtaggccagccgtgcaggcggaaacaccagtcggcggcggtcaaagcggccggtcggtgaagacatagacgcccaacaacggcagcataatatgccagccgtgcaggcggaaacaccagtcggcggcggcgaaggcaagccagtcggtgaagacgtagacgcccaacaacagcggcataataggccagccgtgcaggcggaaacaccagtcggcggcggcgaaggcaagccggtcggtgaagacgtggacgcccaacaacagcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataataggccagccgtgcaggcggaaacaccagtcggcggcgacgaaggcaagccggtggtgatgttctgactgatccattcctggagcgtaagagataagcttaaagccatgaatcccttttatgcatatctggatctagatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcatcattaatggaacaaagtttcacggattagaatttactactcgggtacttttgcaattattaagagcagaaaataaatttatctcatctctatgcttttgatttattccgaataatacttagcaccttgcgttactcggtccatccaacgagcccccgagtgctaggaatcggcccaaaggcaaccatccattggcaaaccaaacggaaagcataggaagatagaactccataactcgataggtacttttgtactcaaattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcagcggcgacgaaggcggtcgacggtgaaagcgaagatgcccactaatggcggcataataggtcagccgtgtaggcggaggcaccactcggcggcgacggaggcaggccagcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccaatcggcggcgatggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataatagaccagccgtgtaggcggaggcaccactcggcggcgacggaggcaggccggcggtgaagtcgtagacgcccaacagcggcggcataatagaccagccgtgtaggcggaggcaccactcggcggcgacggaggcaggccggcggtgaag

SEQ ID NO: 50149 - DNA, 2810 bp, Oryza sativa
ggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcagcgacggaggcaggccggcggtgaagtcgtagacgcccaacagcggcggcataataggccagccgtgtaggcggaggcaccaatcggcaaaagtagtgccgcggcgttacatgcaaacagcagaaaataccaagagagattaatctgacatttagagatcaatctaataaacaacaataagttgaaaaggaaaaaacccggcgaagtcggagattaaaaggaaaaaactcgccgagattgatctcttcgactgactccgagacggagcggaggaggcggaggtcgcagtcgcgggcggcgttggtgtccatcagcacgacgcaggacggcaggaaggcatcggcgtggctgcagccgtctcttatgcatccgattagatcggttttggcatgcttcgtgtttgtagatccatcttgcaacaccatggcatcctcgttgggtagattggaccagtaggcgtggtggtggacgaggacgaccatcaaatccgtcgaactgtcgttgccccgtcgttgccgtcgtgctgatgcaaacaagatcaggcagagaatagcagcgacgattcgtcttgttgaagtcgtcggcggcgaggaatcaaggagctcccaaagcgaagacgaagccggcgactcataaagttgattccatcgcactcgttgtcaggaaactcggcgtttacccctacctggcgcgccaactgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgggtgtagtatagatctgacgatcaggttgtctcatcatgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccacagatactcatctcgtttatctcgtttatccgatgtaaaggtatagctggtccggatatgcagctgccgctccgttttacacaagggaactcccgggggagtcgatgtggaccatagccgaggcgctcggctccggtgcaatgcgcgtggctagagtccagaaacaatcttcaacagcccacggcatgcagctccggccgtacatgcaagacaattaatcacgaaaataaatctggttagtgtcagtactataaggatatatgcatatatcagttgtatgcatgcaacatgcatgcgtgtagatgcatgttaatctaatcctccttgcatgcatcagattggtatacgaaaaccaatctgcacagtgcaccacatcggtactgcctcctgcatgcacagtgacccgcacggcgacagcgcaccggcgtgccgcgtgcctccatgtgcttgtaatccatccagccagccgaggcagatggttcaagtcgcgtcgttcctgacgtccatttgtccaggtggcttgcacggatggtgagcaaccacaccgtaccatcccggcgatttgcatcacgaggctcgccatcatccggacatgaaaacagaaaatactagcgcattaatctgtaaattagaaatcaatctaacaacaagaacagattggaacgacaaaccggacagacggtcgtgttggccggcgacgagcagtacacagataacagatcaatctccggattagcgtacgagcaatctcatgctgataacgtgttaaataactagtggcctattcgctgatccggagtagaagacaacgatttcattcacacaatcatatagtagatgaacacggatatagagagaggcatcacagctttattgctttctcatatgtggatacatcaaccaacctctcaaaccctctatctcagtatatatacccataataggaagagtcctattaggatacgtttccatatatttggtatgagctcatatttatctctggtaggagataatagtttcataacatatacatgaacatggacgatatttacaaggtggcaagccacacagtagagatttactcgtgttgatgaactgcagtacatcttattgatttctactgtagaaggaagcaacgacataattataacatttggagctttgacatactaattttatattactgttacacgtactatacatacgtgctcgatccaagtctcgtctacattgcaagaaaatacaaataatagtcctctcatacatatgttcatgcatcacctgtgtagtaaatttgatcaatttcctccacatcttgctctgttcgttgattgctctgagaaactccttggcagttagggtaggttccaa

SEQ ID NO: 50150 - DNA, 1406 bp, Oryza sativa
gagccatcggaagttttggaaagccagagacaagctgagactgtagaatatatacattctttcaaaaataattaataataactgagttagaaaatatcgcaaaaagtaggaaagatttatatatatataaaccaagagcacattgttagttttctcattttgtttttcattgccaagaaaacattgggctggagcataaatgctttatgctaatgtctgaatcaatggcaaaaaccaatttaagtgaaactaacatagcccaattgcaaaaattcacccactttcagttgtttgttatctttagttggtggacgatcaatgttttcaggtcaaagaagttatttaataatggaaatccacagtaccgtttttatctcctataaatatagcatgtcatctgactacatttttctgcaaacaaagccagggaaggtgaaagaatattttatagcagtatcttttaccatgtttacattgagagtcattaatctcaaaatattaacctttcttttgcagggcctgcaggaattaatgaagatgaaggccgctcttttgatgatactagtggtggccgtttctttcaatttgtgcacttgcaatattccagggaacatggaagaagaacatggtatgtacaaggatgtgcatgctgggaaggacatgcgcaagctgatcgatattgatggaaggactgcccctacaggccatgactatgaccatgtctgtccacgtggtatctatccttgctgaataataatgtcctagttctcaataggaccagaagctattggagccaactagtaattaatagcatcatctggaataattgtagaacaaatatttggatgtaagatttgtgtatgtttgaatccccacggggctattggtgtgagtgcaatatatctagtttatatggtttgtaacgtgtaattcttaaaatagtatatatatgctataaaaatactttagtgttccattgcattatagttgcctgcgtttatttctaacagagattatgaattatgataaatctggcatttcacctatgtaggaaatagaaatggtatctacgtgtttttttagaatatccatgtatatagatcaccgcatgcatacatttaacatttgtaatttcaaattcatactgccaactaatatgatcaattttatatttggatcaagttgttagatttgcaatatatgatcacatattgtaaacattattggcaatgacaaatgaatattgcagacattgttgccaaatttgatctcctaaaaagtataggtcacaggataattgttcttgtagttccaaaaaaacgtatggattaatgcagcttacaaaatgcatctctagaaagttctggctggaattgagataaaatctacaattgccactaacctat

SEQ ID NO: 50151 - DNA, 4708 bp, Oryza sativa
tttttagctgtattccaccattcgcaaatttgtccatcaccgccaagaccatcttcaacattcggtaagtacatgataatgtcatatcacttaattgatctcttcttatttgcaaaagttatgccatgcattcaaattaatgctccgttattgttcaaattgtagggatcgcaagagaaaatgaaaataattgcgttcctctttgttggtatgatttttgtctgttcatgcactaattgtgtgttatggaatatagaatcaggtagaccaccggaggatttgcaccagaataaaatgaggaatttattggccagcactgatagaaaggttgctcctggcgatagaattgatcatcggtgccaacgtatcaattatccaaattgcaagtgaatgagctattggtaaagcaaatgaggtaccttaaagatactgaatgtcagtgtaggaaataagatgtaattagctaggctggtttgtatttgtaatataaaattttatgcataactattcaatttagtatatattgttcaatcatattgagaattatacacttgtgatgttttgttggaaataatatgtctcatggtgttagacatcgtagtgcatgtggcattggtaggtagtactttgaatcaggttggttaacttttttgaatttggcaacaattcttcatcccacaatgaaaatatttttggctgtatttttattgttttatatttagatggtaagattcttattattaaataataagagagattacaaacctgttgtttaaagaaatataaataaaaaatatataaaaactaattatatgtaatatctttgaatgccacagaatataaagctgaccaactcttgcaaatgcaaaaacttatgaacaaaaatcaactaccttcattattcttccaacagaacaacaaaccgttgtcaccgaacaaattgatgacccatatgccatagatggcaccgctgatttgattattgacaaccgttcaggcgtgcaatccttgtatttatcgatgacctcgctagctggagagtcaccaacaaagagttaaaaatccttacatcgtaattatcatggaagatgaacaccatgaacctaattatctaatccttcaaagacttcattgagaaaaccctaaaaacatacaaaagacagatgaaacactggagtagcaggagatgtggcaagacacaagggatgggtttatgatgtttcccattcatttattgatttcctagaagtcatgattataaaaaaatattgttcctataggagattgcaagtattatttaatttcttaataccatggatgaggtctatattcatttattgatttcctagaagtcatgattataacaaaatattgtcctataggagattgaaagtattatttaatttcttaataccatgcaggacgtctatgctttgtgtatgcaatacccaagtatccaaatacacgcaattagctggaaaattaccaaactacacacactatatcagaatttgtgataaatatcaacaaagtctaccaagtatttgtatagaaatacatattatgtacacactctgtcccaaaattatatagtttgcttggttaaggtcaaattttgaaagagggggtgattttgattggttgagatgagaagcatatatgaaaattaaagaaaagataggtatcataggttgagatgtaagagtaggtggaggaaagatgtttatgcttagttttattgagggactaggtcgaatagttatattcgtgacaaaattttaatgaaagaaataagaaaattttgtagtagttaataagagtactactagtagtaaataatattcataaacaatatgtaaaggcaattggttgtggcctgcgagtcttcccttcatccttatgatgtcgctaagttttaagatatcctataagttcatccctagagttttccgtctatccctatttggtttgttaatatcattaatttattatgtaatgttttaaaaatgactatattgccttttacttggacataggttcaagattaattaaaagaataattctcaaaagttgaaatcaattttagctcttaaaaacagaagggatataattatttgtccccatatttgataacggaattttaaattttgaaatgcttttcagtttaatttgttgtctcttcaggggtacatttcacttctacctctatatggaaattttcttcgaatttggttgggattgatttaaggaaatacaaatttttttttggtataaggaaatgtagaaatgggtgatttgtgcaatttccacttttgaaatttcatcaaacttgatttatattcatttaaaaaaatgtttctcttttaatcccttctatatccattttgtttgtcatccttaagttgacagtaagattctcattgttacaaatccagtgccaccttggtataaaaatgattttactagtgagaacatcaattataagacattaaatggttcaaagttgtttcacccaaatttccgaaacaaatgtaggggataagctaaaactcatagaacaaaaatacagaaaaactttggggcccgcaaggaattttcacaaaacaatgtaagccctgtttagttccaagtgtgaaaagttttggcgtgtcacatcggatatacggacacaaatttgaagtattaaacgtatagtaataacaaaacaaattacagataccgcctgtaaactgcgagacgaatttattaagtctaattaatctatcattagcaaatgtttactatagcactatattgttagatcatagagtaattagtcttaaaagatttgtctcgcaatttacacgcaatctatgtagttagttttttttgtctatatttaatacccatgtacgtgtccaaacattcgatataacagggcgaaaagtttttgcatgggaactaaacagggcctaagacaactaacaccaagaaaatcacacgagcaagcatgaaatacatcaactgtatttacaattacaaggtttgatatactgattatataaaacaaataagtatagttaattggatatactaatatactacactgaaatgaaaattaagggcgaaatcttgcagaatcacacctttccaatatcatcctttgcgatttatgattacatcgacgaactctagctaagggactaacaccacttgctggtggtattcacttctaatgttctattgtattgatatttgcaaaactgtggtccatataatcgaagatctctcaaagtagattgaaagttattacttttattcgtgtttacaaagtgcaacaacactactcctctcaaatagatcgactaaactcgaaaccctaacttttctctaaactcaattctcacaaaatttataccggaaggaggcatcaactcccctctctatttatacctgaggtaggtagcctaaagccacaaactcaacttgtacaagaagtcctaatctccaaggaaacattcccgcaaaggaaacaaactttacaaactctaatcaaccaaactggacctttccaaattctactcttcatctcatacgcacacaatatctccaccgtatgccatgtggaatcttcacaaaccacgtacattgatccttagcctaagcatctcggatgctatcctgatcatctggacgtcatattctcgtaagttgactcccgatccatcagcggcaacactctctcgaatcacacctacacatgagtcaaccaagaaaccatatccgagcacaagtactctctaacttgactcaacatttgcacacaatagtattgcttacgcattgtatccatctagaagtcataaacatgaattaatcacgaaaatccaaagaaacatcctgaaactgaaactaacacagagccgacaggttagaccatcgggctggccggtttaaccatgcaacacacactggtctgaccggccgagtccacccgatttgaccggacccaaattgacaatcacaatcctatttacatcttccaaaactacttcgctaaatatctccaatatctacaccaattatccccaatacccattgctcatcatgaaataatgatcaaaacacactttgattttatagcatgatctcatgtttatatctacaaaactactatgaaaataatacagtaaactggccatatttttttttagataatggaattacttccggcatttgctcaacgagctacaaccatttattacaccaaatcgctcaaaagcattcacaatctaatgaaaccacaaagcacaccaatttaacgtaaagcaacacaagctaataagcaccaacacaagattaaagacccacaattattgaatcctcttcgtggacctccatctgtagttggcgaaaatctgcatgaccattgacacaagtttacgacatgcatcatttattagcttgatgtcttcatcacacctttgtagttgagcccaacactgaagccagtatgttgccctgaaaagtacatgtatataagatttttatggtgctttataataaccatatcatttctactaagccaagcctaacatattgcagatgctcctacaaggataagtttcttggttttttatcaataccccaagccaatccctaaaaatatgatatatactatgtggatggtataacccaaaagcaatatgtactgctctccaaataaatc

SEQ ID NO: 50152 - DNA, 1665 bp, Oryza sativa
aagactgacgaggattacgatcagttggatgggcaaccccctttcacgatgacgattgacccttagcatctctcttatcaaatgaagacaccccttactcacgcagcgatcacaaggagggaacaatagtgaggagaaagtacgtgcggtcaactgtcaccgccgatgtaatgccgtaattattgtgtacacgatgtaaactattttggatgtattgattatccatataaatcaattgatgtatggcatatgttaattacgcacgattattagaggtttcaacaagttcaaatcatgtatatgctagttatatgtgatacttacaatttttaaaagttttaaatcacacaggtggcaatttcatatgtacgttaattagagtttttaacatttaatttactagcattcatatgctaattataattgactagaggatttttaaaagttttaaatcacgcaagtggcaattttatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatatattggaatttttattaattataagtcatatatttgcttattacgatttatccacttaatttattacagacaaaaataatttttcgaagtaattgtcattaatctttagtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgaagatatctttagtcccggttgttctcaacaaccgggagtaaatatcttttctttactcccggttgttctcaacaaccgggagtaaagatatctttagtcccggttgttctcaacaaccgggagtaaagatccgggggtatatatattcccggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgccgccagatctccctttatctctcgatctctccgatctcagctcgatctctctccgtctctctccgtcgccgccgccacgccacgccgccgccgtcacggccccagaacgcaacgccgccgccgccgtcgtcgtcacgccaccgtcggcacgccgtgaccacgccgccgccgtcgacacgccgccgt

SEQ ID NO: 50153 - DNA, 5685 bp, Oryza sativa
gagcgaacgaacgtgaacgagttagggaacgtgaacgagcgaacgaacgaggacgatcgttaacgtgaaatgcaatatatatatatatgtatatatatgtatatatatgtatatatatgtatatatatatatatatgtatatatatgtatatatatatatatatgttacttcgcatttatcctaatacatttttttgtatttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggattggtgcgactcctagcaattgactattgtagtcttaattagacttagcatatacgcacgaaacacttagcatacattactatttagtcttagcatgtaatattatttgagttttaatataatattactttatttgtaattagacttggtatgtaattattgactacggaattggtgtgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaagtttgtgtagggttctaatgtacgacatttacacttagcatacatgacttagattgttaaaacataaatgtctcgtgacttagcagatgtttcttgtatcaacagatggctgaccgcgatgaggaacaaatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgaggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtacaagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtattcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttcctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccgccggtagagagatgatcggagcgaggatcagggacacggacttcttgcaaggagatgacattctctggatcaatttcaagggaatctacgaactataccagctggacgccctcgacgtctctattatgagttgctggattttgtaagtatatcgttcggttagatttcttactatacgtctcctttaataaattaggtccttgtatataagtagactatagaaaataatatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctatatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttgatcccaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatatatctatatacatatgcattaatttgcataacatatatatatgtgtataaatacatatatattatgcatgtatatacatataatataatataatatatatatatatatatacatatatatatatgtatgcatatatatgtattgaaacatatatatgcatggtttatatatatatatatatatataaactatatatatatatataaaccatgcagcaacagggccatgcaaaaaaaaaatggtcagctcgatctttagtcccggattggtactcccggtttggaaaccgggactaaaggggggttacgaaccgggactacaaagggtttctccaccagtgaaacataattagtttgtacttttgtttgaattgccatgttagattgaaaaggcacttgaagctgcaggaggccctaattacatatagagattaaaagataaatagacaaccaaataaatagacaaatagacagtacataaaatttcaagatgttcctacttggctcctagcaatcttgtgagcggtaggaaaatttataatctagttcctgcacactgatgacagatagaaaagagcaggacacactgctacagaatagcacagggaagatggccctataggtgtcataacagctaaaccagcacctatagtgcttttcctgcacacacacacgcgcctgaggggacaccaaaggcaagaacagacacattttgtgtacaataggtgccagtttttaattggaactgacacctatatttcctatcaaaaaatggtgtcggatccagctaaaaaccagcacattttgtttctatcccatcaaaatagtttataggtagaccaggatagaagtaatggttctttagatgaggaggagagccaaacacgtcattattttctccctccc

SEQ ID NO: 50154 - DNA, 4614 bp, Oryza sativa
aggggggaccggcgaaggtgtggtctggccacctcctcctctcgccccttcccatcgaccactggtgcttggcctcctctctgtctcaccccttttccacgctgggtggcctggtccaacaccgctcctcctcactggcacttaggagaggtcggatcgggtatcatccctcctcctctctgtggtgcctccttcccaccaccacttgggttggcctgatccgacactgcccctccctccagtatcgccccttcctaccggcgcttgtgtcaaaatttgtgatttctttgatttgtgcaaatgtggaatggatatgaggctgtgggatgtggagctgctagattcattgcctcgattcgagtcgatccattaagccgacatttttttgtgttcttgaaatttgaaaggtgcctgtttaggccccttcaagtccacctcaaaggtgctgcctgctaggtgctggttgaaaaatccagcacctaatgatggttcccaactagcacctgttgttatttttgtattagtaacccatcgcaggtacaacaaagttcagcatagagtatcacaattttcgcaactgatgccattgtcagccatttgaatttaaaatctataattatactagcaaactgctcattataaaaatgtggaaattatacatagtactccaatattatggccctagaagcctagaataaagacttcaagaaaactagttaaaggcatgtgctctataatatgtttgccaatcatgcagtccaccaatatgaaaatcaaatttctccagtcctttgaccactagtgtaatatcccaagaacaaagtttccagaaatgatgtaactaaagtgtcatgtgcaatttcatgttatttaaattgttttggcctttgtttggatatttcctgcattatgttgacgtcgaaaaatcttgtggcacatatgtacaagatatataataattcagaaaaaaaccatcataaataataaatggcatgaatagccttcttaaagggggagaccaaaaatggaaacattataaaccatataagagaaaggaaacaattacttgggcactcattcccaaatggtcttggccgagcaaaccaacatgtgatagacatttgattagggagctcacatataatcaagtgcatatattaattgctacaacatgtctatacgaacgttttgttttttttaacaatggggcgaatctcactaaataaagtaaaatgaagaattatgagttaagttttgaaatcagatagatataaaagctccatcacttgcaacatgtgcgttgccttaacaccgaaacataattaaattaagtagaaaaactggataatacacgttaacacaaaacgcttttattatctgcgattgaagaagtgttgtagtagttgcacgatatcactactgtaacctcttataaacttcatacgtgcatagttcagtctgaaagttacgaagaaacagtagaaagtaatagcatttaaggaagatgaaacacgcaaaagattacaataataagtaatatcgcacaagcaaaacacaaaccaagttatgaatcttgacaaatgcttgtctagatgtatagcttaaggagctagctacatctaggacaaagggagtagctcaaaaatgattgttgtcattcaaataagataaccatagcacaactagtgtagtggagcaagatcacgcgcattactaagtggacaagaaccgcgtattcacgatgaataattcttgacgtgtcatgcggatataaagggcaataataattttgtcatcaataacactgaaaatgattgaatgttacatttaccgaacacacactcttttaaaactatcttcttgtaatgaagttccatatagcataaatgaatgataaaacttttagcatctattaacggataaaaactgctactgcatcgccaaatagtttcttgatgtgccatcactagcacaaatcctcacacatatgtgacgggtcatcagtgacagctaagcagaaccgtcacggactcccttatcaataataggccgcataggcgaccgtttcagatgaagacccccatcttcagttgttacagatgacccctcatctgtaatggctccaaacctagccttaacatctctaacggctgtaggatgtagtcgtgacagatgaggggtcatctctaacagctctgcaaaatcaactattacagatgataccctcatatgtaatggtttctcttcttgagctgttacatatgagtatatcgtcagtcatccaactgttacaaatgacatgccacatttgtaacatttatgttctaatgggtgcccgagctgttacatatgacattcttcagctgttacatataaattacgtatgcgctagtccatacacgaggtgaagtgaacgatagaaattatgtcacccatagatttcttgaaaatacaggagaattgtatttcattacattaagtagaaagaaactaggttaaaatatataaaaaaccaggggagaaaaaaagatcccccaaaaaaaataaaagaaaagaatgcacacctcacacacatcacccaaaggcaatatctattaattgcccgggttaattgacctgaaattatgtcacctataaaaagaggaaaatgaaaatacagataccccaatgatttttcattgaaatgatctccatacatggtggtcgtacttgcattcattaatggaaagcagacaagagtaggggctaactagcatatggtgttcttacacaattaattgacgtgaatgttaaagcgggaagaatatggcagaaaaaaaaagcatgaaaaatggatgcatcgatccataatcgatgaaaaatggatgcgtttgcttgtcataacgacaagaattccaaagtggtcggctcagagggccatgcaagcatccataattgtaaaactgttcgtacatatatatgacaatctagcagggggtgtttgctgataaaagtgagcgcacacaggtatgtgtgtgtatatgtgtgcgcttgtgtagtggtatgtgcgcccacatgcgtgattctatcttcgatcccaaagaggaatttaagatagaaaactaacaaaagcaggatagtatatatgttcttttatatgcacatgcttaagtaatataatcttatctaatagaatacgtcacaactataatttatgtgaaatagaataaattaatacattgcgcacatcggcagagccagttcttaagcatagaatatgagcctaatagttctgtaagaggtctaatatcctactaattaacttattaccaaattaattaaatgattatattatgtaaaaaaaatgttccgggccactagccgtcgaaaccagcaagatgttgcaatttttgtggtggacggctagttgcttgcacgaagggtactaactaatagttaattcggttaatttaatttttgccaggaagctccaaatctaggactctagggggacatgcagcctgtgttgtggaatcatggtgtgggctgcgctagctctagtgattcaaaaaagctgtaaaagcactgtaggcattcgaaaaagctaggttacgaatatcttaaaatgcacttggacgttatggcagacattctatcaaaaagacaaaaatatgtcatcaatataatcaagagaagtggtccaatgacaagattttgttctatgtgtatgttggaggcataccacgaaggatcttcggccggacctgccgaaaccaaggacttaagcgacaagcttagactggaggcaactggcgaagatcgagaagggaaccgtgtggtcgaaagtctcatgacaaagaccatggctcggacactcagacttcgccgaacaagaacttcgtcagaaggcggtgtgggtgagggcgataaggtgaaagccttggcaggagggcccgggtttcgccagatgccgaacctcaccgaaaagtggctcaacgggccactgtgcccaggaaggtttcgctaagtagatgggccaagccatgtagcccaataagggcccataaatgtaaaggacacagtgtgtcctagatagtctctatcacaagaataaccatataaattcccctgtaaaatctaaaccctaaaggagagaatttgtaatggagctataaatagccctctagtgtcttgtaatgggggatcccaaaaatttttcgctaagtaatacaattgtttttacttccaaccactgttaagagaaccacgtctttcgacgtgacacagttgtctattcgacaacagtgtacattgtgcaatcgaagaaaacaaaagttgtaaagtacaattccatgcataccatttttctccttttatgtcatcgtgccattggaattttttcgctgagatcgactaaccacggagatgagaaaaatacttgtctccctttattaaataagggattgttgcgggtgagataaaaaatatctatggcaacgagctgcccgtaccacgacccctatgaaaaagatttggtaatttcggaccccagcaagcaattattgtgtccaaaaattttcggctaatttttcaatttttataaatatggttaaaatgtatatatactcaatcaga

SEQ ID NO: 50155 - DNA, 780 bp, Oryza sativa
gggctaaagatgttctttagtcccggttcaaaagggcaacgggcatatttgatctttagtcccggtgcgcgtccccaaccgggactaaagatcaactaaagatgatctttagtcccggttcgaatgctgtcagggcatgtcaggccctccccgtatctttagtcccggttgataacaccaaccgggactaaagatggtaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagttttaagaattatttggtgtaatattttatgatttttgtatgaataaagatatcttataattattgta

SEQ ID NO: 50156 - DNA, 6532 bp, Oryza sativa
cccgtaccaattttcatagaaaaaacggtacctcatggtaccttctcaaggaccgtaaaattattctaaacttatatatggacgtattactcagagatattacagatttcctattgtttttgtttggccatgattttaacatataggaaagcagaggtatctggtcgatccttttttgaccatatataaccttggaacagctgatatttcttgccaggaagcatccctcagtaaacatttgtgcttttcaatggaaaacttgctgttcatttgtactagtaccatgttctcaaggacaatgattttgaatacctcagtaaacaactcgttctttaattttctccaagactatattataaataccatgttctatttgaatgcaagataggactacatgctcgtgaatgattattgcctgtgatttgtgggagttacatgctagcccggtctcgttctgaaaattcattcgacaaagatgcttctgaaagagtgtgttcggtttccaatcttatgtagaataattttctagagactgttttaaaattgcatttaaaatcaggaggtccacactatagaggtaaaattttcaaatatcgcctagaatactttcaccttatctagggacagtttctacagcttcttttaggcactttttaattagctttttagttttattctatctagaggtacattttaggaggttaatatgcgttagtaaacgggcaataggtttattgtttgtacaaactgtgtctcctcttttataaacataaaagatgcttctaaaaatgactaaagagtcacaagacataaagatattgtgtaatgtgttttcatttgtagagacaattcaccacaaggcatttgttaggcattttcagaacgcctctatgttgttagaaaaatgtctctgtagtgttagaaaaacatatctacaatgtgtttttgttgtactgtaaatctgaaagtcaatcattttcatgtatttggtgacaaaatcactaccattcacttttgtacatgccatgtcacgaattatttatcgtgtgctcgttgttcttatctatattcgtgccgcacaacttcattcgacaaagatatttttaaaagagatgttcggtgatgcaccattcaatcattttccgtgttattggtgacaaaattattatagattcctttatggccataacacgccaagaattattcttcatgtgcccgctgtttttgtccgcttagtaatgcgcatgatcttgatccactacattccacattagttgtggaatggttgtcttctttgaatgatagcaatgattcttttcaggtactttgcatggattaaatacttatgctttacttgtgatgttgcccttattttcataatattatttatgtctttgatgttgtccaaatgactggctggaataaattcacaaatggttatatttgtgcgtgataacacataactataagtcaaattaatcacatatagaaacattttttttgtgttatagtatattatcccacgtttctacgaagtttgtcgtttggtccaaaaaaagagtcaagggaaccaagatgtttttatatagggcatcacacgtacgtatttaattttgctcctgtagttatccggttctgtagtttcataaataattatacattttatttatttcacgaagagatttgatataattaatgtaaaaggaaatgtttgcagagatatattgtagtacaccaacttgatcgtaactatgttgccagctccctaatcgaattgttaccatgaaattgttttgcagaacatgtgcccatgttgtgtcctttctccgatggtatccaatggttccattcttcatgtcgtagagtatggattagggtgtgaaatatcgaaatttctaggttaactcaagtaatcaaatgcatttatagatgcaggaagatccaagcgtagggcaaaagaaattgaacaacacaaaggcaaccaatccactgttgttacaacattttttgagattttagaacttcccttaatttgaaagagaaatttgattatccaaatggggtgcatagttagcttaatttctagacaaggcatctcttgaagtttgtattgcaggcatctagttccatatcatctagctacattgctaatgaacatttattggtggatttactggtagtctacattggattgctattatgttatagaacttttctatcttgatatgttaatatgaataaaactaacatgatggtcgtcatgattaaacatatgtcatgtataagtacaaggggggaaggcacaaaaaagtaagtgtgggttgtctagctagtttgatcagcaaaccagtactatgcaccatcggttaaaataaatgttttagcataccttaatctatattttgaaaagtaatcacatattgatgcaatatgtctaatatatattagtaatatttgatgcaagaatgtaacttgacaataatgccagcgcaatcataatttaacagttttgtgtatgaaaattttcagtcacttctcaagcataatagagaaaaatgtatcttctagccactttttagttagaacctggcgacaactacatatacaaggattcaaagattacagtgggaagtttccatgaggaacttagaagatcattatcatattttattcaacctggacaatcagacatgggaaatggtggagtgactagttaaaattatggaagatgaacaacctaattagtgtttatgaattttgtatctatggtgctcaatttctgtcgcagtaagtaatataatatgattttcagtataccctcttctctttgagtttacatatgttacaccattacctcataattcccacaacgtgcccattacttgagattaattctcattatttacccattgtgaattatcaattgtcagttgattatgtaacattaaaatgtttctttcttaccgactagcaagttacttttttgaacaatgatatcgtggacctaagtaaatatcaacacagaattgtatcatcttgtagaatatccagtaaaagagaagatcatgaaccaaaacgccgagttttcttgggcacttttccgctgttcaaattgctagatccctatatcattggctttgtatgggaagacatgagggttgagaacctttgaacacaaaagaaatactagctaataagtgcagtgcatccaaaacagatgttttattcattagacaaactggcagatctgtcagcgcacatgtcattcatgttcaatactaaagttaaacaatcataagatcagtcacaacatttatattatgaaatttctgaggtcaattcagatagctaaattttatttagcatatatgcatgtttttcccatttccctcaacaacatggaattttttgtagcactgtttcttcagaaaatcacactactggataaaccatctttggtcggttgacccaaatccacaatagtctcggttccattaaaaaccgggacttcacctcgtgtcagaggctgtcaggtcccaaaaatctttagtcccggttggtaacatcagccgggattaaaatcagtgattttttcctactgggactaaaaatcaatataccgtatataatcccttactcttatcctcaaaattttctatcttctattcctcctctctctctctcactcttatcctctccttctattcctcctatatctctcacactccttctattcctccttctctcgactctcggtagcgccggtgactagcaagcggcggccaacgaggccggcggcggggaacgtcggtgggggcctgggcacggtcgacggcccgcggcgagaggcaagaggtgcctgccgcccacggcaggagacggcggccgcagcccgcgacagtagctagcggtggctttatttctttctctttttttaagaatttgtgattcattggatctgtgttatttgatctgtaatgtatttgtgatgaatttttttatagaatttgtgatgtttttttctgacaatttgtgatgtgaatattacgatttgtgatgttgttactttgatctggggatgtaggagaatctcgatttggattttgtgatggtgagattggtgtgaaatcaatatgcaaacaccaataaaaaaaagagaagaatgggacatggcactaccctctttactaatcgggactaaaaattcccctctttactccctattagtgttactaaccgggactaaagataacgatctttaatcctggattcgtagtcttggttggaaaaccgaaactatagagggcttcaaaccgggagtaaagagcatttctccaccagtgtcactttgaaaagatggatcgatctgaccctaagtcactaaattaattcaaaatctacatgtaaatctgttctgctacaaaatgaattgagataaattacactattggaccacaagtcaagcaaattggtacaacatgaagcaagtaagagataattgtccaccagagatatcaaccgcgttcacatcactctcatatgtcctccacgctagttcacaagtacgtaaaccacatcatttgcttatccgccactctctcaaatttcaaagaggatagatggtttacaattgattttcattagattcatcacaaggacaagagaaataactgaaactgtgtcatgctatatgttttttttaaaagaacatatggtaacctgtataaagcttgtggtgcaaaagtaaaaaataatgcttggtccttgcactcaatttagattattcgacccaagtttacttaattgtatttacttagttgtagatgtacatagtcctacggtcctaccacaatcgcacatcaccccatgcccagacactaacatgctaatatgtaatgactccagatttgagtcctcaaaccatgatgtgatatctaaacaagagaataggagcaatagttcctccctatttttaaattatccaattctccaaagtagttatttagcaggacactgagggctgtgagtgcaagatatggtctgttgtctatatcttttgcgtatgttttcagttttgttgctaagataagataataggatttggtgatgggacaaacggttgctccacataaaattatagattaccagctgattcaatgaaaaaaattcacataggttttaccaagttatagtatatatagatatactatgccattaatcctcatagatgaaaagaccccttagctgccaatgcaagagtgcagggccttcaccattgacaaaaaactgaagttgccctaaaatttttgaagttgacagattactattctattatcatgcatgactttaacgacatagcacacactttgagatggatcaggatcctctgcagtcgaagtcacgtgactttgtcactaacatttgggcttgatgatccctggacccacacatgtcagtgacaaaggcatcatacatttgactgcagaggatctcaatcccattatattgaggtcatccaattagagacgtgacctaggacaacccatctcagtcacaattgagtggaccatatttagggaatttaaaacagaattatttattcatgcttgacactataaatatagccattgcgatgcgagcattaacactatacttcttttcgagcatatgatactaaggtaagtttatctgtattggacaatgtactacattcaattccttgtttgctttgttcctcttaataaaataagctacaaactttggcctaatatcatgtccctttgatatgtatagcaaaatcatgagcactgcacgagcaaatcttgccgcgctgtcgatcatggcactgctcttcttaggaattgtgattggtgatgcggctagagagactccgggaacatatttttctcttggtagaatggatggtcataatcctacagtggcttatggtgcaaatactcactcagacagtggggatatgaacaaaggagagaactcaattgcaggtcattctagtgaaagaaaactagggaccactacagatggagcacgttttgaaacccttagttggtattgcagttatatcgggaaaaaatgtctgtagaatatatgtatatctagccagtccagtcctagagtaataagtgtggcagctttctttcagtacatcgctatactataatgttgaaataaataaatctcttggactgttggactgtaaggcatgtatgctgtatttacatgtactgtaaggcatgtatgctctattttcaaatcaaggaggcatccttgtagaagttgaaatggaaaaagtaataatataaattaacttacatgtggtaatcccaatctctctagtttctggctggtatggtgttggtgtgtatatattgaatgatttgagcgacataccatcatcttttgtgtagcatcctacttttcctatggtgcttatgattgtgtgcagctgttgatttgattgtgcatgcatgtaggaacagtagaagcctgctagcagtgaaattcgtaataa

SEQ ID NO: 50157 - DNA, 722 bp, Oryza sativa
tcatttttttttaatccacgattccaacggttgctgcaactcaaacagaaaggtaaatgtcattgacatagcccaaaaatttttagagtaaaacatacgtgataaaaaaaaagatgagcatcacaacaacctacatgcagccatgcagactgtttctcaactaaaaacagatcgagtttgaggctggaggtgcatgtgtctattcacacttgctgcattagcactgcaaacatttgaatgtaaattaaaatcttaaccacaatttattactaaagtaaccaaggacttatccactgcaatatggattgtgggtgcttatagcactctgcttacccgttattgattttgttgatcgagcgggcacgactcggtgtcagagtgcttctagccttcgaacatggcgtgttcgggtatctgatccgtgccaacgatgccagtgctgcttccatccaaaccgtcagctctgcaaccaaaaggaaaataacatcaaagagcatgtataagagtctcattcagcagaatccaaacgggagtcgggcggcgcaagggggcggctcaatttattcatccaaaaccacgatctgaaaccatacatacatccaccatgcatgaccatgttgaataaaaaaggactctaataagctggatctgaaaaagaaagtaatgaaagtatttatctgctccggaggtgcaagagcaagatagatgcaaaagtatacacc

SEQ ID NO: 50158 - DNA, 2066 bp, Oryza sativa
ctgcaccccggcttgttgagcaggatgaggctacgactgcatttagaacccatcaggggcactatgagttcaaggtgatgccattcggccttaccaacgctccagccaccttccaacgacttatgaacactatattttctgcagtgataagaaagtttgtgttagtctttgtagatgacatactgatctatagtaagtcgcttgaggagcatgttgatcatctgagaacagtttttcagttgctgcagcaacatggtctctttgtaaaagctaataagtgctcctttgcccaacaacatttggactactcaggtcacatcattggagttcatggggcatcaactgatccagagaaggttatgactgtacaacattggcccactcccaggaatctaaaacagttgaggggatttcatggcctagcaggctactatcggaaattcattaaggggtatggtgttcttactaaaccattgacagggctactgaagaaggaagtcaaatacaaatggaagcgataggagcagacagcttttgatgcagtcaaaatggcattgactaaatcactagttctagctttaccagacttttctaagcaatttgtggtggaaactgatgccagtgacaaaggaattggagcaggggcatccaattgctttcattagcaaggcattgggtgttaaatcacaaatgctttccacttatgaaaaggaatgcatagcaattttgttggctgttaacaagtggaggtcttacctgcaacatgctgagtttgtcatacagactgatcacaagagtttcaactgggtacaagtatgcaacagaaggcctttctgaagctcatgggacttcaatatgtgattaagtataaaaagggggctgaaaatcaggtggctgatgctttgtcaagaaggggagaagaggaatgtgtggcaatcactgtcagcaccccaaggtggatggagcttgtggtagaagaataccagaatcacccatagaccaaacaattattggtatctttgagtttgaaccctgaaggggaggatgggtttcagttagtgaatggtgtaattcgattccatggcaaaatttggttggggcatcatcctgaagcacagcaagctgttcttttagctctgcataacagtggagtggggggacatttaggcattactgctacatatcaccgaattaagggtttgtttgcctggcctgggctgaggaaggaggttcagacctatgtgtccaatgtgaaatctgccagcaagactcctggattgctccagcccttaccagtaccactgcaagcttggcacacggttacaatggacttcgtagaaggattacctaaatctggggtgtatgacacaattatggtagtggtggacaagttttcaaaatttgctaagttcattcctttaactcatcctttcactgcatacacagtagccttggctttcattcaacatgtttatgatgtgtttggcatgccccaagtgattatctctgatagggataggatattcactagcgctctatggcaagaattgtttcggttggctgatgtgaagttaaacatgagctcctcttatcatccccaaaccgattgtcaaatggagtgactcaaccaatgtttggaagcatttcttcggtgtactgtgcatgctacaccaagcaaatggtctggatggctatcacaagctcagcattggtacaacacttcatttcacagtgtgttgggcaaatctccttatgaagtactatttgcaaggaagccaacccattttggcttagtggacacaggtagtatcactgtgcctgatattcagatttggttacaagagcgtgcacagatgaatgaggtgttgcaccagcagcttactcgagcacagcaaaggatgaaacactaggctgataaaagaagatcataacgtcaatttgcagtgggagactctgtctacctcaagttacagccatttgctcaaatgtctgtggcacaacgttcatgtcagaagttaagttttcgctattttggtccttttactattttggaacaaattgggaaa

SEQ ID NO: 50159 - DNA, 873 bp, Oryza sativa
atgacgcatctgctttgtcacccttggtgaaagagatccgtattctcgggcctatgtacctacacaacatgtttcctttcgagaggtacatgggtgttctgaagaagtatgttcgtaaccgtgctcgtccagaggcaagcatcgccaagggtatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctagcgaggggaccgtctgggtcgatcgcgacattccagggatatgagatcaatgggtacacattctacacgagagcccaagacatgaagagcacgaaccacaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcagacgaaccttttgtccttgccaatgatgtaacgcaagtctttttcgtgaaggacatgtctagcaaaggaaa

SEQ ID NO: 50160 - DNA, 6650 bp, Oryza sativa
ctagtaaccaaattaagtagcagcactgtgcagcatttagttattgctatgctaatctaagtgcgaaccttctctgcaagtaaactgaggaactgttcatatatatgatgcagcaacgccacgtagcagttgctgtcacgtcatacaacgcatcgatcactaattgacaggttagctgaaatacaaatactgttgcagaaaaggccagcgactggtttgctacttccagacttccagtatgtgcctggtcagtctgctgtttaatttaattgcccgcagatcacgttgaacagagagatacctgaattaagcagctcaatgccttgcagtagtttagtgcagttaggaaatccatgaattagcatctgttgaagtggaggataattagagcattttcaaggaggaggagtttgagacgtaaatggtattgcactttattcggtaagctgctgtactcactcactgtagtatgagcagtgccatggatccagcagcagttggcatatctgaatataatagataatacgtttctaaacatttctgatgattgatactacagattatgaggtgcatgtgtacatggcagcatgcccggtccgtccgggaaattaagcagcaacgctcacctcaatatgtaaccatggagcactagttagttgatgaattctccatgtattgccaagaacatatatacatactcatggagtacatacatttcggtggcgatcgagtagtcaaagcgagagatccgtcacccacgccaactcatgttcgtcgccatgtgcgcccatcctcccggcactaactctcaagccgatcgaatttgatcagtagcttaattatactttagtactaccacacccatgcattgctcagctcgatcatcagttcgcacatatcaaaattaaacactagctagtagctagctagacagtttaccagctgaatatcatatagtagtacacactcatgcatactatacggttactacacctatttattattcttaaattcgaattttcgatccatacatacacaggtatctcctttgctacttgcagcgaagcttccaaagcatggactagtctaattctttagtgatcgagggtagtgatggcaccaatttggatgaatcggtcgagaatggagtatttctcgcgtcagttacagcagggagtacgtagtaacagcagctagtgctcgatcgaattcgtcgacttgtagtggagtagcagctatttcagggaaggaaacggcaaggcagctatcttcgtacgcctcgttaactgcaacccatcgattgccacatctacacctacgtatacaaatacacaaataaatactgcatacatacatgatacatacatacacggccgctgctgatagctcctactccctccagcccaaaataagtgcagccataagtttccgtgtccaactcatcttatttgaaatttttatgattagtataatactttctccgttttatattataaaattttttagtattgttcacattcatacatatgaatagtactttatatatgacttatgttttttattttttaaaaatgtttaaataaaataaattggacacagaaactcacgactgtatttattttggaacgaagttagcagtagtagcagcagcagtcgtcgtcttggtacagtgcgtacacgtctcgatctatattagtttagcactctgcccgctgcagagacttagctcgatcgatcaattcatctcatcgtccatggcgcccaaggtggcggtcacggaggcgacggggcggcaggcggcgtcgttcgtgctcggctgcgtggccacgctcaccgtcatgctgctcttccagtaccaggcgccgccggactacggccgcgccgccaggtcgccggtgcagttctccacctccagagaccagctgctgctgcactgcggcggcaatggaacggcgccgccgccgccggtgatcgcacgtggcggcgaggaggctaacatcaccggcaagcctccgacgactgctactgctgtcgccgaggagcagccgccaaccaagcctcctgcgacctctactgcatcttcaccaactcatcatattccagcaaccagtacagatcttgaagaagaggttagttctcattaatctcccggcttaattaattttcacttctttaatttcttatgcgtcatctggtatcagtaatctgctaaatttgtgccgtcttgaattcactctgttgcccacagtttcctcacatgttcaaaattaactcaacagtacaactcatcataataaaaacagggggttcttcaatttcagtaggacacaactaaccctttttgggtgtctgccaaatgcaccaagaaaatgattttgtaagatatatgctacatataaccacgaattcagaaatcattccatgagacttgatctactattttgacttcgaaaaagagataggctaatcaatttgttatatattaatctcgatccttgattacctttttgtacttgtttcgagtgtacgaaaagtggcaaagaaagtcctaggatcttacaccacctagtgattcacgctaatttgatcatcaatggcggcagggcggcgagttccgggggttggcggcggcggtggcgcgggcggcgacggatgaccggacggtgatcatcacgtgcgtgaaccacgcgttcgcggcgcccgactcgctcctgacatcttcctccagggcttccgcgtcggcgacggcacgccggagctcctccgccacgtcctcgtcgtcgccatggatcccaccgcgctcaccggtgccgcgccgtccacccccactgctacctctacaccatgcccggcctcgacgtcgacttcacctccgagaagttcttcgcctccaaggactacctcgagctcgtctggagcaagctcaagctccagcgccgaattctccagctcggctacaacttcctcttcacggtaattcagtaactgtaaattgaaattaacaccgccattgactgcaaatcaagatgaactgattaattaaccaattgcaagatcaggacgttgacattgtgtggctgaggaatccgttcaagcacgtggcggtgtacgcggacatggcgatctcgagcgacgtgttcttcggtgacccggacaacatcgacaacttcccaaacacgggcttcttctacgtgaagccgagcgcgaggacgatcgccatgaccaaggagtggcacgaggcgaggagctcgcacccggggctcaacgagcagccggtgttcaaccacatcaagaagaagctggtgaagaagctgaagctcaaggttcagtacctggacacggcctacatcggcggattctgcagctacggcaaggatctgagcaagatctgcaccatgcacgccaactgctgcatcggcctccaatccaagatcagtgatctcaagggtgttcttgctgactggaagaactacaccaggttgccaccctgggcaaagcccaatgccaggtggactgtgcctggtaaatgcatccattgattttgattgtcgatcgggcagtatctggtgttgtaggctacgtacagtcaggaagatagctttatttgcacatgaaagggcgaattttgttttttttggtttgttgtagattgatgggtcgatttcaagttatattactgtatacctgacggcagacaagtatacgcatgatgggcaaactatatgatatgatatgatatgatagtactttagatgtaaagatgtcatcatgtcttcagctatgattgaatgagaagtacatccatccaaagagagaggcaacaaaacaaaattcagaaagattatactatcccatctcaaaactgtctcgggggatcagtgcaagagccacatgcctcatgtttgtttcttctttgattgattgatggtccaaacaagacattttcctctcgcggacaaattcttttgggccctcagagctaggatttttttggcccaataaatttgatgggcctgaaaaggatcggcctgttaggccctactactaacagtgcacggcgccgcttgaagatgtgcaagttgaaaatgtggccctttcccgtccttccaaatttcttttcagttttgttacccaaaagtattcaaacaccccagcatcactacataatacagtatatctctgagtggtcttcaacacaagtgctatctttcaaatgctaaacggtaaaagcaacgatgtaaagtaaaaccatgcaccactgagagctcatatacttatgcaagtgacttactttatgacactaataatccggcgtcaccaagatggagcggccggtaggagaaacttcaccgagctagctaggcgccgagacggaggcggtcgatcaatctgttgccgccgtcgccgcagttggacgagcggatcctgaaacaaaaacgaaaaagaaaccttgatttatataagggcggttggatcatattcatattcatgtacaccctcccttttaccaaacttgaaggatcactttttattgcatatattacgctttggatctttctaatcactgttttcactttagacgaaatatttttataactcttttaaccatatacatttaacttgtcatatgtcaaaaaaaaatgatcttacatacagctatgagagtgtttttcaaataagagctgacgtatccgagatcgtacatataccagaaggctcagatcatggcacgttgcctgcggcgtacatactaatctcagaacacaactttgtactgtcttctcgatcattacagacagcaaattgttcatctgaacacacagctacagagcagaaacccatgatggagctctccttgttattgttatggatctccctactattactagtagttgcttattatcacgtacggtgatgtgatgatctacatgaaggagcgcatgcgcgggcgcacgatggactgggcgccatccacgaatatggtgctgccagtcatgtaccgggactcgtccccaaccaggtacagcaccgtggacgccacgtccttctccgggtccagccatctccgcagcggcatcacctcccccgtcgccttctccgccttctccttccccacccacaccgggaacctgtcgcccaggtgcagcccacggcacaccgcgttcaccctcatcttgtgcttgcccagctccattgctgacagctgaagaacacaacaaacatttagtacctcttacagttatgagtgttatatttcgagatcaacatggatcgaatcaattgttaactgcaatgcaagtatcgtctacagagttatgctgattcaagcatgtttatgaagaaaagcataaatatggccagctgagatatttcttcagttcagaactgctggagttgtcagccggttattgtgcttgcccagctccattgctgacagctgaagaaacaacaaacgtttacctcttgatttgagtggtgctcgaattcaacacaaacagaatcagttgttgattgaaccggaagtgctgtttatggaggattggaggctcttttctcaagaacaacatatatttggccaggatccttttttcccagttcagaactatcagggtcgtctgttagttttcaactgaaacatactgccatctaaatgtatgcatttcttcatttcaagtgcattgcaagcttaacattttcaggctttgagcaaagcatagagaagtaaagcagcagctctcaatgatgaagggagaacaatggtactagtcagttggcagtacttgaacagaagacttacccggaccaattggtgaatggcacctaaacttgtaccatatgcagcagcaccaggatacaatcctctctcagcaccaataatctgagttaagaatacaacagaccctccacaactggattctgagtcccggagtcgctttgcaattgcctttactagaaaccaaggtgtcattacattcgctttcattgtcttcttgaactcatcttcgcttatattgaggcagtcttgtacttcacctgcccatttgggaaaaacaaacatttgtaaatgaaaacaaagcgccattttgctgaagtagggggttccagattgtgtcatatcgtggttaagtttgatcaccaggcatacagggtacaagcactaaccaattgatcctttcagttgtatcctattactgacaacaatatctatctgatactggttttgtgaactaaggcacttattaagaaagctacggagaatgcgacatgaagtacatataaaaatacaattcactttattgttgcagaaatttacagtgaaatttcaacagttcatagttgacagacagactgatccacccattgcccaaggcacattttctcgggtagtaatctatgaaagatcagatagggaattttctctaaaattaaaattaggtgagcactgggcagactgtttggattgagcttagagcatggcgaaatgttgtggttctcagctacgagtacacgaattgaagtcgaccggaggaattttcttttgaaatgcagaggaacaactaagaattagctctgcaggaacagcatacagaaattcagaagtagtgtacggaccctcgtaggagtagcagttcaccatggcgtctaggccg

SEQ ID NO: 50161 - DNA, 1796 bp, Oryza sativa
actagtgctactaagattgcaaaactgacgtgacaaaaaaaggaggtaaatcgcagctaatagcatagaaatctcaatacaggctacaagaaactgaggctattccaaatgaatagaaacaaacttattagaatttcatttcaaagaaaaaggaatcaaattgcacccaaagtactattgctcgggtccaacagaaatttcactataaggcccaatgagcaatagccctttcttaagcactgctgtactaacagaaagtagaaattctataccatatccaactaagaatgttccacgactattactacagatgaagattttgaaacctgagaggctgagaatatagtgacaagtccagtggatagatttgctgtactgccaggagaagacagagaaactgactaatacaaacatcattgatcactgacccaaaaaaaaaaaaaactttattctttttcttcatcaagtccatgtctactattagaatgttgaattatgaattttaccctcgagctaacatatgtagccctatcacccaatatttacacattacaaattataatgctaaacaacgcaaagagactattgataactaggtttgctttaacatcccactactttgttagaaattatttttaaaacccatggaatgaaagatgtgtgttttcttaaaaaggaagaaatgtgtactccttccgtactcgtaaaggaagtcgtttaggacaatgtttaagtcaaaccttgggaatataaatcatgaataactctcaagttattgagtttcaaaatgtaaaaattatatgaatagattggtcttgaaaaatactttcataaaagtatacatatatcacttttcaataaatatttttatagaaataagaagtcaaagttgtgttttggagaccgtgtcgctgtcctaaacaacttactttacgagtacggagggagtacagttttagcacatacctgtggtgaattatcaacaatgaccacacgagccaagtcacgtccaagaactgatagatcctttaagtagtttccctccacaaagagacaggactcgcggtaaactcgatggcggaacaacctccttttaggatcaagaatattaagtagctgttctgcataaatactttgactagctgtgaaaatgatgatctcaaacatgcttgctactgtctccaagaactctttcagatatggacggcaacgcacatagattgtgtgctctctgagattaaaatgaactgggaatgtgaagtcagaatcttcacagggctcaagagtagagtgcaccagtgtctctgcatgacagcataacaataatggtacattaacattgactgcacaatataaagtacagaggttacatgtaatggctaacaccaaacaacaggacagactgtatatgatcaagtaaatgaacaaccggagatattgaagctaaacagaacaggaatgtgcacacatctcatagggtggatgttctctactccctccgtcccataaaaaacgaatctaggaccggatgtgacacatcctagtactacgaatctagacagaggtcacatccggtactaggttgtttttttatgggatggagggagtactcactaaaagctaagcaacatgctttacaattatatcataagtggaataataagcaagttacacgatcctaataacaatatgcaatccattttgacataaacttataactgtgcaaaatcaggtctcatgagctttaacatttccaagctaatcacagattattgactttggaagaaacataatca

SEQ ID NO: 50162 - DNA, 3437 bp, Oryza sativa
  unsure (1)..(3437): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgatggttctgttgtgttgatggcattgtgcttgactgcttgtgttaggaaacccatcataccatatatgtgtttcgtgcgatcgagtgcgagtttttgtgcaatgatgttatgtgaagttcagttaactgggacactcttttgctttgtaggacaatagcgttttctttttggggcccatatgggataatacatctcttatatgatactgatttgcgttgcaatgagcagaaatgcaacttttgagacaattataaactgtctgactggatacattacctatcttgaggtagagcgcctaaacaaaggataactaatctgattgtaaatattatagtgcaatcattcagacttgatctttttagggaccaaattgggcctatgttcaattcagtttaagccccgctaaattcatagcaacctgagcccccaatatagctcctgccaagacaaattttgattaagggccaacctacaaggctagcccaagtttgattcatgatgaggagcagcccagactagagttttacccttgtccaactcaagaaatgtttagtattacttggttgagtaatattgctctattggctgaaatgtgacaagcatcatagatagtactaactactaacttcgtgttttagttcaaaaaattaaacaatctatacctaattaaaaaatgcgtaagccttctgggagatttttcatccgtagtctttgtcatccgcacagtacgcgattttttgttcgagcaaaacggactctactacgcgagaccatcgttagtatcctgtgcacattccaatatgtcccaatgaaaacagaataaaatagatataaaaattgaagaaccatatacatagatgtgagattggactcgatggaaacacacaagttgaatttcaatcgaattgaataaagatcgaagaaccatacacttgacgagaacaaaaggttggaaagaagcaggcatggaaggatgaggacaatgtccttgacaagcacagatcaaggcctaccgtgccctccggctctcaaatcctcatcctgcaccgtctccctcacagcccacagggttctcctccctctccacttctgcctcaacccaaataccaggagggtcctgcccctggctgtcgcggcgtcgccattggctgccgacctgctgttcctgtcactgtcaagtcctgtcctcttgggaagacgacgacccagctcttgcaggttatacctctagcagtctagctcatagcttcattattctcattgagttattgtgtttgaactttctgccacttgcctttactatttgccaatttgtagttactgaatgtgctgttgatttgctgccattgtagtttgaggaatagggatattgctatcgaactatgtatattgtaatgtttgcacattttgaacctgcttgtcaaatttagtcgattattgattttataagatgttattgctatatttgtataactttttaactaaatttattctcatatatgggatttgcggtgtttgaaaattctggcatgtgatgtgaagtaggactacccaaccaaaaattccttggccacgccactgctccttagagctgtatgtattctcctaaacattatcaattctcagatattcagatcaaatatggacagtaagcctggcatttgggaagttaatattataaacttgaaaactaatcaaagctatgtgtttactttctttttcattgtgagtagatatttaggaatactatcagaacaaaataatgggttatcaattatcaagtaccttttttaaaatgaaatgtggcactgggctctaatattttaatttcttgagttgataatactttaggacttggtaatatgctgatcagttccaacttactttcttactgtggttttgatatataatttgtggacataaggcaattgctttccttttttttctctgtgtgtagggactctgttggcgagaggggtcagagagcgagggataatgcattaggccgtgtttagtttcccccatattcccaactttccatcatatcatatcacatcaaaaactttcctacacacataaactttcaacttttttttcatactcccaactttcttcaaactttcaacttttttcaggaactaaacacacccttagtgcacttccccactgcaagagtccatcataagtaatgttttgtcctaggtcctccatggcagctatgatctcgacaaggtggtggccagtggctaaggatatggtgattcagtgaaggcagaacaacagcttgcttccagggcctcctgtcctgttcagtttctccatgtctgtcatcatcgacgtccgcaactgcatccaactcctccgctcctgcagtgccgtggccggccagcagctgcaccagctccttctcaagtctggccatgtcccatcatcgctgccgccctctaactccttgctcctcatgtatgcgcgctgctccccactccaccagcacgacgcccgccgcctgtttgacgaaatgcccgtcaagaactgcttctcctacaactctgttatcacctcccacctcaattccagagaccaccatgcagcgcttaatatcttccgatccatgcccgagaggaacaccttctcatggaatacaatcataactggcattgtgtccacaggcaatctcgacatggcccgttcactgctgattgaaatgcctgtcaaggatcctgtggcttgcaatgctgttttgcataggtatgtccggcgtggccgggcggatgaggcgtttgcattactcaggacggttggtcaatgcagtggtgcagatgcctcttctccatggaatgacccttttgtgcttgcgacaattgttggtgcttgtgctgattggatgaagtatgattttgggaggcaggctcatgctcggatggtggtttccaagattgaacaggatttggtgttgagttgcgcattagttaacatgtactgcaaatgtggggatttggattctgctcgctatgtccttaatggtttaactcaggttgatgagttctcactttctgcactcatatatggctatgcttcttgtggacatttgcatgaggcgatacg

SEQ ID NO: 50163 - DNA, 2288 bp, Oryza sativa
cctgcgccccagctctacagtttcatcaggatcagcacacccatctgttgaggtagaatcttggctttgttcatcaatacactctagctttgagtgctgcattgcaagatatatagcagacacttcaggagaaaggctgcccaattcactgaattcatcaccttcgagcgtgcttccacatgccgattgcatatgaatatcataagagtgtttgctcaaaccatcaaaagtattgcatgatatgctattggtaacatattcagcattctgaacaggctcatgtatgacttcttcatgtactaagcctgcataatgacaatggcgtattggaaaatacaaactggagaagcaatgcagcaggtatcagtatgcacagagtgcatctaaatatgcaatgtacactatcatgaagtcatctaaaaaatgttgtttttcttattctctagataaatgcatgtgaaaaattcaaacacagatctgacacttggagtgcagaaaataaatgctaaggtggagttatattcaaaaggtaccttcgctcaagcagtcagtaacatcttccttctgattgtgaaaactgggagaaaatatggaatcacatgaacgatcttcatcattttcatgagattgctagcaatagaaaaagatcaaccagacaaataagtaaaggataaagcaacagtcaatttgaggttatttcagaaacaatattgctttcctcttttttcttttttcgcttttatcgaaacacaccgtatgttaaaatgtatgattacacaaatagacaacacctgaccagctaaaaaattcactttgagcagaaagaactttaccttgtgattgaagaaactgctacttggcacgcccgcgacatcatttccagtaccagcagaatcataaatagaattcaattttttcccacccctaagagctcgatttttcttcagaaggcctccacctgcagaggtagcaattcatatttggaacaaaatcaagaaaaatctatgtggagccacaaccaatttcaagaaaactaaagataaaggaaaattgaagaataatttcccaaataataccaagcataattgtagtagtggacaaaaaaaaggcacttaaacatcaggaataagcttggatataatgagcactgcagaacacaacaagtaggatgaaaagctctggaagttttcagtttactctcccatactcatagtttcatacattcctataaataggctatagctttgtactgtacataatagtaggggaaactttaccgatctgctttttggaggaagaagtgatcagatcattgactttatgttcagcagctgcagcctgagttgatctgcttgattttcggctatttgggggattgatatgctcagtggtggcatttcttgcaaggcctttttttcttgttggcattttcaatcaagaagtgtcctaaatagcagccgatttatataccagaacaagaatagcacatcagacaagcagacagcccgtttccttggtgaagactgctcagggttattgtgcaactttcagggtgctgacctagaggaagatgagaaaggaatcagctataagcagtacaagtcaacaaactgcatttcaattttcatacacgattgtttaaaatgatgatacacaaaagttggtataaaactacagaatacttcaggacgtcaaagattggaaaattaacttcatggaatgacatacaaactcactacatacactgaacttagctcttaggtacttcaatcaatatatgtcaaactctccccacagtcatcaaaaaacaggacgctactacggcatacacacttcagtcactcggtaggccactccgtacggcactcaccgtatcggcgttcgctactactacaggagtgacccctcagctcgcggcagcgacgaaatcgcgcatacggaagtcggaggaggcggtcgctggtcatcagcgccggcggaacccagcagcattaccggaaaatccaagcatgaaggtgtcgggagtcaaagaggcataccggaacaaggagagcagaggcggcggcgggcgggacgggaccagccggaggaggcggcggaaaccaaaccctagcggcggcggccggagaggaagcggacaggagaagagggatttttgaatcgtcgaagaggggagggagctccaaaagggcgagaaagtaagcgtgtcaggtgggccccacgtcagaatccagtaggtgtaggcgggccgcctggagcttggcccattaaggcccaatcaaataata

SEQ ID NO: 50164 - DNA, 2421 bp, Oryza sativa
aaggcaggtcggtcatacacgtaagataggacgagtatgagagagcgagagcaatagcaaagcccagtgatggcgacgctgctctccaagctcctagctctgcctcaacaatggcagctcctcctactcctcctcctcctcccaatcgcctccctcctgttggtaattggcaggaacaccggcggccgtcgtcgccggcggcatcttagactgcctccgggcccagcgcggctgccggtcctgggcaacctgctccagctgggcgcgctgccgcaccggagcctgcgggatctggcgcggcggcacgggccggtgatgatgctgcggctgggcgcggtgccggcggtggtggtgtcctcgccggaggcggcgcaggaggtgctgaggacgcacgacgccgactgctgcagccggccgtcctcgccggggccgatgcggctgtcgtacgggtacaaggacgtggcgttcgcgccgtacgacgcctacggccgcgcggcgcgccggctgttcgtcgccgagctcttcagcgcgccgcgcgtccaggccgcatggcgcgcgcgccaggaccaggtacagtacagtacaacgatagcctgcatcttgtttgtctccctactgtgtggtacacacaatttccatctaccaagtgggcaaaatttccacacatgtatgataggcctgcttggatggtgaggtgaaggagacattttcattgtacatgcccttgatgatgacatgttgataattggttggtggtaggctggtagctagctattacctccataccgaaataattatagttttaagtattaaggttcaagaagaaagatgtccttcattaaatggtgaatatgtgagattgtgagggtggttgagggtaaaattgagagcaatttaaatgagatatcattgatggaacaattagtactctagagtgacaactgttttgggataaattttaaatcctaaaaatgcaattattttgggatagatatagtactagctactccctatgtcccttagaaaaccaatttaaaatggcatgatatattttcttgtacataaatgtaaataagtttttatcttagatttattatataaaaaacttggatttttgtgggacgggggtacggaagaagataacgagtagcagattcgcgattttgtcttcgtctgtatgtttccacctattattggatatatggaaatctcgctagctgttggggggaagttgcatgcatttgacaaaatggaaagcatcggtgcaagtggatttgacaagtgaattactttatctatacattaaaattaataatctagaaggtgcttggttctcatctccagctttaataaacataaatatgattaaaatagtttagttgagatgttataagttaatgagagagaggagacaacaaatttgcaccttaatcagatcatgtaatgtacttacatgcttcctccattttttaatatacgaagttgtttacttttaacattatatttatcatccgtcttattaaaaaaaatatagatataatttattttcttatgattttttacatcaactaaattaaaatctcaactttatacttttacatatttatactaatttttaaattaatataaatgatcaaacgttatagtatctaattcgtattggttgatatatggaggattttgcaatctaatcaagtgcatatacattcatttactcatcacgtttcaaacatcaatcaaatagttatacagttcttaaataattgacaacatttaaatcaaaataaaagattcgatcataaatattactactccgtactaccataatttttattatagtgaaatctgtagggttttaccttagatgtgttgatgattgaaatatggcagtgatacaacgtatggcttggcacttggcaggtggagaagctgatcgggaagctgacacggccggagccggagccggtggagctgaacgatcacatcttcgccctgaccgacggcatcatcggcgcggtggcgttcggcagcatctacggcacggagcggttcgccggcggcggcaggaagcgcttccaccacctgctcgacgacgtcatggacatgctcgccagcttctccgccgaggacttcttccccaacgccgccgccgcccgcctcttcgaccacctcaccggcctcgtcgcccaccgcgagcgcgtcttccaacagctcgacgccttcttcgagatggtcatcgagcagcatcttgactctgacagcagcaacgccggcggcggcggcggcaacctcgtcggcgccctgatcggcctgtggaagcaggggaagcagtacggcgatcgccggttcaccagggagaacgtcaaggccatcatcttcgtaagcagcagcagcacacgtcgtcgtcgtcagctagtcaaa

SEQ ID NO: 50165 - DNA, 5482 bp, Oryza sativa
gaaggagacgctgcggctgcacccgccggcgacgctgctgatgccgcgggagacgatgcgcgacgtgaggatcggcgggtacgaggtggcggcgaggacgcgggtgatggtgaacgcgtgggcgatcgggagggacgcggcgaggtgggaggaggcggaggtgttcgacccggacaggttcgaggcgaagcgggtggagttcaacggcgggcacttcgagctcctgccgttcgggtcggggcggcggatctgccccggcatcgccatgggcgccgccaacgtggagttcacgctggccaacctgctgcactgcttcgactgggcgctgccggtggggatggcgccggaggagctgagcatggaggagtccggcggcctcgtgctccacaggaaggcgcccctcgtgctcgtgcccactagatacatacaactataggagtacaaatgaaatggaatttagctagtagcaaagccgcgacttcggccttgattagttcctaaattattttttttccaaaaacgtcacctccaatctttggatatatatatataaaatattaaatataaataaaataaaaaattaattgcacagtttgtatgaaaatcacgagacgaatcttttgaacctaactagtccatgattagccataagtgttacagtaacccatatgtactaatgatggattaattatgcttaataatttcatctcgtggttttcaggcgagttatgaaattagtttttcattcgtatccgaaaactccttccaatattcagtcaaacgtttattgttacaccctaaaattttctttttcgaactaaacaagcctttcatttcatgcctctctcccctacgttttgctgctttgctgttcaacatctacatacttattgctccttcacagatgtactcctacttcataaattaagattgggtgattagaatggattggtaatttgttgagatatgatgaactaatatctgcgtgtaataacaaagtttatgctccgtcatgtcctaattacttgaagaattagctgaggttgcgtgaatccccagcaagacgagaaggtgattccacaggaggcagattagactagagtggcctgtaaatgtgttttgccacagatggaggatggaacaagaatagtaggagactgacagagtgaatcatataattgagccctcatcaatccttagataggcagacctgtcgaaagtctactcgcctagtaggctcttcaaaagccggccataacgcatgccaggctcagctagtctgatgatctgctctttttatccgatactttttgccattcttcggaacatgtacagtcacgacggacctgaccagggtgatggcttgatctgatccttattgtaggtgatctgatacttatctcattcctccataccatgctatgctcttctttcacatgtaccatattcgatatgcccggtcacacgagagcaaattcattcatgtggctggggaatggaacccaagtggctgaggggtgtccatccatgggtcaacccaaataagcaagcaaatgtgacaaactcgttgagaaatttgcagagaagaatataaaatccaaatccccggatgccctccaaaaagctaaggtgcacagatacacatctcacattctcacatccagcaggccaatgatccgttgatcgccaccttttgcttgtcaagggccaaatattcttgttgtgccaaacacgctgcctccagccaaagtcagaagctccttccttataaatatatgcccaggcatgcaaccatcagtacacagccacaaatgcaagtgcagatgactgactagaagagaggtcttgcatggaagtaagaggccatcttcgatagccaaggatgatttgcctgtagccccattgtcatcagctctctccgtcgagagcgacaaccgggctctactggcaagtctcctcggctacccgagtacctcttatgctatcccatgtcagacctgctcttctttaccatcagtgatcatcaaaattcacaacaccaacaatgaggtaagcaatctaagtaacaaaacgtcccagtgattaccttggtggcgcttgtatgtaccaaaggcatcctctatggctacactgtattattctgcagttctgtcattgccaatctgccattgtggtactatcagccaccaccatgccacaaaaggttacacttcggctgaaaacacacgtcttgtttagatatttagtatttctggagttcctcccaaaaatatatgatctaagctttgaaaaaatatcaaggatgatttttatttagctttgcacactcaactcgtagcctttcctttttttcctttcaaaaacacaggcacacaatctgcccatataaaacagagcagcaccggagtacactgaaaattcttcaagtgcaagactataatattagggaaccacggtatttcttgggggtgacattcaaaaaactatggtttttggataaagggtcccactcactatcatttgaaatgtatcaatgtctctcaccctatcgttccaaccttcatgtcaggccgccatccagaatgtcttaaaccaggaggtattaaggataacctgtgaggaaggaagaattggctgagtacttcaaaagaaacctctactacctgaatctggtgccttaccaatgcgattcaacttttcaaccaaaaaataatctggcagtactaaaaaataactggtctacttatttctgtcaattacaagcccataaagtcttcttttacttcaaatatacatgccatccgtacttgctcagccccccatttccaccttttagccagttgacctcatcgttaacacaagttggagaaacattgcatggtagtactagattgtacatgatgtaaggaatatgtgcaagtctaaaacatgttctagcattgaaatataagcgatcagttaagggtacaaattaaatcattatgtgtatttgcaaaaaggttattacaaataaaaccagaatttccgcatgtttctgagaagatagtcaagttatatattagcacaaccaagatataaacaaattcaacacattgaaaattgtatttgcacgataattaacatgttgaaatcattgataaaaatgaaagttaataagccatgatgaactccctacatcagttgtctgcatgacatagaaatgataataggcaaacaaaagttgaagcatgtcgaaatgtcaatgacaagtacagtggaagagcggacaggcaaacaaggcaacaatgaactgacaaatataagcaacaattttaaagatgaatattaaataggacagaaggaacacgtagctattttttgctgattagatggatggaacccataaggaacatagcctggtactgtttcaattagttcaattatgatgatatcaatcacctgccttacttttcatatgaacaccttacgggcaaaaacagcatttatgaaaatagttttcaatggctttcatgccataaagttctgtttaagcattctatatcagaccaacaacggatggagataaatgttgattgacttgaggacaaagttagatacagtttctatggacctgatgttgattttttttttgttgttgttggaaatcatttcaacaaagaatagtcttccccacttgatatggaataattcctcatggggatcatgtgttgacctttcatagccttttgcaaggttgaattttatgcattatttaacaatgaccttaaacagagctcaagaggtgaacaatgtatacatgtttcgaaacatatcatatttctcatgatttctggtaaaacgtatggtcaaaatagagaaactggtcctgagcaattttgagaatatatacctaccatggtcaggaaaagattcaaaggaaaaagtgcgctgatgtgccataaaggaaactatgaatagcatattgatttttatgaaatctgtgtggctgtcttgctgcatgtgcatacctactcctttgccgagtatgatttgcgcccttcctactcgaagctgtaatcctaccttacctttacaagaaaaaaattcatgtgtcctaataagaagctgtttgaatgttctcagcagctcttgcccctcactaagcctgtatgatgtacctcttactacactaccaaaaaactgtggtgccagccagaagtcatcgagaagaagcttgctaaggtagtcagctgacaacacaaaaccagtctaaacaacatgaagtaggttagctctgacaaccgaatttaaagttgcccaatagataagcaaatagccacatactaatgagtaatgaggctactaagtagtttccattttggattggtttcattctgtttactagttgaccacataatttacattttatcactacactgcaattattggctgctttctcaaaatagaggttcgcaacgatatcaaccagagtacttagcaactggcaattagcaacctccaatttcacaacacacaatgcataacacttctagatttcgtgtgcaacaaaggtgacctatagttctatatccaacataaatttgtaggttgactaaccaaacaatatagattaaggccttcagttgtgaccaaataaagaaaggcctcagtaggcatgtaggagtcatgaggcctctggttttacagaggcatagtctgctatatttagccttttatgtcgtgcactaatcaaaatcattatcatttcatgattatttctactgggtttgagagtacaatttgacaatccgtaagaacaccttttaaatcttgaaagcacagcacaaggatcagcataggaagtagtatatcaaaaccaagtaaacaatgatcacatttattacgagcaaatacagttgattcaccttattccattcattattcaaatttcgttcaaacaattcctttcgaactagcggagtagatggtcatcaaacctatatacacacttgggttgacaaatgccataaactagcagctttctatggaaatgaaacaaaaattgggggcaatagaagctaagagctcaccaactcaggaaacgctgtcgctcctctggagcttctggatggcggcatacaacttcctcctcgacccaacggcgccgatgcccatgtccttgagatcttccaacgttagcagcgggagcacctcgtcgtctacctcgtggatctcgaacactggcgcgtaccgagagagcccaagtccatccagccacgccttcacgccaccataccccatggacccagggagccggccgttcgggagaccccaatccgccacgccgtccgactcgtcgccgctggcgtcgcggctccccgaaaccctagccctggcagcggcggcggcggccgagtcggactggtcggcatcatcatagtaatgctccgcttcttcctcgtatccgtcggtgccgggagcagccgggatccaggcggtgcgc

SEQ ID NO: 50166 - DNA, 5908 bp, Oryza sativa
tgccattggcacagaacactgtcgaaccaaaaacagtcgatccatccactgattgatatgggccaatgtacctttcaaccaaatctatcactctctaattgcctgtccttttctctcaaggctaaataaattataccgttgttttctcttttactagttggcatcagcatgaatcagtttatacattatattatatagaatacatgagtatctttcggcaccaggaatcgcagatgagcttcttacataaagcataagaccagtattgggtctttttgcccgtcagacaagtccactcttgcttcttgtatgcatgaagaatggaaaatactgcagctcagctggcatgttccaagcaggtcaggcctaacagtttgcacacgaattttgaccagaaataatccacaagtccagctccaaccagcatccagattcagatgacgcagttgcagaaaaaagatcgaattcaatatggaaggattcttttcagagtccacaatatgtacaagtgttctgtgttcacttgttcagtctcaaccattcataaagagatactaacagagttcaagttcttgttgcatacatcttccaagtgccaatagtttatttattcacgattcacggttgtctgttcactgttttgtcccttgattcttcttttatttgacgagtgcgccatggtgtaagcatgaatgcgttgcgtattcagagaaagtgaatctgaattttctgttgatcaagtaacaaagaggaagacaccatcacaccacgctctacttgctgggttcagagaaccatgaaactttcagagtgggagtagactcagaaatcaattcctttatatatttcgggcttgttcacattgatgccaaaaaaaaccttatcaaattttggtaaattttggcaatttgccaaaattttggcaggatttcttatatagttaccaaaatttggcaggaaactaaatatagccacttttttggcaactttaccaaaatttggtaaggttgaaaataacatcaaagtgaacaggcccttcagctaataaaactcctacgctgtatatattttttccaatgctatgaaactctgaagcttgagatgaatgttcagagaaaaagaaaatggcaagacggttataaagtgtgccttttgaaaagtttatctataaatccatttttgggtgaggggcagttgctaaagacggatctttgttggattctttttttaaccagctgacttgatttccactgagcattttgtcctcctatgagcacctcatgcatcaatattgcatgtttgcaccgttgcgattttttatttctctttattttgtttgcttaagccgatgcatgaaggatgcaatttgtcagtgaaaatcaggtaagaagaatttgacaatcgtatggccagaatttttcaaaagaagaagaagaagaagaagaagaagaagatttttatttcattatatccacagtgtatctattgttgttttgttgtcttcttccaattcaatcagtatcacataaaaccaaaaaaaaaagactgaaagtggcaggtttttagattttcgtttggtgcattcgtcgatagtatatatgggtatcatttcttcataaaaagatggaaacagtttattgtctgcaagtgatatgtgcttgtcagctttcctgctgattataacaaataacagttacattgttgggtgactgatcagcctgatctaccctgcaattcagcaatccacacaactctaaacatgaagaaaaacattggcactagtaacaagatcaccatagcataaggcccagtttagttcacaaatttttttctcaaaaacatcacatcaaatctttggacacatacatggagcatcaaatatagataaaaataaaaactaattagacagttagggaagaaatagcgagacgaatcttttgagtctaattagtctatgattagccataagtactatagtaacctgcatgtgttaatgatggattaattaggctcaaaatattagtctcacggtttccagacgagttatgaaattagttttttcattcatgtccaaaaacctcttccgacatccggttaaacatccgatacgacaccccaaaattttttcttttccccaattaaacatgccctaaattaactagaaaacatactcctgagatcgagcaagtatttactgaagccatgccaatgcttaaaaaaagatgtagccatgaatcatgccaaagaaaatgtagtactactaataagcttagatcaaaatcaactttagtttagtttctagagagaaaaataaaaaatggttaaccaatcatattcatggtggcaatgttggagtgggacgtaggaatcgcaagcagtgttcccatcgacatacagagacagccggtggattccaaaacaaaaccggcgcgaggtgaagaccccaccacacacgtcgcttccaggtgggccctcccatccgcccacccccactcgcgtcgcggcgtccccccgcccacctttcgctcgcccatttttctgcgtcccggcggcggtggggccccgcgtctcgatcgccgtcggagtttgatccacgccgtccactggccgcgtaaacccaacggcccgcctctccccgccgtccgtttcccctccccctatataaccccctcctccccactccaacctccaaccacccccttcgcctcgccgccacctccgcttcgatccttggaagaggtgaggagaggagagatctagaagcttcggtcggtgctgacatggcggtggcgctccggttcgcggccgtcgcgcgggactcgccggcggccgccgctccccccagggtggggagggagcagcagtatctcgcgtgcgcggcggcggcgaggccgggagggaggtgttcgaggaggaggggattggtggtgcggtgccagagcggggcggcggcggttgtcctcaacaaggacgacgcggcgtcggtggccgccgccgccgcctcctccgcgacggggttcaccgtcgccatgaagttcggcgggtcgtcggtggcgtcggcggagcggatgcgggaggtggccgatctcatactcagcttccccgaggagactcccgttgttgttctctccgccatggggaagaccaccaataacctcctcctggtaaccatttctagctctcgctgtgattgtgaaactgaaatgtatggatttttctaccgccattctgtgcttaactgtgagtggttgattggttgttcaggccggagagaaggctgtcagctgcggcgccccgaaggcgtctgaaattcccgagctcgcagttatcaaggagctccatgttaggtgcgtttcgtttttcatttttcgtcatttcaggttagtttcggagcattcactcctgattattcaatttttcttgctttgctcaggactattgatgagcttggattggatagatcgattgtttcaggtattgtccagtgcttctttcgcaaaatcccccccccctcccccaaccaaccaacacacacacaaaaatcactggaagcttagtctgtctgaagcttcccattttcctttggttggcaaaaacctacactgcaaaatgtatattccatcttgttgatgcattgatttccatcttttggcacatgtatagtcgtcaaaatattgcgatttcacagtctggtttggtgtaaggtttagaagaccttattattttaaaggccataagatggtctatcaaaactacaggtaattcagattagggcattgtcatccactaaaccacatatctgtttttattcagtataaactaaagaccaccctctgatgggattttttttttagctacacaaacagtcctcattactatacgaagaaatttgatttcagaagttagacaatatttgtggttgaggattgtcaataaacacaagaacaccaattttcctttaatgttgtatggtggtgacaagacttgaggtcgttatcatgcattttatgtcattttcagcagagtacctttctattctgtatgcaacaaggtgatcttgtgtatcctatagcttagtgcctccaccctagttggtttaactaaagtagcggtttctaaagtaatgttcatacttattctaacaatgctttgaattcatacaatggacacataatcatcgagcagtcttaaagtagatgaggcagcaattgacatggcaagtgcaggtgatatacatcacaaggaagaaaacacattgtaatgtttgttttgttccagtttctacatacaacaaccaaataatttaaatgcagcaagtatggaaaataaactccaattaccctatttagaatccccaatctaatgacaatgaaatggaacatgtggcttctctcatgatctaaacctgtcaggtttctctacttgttttatagcccaccatgttttaaacatgaaagattttagacagctgaaacatggtatgctgcatccttagttataaatcataataccattttaaactttcaccaatcattcttcagcatattatccattggtcatcaatttatttttggtcaatgtagcatttctcgtcccttttgtctttaatggaagtactttctttagcactgtaccatctataaaagcactgtatttatcactgttaatatcaacaggtttattggaagaattggaacaacttcttaagggtgttgctatgatgaaagaactaactcctaggacacgggattaccttgtttccttcggtgaatgcatgtctacaagaatatttgctgcatatttgaataaacttgggaaaaaggctcggcaggtacatgcttctagtaaatgtgttggtgcagtagtttaattgaaggcttgttgagtgctttgtttcaatttagcttctagatccttttcatgataatataattcaaatattctatctaaaaaagcaacatctggacctgtgaaaaaaatgagagaatattactaccgtagcaaattgactaggttataggaataaggtaatttgggggacttcattacatttatcccttgctcatttgatttatagagattgtacatggttattgctagtgcaatagcacaaactaagaaatttctttccttatcaatagagctgatcactttcctttaaactgccaactgaaacctgctaagaaaaaatggcgtgcgatcagtttatttataaaatatacatgagtaatccactaaaacatagttcttttcattttttcttgtttcatagttcttttcattttttcttgtttccttttaatttctcatattcatttcaccataggaacaatgctggtgttccatagtaagttgatcttattgtgcttctatatgtgtgtagtcttttttaatggattgttattataatgagtatattttaattgttatttggtacctttttgttccatcaacacctaaaagttcctaagcatgcagcgtttacatgaagtttcagtgcgagcagttattggtatatgatggtggtccaggttttagcttgacgctgtctcaactaaattttgcttgattgcagtatgatgcatttgatattggctttataactactgatgatttcacaaatgcggacattcttgaagcgacatatcctgctgttgcaaagaggttacagggtgattggattgacgaccctgctattcctatagttactggtttccttggaaaagtatgcattttcccattactcatgtttaatgccatcgcgcctattcttttgcatttatgatgctgcacttgaattacatttgttatatttgtgtttatgataatgcacattaaattggaaggatggaaatcatgtgctgtccccactttaggcagaagtggcagctacttgactgctaccacc

SEQ ID NO: 50167 - DNA, 5769 bp, Oryza sativa
gttttaccggctgttataactctttttctttttaaatctctaacaggtatggaaggatgttgatggtgtgttgacatgtgatcctaatatttgtgcgaacgcgatacctgtaccctacttgacttttgaggaggcagctgaacttgcctactttggtgcacaggtattgtagagcttattaccatgtgttgatacaattatttgacactctcacggtgattgagatagcatggtcaactactgttgccctaacagaaatacgtttgccaattgttaggttttgcatccccaatcaatgagaccagccaaagaaggtgatataccagttagagttaagaattcatataaccgtcgagcacctggtactgttattactaaaacaagagatttgagcaaggttcggcatatgaatagattttgatacgtctgtttgtaaatacttcttgttaatttctgatttgtgtacattatttttcagagtatattaaccagcattgtattgaagtcaaacattactatgctggatatagtgagcacaaggatgcttggccagtatggttttctggcgaaggtattttaatatgctcattgctcttcctgtttattttgttgacttatgcatattagtaatttgttcatatttttatgctcttgtgcaggttttctcaatatttgaagatttaggtatctctgttgattgtgtggctaccagtgaagtcagtatatcattgacactagatccatcaaaactatggtgtcgtgaattgatccagcaggtgagtttgagacagatcacgtttcgatatacatgtgtgatgtgtcaaacattgggtttgggggtatgaataaaatattgtacaaaagcctgaagtttgaattgcttgcgaatagctgaatgtgtttcatttttagttttctttggctttgatgaatatagatacttggaacagtagatagcccacatctagaaacctgttagggcaatttaaacttaaaaagaacagataatggattcaagttgttctgcaggattagcactttgctgatacatcctgaaaatacgtactgcaccagctgttctcttaattcaatattcatttgttttcttgggatgatgtggcaggaacttgatcatgtagttgaagaacttgaaaaaattgcagttgttcatctactgcagcacaggtctatcatctcactgatagggaatgtacagagatcgtcattgattcttgagaaggttattatctcttagccaccgaaaactctggttggacatattgttgatgaacacgattacttgcaatcctgtatgctagggtgtacttttatttttgcagggcattgactggtttgttttttgcatctaatcatttacatttgttgctgtacgccaggctttcaatgttctacggagaaatggcgttaacgtccagatgatctcacaaggggcatccaaggtatccatctctcctccccagatgaacgaaattcttttgtgcaaatgaccaaagggtgtatgacaatactcactgtgcgtgatcaggtgaacatttcattggtggtccatgatagcgaggcgaaacagtgtatacaggcccttcattcagcattctttgagaacggtttcttgtcagaagttgaggaagaggatcttcaacacaatggctctcctgtgagcccaaatggtgtcatttacggaaactagtcgacttagcatttcctgctgttgtggtatctttggaatttggataggtttaaaggtgattcaggcatatagtcatttaggccacctaggtgaaatggtgaattccctggtgttgtaagagccctacaaggagcaccctgtgttaatgataatcacgcatagcaggctcacttataatgttaagtttgctgcaataccagcggtgcgatcgtaaataacattgtttgttatcttttggaataaagaatgatccggtgttgaaacaattccctgaaaaaaacattgatatcaagtttaaaaaccctatcacagttgcggaagcaccagtgatgtgatagttgtatttgtatggtttcacttactaaggtttaaacgctagtgatcataaatatcacgcatataatcataaatattccacgcagacaaatatagtctcaatataggattttagtgagtctaggttgtgcattctaccgttagtgggccaaattataaaagttcaccggaggtcccatcaacttaacagcgagcagtaaattttgaattttcaattttcaatttagagttgattttggatttttttattgaagtttatttttttagcatttgtttttagatcactatgaagacgtgtataaaaattttatttataaatcatatttcgtttgtaaatacgatcgaggccgtatctttgagagtttgagttattttagagactgattgtgcgtctatgtgttaaaagcgaggctgagatgccacgtgtgagtactaaaacgcgagagttctactagtcgagtcgagtcgagcggcagcgcagcgcctccgcctcggcaagtcggcgacggttgcctggctgttccgcctccaccgcgagaggctacgtcggcgtcgctccgcgccaccaccaactcgcgaggccgcgacgccgtcgtcccgctcccgagctcgctccgcaagtacggcgacgacgcccgtggcgcgccgacttccatctccggccgccaactcgcgaggccgcgacgccgtcgtcccgctcccgagctcgctccgcaagtacggcgacgacgcccgtggcgcgccgacttccatctccggccaccgccaactcgcgaggccgcgacgccgtcgtcccgctcccgagctcgctccgcaagtacggcgacgacgcccgtggcgcgccgacttccatctccggccaccgccaactcgcgaggccgcgacgccgtcgtcccgctcccgagctcgctccgcaagtacggcgacgacgcccgtggcgcgccgacttccatctccggccaccaccaactcgcgaggccgcgacgccgtcgtcccgctcccgagctcgctccgcaagtacggcgacgacgcccgtggcgcgccgacttccatctccggccaccaccaactcgcgaggccgcgacgccgtcgtcccgctcccgcgtgctctcctccgcaagtcggcgacgacgcccctggtgcgtacctctcctctcctctccgcctcctctctgaccgctcctccgccttcacagcccgccgacgagcgccctccgccgtggcgccgcccctccctctcctctccgattcttcgatcgtgttttggtgttcggctgttggttgagaatttctgtgtacctcgaaaaaaaaattcggctcgcttggttgagcattttggaatttgctgctactcatttgattgtttcctgtccgatgatgctatggttttgttcgtgctactctctccgttgttgttttttttttttgtgtgtgtgtgtgtgtttcttcgtggttttccccttcgttgatgctagggtcgttcgtggtactcatctccgtcgattttgcgtttttttggtgctccgatgaggcgatgatgctagctagatattgtcgtgtgacgactgcgagtgcgagctgtcagtttttcgatcgcggtgttcttcttcttttcgcaaatggacttggtgcttttactgagctatcttgctcgaacatatttaatttcggaagtctttggatcgtttcgtggcaagattttggatgattgctgatcttgttgttagttttacgttcctgtctccaccacctctccaaggcgcttcatgcgcgtacatcgtcttctggcttctcttccgttcgtgctccgcctccgcccaaaaaccgccgtggccttggttcacagtttgcaagccgcggcgagtgccgacgctgacgcatcttctgcactgcgaccagctacccatttgattttgttgtttggttggttttttcgatgagttctcttcggttttgcgctatgcacgctcgcgatagaattccgccgaaaagacaccattcttggctacttgtggttttctgcgtctctcccgtgctccatcgaactcttgggttgtttttctttttttaacctattcgtattaaaggagagggaaacactatacaacagccgtgaggctaggagcttataaaattgaaaaaaagagagaaacagtacgtggttggggagggggcgaccactagaggagtagagggtgcgaaaagataaatttcttgattacggattattgattgtgctaccacgggtatctggcagtagggactggattaccttcgctccacttgcgcgccatagccatgtttcgtcaattgcccggttaatgattccttgcggtggctcttgggttggttttttgagctctcgtgacccaattccgtcgagaagacgctcaagatgccatgctcggcaactagtgattttctgagttgtattgcgctcgatcgagatgccatcctcggcaacttttctgtcgctcttgcgcttgatcaaactccgcaagacaacgccggagacgccatcatcggcaatagttaagctagcctattgtttgttgggctttgggttttttttagtgaaatatatggccggcccctaaacttgtgtgttagtgtcacttaaatccgtgaacttgaaattgcatgtttaggaccgtgaacttggtttaatgtaccaccccttgtccaaatgtcatttgactgtgtttgaccgccaacgtggcatgccacgtaggcaacacatttgttctcaaccccctccacatcacaacacgtcgcatatatctcctcgtagctatatagtgacaccagaatcccaaaaaaaaaatccttaaatcattcttccctctcattcttctccttgcgtgtacagaaaatgcacgccctattagcaattgacattgctctgcacttcaaaatgatcttatccttgcacaaggggcactgcacccaaccccgctgcactgcgctgccttctgccgctaatctcaccgccgaggccgccacagccgctacctctcggcctacttctgctaacctcaccgtagagaccctagttaatttagagatattttgggggatttgggttgaaatgcacgggtcagggcgagttatgtgtgaaggtatatgtggaggggtcgggggactgagtacaaaaatgttgcctatgtggcatgccacgttggtggtcaaacgtggtcaaagaacgattgaactgggggtggtacattaaaacaagtttacagcccacaagtttaaggaccggcaatatattttactctttttgtttgtactctcttgtttgtgagatttcattgcatttgtgatttttttttcagtttttctaattaaatttccaaatccaatgatttcttttacgcttttatgagatttcgttgcatttgtgtttctttttcagtttttctaatacattttcaaatatttgatccgtaggctaaagcataatgtcgtcgactcttaacaccctaataagaactttcctacgagggttctttagggaagtaaaagaggaagtcaaaaacaaccctgatattgttcgagaggtgtttgagaagaaatttctgatgagggaaagttgccactgccaagcgctgatgaggctcttcagctgcctgaggaggttattcagctgcctcccgaggtgcttgagcgaatttctaatgttcttaaggaaaccatccagactactccgatggggctgcaggaat

SEQ ID NO: 50168 - DNA, 30672 bp, Oryza sativa
gcatgatgggaacctggagatgtttgatgatagcaatgaccatggttcttcagacgatgaaggagccattcacgatattgttgccattcctggagaaggttttcaattcaatattattgctattactggaggagggttccaattccttgttgaggtatttggcagtgattcttcaaacgatgaaattcagaatgttgctattcctggaagagggttccaattccttgttcaggtatttatccctgaattattttcataatgagttttcagatcatgtactgaattaatcatttggagttagtgctatttctggcttcgtgaaagtatagccctctgtccatgcttattactatcttaattaatatctttaaaattacattgcttttactctcaggttgccatacagtcattaatatctttaaaattgcattgcttttactctcaggttgccataccagtcgcccccacattcaaggtgttcatggcattgacaaagtttgaagggttcactgcacccccttacagccctaacaatagcaagaaccttcccctaacagcagccctcctcaagtttattgatgcggtgaatcaaggctccttagtgccatcagtagtcttcctcaagtttattgatgcggtgaatcaaggctccttaaagccatcagtagtcttccccagttctcaaatttctggattcaatagatcaaggctccttaccaccagtaccagtcatcctgcagtgcatgaatccaatggatcaaggctcctttcactcagtgcttagaccccagaagctgcggcatgcaggatatatatagctaggacccgacctatttgtcattcaaaggagaggaaatgtagcatagatagatagcattgttggttcgagagttcatacatatttgccgatacttgctgatttgagtgaaaggacgagtgagagatttgaagatgggcttcaggtaactgccgagaaacaatctggcttgtctagtttcgatttgatgaaaacttctgttcctagcattccttcgtttaacccaaatcatgtcaatatcacttgcatgttattgcattaacctgctggtagtttttgaccgaggtgactgttgataatgctggtgctgtggtgtttccaagctattgcctgctccttaatttgcatcttcacagtacgcgttgacactcaaatgcgtaccatattttttcatgttgggggtgttgcgaattttgtgacatggaatcttctttggtagataattggcagctagattaggccctgtttagtttgcgaaaaaaaaatttagtgctacattatatgtttgacggatgtcggaaagtattatcggacacgaataaaaaaactaatttcataactcgtctaaaaatcgcgagacgaatcttttgagcctaattaatactccctctgtctcaaaatataagcattttattcatagttaaaaatgattacattttgagacggagggagtatgtcattagcacatatgggttactgtaaaacttatggttaatcatgaactaattaggcacaaaagattcgtctcgtgatttccccctaactgtgtaattatttttttaatttatatttaatgcttcgtacatgtgtctaaatattcgatttgatgtttttaggagaaaaaattaggactaaaccaggccttagttctctgcttttgcccatggagtgcagggatcgatattcactcatagtcgaatttgtcctgaatagaagtctaatctgcaagtataatgtgagcttgccttttgaacgtgtcgagatctagtcactaattttcgtattggttacgtggttacgctcagcatcaaattttaacttttcaatgggacaatttattttcatgaattttgtagcatttgtcctaaatttcgtattggttaatggcggctctagttccagttcttcaggccaaaacatcagtagctattggagatggacagcgtacttctttttggcatgactcctggctcgactgcggtcccttaagtaccaaattcacagctctgtttactcatgcactagacaagcaagcctcagtctaccaagttctttcaacaaactcgcaagcctgttttgtcccaaggctgaaactcacagcttcatcagctccaagagctaattgcttccacttcgctaatcccctccctggatgaaagaaagattacgaatagtgctgcagggagtttactctcttctcgtatggtttatgaatcgtcattccaaagccaacctctctgtgcaaactggaagtttatctggaaaagtaaagctcaacgaaaattcaattctttgcctggttacttgtgaaagaacggctcccgacaaaacaaaaccttctcaagaagaaaatcgtgacctcagatatttgtgagctttgtaacagtgaacaagaaacagccttccatttctgctttcgctgcatcattctggcagaaaatggggatccaggctgctattaactcgatgtcggagctcgctcaacttcagaagccccactgtctgccggcaaagcatttccaagttttcttcctactctgcttctagggattgtggaatcatcgtcatgatgtgatctttcgagggatgtcgatatctctcccacgcctagttgcaaagtgcttagaagatgctgctcattgggcagagcgtctgaagatagacgacaggattgtggtttccgtttggaaggaaatcatttcttcctcccttcgtatctctccccctatgtaaatgtaatctgtgtacttttccgccccttttaatgaaaattcaggtgaggagcccccccccctctgaacagtactacgtggttacgctcaattttaactttcaatgggacaatttattttcatgaattttgtaacatttgtcgactcgttttttcgtgtattcatttcagattgtctttgctcactccttgatttttgtgtattcatttaatatggtctttgttcactccttgatttttgtcaactactccattattattagcttagtagtaactactaatatactccccacgttatatataagtatttgacattcaaacaatattcggtcgaactttttgaaactttgactcttaagttaatttatgtgagaataaatttatgaaatctaatatgcaaccgtagcatatttacaacacaaaccaaattatatatttccttgaaaaaacatttaatagttagtattgaagatcattttttaaagaaaaagactgaatactattttaaatattaaatatttatggccgaactgagtatcttattatatgatcaaactaccgacacttttcatcatcatcatcatcattatgagatataaaactcaactcaatcggcatatcatatttactgttatatataagactttaaaaatatatccgtgtgttgcaacgggtaaatattattttaattttattattattattatacggtttagttagggtaaaattcattatacgaattcgcttggataatttttttaagaaaatcatgagctgtgattgagtacgtatttcatctctcaagttagcatacgagtttttttaaaagtgatttttatacgacttttttttatttccaaaagcaaacgggattaaaatcgaactcaaacacagatctatatttccgaaaacgaacgaacttaaaatcgactcggacacggatgatgtaacaaatagtatagatgagactcaaaccaaatgatgtaccaaatagtatagatgagactcaaaccaaatcgacaggcggtatgtaaatatagtaccatttactcctattagagcaagtttaatagtatagccaactactagctccaatttatttatagccaatctaatagctcatttatacaatagttgcatactacactattaatatctggtcccacatgtcatacacacactgtatcttggagtccgtgctacagctggctacaaatctgtagtccgctgaccttctctctcctcatttatctgcttaaaatatgtttgcagctggcttatagcctgctattgtagctactcttatatgaatggtctcttttgataataatgataaattaattaacctagtggctagtgctacctccgtgtattgatccaggggcgtgcatcgggtgagtcgatgacgtccagaatccagtagccgaggttacctcccagcccaacgcatccagcgtagaacaagacgccaaactttaacatctcagagcggctaagcgggaatctctcatacgcatgctccatgatatcccgtttaacgtagcatgttgtgatgatcacaccaatccatcccaactcaaacgtcactctagcaaacggatccgaatctcgatccccagctcgaggcataattaattaattaattaatatcctccgaaatcttaatcttaatcttaatttcctcgctctagatcttctcttgttgaagaggccgatcaatcgattcgagaacacctcacctggctgcatataaatatccatatatcgatttgcctatgttaggtgcatatctattataaagaataacactgaagggaatgtaaaagctgcatgtatgcgttctaattaatggcaaaatctcgtttaatttatctgccaatcatattttggggaaaaaagagcaaagaaacaaacatagatataatgtaaaaccaatcgatgacttgctgtacctacggcgagcgagcgagcgatcgatcgaacaaaccaataaaattattgggagctgggagaagaaattgcggcgcgtcgaggcgaggcgagatggactccgtgcgccgcccgcgcaagcgatagatgcagcttctattctagctagggtgtcaaaacgcaagcgtatactttgagatttatatttatacagggcgaatcgacttttgctgggccgtatcgggccggaatttcgctggagctgaccggttttcgcgagtttatctgtaaactcaggacatttatatttaaattttggtttatgaaatttattcggaatctatcaaattcgaattcaaacatctactagtcggaatatattctgaatacaaataaatttgtatttgaatctcagtcagaatatatctgtatttgtatatttgtatacaaatatattccaaatttgtatttaaatctaccagtcggaatatatttgtattcaaatttggtagatttcgaaaaaatttcataaactaatatttgaatataaatatcatgagtttaattaccaataatcaagcttgtgaaaaccggtcggtttttgcgaaattctgatcagatacgacccagcaaaagtcgattctctgtataaataaatctcaaagtatacgcttgcgttttgacaccctagctagaatagaagctgcatctatcgcttgcgcgggcggcggacggagtccatctcatctcgcctcgccgcgccgcaatttcctctcccagctcccaataatttattggtttgttcgatcgatcgatcgctcgctcgccgtaggtacagcaaatcatcgattggttttacatcacatctatgtttgtttctttgctctttttttcccccaaatatgattggcagattaattaaacgagattttgccattagaacgcatacatacatgcatgcagcttttatattcccttcagtgttattctttatactaatatatatgcacctaacataggcaaatcgatctatgtgtatatatatgcagccaggtgaggtgttctcgaatcgattgatcggcctcttcaacaagagaagatctagagcgaggaaattaagattaagattaagatttcggaggatattaattaattaattaattatgcctcgagctggggatcgagattcggatccgtttgctagagtgatttttgagttgggttggattggtgtcatgatcgcaacaggctacgttcaacgggatatcatggagaatgactatgagagagtatcgcttagccgctctgagttgttcaagcttggcaccttgtactacgctggatgcgctgggctgggaggtaacctcttctactggtttatggatgtcatcgactcacccggtgcccgcccctggatcaatacacggaggtagcactaggttgtatatatatattcaattaattatgcatcaaaagagaccattcatagcaattactaatgcatgagtagtattcacgtaccggcaccccctctcgattggtttcagggcctgtttggatcagggactaaattttacttcctccgtttacagtgtaagtcaatctagtatttttcatatttatattgatgctaatgaatctagacatatatacctatttagattcattagcatcaatatgaatgtgggaaatgctagaatgacttacattgtgaaacggagggagtagttcttatcacatcagaggtatacacacacaaaggaataaccaaattcacgtatatacaccgtaaggcacagagaagataatcacatgagaacagacagttgtacagggtaagacccctctctgatcagatacccagaggagatccatcaacatgtatatatatttatatctgatttgcaactacacatcgcaattactctagctagtacattctcattcctatgtataaactgagttactactcttactgacatgtgccggtatctgtgaaactaccatacatgtacatcaattgcatatacttccttggacgtacacgtactaaagctgctgtgctggtttcagccatcggtctcagtttgcatctcgagcttctgtatcaaggccttcttttcttcttcagggagggcgttgaacataaaaactgatttgtcaccaatgtcatcctgattcatgaggatgacattgatcatcaatattgtaatgttgtaagtgaggaacgaacatatgtactcggtagtaatgaagctagatgcggagcattttaatttggaggaatctgtaccttgatgggctgctggaattttcttgctgcgaatacagtgaagagaaccatccaaactcctaaaaggccggcttttgttccgttgtccattagaccagactgcacgaggtggtgacaagacaaatgtaagaaatgatgaatgagtgctctaaatctaatgcaccctggtgctgtaacttctctaggagtgaacaaggtgaaactaattataacatattgaatttgtaacaaaaataacagaggcttaatttaccaggtgtccaagaagaaggccagggataacaaaagttaaaataccagcttccagttttccatagcagagacctgtagaagcattctttgtcagagaatgaataattcgattcagttcaatgttcaagcaattcattcatgcaatccgcatccaacgaaaaatgaaaaaggccactaaattggtgctcattcttgttggaataaatgggctaggcccaatttaattcaattaaaatctcaagagcccacaagtaatgttagagagaataatactgccttgaaaatttaggtggaagaacctcaacttaaatagggtgatattagagattccctgttgaccggttgaagtgatggttggactgccacacgcatgcgcgcatgccgagtcggcctcggccgtgggcgtagcgaggcgaggcggccgaccgagccgagcctgcctgctgctcttacgttttgtaacagacgagaataaaatcaccattaacaaatgaaattcattgtgttgtaacctccacaacaaatgagagattcattgtgttgtaacatccacaacaaatgagagatttatttgttgtaaccttcacaacaaatgaaagattcattatgtggtaaccttcacaacaaatgagatttattttgtggtaaccttcacaacaaatgagatttatttgtgtggtaatggagatctctctctacatataacgcaaggcagaggctctcaaagtgtgtgtcttcctcctactattgttccttggcgatactctccttctgttcctgcgctgtctctctgtttctccggttctgttcatcccgcgcacacgggtgatcggaacgagcaagtgcctccgaaactccgtccgcttgagaacctgcacgggtaggcaggcgatcaagtttttgggtagcgcttcaagcgcgactgctttgcatcatcttcaccaacatgtcgacaaccgatgacaacaacaacaccggagacaaggagaaggagcctctcgtcaacaccaacgaaggcaatactgcctcaaactccagcggagggtcattttcggggtataacgtttcactattaccgttcgttcttcgtttcctacaactgtctgtcgcaatattattgcgatctcttatctatgttgatgcttattctatattaagcatgctcatgttatacacatctagcactgccactagatctactcaaattacaaatgtcatgtttattgtcttaaaattttagattaaaatatgccgaattatgaccaaatttccaacaattctaacactgaacacacacaagcactcagctagggaacaaatcagcagcgacaatgaactgaaattctccgattaaatctgttcagtataaacactagaactccttaattgtcgtaccaatttggtagtaataagcaatgtgtaattgcacggtaccttccttgaagacgaggcctgtgagcgccgcaaacgtagggccgacgaaccacagcgcagccgggtggtcgagaacgtagccgacgaggctctcgtcgagcggctgcgcgccggcgacgtacgtcccgatggacccgacgactccgaccacccacagcgcctggaggaaccgcttgatcggagtgacgtagatgtgaatcagcacgagcgaaagccccagccccgccgctccggtggcgtagaggaggtcggcgccttgcctgatggcgtcgccggcggcgttcccctcggggaggaacgcggccgaggcggcggccacgaaggacgcggcggcggtgaccagcccggaccgatacagcaagacctcgcgcacgtcggagtcctcgacggtccatgggccgtagacgccgttgtagacgttccggtcggcgacggcggcgagctgcctcgcggcggcggcgcggcggccgaggtaggcgaggggaagaggccgtccgactgcggtgggggtcagccccagcctggggtgcggccgtagaggcgcgacggcgaggcgcggcgagaggaggaggacggtagcggccatggcgtcgcggcgggatgataattttttgggggagattttttggtgggtggtggtttccggcgaggtgtcgagagctccggcctgtgacgaccgcaggctcgacggacggtgcagattcagtttcggcgtcgatccaacggcctctgatccggtagagtgccgccacgtggccgtcccggcccaactcattgggccgcacggagattgcaacccctttccggcccaataagtacaggccggcaggcctgccgtcagtcaaatccatggcgctcccatgttaatttccttctttcacgtaaaaaactaatctagtatcggagattcatagtgttataatatgttgtatcgggttttagattcgtcttttataggacggagagagtacaaaggagtaatgacaacttggaacgcatgaaacacttgcgacggttcgccgccggcagcaggtcaaccacggcaagtccggcgagcggggcatttaactatttgccacttttagatttgacgattaactatttgctacatctatctcaataacatgtggatctacatgtgtctataatatatgagtctaatggcaaatagttaattgccacgtctaaaagtggtatatagttcaatatctcccggcgagcaactagatcgaccactctcttcagtgtcagtttcatcacagtgattccggtcgaaaaatattaacggctgctggtggtaatgtttgcccaattccgtgggctgcctgtgtttccctgcatctgcatctgccgccgcgagcagtaactaattaaaagttactgtctgttctgatgccaggaccaccgtacctcgtctatgagacgtactatgactgtaattcatactgtttcaacatttggatgcattgcatgcatgcttaatttcaacatactattatataattaagtactccctccgtttaatataaggggattttaaatttttcttacaacgtttgaccattcatcttattcaaaatttttttgcaaatataaaaaacgaaaagttatatttaaagtgccgtagataataaagtaagtcacaaataaaataaataataatttcaaaaaaaaattgaataaaacgagtggttaaacgttgcaagtaaaaacttaaaatctcttatattatgggacggagggagtatatgttttgattgccaacaagatgcatgctttgatgcagacgaacttgcatttctcatcaacagtgatcattcatgatcagtactgttcagagccgtaattcaatgtatatagcacgcacgtacgtcctcgaattcgtagtgtcctcctgtcccgtatacatactagtaacatacattcacgtacaccgtacacgtgctacatacataccattaaattggatctcgagatgggtgtacatacatcatatcgatcttcatgcacgcgacgcgagagctatctaccggcggcgattggattcggtggcgccattaataaggggcgagacgagcttgagcttgccgccgtagtcctcggcgaggttggagtcgtcgatggcgtcgcggagcgtggcgtggaggtccttgtcggcgacgaagacgaacttcttcttggtgttgtcgtcgatgaaggggtagatgatcttccaggccgccatgaacacgtaggggacatggatcaagaacaccctccccagcctctccgggtagtagttctgcatgatctccagcgccgccacgtacgcgcggatgtcgcagttgccgtagtacccccacccctgcaggtcggccacggcggcgaacttctcctgcccgccattgccgccgaggcgggcgcaggtgcggtcgaggacgtagacgacgtagcgcttgaactcgtcgaggtcgcggcgcgccgggaagtggcgggcgccgaagccgtacaccagggggcgcccctgccggtcgtagccctgcatgtagagcttctcctgcgccagctcgccgcgcacctcctcgtcggcgatggcgcggccgccgggcttcacctcgcgcttccactgcaggtacttcaccagcatcgccgacgccttgccgatgttgtggtctctcgcgcgcaggaaccggcgcagctggtagtcgtcctcctcctacgtatacatatgcatcatcattgattcattgtcttgctactctctctgtgttttactatattattataagttattttattctttttataattaaattttttaagttttgatctataaaaaagttatagtatatttttaatataaattgaatatattatcaaaatatatttaatggtagtttcaatgaaactaattttaaatgttgcttaatcttttttatagatttggtcgaatttttttgaaaaatgatatataatataaaacggatggagtactaattaccaacaattaagttattaattactgtagctaggtaatgctgcctgctttgctgatggtcagctcgtgttagctactctaggctggtccagttcgatgtgtactggcgggagtagtattgaccaacatttatgaagggctttttgcacggcacgggtgacgcatcgcctcatgcttcacatcgccaaattaaataatggttgtgtgtagacgtccatgctactgttcatctttttaattatactacagtatttaatactgcctcactccactccacatatttacgcatgcagctggttagttgtgtccacgaccatctgggtagccctccaactaagaggatccgcaatggtaaagtaccgcaatggtaaagtaaggtgctatctataaaacatgtatatctcagcaatagactagattaatagtaaaccactttaatggtatgtctacatgagtatctatagctctctaatccattgtctcgtttttatgtatagaccatcttcaggttagtagatagctttgctctctcttcatttaatctcttacaagtaggaaaatatgctggtatgaatctcttgtagagagactatagataaccattgtgggtgtcctaagatggtgtctatagcattaactacattgtcacgtagactttaaacttatgtggcactatattaattaaaagagagagcgaagagatgaagaaactgggtctcatgcaagacacggcttcaacatgagaacttatgtactagacactatcaagttttgcatagggagagaatagtgtctttataatagatgaagaataaatatgattggtactccctccggttttattttaattgacgttttggacaatgacacggtctacaagatatatctttgaccttatttttctactataatatatataataaataaatgcatgtttaattttattatagtgctttaaaagacaagtctatatatgttgttctagtttctttaaactaaatatttttaaatttattgatgatcaaagttataaaagtttgacctcaactttatccaaaacgtcaattaatatggaaccggagggagtagataagagagatggtgtatttattaatggcctactttaagaaaccatgagttgtagagtgtagtttttattgtgatgtcttattgacatggcaccatagacactgcttatggacaccatgggttgggagtacctcagtgtgccgttttctactgtatatattggacgtcctaataattaatattcccctaaatgacatttgtattggtaatcaataatcagcgtgtgatggtggtatagtaaactcagttgtcctaattggatggatcgatgtagcagatggttgattaggtggagtgtcgctgatgaatgaattcctccactactggattgtcatgacgagttgagagtgagatcaatgtgatggccatcgagatgtttctgctcaaccgctaactactttggcttagaccttcaactacctggagctggagatggatgggcaagccaccagtctcaaaccaccaaaactgcccagtcccctagtcctttcccatgtacgtacggtacaatacaattcacgctgcgccgaccagccaaattgcattatactgtaggagttatatatatatctgcgaccaaattatgttgtgtgtaaccacctgcagtacggcaaacaaacccagggtgtgtgtgttcttctgtttctcctcttccaacggtggagaaaactattttcttaattctgcagtgcagttcagggacggacgtgctagattcggtttttcatgttaggcgaatcccattttcgattcggtacggatagccagggtatctcctggttgatttcattcgttttttttataattcggtccctaaggtagtgtttggttgcaaggatgggatgggatgggatgggacgaacccacttttaggggtgtttggtttaggggtgggtgggatgggttggtccctggagaggaatattcctctcagatccgggaccaaccgatccgccaaaaactggcggacaaactcgtcccacctgagacgagcgacggcgtcaccgcgccatccaccaccttcgcgagctccgccgggcgcccacgagcgtcgccgcctggtccacacctgccgccacctccgcacgtccttctccgccgccgccgcctccttgagcgccgccgcctctgcctcgtccgcgaccgccgccgcctccatgagcgccgccgcttgcccgcgaccaccacctccgcgcgtccacgagcgccgctcgcctccacggccgccgccgccgcctccacgagtgccgccgctcatccgcgaccgccacctccgctagcaccgccgccgctccactcagatccagccgccgcctcgcctccgcgcccggcgcctcctccgcttcgtccatgactgccgccacctccacgagcaccgtgaccgccatctccacaaactccgccacctctgcctcgtctacgaccgccgccgccaccttcgcaagcgccgccgccggtcctctcagatccgggcgccgccgagtgcctccgcccctagacggcactaacggtgagtacaaatccgtccatcccatcccacctcaatcccttctaccaaacaaaaaactataaccatcccataccataaaccaaacagacaactggaaccatcccatcccacaaaactaggataggtctgacctatcccacttcgtccccaaaccaaacactacttaagttaattactactctgtgatccggggtcgtcgctacatagttggaaattaaataaagagggaaaattacaaggaattaactgattgagcttcaagaaattaactactgctactcctaattgccttcgcgtttgtgttcttagttgattgcttcatagctagctcgtacctctagttgtccttccatccacaagaacataagaggaaaaaaacaacgaaggtgtgaactatctatctatcataccattggttcacatcatcatcacaaggccatggatggagggaaagctcctaagctaggtgagtcatacatgcgaagaagatgaactaattggggagaaggagaaggagataccttgcatgcagggtcctgggcttcgacgacggctctcagctcggccaccttcttccactccgtcacatcgccatcgtcgcggtgcccgtctcgctcctgctgcttgcagtaatccatggctgccttagctagctctcctctcctctcctcttgaattgctcttcaggcgatgataattcagaaatggaaatcgagagctgaagccctttttataggcagaggagaaacagcagcagctccaaaaggaagctaagctgacgatgcagagtcgctgacccccactatttatggttgcggtctaaccgtgtaccaaagctgctgtctcgcaaacacttgcatgacatataatcatatactattaccccctccgtccaaaaaagaacctaattggacggagtagtaccttctttgcacagaaataaagaacttttttttctgtataggtataacattggcatgttgctgctgctgcctaactaactaaatatgacaactcaagagattactgactgacgttaatgacgatgatggcgaagtctaacagagtgacagaggcaattttcttgcagaacataagtaggaggttggacggtccactcctccgttgtcgaaacaacgaaattaggacttgtttgagcagcagaagcaatcacctgaaagaaggtgttaagctctgttatttactctgttcgatgataaaaatggacatcttaacaacgttggcggcttatctccttcgttatctcctctctctctctctcccataaacggtaagactcattaatactgaccactggctgcagatacaatcatacaaatactagaactcttgttaatttcgtagttctgtttttgctagaagagagagagacagacagagagtttagggggaaaaaaaatcttaagctctactagtacagtagttgtacctatcagaacttgtggtagtaagcagtagcagagaagtagtgatgcgtacaggaaacggcgagcgtcaactacaaacagcaacagggacgttagccaactactcttggttttcagccatcagaaatactaccaaaatcatgatctggcagtcaagtcacgttattagactagtagcagtatccgtttacaacaaaatagtggtacgactaattattattttaaagattgactatgtatctattggcttcgttaatattaaaatatatcggcatagggcctatttagtttgaaaccaattcttaccctaccaaaatttggcactaccaaattggatagtattgaatttaaactattgttgataaaatttggtaacaaaccaaacatgcacttgctattattgaagttaccaaaattttggtagggcaataagttggtatcaaaccaaacaagcccatagtcttctgtagatgcttatatcagtaagatgtgtgttcatatggatgcatgtggagcattctaaacgtctgctttgctttgtcctgtctgtcttattggttgctcgtattctctaataaactatttattagaaaataaaaataatttatagataaaatttttatatatgtgttcaatgcagaaaaactatgtaaaaatatctttaatcaagttaaattttaagcctaaaaattaaaactttaactttattagggacgatggggctatgtgtatgtaaagaaaaaaaaaggaaatggcgagatgcatgggacgcaagaaggaattttcctcgtgccattttgatgcagagtagccaaatgctaaccaccacgtacccccgaattgaattgaattgtatctttcattgatttggccatgaatgctagcagctgccgagctttgtgccttaccgacgctgccccgggaaagtagtggctcgcacacacgcgcccatggcccattgggcccatgcctcgtacacgcccgtacgcgcctcctgtgtggctcacctcctgccacgacgccatccaaagcggcatgccaatatgatttctcttaaaagataacgaaaatgtattacatccagttctctgctttaagacacacagtcgattatagtttttattgaaataattaacaagagtggtgggataaaatccgagctattcttaagacataaaaacagctaacatgttacgtcacatataatgaaataagatatttttggcaactgattttaagagggtattcactcctcctgtttgatatgatatgatatgatatgccacacttctgttgattgagtaatcactcaatagttaaataaaacataaaaaaacaaaataatgtcagtagagtaatgaatttgttgacaaatagagcgaagaatacaatattagatcagtatacacataagcacccccccccccccccaaaaaaaaaaacaaaaaacaaaactaataaacatatatatcaaaatattcaaggaaaattttccaggagcccaacttcgtcctccaaccccatgcggtggttggagactctccagctcatgttataatttacaaaactagacaattagacaatgcgatagtgttatataaatttcggggttttatttgattcataccaatttatttctgcaaattcatgtcctattgaacctctagtagcctaccagtatgatcgatggtcctggctttatgagtaggggtggatctatctagtagacgtgcatctggatgggatggccttggcagacggcgagatctgtgtcgcctctctttgatctgattcagtctcagtaatcatcatgtttatttttacttacaccccgtggtccattgccagcgcattatctatcttcaattcaattcttccatcatccgtgctgcaatttctgcacaatgttatcgatcctactagtagctactagatcaatgtagaacacaacccagtcccacctcacctcaccttcccaggcaacttactctgcatctcctatgcttttactgtaaccacatagtgaaccatatttatttcacttcatccgtattatgagtacggttctaagaaacacatgatccaaatttattacacaaatgatatatggtccagattagtttcacctgtttgcacaaaactgtacatcccgcaaactcgcacagtgaatgttttgaatgtgatacttgagcacaatacagacagacgattagcagcatggtggccatactaattaaggtcttgggtctcaccagataatagtagaatacagctagcctctcagaattctctcctggggaagaagcccttatcatgcccagcaacaggttcagagatgagggcgttgtcgttggatgtttcagtctcatcacccttgccgaagcagtattcaggtgcctgccattctgcgtcctccagcacagcaccctcctcaaagctcatcacatggctagtcctccctatatagtagtagattgcaaaatgttagtactacaaaagtgatacacaattatacacataattataagcgtttggttctcatgactcatgacgaattcaggacaaacagacatctctgtggtaccaaatgcagtggaactgggagtgtggaaatactaacttatagtcacctaagagtatcttgctgtcttctttacctgttgggcagctcatcagcatgacaaacttaacggagactacaagttgtatcactttggcaaacctaaacaatgagtactattaactattaactgaagtgtacatgccggcaatacagaaggcatactctactttcaagggaagatgacacaggactggtgactaacgagaaattctttaattcttgaccagcaagaggcagcaatacctgcagacatggctcaaattggaacatttcccaggcatatatttgggtctgcatatttctatggctaggctcaaagttgcagagccgagatcgaacattggggaaataaaacttaatggccagatggccacagtttcatcacagagaagacatcacaacacttaaagataatattcccaaaagctacattgcacaatcatctataagaatttaacatgcgatgaaattgctgagaaagttttttggaaagtaaaattgggcagcatttcagaacataacgactagcgatcagtggaaaatggaagtaaagttcaaggggcatgggccctttcatcaaccattagtttgtgagtctgaaaccacaagcatactaagtagctagcctataggcactaaacaagtgatagatagtagaagttaagaactagaatgtttttgttcgaaatgcttccaatgaaggattgcactactgggtgaagcagatcccctatgatttcatcatacagctgtagtctccttgatggatacagttcatagtgttattgcctcttcccagcaaaaagaaaaaaaaaaacagttcataatgttaattgattacatactgtatatgcttcaagtgagctgtttatagcgctattcatcggtcctggttgaattgtatccatcaaaagtgtagcatcattttcaatttttcattcaaaaaaaatgcatcctcaacatactgaaacaatgtactaactactagcaacagatcaatatgcagcaattccctggatatatgaccaaagcataagaagggacatggactctgaatatttgcatcctcttgtgggctctaaccttaattctgaactatacaggtggtgcacatggatgagaagggatggaacaggaaattgccgcggaatagggttcaaaattaccggtgtagaagacccatttgacggggcgtttggtgagggtgtcctcgtagtaggtgatgaagtcggccttggcccagacgtggcagtcgaagccgtcggcggggtggcggccgaggtagacggagccagggacgagccagtttgggggcaggatgccgacgccgacggcggcggagcggcaggcgcggcgggccggggtgtagaagaaggaggtgccgttgttccactcgttgtcgtagaagggctcgtcggcggcgagctggtagcggatgacgtggaggttgcggccccccggccagtcgtaccacaggtccgccagcgacaggttgccgtggaactccatcaggagcttcgcgtggaactgggccggccatggcgtcggcgtcggcgtcggctccgatccgtcgccggcgacgacgaggaacaaggccgccgcgaggaggagaggggccgccgtcttctccatcttgtgcaagtggctgcgctgctgcgtgggagtgagatggcgtagtacggtttcgagggcttgagtgaaattgtgtgattttccaagggtgattatgcaaaaattcgtccatttttagtacggtttgggcccattaacaaatggactttgctttgtccaattgctacaaattgagcctactttcttttcgtttttgctgctttaacaagtagaaataggcccaagtggcagagttacctacctttgctaattttggactccaagcacacaattagtactcatccgcattgtgctaattcaggttattgagaggggaagaaagtggttatacgagatcgatggaggacgcagcagctaacggtcgctatacgatggaaatgagattgtaccggacatattgtgcatatatacaaaaagtataggagtatgttccagacgatggcaacttgacctctttaattcaaagctagcctcaaacgtacttaactattcatgctttgacgtcaaggcaagggtcgagtagtaagtaacacaggctcaaaaggcaggctatcttaagctacctatacgttttgagtgtagtatacgagccgatcgatcgatcgatcgaccactgtaccgcactgcacgcgccaaattgaaaatcggattagtggctcaaatcaaaaactaaagttagtctgaactttgtctagtgtgcaaaatcttttgacattaattaatcaattggtaggttttgtgcgttgtgtcttgtgtgatttccacacttggttgacgccgacgtcgttgtaaagtttgcacgcggcaactgggcgtggtctctgaacgaaccgtcaattcattcatggaatgaatttgatggaaacatatcccgactttgtgcagtctgtaattgtgctatgttagtgccacaaagtcgatatagcacaactacaaattgcacaaaatcgacatgggacgactgcagattgcacaaagttagaggagtttctttcgaatttgatatatggtccgtccaaaaaaaatcatgggattggcgcctgcctgaatccatggtgggtcgttggccaactcctccatttctcacggcgccggtcgccgccccggccctacttcccttcacgcctccactgacctcgccggccggccaccaccaccgcccgcgcgccacacctataaaacctcacctcctccacctccatggctcaccaccacgtacagcaaacaccaactcagctagctatactctactcatcttctctgccagctgctactacaccaaccagagctaatcaagtaacaatggcgggaagaggcagtgccatggcggcggttggtgtgctggtgctcctctgcgtgctcctccacggcgagatggccgagtcggcggtgttcaccgtcggcgaccgcggcgggtgggggatgggggcgggatcgtgggcgaacgggaagcggttcaaggccggcgacgtgctggtgttcaagtacgactcgtcggcgcacaacgtggtggcggtgaacgccgccgggtacaagggctgcaccgccgccccgcgcggcgccaaggtgtacaagtccggcaacgaccgcgtcaccctcgcccgcggcaccaactacttcatctgcaacttccccggccactgccaggccggcatgaagatcgccgtcaccgccgcctagttcttcttcttcctcgtcgtcgtcgtctccgtcgccggcatggcgccatgccgtccatctcaaccagctgcttattatatctatatacaaatgtttgtcgatcgtgtgtgttctaaccaccatcagctgatttataattctacgaatgaagaatacgatccaatgcatctatgcatgcatacacacatggatcaatatataatagttgtacacttctttgagtgacggatgttgtatccggtgaaatttatatacatataaatatgaataaaagccacattatgcaggttcttgaatcacaaatagtacgtttgagtttcaggtctgtttggcatagctacacctccacctctcctgaaactggagctcagccaaactgttttacctccatctaaaatggtagtggagctaggtgaagctctctcacaaagtaaacttgagaggtgaaactgggtttagtcagctccacaactccactccaaactcaactcatgaagttaaatttagaagttagagatctaccaaacgggctattcaggcatagaaattcggaataagttcatctgaggtcccttaactttacaccgaatccgattttcgtccttgagttcaccaccgagggatctcgtttgcaccaattttgacagttaaggactggctgatctggttttggggttaaaggacgaaaatcggattcggtataaagttaagagacatcagatgaacttattcctagaaattcccactcaaaacttccacacgaatacgaccgggccagttattgtagtacagtagtagacgagatggttgtgggccgggcccaaacctttgggccggcctgaccgttccatatatggaaaggcccaggaattcgtccacaaaaccctataatcctcgcaccccccaacacctctcttctcctgcgccgccgccgcctcctcctcctcccgcatctccctcctcgcctctcgctgccggccgcgcttcgccaaggtgagactccccgcctctcctccgactcattccacaacgcgtattcggcggccagcgaattggcttctttttttttatttcctttcccgacgcccgatgatggtttatcctagtgtggctgtgcgcttcgattcggatccatctgatctcttccggccgcattctggttgcccagatccatgccactttcctcgttcatgttaacgaggagattttcggttcgttttgcagatgaacaaggagaggcttatgaagatggccggcgccgtccgcaccggcgggaaaggcaccgtgcgcaggtgggtaaatcgcctttgtcgcgaaatgaaatgaatgtcttgttctttgcttctcgccgtgtcgcgaaatgaaacaaatgtgcttcattttgtttgttaggaagaagaaggccgtccacaagacggggaccactgacgacaagaggctgcagagcacgctcaagagagtaggtgtcaacaccatccccgcgatcgaggaggtcaacatcttcaaggatgatctcgtcatccagttcgtcaatcccaaaggtataagcatccctcctgttttgcctaccgtaccatggaaatgccaactgcttcttggtgttagattacttatccatgttcgatccgacctgtgcagtgcaagcttccatcgccgcaaacacatgggtggtcagtggctccccacagaccaagagtatgtgacttctccttgttacatttgatcagttcgttgtgcgagttcaattcttttaagattagcggctgttctgtttctcttatacactgctgagttgcagcaaccatcccatgtagagctctgtatgacatctgaataatcccatgttcgtctttagttttatctctgcacactctctaggagattttatgcattcagctgcaacattgtagggtttactatatatgttgattgtggggtggagtgaatattacgatgaacaaaactagcttttagcaagactcaaattgccttttgattactttatttcagtgattgtctgttattagggtgttatttttatcttcctgacttgtgatcactgtttgacttgtcagagcttcaagatgttcttcctgggatcattaaccaattgggtatgtcctcttcttggtttgctgttataaaaactacttttgacttatgcttctgcacttaatattcaattgatagttgtcttaattggtctgaattggcttgttttttctgttataagaactatgttatcagtctcatttcatagctgcatgactccaatttctctttcctgtcatgtatatattccagaaccatgttcacaaaatgtatattccaaacatgagctctttcgtatggagtatctcctagcctacccatcatgtaaatcagcgatgaagctatgcaaacattagtgtttatctatttttgatctccataaaatgtaactcttattttttttctggttttcttgctttgtttccattgccaattatctgttggttgccatcagcctttattcctgctcatcactggacttgtctgattattgtcaaactcattcagtttatctgcagtttgtccagttactgacagtcaaatctttcttgtaggtcctgacaacatggagcacctaaagaggattgctgaagagatgcagaagcaggtagctgctgcaggtgccactgcccaggcaaaggaagagaacgatgatgatgttccagagcttgttccgggagagaatttcgaagaggtagctcaggagacaaaagcctgatcatagataccacaagtagtgaaatgttacttgaccgctgttctgaggtcatggttttctatgacggccctgttttgcttctcctcgtaggccaatctttgtatttgcaattggaaacttttagtttctccgagtttttacctaagttatgaatgctgagatgccatggagtcctttttacctggttttgatgttcacatttctggttggttcagaatatactagcatcagggtttgcagatgtccttcacgtctcaactatctactagtatcatttatgtttggagatatcctgcaatggtacagtgttgatttttccccaaatgaaaaataatgatgtgttttacctgctcagatttcagttctgaacttatgttatactagcatatgaaccatatgaacatgctacgtgctctctcttgaatactaaaccccccagcaatgctctcttgaatactctaaacctctcaatgagaggcagacgcccagttcgtgtttgtactatagtgaactatgattagcaaagggtgttaattgtttctgtctgtaaagagagagctactattgattgaaatttgaagtacagtttaaaacagcggaaatattggtataagaagaagtcccactgaaaatagtgcaaactgggaagcatatggttgaaagcgatgttcaacacgccagcatatgactggtttgaataatcttgttctcgagacaagtttgtattcaaatgatatatctactccaaagctcatgatgatgccatttaaaatagacttttgcgtctattgcacctattaatagttcactaatataagaatgtacagccaaggtgatggaaatcaaaactgaagctcttgcgcgtgcgcatatcagctagatgatcaccacataaaaggcttaaaaactcaatctttgtacactgttctgcgccaatttcagagtttgagtttgggcacagaaaataatcaccgcaagatggaagacgaacaaaaaatactctgcctagcaaaaagctctctctgctcaaccatggatgaacagcaattggcgcaatgtatgtgcctcttgttgctgcttgccatgtcaccagatgctacgctcgccggcggcggctcggtgaggcgccgggcggacgtggccgacgggtacgcggaccaccctgccggcgaacatggcgtggaggtcggcggcgtacttgacggtgtaatggtaagcgtcggaggaagacaccaccctcgccggcagccagatcacgaggcagcacctggcggtgatcttcacgtacctcgtgcgcacgtacacggcggtgccgcacgtcagccgccgcgccgggtggacgctacgggtcacggcggcgaccggcggctccgagaactcggacgccggacgcgccggcttcctggcgaccaccgtcttggggttggacgacggcggccacggcctggcggcggagggcgcgtccggcttcttggagattgagggcggcggcggcggcggccgcggcttggcgacggcgaggtttgacgatgacgtcgcgcgagcgatcttcttggcctgcgcggcggcggcggcggcgggagagatgaccctgggggcggcgagcgccgggaggttgggcgccgacgtcgtgcgggacatgatcttgttggccggcgagtgcgaggagatggaagatggcttgttggcggcggcggtggacttgacgcgggagttggggaactgcggcggcattgcttctcctctcgacggctacgccgccgccgcagccgccgtcgattccgcttcttgatttctagggcttccaaggatcgatgagatgatgtgaacgctaccctccgttgattcgttgcgttgatcctaacttgggaagagatgtgtgtcgtaaaaacaacttaacaagtgacagcgaaattaacccggacgaattgacatcacagcctaactttgcgagatagtcgccgtgttcatctcacccggacgaattcgcattgttcattgttagatacgatttaaataataagtttcagatttcagacgatttattttatcgtctcgactgaaatcctattagttatttttcgtcttatagcattgatgattatttgattgaacttctacaacttgagattgttgctctgcttataccattgactgaaattcttctacagatatagattgtttttccgccattgatgaactcaaatcggcaaagatgtttttcggccattgatgaatgaattcaaagtggcaaagatcatgcaagatgcggcacatatcggctgcagtcttccatagactgaaagcaatggctagcacattttatgacgactgatcacttgatcagataagtcagccatgtatccggtgtgaaacttgaaacttcaagtacacatcgataaagtaaaacagaaaatcatgcgagagaaacatcaaccattaagatgcttatgatgaatctttcttatttagtcaccaagctatgggcaaaaaaacgtgttaagatgactaaacgcgttgttatacagcaacaaccagacatggaaaaagaaaagcaataactagttcggaatggtggccgagccaacgatccctgcatctcatgaattcagagaagatgctctgcgagtccctcgctcttttgctctcatattgccggtcggatagatctgattccctatgaacattcatttgttactaaattcgctacgcagaaaaaactggaaacagatcagctgtaaactttggaaacaactccggcaccaactgtcctccctccttccctcagcgcaaatctctggcctgaatagcataaaatgaaacaaatgtgttcacttcaattgcagaaaaccataccaaaaggtcgaaatgtcaaaaatggtggagcatacctggctcaaggggaacaggtgatatcaactcaaatcctgcagttacattatcaccaggcataaccatttccacgccatcaggtaacacaacttttccagtgacatcggcagtcctaaagtagaactgtggactgtaatttgacaagaaggctgtgtggcgaccaccttcatcctttgtaaggacgtaaatttccgcctcaaacttttggtacgtcttaacggtaccaggtttgcacaccacctgaaagcagtacaaaaaatgacaaacataggagcatcaataaaagggtcaaagaattgttattgcaccaagagtagtaatatatcaatccaccagttcgctcaaagcccccaaatgatacgaatagaataaaagatgacttggatcagacttatatgggtgccgctcagagttaggtatgctaacctggccacgctgtacatcaccacgcttaagaccacgaagaagaagaccaacattgtcaccagcctgcaaacaagttgtagctataagattccacattaatagaaaacaaccagtaaatggtttactttcagaacagacctctccatgatccagtatctttttgaacatctcaacaccagtaactgtagtcttcaagggaccactctgtgaccaagaagtgctcatcaaaattcacaatgcatcaaaatagcaacataacatacaacatggaatcaacgtatgacagttccaaagaacctagaaatgtcaagaggctttatgtagcaggcttacatttttctttcaataaccatagttggtaaaaaaatatattagcttaacccattatgacatatacatattccattccgatatttgcgtgaagtcaaatgtgcatatggtgtaaaaaaatcgtgggtaagatataactacaaagattgtggattctcgaatcttcagaaccaagcaggtcatactctcaagaataaatttgtacgtctaggaggcggtataaaccacattactggacttaagtaataaaagacaaatcagatattttactcactggagtcaaacctaggatctcaacatcttcaccagttttgattgtcccctgctcaacacgccctgtcacaacagttccacggccctgcagattgaaatcaattggtctgtgtcatccttatacttgccaaaaacagtaaacagtgttctggcacactaaaactcatagttacaagaacaaaattaacataatataaacaatttaatcatatgacttctcttccagagacttaagggtacaatggttaaaatcttttcaggagttaaatagaatgcctattgacagaacaaagtataaagtgtcatatattcttgctgtatagtttctaggttcccagcagcattcatccatcaacttcaatggctaattttgtataaacagatgctaacaagtacataattcaaaccttgagccggtttcagaattagaacactaattatatccatagatcaagataggttcgctcattgtacttggcacagaggaagtaaattcaatttttaattgcaatcagttcaaaactacagtgaatatgaaaaaaaaatagctgtataccatagcataaagttaatcacctggatagagaaaacatcttctatcggcatcaagaaagacttatcaagctgcctcacaggatcagggatatactcgtcaactgcatccattagtttcaaaatggcattctttccaatctcatcattagtcccctgtaaggctgacaaggcggatccacggatgattggaatctcatcaccagggaacttgtagaaactgaggagctctgcaggaaaaaaagggaaatataccttagaacaagaacaaaacaattcatacaacaatgtaaagagatgcagaatgctagcataccacgaagctccatctctacaagctctagtagctcggggtcatcaacagcatcaactttgtttaagaaacatacaagtgatggcacaccaacctaaaatgccgagaggaatgcttgagtaatcagtaaccagaaatgaaatgatatactaaaattcgcactgaatgtgaaaaagataaagaattgtcagtgattcaaaacctgtcgggccagaagaatatgctctttcgtttgtggcatggggccatcaggagctgatacgacaagaataccaccatccatttgagcagctccagtgatcatattctgaaaatgtgcacattgaaacagagatgtcattggtcattgctcaatattaaggattctagcagttccgggacagtaactcagtaagcctgagtatcagaagagcctactggatttaataattaatattgacagcgcatactacaaatgtgctcagcaatttcataatatccaatgaattagtattacataatatccatggttattgttcgtgaagattgtcaatatataatcttgataacttccactttagtaaaatagaactacttaccttgacataatcagcatgccctgggcagtccacatgagcataatgccttttagcagtctcgtactccacatgagcctacacaaccacaaccacataactcagacttgatctacacatgatgacatacaaggacaccatctggtccaaatgaagaaaaaactagtgctaaggctcaccgttgcaatggtgattcctcttgctttctcctccggggccttgtcgatctcgtcaaaagcaacagctttagccttccctgcctcagctaacacctgcaaagagcataaaaaaggcatttcacgcgttgaaattgtttggactccaaagaaaacaactgaacttgcactatatgtgacaaatcagaccttggtaatcgcagcagtgagtgtggttttgccatgatcgacgtgcccaatggtgccaacattcacatgaggcttcctgagacagattcatacaacaaattcaaaacacaagtcacacacggatcgatcgctagatgctaaccacaggaagagagaaaaccaggcgcggagagcaacggatctgatccaagaaggactcacgtgcgggtgaaggtggccatggacctcgcccacagggttccagccagaggcggtggctgctggggcgccgccgccgcagccgccgacgcatccggtagcgccgtggggcccgagatcacggcggcgcggagggtggggtaggagaggatgcggcgggcgccatggctccggagcactgcggctgcggccatcgcgttcgcgttcgcggcggcggcggcggtggcgctaggtgagaggaggagagagaccggtttagggctttatgagtctaatggggaggagaggcggccaccttctatctgtaacttgtaaacaacccctggaggcgcaaatgggccgt

SEQ ID NO: 50169 - DNA, 6133 bp, Oryza sativa
acgctcgacgtgctcgccaacaaggcgctccgccaagggctcaaggagtactccagctggccgaccttaccgcagctctacatcgacggcgagttcttctgaggatgctacatcaccgttggtacgcaccccgcctccccgatttgacctgacatcacgcaagctcactgttaaggaattgaatctttttaagcagcattgatttgttatgagaagtttgacatgccaattcacctcttcgatccaacacattgtgattatcccactacgattagtctaatgctgaagacatgctgcggcccgcttatcgtgtctagtccattagaatcctgttagaaacttttcaaggggaccagacgtccctgttgtttactgtggttctgaattttgatgattccctatcctcataggcatagttcagagtatataaatttgagagaatttatcagagtatataaattttgagagagaattttcatggcatgagatactcgcagtatctgaagatctgatcatctgaacgctggttttgcgttaaatcaagatatgctacttgtactggccataaaagagcagcttgtgaaccctgattcatatatataacccgagacgtggctttcacccctctcatcattaccagttaatcatcaccaatagtgatgtatcctaagtatccatgcctagtggcgaaccgagaacaaaaattaacagggtccaacatactaattacctaattgttaactgatatattgatcagcatgatataatttagtttaaattaccagaagctgcatgtaggagcgccactgtctgtgccaccattggttataatctggtttagtgttcttcactgaacaactagcttgtataggtctgctccatgcagttttctgagtgttgccacctatatactcaagaacctactataatgtaagaaataactgttaaaaaatatgtatacatcttgcccagtagtagaaattaagggagtattcactttaatgcaattttcaaccttaccaaattttggcaggatttcttgtatagttaccaaaatttggcagcaaactaaatgtagccacttttttagcaactttaccaaaatttggtaaggttgaaaatggcatcaaagtgaacaggccctaaggtggatggtgcacttggcgaccagctgaccagtgagaacacaaatccatgatgtagcaaatcatcacttaaaatgttcatcatggtagtatatttagatacttgacttgagtaaacccaaatgaataattgacacacaagatgtgaggatgattaatgtgtgtgttccctactgaatgtttgatatgatcagtgtttcagcaattcagctggatttaatgtttgcactgttttatattttgcagatgcatacaaaagtggagagctgcaggaaacactagagaaagcaatgttatcttagtataaacgtcgaaacacaccatagagtacatataaatggtatatggtcctttacgatgtactcttcagccatgacaaagaactggtgatgctaagattgtcaacagttcaattcatcaagcagtgaggtccaactcgaacgtgcaattgtactcatgactaataaattttaatattgatgacaaatacttcctgttgcaacactcggatgtcacagctctaaatgtctggatctctaaatgtctggatggtattctcttatagagctgaggcgatgatcttgtacctaaaaagatccaaaacttggagcgaaatcttttgcccaagtagtccaatctatttgtttttcatcgctcttaaatgtactactccttaactgatactccctccagtttgatattaagtgacgttttggacaggattgcatataccaatgacttattaattagtcaccatattcccttgttatacccttattaaatactctcggatacacatcaaatcaggaataacttctcctcacttggttaaagccaccatcccaaagcatatggttccgtgttcgagcgcttgtagcgctcgttttcatccgattttgcatggtattgtagccgtgcatgcaggattttttttatgtcattttcgctcgcgcgcgcgctgaagttttgtaagctgattttttcgctcgttcgtgcttggtatagaaaattttttggtgcatcttgcagctggttttgagcgttttggcgcctgctgcctcttgcgcatattctctgtgaacaagaccacaacgagagcatggcctcctacgcgcgcatcggatcttgtcaagaccattctcgtggactcggccgcagtgaacgcacacttgcgcgagctgctccacctccatggcgtcggcgctgttgtcctcctgcgcgaggtggtccacgatgccgcccgtcatcatgtcgtccaccggcgcaacctcagcatccatggcgccgatggtcacttcgtcttcatgcgcgacggcggcgtcctgcagcttgacatccatgatgctggtgcgcgacgagcggcgttgtcaagaggcgaagcgacgcaatggccagaggcgagcaactagcagcacacggtggctatcatggagtctttccgcttccgtggccagagtattagtactccaggcattagttaatttttgccttgggacttttccgctggatggagacgaagcaacagcatttactgtttgcatgcatgaatgagggtattctggacaaatacaagggagagagttgtggagagcgctaaaacatcaatttttgccagccaaagaggattaacccatagcgtcagttaatatggaactagagggagtaactgataacaaggttatgtacctccatgcagatatttgtaccattagttaagagcacccgcaatggtaaagtaaggtgctatctataaaacatgtacacctcaacaatagactagattaatagtaaaccacttcaatggtatgtctacatgggtatctatagctctctaatccattgcctcgtttttctctatagactatctccatgttagtagatagctttgctctctctcttcatttaatctcttccaagtagaaaaatatgctgacatggatctcttgtagagagcttatagataaccattgtgggtgccctaagtagcttggataactctgctctaaacagaagatagccctgcccccaaattcaattacttaggcacgagttcaccgtgcttcatgcaaacgacaagatctccagttttatcttctccacatatgatgcatctccagaaacttaaaatcacaacgaacgcgttacagatcagatcatattgagaaccagcgcatctgcagaacctaaaacaagccaggcatctgattgaataatctagaattcaaataatattcgggaagatacacatgttaagcaaattggaggacagcgattgaaccccaacaacaaataatatgtcatcattctgtggtcacagtatttaagatcattcacgcacgagttcccaaagcaaacaggtgatgcttgagctgagaaaagcttgacgtcctgtgattgtaaaatttgaccatagaaggccaggcagagaacctaagcaagccagccaatgcaaaatggtttacagattaagctttcaacaccgccttatggatcatcgtctccttgtgtatttggtgacagctcttctcaacaagatcgaggagtttctcgaggttcgccgcccaggaattgagtataccattactgtcttgtgctgtgcggaagcatacaacacccattggcctgtcaatcttcgcaatcagcgactttgagtttaccatgtccgaaaggtgtttctctgcctcctgaatgagaaaaatgtggggcatgttagatcttggtaggctacaaagtaacaagaggaatacaagtgatgctaggaaggctgggaacacaaacctgcaagctcaagcaaagaagatctgcgagcctcttcagggtaatccttgaatagtacttcgaaacaaccaagatattctgaacaaaagcaaagaactggaaatcaactgacaaatacaaagcaaggaaccaaaagagaaatacgataaagtcaagtaagcaatacatgttcaatgatcctcaatttcagatcctctgcagctttgtcacccaaagctcctccgagaaaattcttctcattcgcatattcatctttaaagaattcccacaagcttgtccactgaatcacctccatggttacaagttgcttcagcagtaacctattcccatccaaacagcaaaagtaggaattagaaagaacattaaaaaccatgataatttgtaatcctgaaagcaacataacgtaccggaaatttggtatctcggagagatttttgtcttcgagtgtggcattgagaaggcttgattgcatcggatcatgaggcgccaacaccaaataccaacagatctttctaagaacctaaagcgaattcaggcagtcagataaccattatagcgtgagtgagtatgcgcacacaccacaccaagtaagacttgcgaatgagagagctttaccggtatccactttgatggatcctcttttattgatggaatttcataaatcgacttgtagcaacggcagatttccaggtaatcattgttgtgcgagtaatagctgaatagagacaaacagaaatcatgtttcaccacatatatagaaaaaaatatatactcttagcaggttataaaatcagttagcgagaattcaaacagcacaaatacagtattcataattgtagcataaaaaaaggttgatggatacaaataaggcattcaagcagtaaccataacatgatgatggtaaacaatcgcaaacatatttgacaggtaaccgcagaagaggaattgatatttcctgagtaaataaaatacaagctacataaacaattgtctaatagcagtaagggatatgacaccacattagttcttttgtttaatcaaccaagcattagattgacttagcagaaaactctaaatagttaactatcactatgtattagatcatgaatcaaacagtcgaaagcaattctttgctgaacaaaatagaactccctccatcccaaaatatagctacctttatctgtgaatctgaacttgtccatattcatagctaaaggtagctatattttgcgacctgagggggtagcattaacttcaaccaacattactagaagcgacatgaactcatgatgaattagtctcactgagcaggaagacataccgaatcatcagttcatagtagatgcgcttcagttccaggagggaaggtatctctgctggggcttcctgaacaatattatcaccttctttcggtttctttttttcctttgacgggtctgcatcaaataccctaggactgattttcctggataaaatctgtgcgcgtacataatcttgacgatccaagcacagccggacctgtgatcatgattacagtaagattccagaacccaggcttttgtaacaatttcaagctttattactgtatttcttcatacctgctctagaatgaatgcaatcttttctgtctttgccatggagccaaatgtttcaacctgaggatgaacttgttagacattatgtagatgcgaagacaacactatggtggttatagtagatgtaactgtgtgccatgattatagtgcagcttgaacttacagcaacttcttgcattaaatcagcagcctcatcaatctgtccctgctcctctttgatttttgcaagtcttttgatcaatcttgctctctctatctccacatatatctacagttgatgcatatcagtgagattacacacatgaaagggcattaaatcttataggtaagcaatatttgagtagccatgattctcacttttccagcagatacactgctcaacgtcttgattagctcaatacgtgtgtccatgtctggcgttaagtcaatgtactccattgctttctgaaccatggcagtgatagcctgtaaaaataaagaattagaagagttgagacatgccacatgtgcataaccaagttataatgcagcagcaatagtattgcatacataaacaggcatgatttatgaaatattgttcaacttgtaaataataactggatatttcaggaagac

SEQ ID NO: 50170 - DNA, 8790 bp, Oryza sativa
  unsure (1)..(8790): unsure at all n locations
catgtgctcctcggaaactttggggtttgcatgtgcctctagtcagtagagtataactttgaagatatcagttagatagctaaatacagctagtaattcaactagaactactaaacgaagtccaaagataggagaggacgagagcttgacctgcttaagctggcccctcctcttggagaggaccacgatctgatcgttgagcgtcttccaggcgccggccttgtagcagagctcgacgatgtcgatggcggccttcctcgtgccggcgacatcgccggccagcctcatctgcttctccacgttgaggagcgactctatcgccgcatcgaggttggtactgttaccctcctgcatcggtccacaagaaacagggtcagattgcaaggcatcagatcaacccgcaagagatcgaaaccctagatgagaagtgcgggccgcggcggggcgggcgggaaggccaaaaccccggaaaggcgggcggagggtcggggtgggggaggggaggagggaggtgagctcaccatggcgagggagggaccgtggggaagcgccggcggcggcggcggagtcgaggagatctaaggcaaaggcggcgtgcgctttgcttgcgggagaggaagaagaggagagaaggggagtagggctctcgggctctctgtggtgtggtggtggccgttttgcggggaaaccctcgcggcttctctcaattacgcggcttatagcagccggccgccctacctacaccgtaccggcctccttgcaagttgcaacgcacgagttctattaggatttgcattttcacatgattatgttattatccatcgtttcaagatctcataaaattctttatcccattggttagcactcgtctaactttatccaaaataacaataataataatctgatgcagtatttctaatagtgtcttatatactaaaacaaagttttaagatcactgctggttacatatatacacatcgtaaaagctagtttatgacctgatatcattgttgttaaatgtcaaggtaagtcgctttgtattttgttgtgaaatatgtggatgcatatatgttaaatattgtggaaatgatagatggtatatgttaaaatattatggtaaagatatggaaaatgattatttgtgtgcttacatattgagttctaaaatataataaattgcagatgacgtggcatgcttgtatgagatttaagatatatgattactattgaatgatggagtgacatgtttgcatgatgcgctttaaaatataatgtgttacaactatgtagaagatagatactctatttccacaaaaattatcatctgaaaagaaaaagactaaaataggcctgattcttatgacatgacatgctttgtattgtgtcgataacatgtacttttcctctccatctcctatttcatttcatctatcatattgcatgcgttgtatttgtatttgtcgactacaattgtgaaaaaaatggtggcatgattaattattaactcgagagtggtagcatgatgatattacgatggataatatgacacagttatattatataagaagttagcattcaaattagttgtctataagttatttttctatgttgtgtatatatgatttcatacatggcgttttcgtttgttacatacttcaaacctatcgaagcaatcgacctcactattgcatatacatttatatcaaatgaattttgctatcgaccacgtgggctatggtaaggaatatgggtgttaagacccatattacattattttatttcatcctaatgtttcgcgtatgggctattgcagcatgggccgcccgaaggcttggcccatgttgggtctacacctttgcctcttgtactaccacatttaggcctcatggttttctatgactttagttgtacttgtgttgtgttgatcatgtcgcatgcattttttcttagaagcaactactctattgtaaagttagaggggcgtgagtccctaacatgtggtggcccatcgtcatgggcccacatgtcaaaggtacacatcggtccaacgtatgttatgggagactcgtcgcttcttctctctttcatctctctagtttttttttgtatattttgtgccatgcagttgttgattaaacttgtgaagaagaaggggtagcgtgattgattgttgatctgaaagtggcagcaaaataatattatgatggataatatgacacaatctataagaagttaacacttaaaccaatcatttatggagtcatagaagatgtttttctaaggagatgacaaaagcgcacgtatacatgagcacaatgctgatgtacgatttgatttcataccttatcttacatatcctagatccatcgaattttatcgttatgcatacatttacctcgagagtcatggataggagtgtgtgtgttaaagcccatatcactttatatttaattttggaaatacttaatataatttcgttatagtgtttcatccatgggccgcacaaaggcttggcctatattgggtctactccttacctgctacagttagtttgtctttgtactatctcatggtttatgtatttgctcatcggtgggacatcacctaataatcatatatccactaacgattaatatctaggttttattttagagtgtgacttacttcttccgtccgaaaaagatagtaggtttaaaagcgtctataccatatctgataatgtcgatagcatcaactcatgtacaaccaaaataatttatcatgagatacctctattttcagtaacaaccaaataatatactcaccgtggagaacatagaaatcgggtgctcacacaacctccatatttgactagatatagaaggtggagcaaatccatgaattttgtaatagagtaggactagttcataatgtcgggacactaatgttgtattcggttaggtttttttttaagtcctatccccaacctatataagatgggtacacatagcaataataagcataacaccaaggtgaccaatgatatgctcaaaatcttaatggatgttctaaattagactaatttaagtatcttgacaaattttatcgtgtagagatagaggagctagtaattattactagcaacctgaaaaacttaatttggctcctccgtaaaaagaaggaaacggcgaaaaagcggctgcctctgccgccgtcacgctgaacgcgcctcaccggctcaccgccgcggctgacccaacccaacccaacccaacccgggctcgatttcacttgaaatttggaccccacccaaacctgtcgtcgcgactcatctactatccattctattcatccccatggcgccgccgccgccgccgccgcctgccgccgccgcctcccccaccccaatgctgctcgccctcacgggcctctccaccttcagcgacaggctcgtcgagttcttcaatcncngggcgcgtgtgatgcgctatgccaccgccatctccgacgacttaccaccccttcccgccgccgaccaaccgcccaacctcgccgatgtcgccgagccagaatccactaccccgcacagccccgtcgccgtcgatgagccagaatcctctaccgcgcccaaccccgtcgccgtcgccgtcgccgagcccaagcctgcacccgtgccccagcccgaggagcccaggccgaaccgcggcggcgacccatcggcggagcatatgggccgcatctgcgagcgcatgggctcgggggagctcctccgcttcgtcatctcccgcatgggggacctctcctggctgctccgcgctgtcccgcccgcgctccgccgcgcccccaaccccgcggagctcgtgctccgggctatcggccgctactacatccgacccgggggcaggcacaccgaggccgcgtgcgagctcctcctgctgtcctacgtgcgcgccggctgccccctccgcccgggccaggaggccggggacgaccacctgcgggcggaagcccgcgaggcggcgctctcgtggcgcagccggcttgtgcggtccaaaggacgggttgccgctgccgccgccaacgatgcccgcggccttcttctcctcatggctgccttcggcgtgcccgtggagttcccgtcgcaggagatcttcgagctgttgcatgctgctggcggcctggcctgcgccgaggtgctcaaatgctccaagcatttcttagataagctgcgtggtgagggccacttaccactgaatcactgataaacccttgtgacatttcacctatgcctaattattccagttccttgactaactggctgcagctgttttgtcttgcagatgttgttgctcatatgctgaatagaggaatttatcatcaaaccgttgctacaataattgcatttgaacttcaggatgcattcccgctttctgcgatagcgacttgtgtcattgagagagttgggcgtacaaaggatcaagacagtcaagaacagcaccatctgccaggatcggtacctttgtcgtttatcacactatcagcttattatcatatattccttctgttaatgcatatatttaattactgttatatgatgtgttattttcaatactcaactcctgctatatgtactttgcactaccagtaacctattacaagtggtttacatgatttaatgtttgacatgatatattctttccgttagtgcatatatttgattaccgttatatgatgtgttatattcagtactcaactcctgctatatagtgtagattacactttgcaccacctttttgtgtttttgtgtcaccttgcgccaccattaaggatttgtatcaccctgcaccacattttactatcaatttttcaacctgtgccacatttaaccaataggcgttaacttccaccgattaatgcatccatccaattgatgtgcgcaccaataccttcaacaggtcctttttagcgccaacaccagacaaattgcacaattagatttatatgactgctgaaatgtaacaaacttcatgtcaccatacctataagcaataaactaaaatgactgtagaggttcatattgtagcaaagactaaataaacaccatgccaccaaattcctccagtattatgtgagccaatcccttttgcatctgttggctgttgctgaaacactggtacttcatcaatgttaaacacatccaagtcagcattgacatcaaacaggtcttccgcatcagtgtcagtgtgtcacttatggtccttgtctatcctactgctcatctaagcaatctgctttaagttctttattctcctcttccaagattgataagtcttcatagttatcatcaaaagattgatgatcagctagcgaaaccataggttgcaactaaactaaattctccaacccattccaaccaacaaaaacaaaaagtaaattggatgccaaccatgtttatgaactaatctcttcccatcagagaacatcttcttgagagtcgctgtgtgatggtggtaggatctgaagtggggtgcggaatgctgactgctcgcgccgttgcttggcagcggcactgggaccagggtcagggcatgggtgcggtacccatcatgtgttgtggggcacatcggtgggttgtgctgattcagcactgatcgaacaataggaagaaaaaagtggtgcagagtgatgcaattccttaaaggtggtgcaatgtgagtatgtgacagtgtaaattaatctctatgtttctatatagtttgtgtgtctctgtgtgtgtgtgtgtgtgtgtgtgtgtgtttccagcctcatccctaatgttgtataaccatttctgtgcagaaagagaatgatgaagagaagctagctctactgagattactatccaaatacgtggaggatccaaaacaatgttccacagagaatttcagcattgctgataggattgcgatgctggaacaaagcctcgcaaagccacatcaagcatttacaggaacaaagcgcaagaggacagcacaggaggacagtgtagaatgcactcgagggcctaaatgttcatacactccagctgcttctagtgcctcacgtaacaaaaatcttgaaggatagaagcagcatatctgttcaattaactcagagttcgccaaactttgttggggatccagttgaaccctgtggacaatagaattgctctacctagcaaggtgtgaaaagtataaccatgttttcgtttaattttcttgtggcaagcttagccagacttgcctagtaagcacattatctttctacatgtttgttaagggatgcattttggggttgggggtctgaacctaggaaatgtgcatcatccttagcatcatttcaatagtggcctcattaagaaagctccgtttacttattcctatattagtgagtcgtacaacgttgttgtttatgtttctaactataatacttatgatatatcatggacttacgtatttaaaatcattttcatcaacatccactagtatttggccagacttgttaggccttattagttgagtaagggtcttttaaaatatcttttccatttggagaagatatggatgagttctggaatataatcgaaactttgtatgaagtgcattttcatttcaattggcacaattttctgtcaatttttaatctgcaccacattgaaccaaaaaacactactgtttatttgatataccatagtggattccattactggttcatggtaaaaaaagaaaataaacacgatgccaccaaatcgtccaatctttgagccaacccttttttccatctgttgctcaaaattcaagtcagcaatggcatcgaacaagtcttcaccattggtgtcaccctcacaatgaaagtccttacctaccctacttttcatctcagcaatctggttcaagttctttttttccctcctcgaaagcatattctgcatcatcctcatcagaagattgataatcacctagctgcaaggtatgattctcctaatccatgtcattgtcatcatcatcttactaagggaagcatgctcttgttcatctatagtaacaatggtcgatgatattgtagaatcaacaatatttttccagtggagataaaatcctattgtcatctatcaccatgtaaaacaagactgaaacattacaattcaactacatatctaaaaaggaaaattgtactccaagctgaaaccccaggttgcagctattcttttttttttatctccaatccattccaatcaaccaaaaaaaagtaaatgggatgccgacctctaggttttgaaccaatctcttctcaccagagatatcctccttaagcgttgtctggcaacgtcagtatctgaactagggtgccaaaagctggctgattgtgctgtcgcttcgcagctctcctgggaggctgggaccaggggtcgggacatggggtgtgtgcatcatgggtccttcatattcagtgtaaattgaacaatgggaaacaaaaaatggtctagaatgacacaatcccttaaaggtggtgcaatgtgaacacaaaggcacacataggtggttcacaatgtaatttgctctatatttttttgtagttgtgtgtgtgcgctcacgcgcatctgtttgttttgctgtaatgtgcgtatgtgttttgtcggccacatccctaatgtctatgtgcaataatttgtgtgcagaaagagaatgactaagagaagtcggctctattgagataactaatatgtggaggatcagaaacaatgttccctagaggtttcttgtttcagtattcctgatagggttgcgctgctagaacaatgcctcggaaagccacagcaagcctttatatgggaacaaagtgtaagaggacagcacaggagggcagtttagggtgcactcgagggcctaaatgtccattcactccagctgcttgcaatgcatcacctaacagtaatcttgaaggagcaaattgctcaacctagcaaggtgtgaaaaatactaccacattttcatttaatttcttgtggcaagctcggtgagacttgcctagtaagctcaccatatttctacatgtttgctaagtgatgcattttgggttgggctgttgggttctgaaagactgaaactaggaaatgcacatcatcgttcctttttttttttttgaaaaaagaaaattagcatcagtttgagtattggtctcattaagaaggtcagtttacttggcatatcaatgagttgtacagctttgttgtatcaatttctaactatagtacttatgataaaccattggtttacatgttcaaaaatcattttcatcaacatctactagcgtttgactagacttgttaggccttattagtggagttatgtttacggtcttttaaagcacctttccatttggagaatctatggatgaggatgagtcataatccaaaattacaaactctgtgaattgtgaagagcatttttcatttggagaatcatgcatgagttctgggatataattgaaacttaatgcaaagtgcatttttaatttggagaacctatgcaatgcataagttctgaaatataacccaaagtttatgcaaggtacattttccatttggagaagctatgcctgagttcctggatgttatccaaactctatacaaagtgtttttttttttttcattttggagagggtattcatgagttctggaatgaaattcagactctatgtcaagtgcattttttgtttggagaagctatctgtttgttctggaatataatccaaactaaatagatgcacatttttcatttagagaatctatgc

SEQ ID NO: 50171 - DNA, 4007 bp, Oryza sativa
  unsure (1)..(4007): unsure at all n locations
gttcacagttcacacgttttttgcatgagggcacagggagagagtggtagttgcaggctgcttccaaacttccacctacctccacagtgttagagatcccttcccatttgctgagtaggaagctttcactctctagtagtaggtgtgtcctttacatttgctagtctccactttccgagctcgatcgatcgagcatggaagccacaacctccagcttgctcgtgcgccccgtcgacacgcggctctccgccgcctccctccccatcgtcgtccgcgcccgccggcgcgtggccgtcgtcacggcggcggcgccggagcggaagccggccgcggcggcgagcagcagcaactacgtggtggtgccgctggacgcggcgccgtcggggatcacgcggccgctggtggaaatcctgcgcgacctcaacaagcgcgtccccgacaccgtcgtccgttcctcccgccgccgcgcgtcgccctccgatccggtcatcccctggtacggaacaacctatacatccttggcctttgcttgtgctactggtaaagcactgcagatcttgctgccatacacatttgcttgcaacaaggagcactcgcgatattcaggctcatgtacagcatcgaccaatgacgctcagatcctcacatttctagtggcacactctcaagagtcaagacacaaaaagaagtttgttccttgctgatgtttcacggtttcttgtaggtatcatgccaacaggatgctaagcttttatgctccaggtaagcatatctcgtgtactctatacctgaatctaataccgagctaacggtgctgaacattaatttgtaatcacaaaatcgatgccagtcactggttcaccccttctgtgcttgctcttttgaaagcaacatgagcaaataaagttacataagtagtatgtgttgtatacataacctacatatgtactagcttccaggatgctgaataagtaccgtgtgttgtacacataaactgcatatgccgttttcaggatgctaaataagtagtgtgtgttggtacacataacctgcatatgtagctttcaggatgctgaatatgtagtgtgtactgtacacataacctttataggcagcttaaaggatgctgtcatgatgaataagtgtattttgtacgcataacttgcaaatgctgcttccaggtgctgaataagtagtgtgttttgtacacataacctgcatatgcagcttccgggatgctgaattctctctcatttcaacttataattgtttccttctgatgattgtcaacatttacttgctctacctgtcctatgtctgttgaaatactccaacgactaccaaatttaacacctttaatcatttccagtggatgatagtcacatttccttgcttgatctatcctttatctacttgaaatgcactggtcatgccaactcttcagtcttttacaccgttcttggatttccactcatattatcactgttttttttggaaacatcaggctggtgtggagaggtccgtgatgttatttacactgacaatgggaaagtgacagtgatatatcgtgtcacagtacgaggaacagatggagaggtaagtttaaaggtgttgcctcttcttgaagtcttgtgattttttctctggaagcttcactttctctattgccattctcacttacatatacatgggatgggccctcttcaatagatgggctagcacacaagacacacacacataactagtctatttacagcccaacactccccctcaagatgggtgatagatatctatcatacccatcttgtcacatgaacaattacactctttaacacctaagccctttgttaaacaatcagcaacttgtccaccagacgttacaaatcctaattccaacactccctcgtccaatttttccttgataaagaaacgatctatctccacatgctttgttctatcatgttggactggattattagcaatgttaatagctgacttattatcacacaatagcttcatgggagtgttccccaaaattttcagctcaactagaagatttcttaaccacaacaactcacttaaactcgctgccattgccctgtattctgcttcagcagttgagcgagacactacggattgtttcttgcttctccaagataccaagttgccaccaacataaacacaatagcctgaagttgaccttctatcatcaagacagctagcccaatctgcatcacaatacccttctatcttaagatgtccatttttcttgaaccataagcctttgcctggacttcccttcagatatctcaagattctatacaccgcctccatatgactacttcttggatcatgcatatatcgactcaccatactgacagcatatgttatgtcaggtcgtgtatgacatagatatatcagtcttcccaccaatctttggtatctttccctattcactggatctccagactccgcacataacttatgattttgatcaattggtgtagagactgggcaacatccaagcatacctgtttcactaagcaagtccaatacatattttcgctgtgaaataactatccctctaggagatcttgcaatttcaatacccagaaaatatctcaactggcctaggtccttgacctcaaattctttgcttagattccgtttcaacctagttatctccaagcaatcatttccagtgataatcatatcatcaacatagacagcaagaatggttatatgatctccactatgatgatagaaaactgtatgatctccattacattgcttatagtccatagcacacattgcacgcctaaaccgatcaaaccatgctcttggtgactgtttaagaccatacaaagatttcttcaatctcaacacctttcctttagtttgtgaagtggcaaatccaggtgggacatccatatacacctcttcttgaagatctctatgtaagaatgcattcttgacatctaactgatgcaatggccaatcaaaattagctgcacaagatataagagttcttaccgtgctcatctttgctactggtgcaaaagtttcatcataatcaattccatatgtttgactatatcccttagccaccaaccttgctttgtatctttccacctttccatcaggattttgctttactgtataaacccacttacagttgacaattttcttccctttaggaaatggtacaagatcccatgttttgttcttttcaagagcctctagttcatctagcatagcttgatgccaccttggatcttgctttgcttctctccaatcctttgggatttgcactgaatctagtgatgctataaaggccttatatgtggatgacaaggagtcataggaaacatagttggatatattattttcatcatcaccctcatcttgagcttcaaaaccataccttagtggaggtttacctgcattgcttctcacactctttctaatggcaattggtaagtcagattcttctctaacttcctcttcttctccccctgactccaaagatccttgctcacggcttacatcttcctctacctgattatcctcttcaacttgttggattactggacaccttgttctccttgtgtatacttgaagatttttctcttcatgtggcttcctccattcttgctcctgtgcaacaggaccacccatgggacatggaattgaaccaaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50172 - DNA, 10154 bp, Oryza sativa
  unsure (1)..(10154): unsure at all n locations
ccgcctactttttataccgtgattctaaaaatcgaacataactattgttgcaattcattttttatttctagaagtcccgtcaaccgtcagcggctctgcaactatactcttacacaccccgcccgctgcttctcctttttattgtcattgagattttaaaattcgaatatgattatcaatgttgttttttttttaactttctagaagtcccggcaaccgcctttcatgtttgcttcacggcctgcctgacgtccttctttttaatcgtcattaggattctatttggtgttttattaacaatttttatatggcgtatcaaccgccaccaactctactcatttataggcatgttatttaatttatctcgtcatgtgttttagatggtcttttctttcaatagtctttatttttatcaaaaattttagttatttataaattttattcataattgaaatcttttttttttctaatttcagaatttactttttttaaaaaaaatagttgatatcgtattgtgttcttttaatgtttttatttttaattttcaatttcagttgtttcataattgtatttctacttgaactctcttttaattttttctaattttagatattattatattttttattcgaaattttaattaatctcgtatcgggttcttatatggattcttctttcaatattgcttatttttaattctgagtttcagttaattttaaattgtattcctacttggactcttctttattttcttttgctaattttggttttttttttattttattttgaattttaattaatctcgtattcggttcttatatgaaaacttatttcaatattgcttatttttaattctgaatttcagctatttttaaattgtatttctacttggaatctcattttcttttctaattttgaattttattttatttttattttgaattttgattaatctcgtattgggttcttatatggaaacttctcctttccttttctaattttagattttattttattttatttcgaattttgattaatctcttattgggttcttatatgaaaacttctttcaatattgtttattttaaattcagaattttagctatttttaaattgtacttctacttcgactcttcttttttttctttttcttcgattaacgtagctgaaattcagaattaaaaataaagaatattaaaagaagagtccatataagaacccagtacgagattaattaaaattcggaataaaaataaaaacaaacccgaaattagcaaaagaaaataaataaagagttcaagtaggaatacaatttaaaattagctgaaattcgaaattaaaaataagcaatattgaaagaagaatccatataagaatccaatacgagattagttaaaatttcaaataaaaaataaaataacatcgaaaattacaaaaattaaaagagtgttcgagtaggaatacaattttgaaataactgaaattgtttcagctaattttaaattgtatttatacttggactcttctttattttcttttgctaatttcggatttatttatttattctgaattttaattaatctcgtattgggttcttatatgcactcttcttttaatatttcttatttttaattccgaatttcagctatttttaaattgtattcctacttggactcttcttttcttttctaattttggattttattttattttatttcgaattttgattaatctcgtattcggttcttatatggaaacttcattcaatattgcttatttttaattctgaatttaagctatttttaaattgtatttctacttggactctcattttcttttctaattttgaattttattttatttttatttcgaattttgattaatctcgtattgggttcttatatggaaacttctcctttccttttctaattttggattttattttattttatttcgaattttgattaacctcttattgggtttattgggttcttatatgaaaacttctttcaatattgtttatttttaatttcaaattttaactatttttaaattgtacttttacttggactctccttttcttctttttctttttattcaattaacgtgagaatttctagtctcaacagcgaacgtggtgcctcctttcaaagctgtctttatataatataatataatagatataatagataggtagataatagcctggacacatgcttgatgattgatgcaaagctgatgcattcttttatctttacagaggagctccgggatacaagcatgctagaattaatctgtatacatacgtacgtacgtacgtacgtataaatatatgatgtaataacttaatatatagattttcctaacttgacaaaaagaatcggcgcaactaataattgaggagaaagaatttggcagctcgagaaattaaccggcctgcagtcgagcgatcgcctagctaaattaaccaagcagccaaggcaatccagcaatgctgaacgctgcgtgtatatgcatatgaacatatgatcgatcgatcgatcagtggatgcagatgccggggagcttccactggaacttgcccgagcgccgctcgtcgggcggcgccgccgtgtagttcctccagacgtcgaggacgcctcggaggtcgtgcatcttggcgccgaggccaacacagcagttggcatggagcgtgcagatcttgttcagatccttgctgagctgacagaagccactgatgtaggtggtgtcgaggaactggatggcgatgcccagcttcgcctgctgctcgtgcttgatcaggttgaacacgtcctgctcgtgcttcccgaagaatcgccacctcccttgctgccaactccggtagaaatcgagggtcttgtcgttggatcgcacgaacaggaagccgccattggggaagttgccgaggctgtaggggtcgccgatgaacacgtcgctggagatggcgatgtctgctcccattgatatgtgcctgaacgggtccctgaaccacatcacgtccacatcctgcaaatgcattcatatggattaattaattactgtcagtgcaatccttttccagtttactgttcattcagccattgattggattaattgtactcctggattagtatgcaattcgcaagtcattctctgaattttgcaatcaatcagtgagagcgccatcaggccaggaaaaccgggcatgagcgtgtctgcttcctcttgctcaacggaatctttcagtttcacaggttcagttttttcggtcgcctgtacgcgaaagacaagccacaagttccaatccaaatggacggccgggccgacaacaacacgagtagagtagagtatagacgaacgtgtcaaagtccaaaccaaacggtttagtccaacttctctcgaatcggctgcgtctctgcttagccgaggacatttctgcccagcaactatgatgaaactgtagtgcacgagagctaagctaagctagctagccaagcagagcactagcagccaatgtatcgcccaatccggccaactcaaccaccacttcgatggaacacatagtatattgcatcgaaaacgacatgaaaatgaatttatatattgcaattgaagcgtgaaaagaagaaaataatttagtactgaccgtgaagaggaagttgtagccgagctcaaggatggtctgctgaaacttgttgcgaccccacatcatctcgaggtagtccttgctcatgaacatcttctcggagcggtagtcgacgccggtggtgcggaggaagtagcaatggcggtgcaccgcctggcacccctcgtacgccgcggggtccatggtgacgatcaccaggtggtccagcagccgcgacacgccgccctccccgagcctgaagctctcgaagaagaggtccagcagcgaccccggcttcgtccacgccaggttgatctgcgtcatgatcaccgtcctgtccttggtcgccgctcgccggagcacctcctccaggtcgccgtaaggggacgccggcgccggagcctgcacattgtatatgcacacatgattcatgattggtttctgttcacatttcatgatcagtgcagatatgagatgactacagagttggatttttttgcttcatgatcactacaaactgaactccaagaattggatttttgctgcatgcatgtgacgagttggttgcgtctctatggttcagcattggctgacaagtggggccatttttttttggaagaattgagctatgggcagcaactaaagctgagtatagcagcaatctaggagaagacacgcccatgaatgccatgctgcaactagcaaatgagctcaaaccattccttcattttatctctttttatgcaagattttattttcaacaattgaaacggccaatgcattttcttctgaacaacgacatgtgctacctcacatggttgaaccaagaatagattttgcctgtcagtaagacatactactctgtcccatagaaaatctaattctagttacaaacttttacacacatatgtctagattcgtagctagaattggttgcgaacccgtcttctctctttagccttagagcaggtttaataaagcaggcgactgccggcggtaaaaaacaccacatcagcgatagagataactatgagataactagaagatgggtgtatgtacagctgctggctatacgcacaagcaccaatgaattgattatcatttttttacgcccaatccgtctgtacccgcgcattgcctcgcgtagacccacacgcagccatgggataagctttttctacagtttctttcttcttgaagttcgtgtgtagtcggcgacaatttaggtggtgtttggatccagtgatttaactttagtccctgtatttagacactaatttaaagtattaaatatagactacttacaaaactaattacataaatggaagctaatttgcgagacaaaatttttaagcctaactaatcaataattagagaatgtctactgtagcatcacataggctaattatggattaattagactcaatagattcgtctcgcaaattagtccaagattatggatgggttttattaatagtctacgtttaatatttataattattgtccaaacatctgatgtgatagggacttaaaagttttagccccatttaaacagggccttagtcgtccgctaacaccctctctcctggttttttccatccagctcatcactttggccaggttggatgcgctatcgccggcttaaaccgtatattgtacctgctcttacgcgaaaaccgccagacagaggcgtcatgggccggctgaacatccatcgccgatcagtcacacatggaccgtccgatcgggagccggactactagccgtttccggtgccacgtgtacccatcccactgcgatggccggtgacacgtgtgagaacatggcagcagtggcagtaaacctgtgggacccatgccgacagcagctacaggtaaaaaggagctagtagaacgcgatgagtcaccaggtctagactagttacatcatgtggagaagaagggaattagctgctggtgttaacaagtgtgattagtagtaatagtgtttacatggggagaggggaaagacaaaagtggttgggagaaaggggagaagatgggagcaagaaagcaggtgtcaatggcgagcattagcatagaggcaggaccgtgtctttgtgttgtaatctagactgactaggtaaataaactattactggtatggtaatctaatcagtaatcacgcgggtttggttaaccggtcgccgtcaggctacgtaacttgttcaaagaggattcctcctcctcctcctgttaatgtgttttgttaattattgctgatcgcggcagcatatgtaaatggcatctctggtttttatttgagcttattaaatatcacaatttgatgccatctccaccaccacgcactacttaattagtattactgtttgattattttttattcttgttactgttctttcagaaaaaaaacggatttgttaactccagggaggtagaaacatctgagggaaaataacctcctttgttttttttttcattttgaaatcttcagaaatgatattggtgccaatcaattcgttttgttcatagcatattgaagcaataaaaaaaatggcaaatatgtgcatacctggacgggggcgggagccggagcagcaacgacggtgacgttggcggcggcggcggcggccagcgagtcgttggagtcgacggcggggtcctgcaacgggagcggcagcggcggcgagtcttcggcgttgctccaggcggagatgtcagcgaggcggcgtcccgggctggcggacatgacgaagaggatgcagacggtggccatggcggcgcccagcacgaacgacaccagcgggctaatgctgcagctgcgtgancccgccgccgcccatcgtctccccacccttcatcttgccgccgcccagcatcgatcgatcaaccaatcaatcaaactatagctgcttcctccgttgatgtgacgaatggtttcttgctcaaattaagagaggttcttgcttcttgtggcaggatggtggaagaggaaggaaaggcaaagcctttgtctgaagaaaggaacaagaaggaggtatagtagtagcagagaggagagggaatgggggtatttgatggaggagcagcagcaacaggtaggcgaagaccagcctgaaagggaattaacgggcgtgatggaggcctaagagacagatcatcatcatcttaatcctctcccactgattgatttactcgtagttttggctttgctggtggatgacaacttgtagtgtgatgcgtgcctcttgcttcagcgtgacaggtttcaaagtcgcaacacacggttgctttgctttgatttgctagctgctggaggtggaggtcgaggtttggctgtcaggaactcaggatgggttgggttgttggtgccgaccctgtctgcctgtaggttcgcgtttgtttaggcgtagactggacctgatgcgttgaactgttgagatggacgtaataaacccgatccggggtattattctgatttctgaattctctccctgcatccctgcaataactgaatttttctatgctacttacctgtacatgacattgtgtacgcgtctttggaggtgatttttttagtgttgcagacggctggttggttttattctgtttgctcacatgggggagaaacaatatttctgaatttccctcgtactgtgtaggaaaataaggttcgacatgaagaaaagaactgcacaatcaaacgttggatactgttgctaatttgagtacaaaacggtttcatgctttgaatattgttgcttatttatgtcaaaaaaagtattgttgcgtacaaacggcttcatgctgtatggtaaacaccgccaatcattcgcgtgctgagtcttacaaaacgaacaaacattcactatcggtctatcgccgcatgtagaagaaaatgatggtaatttcgacctgcaactgttagagttgattaattattaatttggtgaagattttttctctaccggaaggaaatgactaaggtgctattagcgacttctagctagctaggtcagacgccatctgatggccaccacaccctatatgctactagtatgatgctgcacttgccgtgttaggtttgctcatgtgtaagtcgcagcaaagctcatgccgctgttgccatcgatgagcaaaccttacctactagctctgctatctcatcgtcaactccatctttcgctacttgcatcttcagaaaaagttcagaaaaactcagcctgcctcttttcttgacaaaataggttccttgttcagagttaaattgaactgtctgcagcgtattcttttgtagtttttcgtgtatctagcttgtcattttgaggtaagcaagtaagcaccaacttctgtcattctcggtatataaacaaattggagaagtaggcatctaaataaagggtagcgtgagcctgtcattctgccgccaatttcgggattgcatgcaagactaagctttgaactataactgaacaagtaatctgatggcgatttgtcggtgcagcgatttggtactagcactgctaatctgaagcacaacagaaggattgttttttttttttacctagctttcactctgcttttgcaatcttgcatgctcttgggtgcaaactaccatccatcaatagctttggccgatacagtgctatatacttttgtgtgtttctgtcagatcagtctatgtgcaacagtgcaagtgttcttctcaactgctgaaaaagccaatgccggaggaactatttttaggtggaaacatatactatgcagtattgcagtaaattaactctccacacgggcgggtgaataaacttgtttacactgcctattattaattatctaaaaacattattcatccattttcctatagacagacgtctctattgaaggcctaaatacatctttgactaactatcttattctaatcattttgggtcagggaaaacaacatgtacaaaaacgtgcatatttccatggaagttagcagcatatgcaacacatattctgttaactaatcaggtcgggttcctgtcccgatcatgattcatgagccgaaatgtctaatagaatggcctagctgactgattgttttgcctaaccatataaagactggccgggttgattattatttatccggtattttgtcttaataatcaccagatacaagctgcttgccaaaccttaggcgcagccatgtacacatttttgcctttcctgttgttggttgaatcataacattagcaccaaactgtctgtttaccagtcttgaggaagaacaacaccgtaaatcacgctggaaatgctgcattttgctagccattcttatgtagttgatgatattatatatgctcctaggtttatggcaagttggcagagttaatttgattagaacgacagatgttaggacgatactgtgttggaagtttcttggattgacctcaaacgtgcaagcagatataaggctggcaacttgactatagttattagttggattctgtagtctggtctgcacatataatattatacaggtaatcagacagcattatatattgatatatactactgaataaaggaactaagaggttcagttttaacgaatccatgattgcgacatgaacaagaattaatctattcatatctagctacttgctacgatacgagctaacatgcacccaaatgaaaaaaaggaagagaaaaaaaagaagatatgatgtgcacaacagtacagatggtatatgtagccgtttgcacatggcttctcaagaacaaaatgcagtggcttgccaaaacttaggacagttggaggctctgcatttgtgtagcgagtataatattgggaaatcttgctgtttaagagtaaaccagctctgcatagctatatgaaaaggagtatcaggtaaccggctttgcaggggacctcacacggagagacgacgacagtggagaggttgctgtttaggtgcatgatgccattgctattgctgtattaggccaaactcaactcgctaggatgacaattattgcaggtgaagcgtgcataattaaagcatgtatagcaccaaacatgcatgaacctatcagttatatatatgggttttcagactaggcaggagaactatttttcagagaatgccctgtggatgtttaaaccaaatgaacggatcaaatcagcagcaggagcaggtaatgtgcctgtgtttgaggttgtaacacgtctcaatagtattttgcagtaatgaggtcacaagatcacataatcatatggattaatgggagatggcgaagaatcatgtttccttgtgtcgcagggcagcacatgcattgcgtcgccgccgttgctgtcctccgatttaacaagtcaaaaggcagaaaaaagaggaggagaaacagtagtttaaacaagaagaaaagtgcacaacgaaacgcggcgttctcgaggcgctttggctacctgatgatatatactaataatccaaattaagaggtaattcgaataatatactaatatagaagaatgggcagctagttagctg

SEQ ID NO: 50173 - DNA, 1005 bp, Oryza sativa
aggttttgtggtggcggcgctgcgggagcgggacgtcggcggcggcggcggagtggacgccgatgtcgccgaggcggacgctggggcggcggcggcgcttggagtacggcggcccggcggcggcctgcgctccggaggcttccgcggcggggtccccgagcggcgcggcggcagcggcagcggcggcggcggcggcggcgctgccgccgttggtgtcaggctccggcgggtggagatcggccatgggggcgaggcgagatgcgtaatccgtgggggcgaagacgagtcgtgggagagaagagtggatgattcccttcaccaactgtggcgcccgcggcttcgggagactcgcgctcctctctctcctcgattgccgctgtggggaggcacgatgccgacacgtgtcggatcggacggtgaggatccccggttgggcgctcgatgaagtcgccgagcgttgactcggtagagtcggacgcaacactctctgaactccagcttagatgggcccaggcttcagtaacacgggttacggcccatgggctttttccttttacccctccatccatttcgtgctgtactcctgctcctcgagtctcaacaagcagttgcgaacttgcaattgcagctttgagctttggtaaatagtagtaataaagtttacagagttggtgaataatcatctatgcgtacttatgttattgatgatgaactacttgttgtctcctccaggaatgtgatgagcatgattgcatggagagtgtcaaactgctgagcaggctgcagcagcagcaccaataatccataggagtagccattagtgattagtgtttagtcgttgttgcaggtaggtaaattcgtccttggacctcaggtgtctccttcaaggctcgaccagttcacgtggtcctggccggcctgaaaaaacaaacctgttgattttgattggattttgatatgatcagacgtcctgtacccggaactgggactcggaaaatctgggcg

SEQ ID NO: 50174 - DNA, 916 bp, Oryza sativa
catcttgttgttgataactctttaccggatgccattttgaagaagttatatgacatagcttgttctgcacggtcaaacatttacttattcacatgcaattttctccttgagttgttgcctaggatcttgccacctgaatggcagcatgctaagcagttattttggtctcctggacatcaaggtcagccaagtgtggaatggatggtgtcactctggaatttcttgcgacattcatgtgaagatctttcaatttttgcaaaatggcctatattaccactggtagatggcaagcttatgcaacttggcaatgcttcaaatgtaataatagatgatgggtggagtgaaaatatgtactcgttgcttcagaaactgggatgtttctttctgagatctgatctgcagatagaacatccgcagctggcaaattttgttcaggaagccactgcagttggtgttttgaatgctgtgcagtctgttgcttctaattttcaggatatcaaggaattgttcatgggtatttcactggcagaaacacatgagctacgcagttttattttccagtcaaagtggttttcaggaaatcacatgaactcttcccatatgaatacaatcaggaatcttcctatatttgaatcctataaatctagagagcttgttagcctgacaagtcctagaaaatggcttaaacctgaaggtgttcatgaggatctgttgaatgaaagttttataagaacagaatcggcaaaggagaagtcaattttggtatcatactttgctattacggaacctcaaaaggctgaattttacaaggaccacgtgcttcctcgaatatccgagtttctatcacaaccagctgttgtttcagcaattctccgtgatgtgaaactattggcagaaaatgatacttctgtgagag

SEQ ID NO: 50175 - DNA, 1074 bp, Oryza sativa
ttggtgtccagtccatgttgcaccattgctaaaaggacttccatggttcatatctgaagatcatgtggctcctccaatcacaacaaggccaaaatcacaaatgtggcttgtttcatcaaaaatgcggattcttagtgctgattcttgctccatgtatctgcaaagaaaacttggttggttagacccaccaaatgcaaacattttatcttcccagttagttgagatctccaagtcttatgatgaactcaagatgttttctgaagacagtaccaatgatgccgttccgcaaaaggaaattcaactgatctactcaaaattgcaagatattattgacacagccgataccaacattctaaaacggaatctggatggacacccatgggtttatataggtgataggttcgtgccacctcaggcacttgcttttgattcacctgtaaaatatcacccttacctttatgcagttccatctgaactgtcggaatataagaggttactgtcggttttgggtgtgaagcagacatttgatgcagcagattatctgaatgtacttcagtgtttacaaagcgatgccaaaggagagccattgtctacagagcaactaagttttgttcatcgtgttttggaagcatttgttgattgttatcctgataaccaagcacctgatatgatggtgaattcattgttgattcccgattcatttggtgttttgacacctgccagaaatcttgtctacaatgatgcaccctggatgaatgctgatcctacttcaaagagctttgtgcatcttagtattggtaatgatctagctaataggcttggggttcgatctcttcgtggatcatcattactggatgacgagctaatgacggatttgccatgcatggaatatgctaaaataagtgagttgctggctttatatggtgagagtgactttcttttgtttgaccttatagagctagctgatcattgcaatgcgaagaaagtgcaccttatctatgataaacgagatcatccaaagcagtccttgctgcagcagagtttaggtatgatagaaattttgggctgcaggaa

SEQ ID NO: 50176 - DNA, 2595 bp, Oryza sativa
gatgtcccgtgctttgttgcggccggatatatgttagatattggagaaatgatgaaatgatttggattgaaatattatgaaaatgatttgagaatgatgatttagcgtgtgtatgtttagttttaaaatgaaataaatagtagatataactattatatgcttgtatgttgtgttttgtatactaatgggttgatgtgacatacttgtgcaatatgtaggtttttaggagtgataataaatactatgcttgtatcttgagttttaagtgtttggtgggtattagctttctatagaagaaggaatgacacatttgatatttttaatcagtccgacaattttaagattttttttcaaatagactagataaacatttttttcctttttaccgaattgaacgtagactcgttttatgcatgtcaactataaagtcataaaaaatctttaaaaatggaaatatatattaacttgtgatatttcgatctataaatatataaatttaaatttgatttataaaggtagaaaaaataatatatcttaatttgatttatatttgtaatttgtgtttctattgtgtatatgtcgaatttgaatatgtatataggaagcccattataggcccataactatttaaccctaaattctctcatcttttaatttctccatgctgactggtgttactgtccacctttttagttttaatctacctgtgaatattcgattgaaatatgatgcatgattatattttgcatctgatctgttattctgagctatatctaatctggtctgatcagcaaggtcatgacgctagcttgcagctttcaacacggactcagttattcttcttgtggaacttatggtgattttattatgaaatgaagccaggttaccaagtaaacgtacttcattgttcaaccacagtataattcatgattaaatagtcaatgctttcatattcagatactacttaggcatatttgaaaagtatagaaatgtttggtctttgaaaagtataatctatttttacaatatatatattatatatatatatatatatatatatatatatatatatacactcgctgtatcgacgtattagtgtttttgaaaatttccgtatcgccgtatccgtatccccgtaccagtatcgcgtatccgtgcaatataggtgttcactagcctaaaaaaaaagaactttggttgtttagaagttcccccctttgtgaatacactacaatcatgacttaacttcaatctgaaccaaagttttaggtatgctcatatgcgcaaaagacagaatcaaatattctattcataaaaaagttaagaaataaactactgcatgtcactatgcgctttttagcattaccaactgccccaacagataacataaatagatcactattcttgtaattttattgtcattggcatttttttttttccacaacttacgaaatctgtttgcgaagccacaatgaaataaacttacagacaactccagtgtttccatgaaaggagcaatcttcaggatataagcataatcaagggcatcagtctttctgatatttccatggccacagagagctaattccaacctcaaattccgaagataagtaaatttgaaaggcccttctggtacgatagttctctgcaacagaaatgaaaaaaaaaattggtgaatttgatcttatagtgatatatgcacaaaatatggccacaaaggacgacatatcacgaacctcacgttctccacaatgtaaggtcagagtctcgagccttggcaaagtactggggaatccagtaatgatataggaaatagcagattggtaattgatgaatacaatactaatatttgtcagcctggatgttaagcaaatatcaaaggaaccatggtgccactgtacttaagtgttgttggactacaattcagttctatctcttgcagattagggcagatatccactaccaaatgcttaagccggtccaatggatgaagcattcgtatgctattaaccatttcgcaatatgagatcaggaaaaactccagaatattgcatttggatagcatacgctgaacatcttcatctgtaatgctcatatctactaagctaagaatcttgaggtccagaaatcctttgaaatcagcaggcagctgcagagacacggtcgtaagctcgagacaccgcaagtatgacccataattgaggccaagaagctgtggaggcaaattatatggtggttctttgattatccgtatgcaattgctatgtgtcaaatctgtgaaaaatgagcccttatcctgacctgataaatcaacaaccaattcctttgtttttgatgcaattgcaaagttcacccatctatcaatatggtctgcgtgcttactatgcaaccgaaacttaatttccatacgttgaacccccattccactgtgctgacgcaggaccgcatcaacccttgtaataaattcgtagtccctgagccatcgccatcgatatggagtcaaggtcttgacataaggtttcctcattgtacctttattaagagtaagattggggtggctgcaccaaaaatatttccattttcttgacaatacac

SEQ ID NO: 50177 - DNA, 3077 bp, Oryza sativa
  unsure (1)..(3077): unsure at all n locations
gtgcactatatgcaagtttccctacaatatcaccagtaagaccccacgattccaaggttcttgcaggatgcgatacaagattgcgcttcaggggaacagatgttgtggttgaaccatttgctggcctatccattgaagaatggacccccaggttgtttggtgcaagttgctttacagcttcccccaaatggctggtagaatttaatcttggcgtctgctcccctaaagctctgttgcatggtgacacactagaagatggctgagaactcaaacggaccattcttgtggctcctaatttctgcttggaagtgctaaggatgcgcttaggagccccaaagaagttggcctgccgtaagagaataatgatatgaaattagtctgtagaaaaaaatattcatgggtttcattactgaaaatagtaagacacagaccaaagatggtgaacaatctcttgtatccgcaaaacgagaaagtgccatatcttcagccacaattcctgtaaagatacgctatttgccatgagaaaattttaacacaatggagaaatataatattcagtaatctacagtagcacaatttatttgctccaaaacatactacagtgaaatataacataccagagactgacagacagtaaccttgtcattgccgtctttctttttaggtaacccataatttcttgagttggaattcccattactttgaagctgctgaagcttttcaaaaacagtggtgccagattcctgagagcaaacatttagttatgataatgtaaactagtaaaatttttgcagttcaaatcagcttatcacctctccaaggagatacaaacaaaatgattcctcaaatttcaggtctgtgttttcagatgcaactaaacaatcgcaaatggttttggctttactgatctgcataaaggaactgtacgttaaataatgcataaatagcaaaaatgatagtttactactattgagaaggagaaggtaccaggtcagcctgccgggttgaaaaccctaacgcaaagtgagcaagcatcgctacatggaaacaattgaagtcaactactgcccgctggctctgggattccaacgattttttgtttttacgagttgtagccaaagtatcccaagaaagtagatccacaatttcagtggctaacaacttattcattgcttggcccaagaaacaaggccaatcatgaactctacaagaggattcaacgtcaagaccctgtctaagcagttcacagagagctgcaatagcaccctgcctgcgttcagcgttttcaggtgtctgaggtaagcttagaagctccagagtgcaagcaggtgcaagctcttcaagtgattcttcaatctagttcatccaatgaaataagttaagggcataattctacatgtagaagaatctgtagagcgataacaacaaaaattaacctgttcaagaaggggcaacttctccaaagacggttttctcctcaacaggtattgagcacgtgctagagcttcaaagccaagagacactttacttttctcanagctagcttttgcaatagaacactacaagaaaatgcatcaaatcattgcaaaatataccaatttgtagtcagttatttaaaattttgtgtgcttcttacttcagctagtgccattgcaagaagcacatcatgaacatatggcctagaatctgggcgtcgtagagccgcctgaccaatttccaaaactagcttctcttctccaacctgaaatgaatattgtagcatgtaatacaccatttcattatgataatggtacattcaattttaataaattcaagctgctaggtgtcttgtattcatgatcacttagaactcacaaacatcataatggtgactaacctgcatcccctgcattttacgctacccagtcctaagaaagggcaaagtttaaaacctacgcgctcctcaccacattcctaaggataatttaccctgaagttagcataaaagttttctttattagttaaacattattgatcctaaatcttcttgatccctttcaaatcattcagtgaattgagaatagtattctgacaaagaataaggcagacctataaagaaacataccgggcatggtcatggtgacgactatgactatgtcatgtaacataaaaggtgacaaacctaaaccaaacttggtggttttcctttatttgttcacaataataaggatgtctgtgttacacattacctcctgcaagacacaaagtgcagcaggcaaccaactcaaggtatatgaagagaggatctgggtggaagcttttcttttatgcttcctgcgtactcctgttcaaagagaagtttgtctctcacatctaccagcagagcctaccaaacatgaaagaaataagcaaagattaaccacatgaattctgcattccctacattaaacaaagcagtatatccaaatatatttccagaattccttgattcagcgagcaacctgtctgcaggtagacacctctgccatgtacccgtcttcaatttctgcatttttcagctccattgctgctttgacaatctcatctttctcagccttctctgtaacaccaagaatctgcattggccatttgaaacatgtcactccaaaaatcagggaggcgtgtcacgcgtgtgaactaccagtgcaaattacaataggcatcgtggtgcaaacactaaagttgaattatggtcaagaaacgactatctaatctgcaactgtatcattcgaacagagaccagccgagctaaactagatccatcgacgatataagaccacatttccaaaattcggatccataaacagtacgagtggccaaaaaaaaaaaaaacctgatagcaagtgacggggatctccaccatcggcgcggcgggggcctcctgcctgctcccctccgcggccaccggcggcgcctccgccaccctcgcgcgcgcaacccacgcggccgcccctcgccgtccgccagccaggcatccacccccggcgtgtgcggacgcattgccatttcccaccccaacacgccgcgtcgaggacccacatgcgaccccggggacaacc

SEQ ID NO: 50178 - DNA, 3306 bp, Oryza sativa
ccttcgagaagattcctcatcccccttcccttctcttccctctcatggcgtccgcaccgagcaccaccgcgtccggcctcgcgccgccgccgttctcctcggcgcgcggcgcgcgcctcctccccggcgcgctgctgcgcctcccgccgcctccggctcggtgggtagcttccgcgtggtggggcccgccgccgccccacccggcggccgccgcatcgccagcgcgcgcgtgcggtgtggcgcggcggtgaggttcatcgggcagagcgagttcgaggcggaggtgttgcagtcggacctgcccgtgctcgtcgacttcgtcgccgactggtgcgggccgtgccgcctcatcgcgcccgtcgtcgactgggccgccgaggtctgctacttccttcatcattctggtgttacatcttgtctgaatagcttagaattgagaattaataaaccaccatggactcaaaacgattgaatttttggtgtgctaaataattactagagatatcaattccatggagacatcagacatggactatagactaagactagacagcagtgacgatgccaatgttaccagctaccaaccgctgtctgtgggttttaggtgttcatctgagaacaacaaaaagctttcagatcagtctattaagtcttactattagagagtaaaaagatcagtctataacaagtatacttctgttgtgatgtacactcttcaagttaagtgcaaacgcatacctcctttatactacctacatcccaaaatataacatcttttggctacgaatctggacatgtgcatgtctaaattcatagtcataagtggttgctatgttttggaatggaggtagcagttcaaaaaatggcatataggctacaccatttcagggcaggtttggtgaattggtgggatgatttcagcaaattctaaaattggcagttgccaggacttgctatcatggccaattaatgggaggacttagtttgcaaattctaactttgatatcttgatgatggaaaagggtctaatgaatcaaccaatgtgcagatacattcatatataaagaattaagttctactcaagcgaaataacagtccaaaacaagcagtgcaaccttggtcagtcatgcaaaactgcacatggttggtcgtatgggagtttgttctctatgtttcaacagaaataggttctcaagttatgttagttggactttgcatctctaattgtttaattttggttgaaaataggaatatgaagggagattaaagattgtcaagattgatcatgatgccaatcctcaactgattgaagagtataaggtttatggtctcccatctcttattctattcaaggatgggaaagaggtaccagggagcagaagagaaggcgcaattacaaaagccaagttcaaggaatacctcgaacctctcttgtcaacctcaacagttgcttaatatcatcatctgcagtatgcatcactgaatctgatgtctggagggtgccaatgcacaacacgacctgcatgttgaagttttttcccccctccatgaactccccattctaatttgtaattacctcaagatcatggttgcatatatttttcattattgatggtaaaaattagtatgtacgaagggctatctgaggtgcagtttgacctggcacaattcctgaaattgaacttctgccaattagtttcttgtacaattcattgttaatacccacaggaccatgcttatatgaaagcatttttcaaatgtgattgagatggagtcagctaaaataagatgctttttagagaggcaaaataaggtgtttttggaataactattggttgaaaaaaaaattgaggctcagcgtgtgtaccttaagaaaacaatagaaggggtaattgctaagcaagttcaaatgataatatttgccctactgaaaaccaatttcgtttacgaaggattaaatttttacattgtatttgttggtcaggtgcaactttttacccacgaggttatgcagaaatccatcgagccaaaaattccatcatttggacaatcaatcaacttatctctgtagaccgtaggtgatgcctaccaggtgcttgtacaaagcttgccttctctcagcttttctgacatggaaataggaaattgaaagtgtgcctggcaacagttctcaggcatggactcgaacaaaatagagatgggcagcttcatggcttctctgtccccttgagtcctttcacctctgctgccattatgtatgcttaacagcaacaactacaagctcaagtgcatgctttacatctcgtctgcctgcagtctcgttgctgtgaagttgacaagcatcatcagatcacatccaaaatttcaggcaacaactccagggcgaaatggcatccgagaaatcagctcttcagcctcttcgatgcgacctgcctttgtgagcagatcgaccatgcaagcaaagtgatcctcgcctggctcaacaccaaacttgtctgccatggcgtcgaagtatatccagccttcgtccacaaacccaccttggctgcaagcatacaggacagagtaaaacgcggcgtggttcggtgccatgccttccaacagcatgtcgtcgaacaccttcacagcctccctcgcttgcccgttctgcgcaaacgccatgatcatcgccgtccaggacacaaccgactgtcgctgcatcgactggaacaccttgtgtgcaccggttactgatctgcacttcgcatacatgtcgatcagagcattgttgacacccacattggagtctcctcccagcttgatcacatatccatggatcttccttccttggttcagattggcaaggttcgcgcaagcattggcagcagctacaatggtgtagttgttaggcctgattccatccaggatcatgtcactgacaactctgagggactcagcaggctctccacaatgtaggagacctgcagccagctctgtccaggacacgacatctctatggcgcatctcggtgaatgctctgatgccggattccagctgtttgttcttcatgtacatctccagcaaggagttgcccacgcagacatcgtcgacgaagccgctcttgacaagctgcgcgtgaacttgtaagccggtcccgccacgttcgcgcttccggacaacccagacagcacggtgctgaaggagaagccgtctgcgctgacaccttcgatggccatccttcgccagagcgtgcacaggcgcagggatgaacggtgcgcgaacgcggtgagcagcgtgttccacgacacgatgtcccaggcatggggg

SEQ ID NO: 50179 - DNA, 1225 bp, Oryza sativa
agcaggcggaggccgtggcggtggaggcgggacttgaagcaggcgatgaggaggtggttgcataggaagatgtgggaggaagcgaggaggaagccccgcttgaggagcgccgcgtggagggagacggcgaggcgggggtcggaggtggcggcgctgcgccggagtagggaggcgtaggagtagatgccggggatgatgggatcttgatgccgctggtgcgcggcggcgtggaacgcgcgcaacgtggtggaggcgagaaggcgaggacgcggcacgagagatggcgcgcgcatcgtggccgcgccgcagagtgctagctagttgcgtaattcttcaagggaagtcacaaggcggcggccgaattgcctgcgacagcagcgagggcgcgagtatacgccgatatgcgcgcgccgcgtctcggcgcgggcgggcacatcatgaagggattgggatcctctactttcaaagtgactatgtctttgtcacagatatgtgtgtccgatggttagtgtacatccgactcctatactaccatgactagctgtgaaaaaactggatctacatagaagtaagctgagcaatgtgattagtcttgagacgtgcgcatgggccgtacgtatagcacttctcttgataaaagcgcgtactttgaaggtagaggagtacgatctatggtgaagtggtttatggcaaaaatgcattgttagattgttaatgttaccggtacgtattttatggcaattggtgaaatgatcgatcaaaccaactctcatcggtgcacatatgccttcaattcaaatttcggtttgtgatggaatacatctttggcttgaacattttatcaaacatgcagtattttgcgtaggaatgtgcagtggagcgaaaccaatatctcgagtgcctatatacactgtgaaaattagtctaacacattaaaatatctgattagctagttgtttgttttcctttgtctttaagacagtagtttagagttgttctggagctatttttgtttgtttttttgtttttttgagggaacaccggggggaaggccccacctgaattggattgcccctttaaatcataagattgagaaaacgtaggaatagaaaaaacgtaggattttgatagaaatgtaagtgtaaaacagaggattgcaaaacgcatgataaacacaggaatgaccatctgattgaaccacgggaaaaacacaggaattgagaga

SEQ ID NO: 50180 - DNA, 5737 bp, Oryza sativa
tcctgcagcccagcagcagcgacagcagcagcagcagcaagcaagcaaaatgcaacgtatatccgtgatctcattcatccatcgatcgaaccacctgtcaccggaaaaaaaattcatggcgattgatcgattgatctatcggatccatagctgagatcgagctctagctagctagcccgtgcacgcgatgcagatgcaggggctgtctctgtccgatcgaatcgagtgagaccaaccatccaagcgtgcatgcatcggtggccggcaactaggcctcctagcttagccctgccttgtcgatcgatcgatcgatggccaacgtcataataaccttggccggtgagtgaggtgagagttcgtgcgtctctgcatactgcgtcatcacctatgcttcactcctccgtcctctgacccctctcgcggtttggagtagcttttgtccaccgtaatttaccttcttaatatactgacctgcaatctttttgtgtgttcgccgggatcgtgcaattctcaccggaaaagcaggagctaacaaccaaagccggcgtgtgtgttgtttttttttttaactagtaggtgtggtgagagctgagattgggtggtggtggcagagcatggaattccgggagtcccggtgcgatgccggcaggtgcacggaaaaggaggggatgcgtttgcgtggggcagcgtcgccatgaggccgagccgagccgagcagcctggctggctggctggctgctgctgctgcgtgcagagcagagcaggacaccgtactatataccggcccgtgccacaccatcctcccggttggttatctcctcccgctatttatatccccccgcctcagtgggccgttgcccctctcactccatccatctctctctctctctatctcttcctccttgcaaccacctctgcatcttctacttcctctctctctttctagatagttttcttgctgttcttgggtggtggtggtggtggtgatgatgtgatgaggtgagaattgtgatgtggggggaaagatgtgcgggcatgctttccacaggctttcttgaactgtgaactcgtgggggtgtatgtgctcatgttgggattgtggtcggtggcctccaattctctgaaaagaaagctgaattgtcgagctccccgtctgtctttggtcgtctctacctgttgatggttcaagaaagcccatgaaccatgccgcgtctttgtgtgcttcccgttccgccatccggagaattccggccacacagatccctgggggggttgaattctgtggttttggttctgaatttggatggtttttggctctctggggcgtaattctctgagaattctctgtgtgggtgttcttggaccatccagtacttgttgctcacttgaattccgccgttgcggcggagaattttgttgaattcttggtgtttgttgacttctgtggcttgagaaagcccatggcattatgctgcatatttactttggttaaattcagcaacaggatggttcttctcttctgaatttcgcccttcttaaatgtgtgtggtcaggcgcaattcggcaaaggtttccttgcttggaagtctgccttctctggatcttggttttcctcgttttgtttcttctgctcgatcctacaattactcttgctgctgatgtactgaattccctactctaggagaatttgggttcaacagtttgtctaacattgacttgttctttaacacactgtttatgaaaattcaattcagcacaggttcttatgaaacaattgcctgacgaaacactagagagctagcatctggattcagcgaaaaagatcttcagatcatacacgcccatggaagtttgatgaagcaaatgctgcggggaattgctgaacggtgcgacagccggtggagagaattcagatcagaagtacgctcagaaggtttggctgaagcaaattccagattttatttcactgaagcaatcttcagaatttgataattcagaacgaaaaacgtactggcgttttcagagtccatctagaattcatcatgtatcccaaaaactacttttgcatccgtatccctaatttcaaaatgaaaccactacaaccaacgcgtttaaatttcaaaattcaccactcacaattctcattggatctctctgttatttgccagaatccgagccccgacagctcgtacttggccacacgaccggaagctactgacacttgggtttccaattctaaaaccggcacgaaattagcataccatgcaagctctctcctaattactgcagcatttacgacaaaagccttttccaaagtagcccccaacccagcctcacatccctgacaaagaaacaaacagaaaggcgagctaccttagcctttgctgcttgtcctcattagtacttcaccactgtaattagagctaggtcagttcactgcacaacatttatctttccccgtaagttggcagaaaaaaaagttatttagaacactacaaaattcatgtaaaattttaaacttatcgtattccatactgccatttctgagtaaaaacaattaagagagacagcaatgaagttaagtgaaggaggcagaggcagagccgccagggcggtggtgggggttctgtcctgagcaggtgtcaatcacgcatgtgcagaaagagatctgaaggaggcgtaaagaaaagagagagagagagagctaaagcaaaactccgtctctacggtccttgagtagatactatgaggtactaaaaatttagtgtaaaaattagtatctcatggtaccttatagtatttagataccaagaggtatcaaatttataatagaaaaatggtatctcatggtaccaaatgctaccatccaaaagctaacataacccccacataaaagtcatgtgattctcccagcaaaaaagaaaaaaaaaccataaaatctcactcgatggatccatgatccgtctcgcgattaattactgcatcctcctgctgctgctggtgtgcctgtgcctgcctcacctcacctgcagtgcaacaacccaatccgggcctgcactggcagcaatcagggggaggatggaatttttcgcgcttctcgaggggcaaagcgaactgaattttgcagctgcctgtgatgcccattccatccaaattccccctgatccacgcgatgttactgttactgtatcccctctaatttcttaattagtacacggaattgcatgcagtgtgtccatcagaattacatgttaatctatgcaattctgcagctgttactacaggctgatctccacttgtaacccttctcctactacctgatctctgaatgcagattactgcagtatattttcaagtgaattcatgcaatgttatgtcggagtgattagctagctaggaggtagtagcatggtggatagtagagttatatgggaaactattctaatccctcgaagggatgttccctcgtttacctaaaaaccatctaaacggttatgaaaaattctggaaaaatttaacaacattcatacaacacatatatacaactccacaaaatcttaattccaaactcaactcacacgtcgagatataaaaaagacaaattcaacatatgaatagtagcgtactgtttatatctaaatttgtcttttttgtttctcgatgtgtagatcgaatttgaacttgaattttggtggattagtaggtatcattatactctacattgtcaattttttttcagatttttttataactatttgtatcgaatttgaaaaaaaaagatatatgaggggatattatccccctcgaatcccctcgagggattagaatccattcccagttatatggatcacatgactctcaatgatggagaggccggcctgggctggctggctggccctgcctgacccacgctgggctgtgcagatccagacccttcctgccctccgaggggaccaaccagatctcccacagatattcgcctcgctgtattctcctacctacacacatcaacctgacctagctagctcgctactgctacctccgtcccaaaatacgacacagttatatttagataaaatcaattattttttcagtttcatatcataagtcgtttgattttttttcttagttattttttaaaaagtttgactaagtttgtagcaaaataaagtaacattttcaatacaaaacaaacattgtattaaaatatattcaacattaagtttaatggaactaattttgtgtcgtaaataatttttttataaacttggtcaacctaaaaattttcgaccgaaaaaagtcaaaagactcataatatgaaacagtgggagtacttcatcattctcgccctcacctagcaaaaagtaaaggcgaggagagggagaaactacgtactggttcatgcgtgcaacccaaaaggtaaaatgatcatgttatcctactataagtcgtagtgctagaaaggtacgcacttgaaaagttgagagcccaggtagatcagatttggttgctgctgtgttggttgtggtaatattgacagtccaaataatgtagtacttgcattgctgctcggttcctagtagctatttatatgtgtcacatgcatgcatgcgggctactagcaaaggcatctgattctaaaaggaagcaagacacaaggaggctacgacattaatgtatgtgctactgctagctatatatgaagttgtcatggttgagtgagtggtcatgagctagctagatagatggctagctcgtcgatcagctgcatggtagctaggaggaggggagcttggcgatgaacgcgtcgaccttgatgttggtggtccgggagaggaatttcatgcagatgggaggcttgacaccggcgagggcgagcaccgactgcggcagcgtccagatgccgtcgccgcagatgaggcccgacgcgacggggggagcgaacgccttggccctggcgccgtcgaggcggtcccagacgaagcggatgaggctgccgatgcacatgtcgatgccgaagtaggggccgaggtagaaggggatcgccatggccatcggcagcgggaggaacctcgccaccttgggcgccgcgaggtccctggcgaggttgacggcgatggcggcgacgaagaagccgatgcagaggtcgaggcagtgcttgggcagcgagccgaggccctgcaccccgaggatggccatgttccggtacaccagcgcgttcggcgacgggtactccgaccccggcatcccgatgtcgtggaacgccttgtagaagagccagaacaccgacggcgcgatcacgcaccccatggcggtgccgatcacctggctcacgaacatggaccgcggcgacgccagcgtcatgtacccggtcttgaagtcctgcgtcaggtccgacgccgtcgacacgatcccgatcatcacgccgcacgccgccagccccgcgatgatgccgccgtccgacgcgtccgcccacgcccccaccgtgaagatggccagcttgccgtacgtcgtcgccagcgaccagtccgtcagcccgcacccgtacgcgttgcagaacgccagcaccggcgccaccacgtacgacaccgcgacgtggtaccacctcagctggtggaagatgcggggcaccgtcgcgatcgacaccaccgcgatcaccacgtacgcgctcagcgccagccagttcgggatctggtccttgaggaacagctccgtccgccgcttgtcgtcgaacgtc

SEQ ID NO: 50181 - DNA, 7549 bp, Oryza sativa
aagctcgttctacccggtagccgacgatgccgcggaggctgctgggtttgaggtcagcaggataccagtcacccttcttgtgctcgatgagaggccacatgattccccacgacatgacgcctccgaggagcacggagatgttgacgaggtaagggcagatcatcccgacgccgacgtacgtcgcagagaaatcgaagaagaacctgcagcaagaaaccaactgaagaattcagttaactgttgttgactgtccagtgtggcgagcatctgtatgtttcaagctagcatgacatttgtctatttcttttattcaaaatacttgtattattattgtttattttattattacttgttttatcatcaaagaaatgtaactttaacttatatttttaaataatgtattatacgaaatattaacgacgtcgtgtataaaaaaacaaagacaatacttgtttctgtaggcctcgagacccagcgtcgggaacgacatgaacccgcaaccgtcgccgccggtgtagaaccactggaagaagccccaggagaagctcatcacgaagaatttgcccagcattttgacctgcatcctgcaggaaaatgattcagaattcagacaagagtcttatttgttctctgtattcaccacatgtacatatctttagcaaactttcttatctgaaaaaaaaaccgtacttggcaagctttgcaccctggggagtgtggaagctgttgatgagatgtgcggttgcagtgccactcgggtatatgagcttgtaatcgatgatcattatctgacagagaaaaattaacatcatggttcaattaatttaactatgtccttcaaagaaatcatatatctctgaattttaggagaaactgtaacagctgagctgatgaaatgtactaagtaccttcctgagtggcacaactgagaagaggcccaggaagctgacaatgaagaggaatccaatcatccagcccaagctggggttcttgatgttgtgctcgtccctggcctcgcctgactggtcgctgatcctgtcgctcatcgcgaatatgtagctgccaaaaccccctgtaccaccagtgcatagatcagcatctgaaaccatcaccaccctgacaccaagcagagaacgtagtgcacagtgctctctgtggatgtactactgataacagggagagcagtgataaaagtctaggacgtgaagaacggaacatgtatgcttatagtaacaaggtgcttaaagaaagataagtttttttttgttagtaaggatgcaaattaccaagtgctaggggaaacaacacgaggaatgagtctccaatcaaatcatttctttgtaggtgctttcccatgggccatggctagttggctacattatcctctgtatttaaatgcagcaatcatttttttttgctaagcaccgtatttgtcctacgtggcaattagaagtacacctatgttgtgtactcccttcgtcccaccaaaaaacaacctaatattagataagacatttcgtaatataatgaatctggacattagtctttttttagacggaggaagtatgctcaataggccagtttccaatggtgtgctaaaaacatcattttggttggaaattcaaacacctgaactttaagaaaggcaagcacagaacaagaaaaagaatccagaaaaaacctaagatcaaaattcatgctacacaccgaaatggaattgtggcctgtgggccttgatatacatccaaaaaggaggccatcgaggcctaatttacggcccaaacaagtgatccgtcgccattcgattcgacgcaaaatttgcatcgcgcaatcactgaatcgtgcagcgagcgagcgatccgatccgcggcgagtgcgaagaatggcagcggggaaaccgtaccgctgaaggcgatgccggagcaggcgacgacgcaggtctggacgacggtgttctcctggcgggtgaaggggcggacgctggcgacgccggccttgtcgaggagcttggtccacgacgtgaggaggaagaagccgaggagccccgcggagacgttgagcgaggggatgatccccgtcgtcaggttcagcttcatcacgatcacgctgaacatggcgcccagcagcgcgctcaccgccagcgcccgcagcgtcacctgctccttccaccccggcaccaccctcccctcgaacacccgctccaccgacaccaccgccgcctcctcctcctgatctctacgctccctcccgctcctcgccatggcccgcgaattgagctctcgctctcgctctctctctcgatcgatcgcggttgcgaggtgtggaggcgaaggcgaaggcgcgcgtgtttccggggagttaagagttgtcgtctgggccccacatgtcagtagtactggttgtccgctacgaggggatgacatgtggggtcactgatgagtttcacttgggttcagtttgctagtgccacgtggcagggataggggcttttccgtcgggatccgcttctatcggcgagtgtcacccccgtctcttgatcgtcttcccgtcaacgtagcactagctcgcggttaaatttggcaaatcaaccgcttgatgatagatacgagcccggaatttgacgaccaaatgcccaaaatttcacgaaacatcgtcacacggacacgtacgtagtgcaaaatcacatggcaaccaaaaaattaccctggcaaaaatgggtgaaaatttttagcgtgtcacatcagatatactgacacatatttaaagtattaaacgtagtctaataacaaaataaattacataatccacatgtaaactgcgagatgaatttattaagcctaattaatatatcattagcaaatatttactgtaacaccacattgttaaatcatggaacaatttggtttaaaagattcgtctcgcaatttatacacaaactgtgtaattagtttttttcgtctaatatttaatacttcgtacatgccttaaaaaaaatttatcggtggatctaaacacccccccccccccttcccccaatcaaacaggccatggctggtggtgctgatatatcgacagaaacatgccatgccatgacaatgcggaatgcatcagcctctgcctgcaccagacatttctgctctgtgactctgtccgagtgaagaagacgacgacgacgctaaaaagcaagtgccacatctgctggctagatgccgctacattttactgttgcgtttggtgttggtgcccgtggtgggccccatctccttggcgatattccggagcacgtacttctggatcttcccggtggacgtcttcggtaactcgtcgcggaagatcaccgtctttgggaccatgtaccgcggcatgcgctcccggctccacgcgaccacgtccgccgccgtcaccgcgccgccgccctgcttgaggctgacgaacgcgcacggcgtctccccccagaactcgtccggccgcgccaccaccgccgcctcgttcaccgccgggtggccgtacagcacggactccacctccacgctgctgatgttctccccgccgctgatgatcacgtccttggaccggtcccggatctccacgtacccgtccgggtgcatcaccccgacgtcgccggtgtagaaccacccgttgtcccggatcgccgccttcgtcgccgcctcgtcgttgaggtagcccagcgtgatgcagccgccgcggagcacgatctcgcccatggtcgacccgtcgcggggcacgctgcggccggtctcgccgtccacgacgtccacctcggccatccccggcgtgcgcacgccctgcctcgccttgagccgcgcgcgctcggaggccgggagcttgtcccactcgcccttccacgcgcacgagagcaccagacccgcggtctccgtcagcccgtacccgtggctgacctcgaagccgatcgcctccgtgcggtacagcacggcggccggcggcggcgcgccggccgtgaggatccgcaccttccccgggagcggcttccgcacgccctcgggcgcgttcgccagcatgttgagcacgacgggcgcgccgcacaggtggttgacgccgcggcgcgcgattgtgtcgaacacctcggcggcgtcgacgcggcggaggcagacgttggtgccgcccaccacggccatcccccatgggaagctccagccattggcgtggaacatggggagcgtccacaggtacgtcggccgcggcggcaccgcccagtcgaccagcgagtcgacggtgatgaggaagatcccccggtggcagtgcaccacccccttgggcgccgacgtggtgccggaggtgtagttgaggatcatcgggtcccactcgctcgccggccgcacccacgcgaactccgggtcccccttctcgacgagcctctcgtacgtcagcgcggcggcgggggcgggagggaactccttctcatggggatcctcgacgaggacgacgcgcggggccgtgtgccccgccgggaggaggcggagcgcgtcgcggaggacggggagcagcgccgggtcgacgaagatgagcttggagccggagtggcggagcaggacggacaccgtgcgcgcgtcgagccgcgtgttgatgctgttcagcacggcgccgctcatcggcacggcgaagtgcatctcgtacatcgccggcacgttcggcaggagcacggacacctgactcaatccagcttagcttagcaacacgaggaaggtgttcgacgaaatgaccgtggaaggaaaaaggatcgatggatgctcacgacgtcgccgcgggagatgccgagggaggagacgagcgcggaggcgaggcggaggcagcggcggtgggtctgcgaccacgtgaagacggtgtcgtggtagacgacggacgggcagtcgccgaacacggtggcggcgcgctccaggaagcccagcggcgtgagcgcgcacgagttggccgggttggcgccgagcttgtccatggccgccgcgtcgatcgccggagcacgagctgtcgcctgtgtgaacgccggtgactccagctatcgcggggtggttggagtggaggcgaggaaagagcgagtgaggaggctgcggtgatataaaaccagtttgctattgaccagatgacttattctccgaatctcagtcaccttgattcctgcccgttggatcgagatcaacggctaaggatagggcaacagcgagtgaaatttacgctggtcaactatgtcaaataaggaggaatggatttagtagtaatatatggagtacagtatatagtactaatttccaattgcatttataaagaaatcagtggtcttccatttaaataaaaagaaatttatccatataaattggcagcagcttcgtttgatggggacggccacgatcagttgcaggcgcaatctggatacacggaatgtatccttccttagtcccagaagtagatagaaaaaacaaacgtatcgattataacacattaataatgtgaatctaaacttactactacctccgtctcaaaataagtgcagccgtagaaatccgtatccaacgtttaaccgtccgttttatttgaaaaatttatgattttttttaaaaaatttagccacacttaaaagtactatttatgttttatcatctaataacaataaaaatagtaattataaaaaaattttaaataaaatgaacggttaaacgttggagatgaatagtataaaactgcacttattttaatatggagggagtactgtgttaaactcgatactaaattagtgttttataaggcgaaggagatacctcatcatatgctagttcatgccgcagtaaaaagaaagattgaagataattcattttcttcgatccagcatcccagccaaacctcggagaacccagagatgagacaagagaacgaatcaaaatacttttcatcatatatgaacagatggcagtagttggcagtagcatgtttttttttactactcccccttcaaccccatagatttgcatcaaatgtgcatcacatgatctaggacctctgtctttctggcactgtagattaacaaacgatacagaagatggtacctccaaactactgatgtgcagtattaaacttttttaaaactggtaaaaacaagactcccgtttccatatacccggaacgtacaaaagcttgaaacttttcatttaatttgttcttgacttatggatatatgatacagatcagcagcatgacaaattaataccttaccatgatctggcgatgtgtatgtacggtccaaaagatgagtcacgaacccacgatatctatacgagccttattggttgacctaattaatcaaagcaaaagctaaaaattaaaattttaaacttgattttgaaattaaatttaagatatttttaacatagttttgttttttattattagcttttaaatcgctaaaaaaatatataaaaattttatataaaaattaattttattatttaataaatcagtgttttattaggaaatatgagcaaccgacgagactctacctatctcccatgctactccactatgacaactcgtatgcatgtgtcgctttcagagttccgtgcaggagatgaacataccagtgtattatcttcagagaaaagaatacaccggagtatgtagcactgttcttcaccaatccttggctccttgcagctatctaatctgctagttgctactgcatgtgtctaatttggtcagtcaattgcaatgtgcaaacaggctagtcaagaatgtctatctcgtgcccggcgaagaaaagattgtctagctcgtcgatcgttttcattggtagttctagtctagcaattggtttttttcctgataaaaaaatagtgccttttctatgtaggagtatatgtctgactcatcttattttatttcagattattggctggacagtcatcttcatcagttatactagtaaaacattcgtccatactccatagaaatttcagaccatcgtaggtgtaaaatttcttctggtctatttgaacacatgcaccagccgcctttcaattcttacaattctgcgtactcgcgaacgtgaaattcagacgacatcaatggaatttccctcttggccttccgttttttctctctctagaaactgtaaagctaccgtggagcgaaaagatggctggtgtgggcataatctagtcataatccacccaaagcaacgctgatatatttgactgaccactgcaaattgcagattggctagaccaactgcagctggtcattcctgctctgtctccggggctttggaatcatcaccatgatgtagttttcagaggagaatctccttcagttacaacagcatgttataagccaactataaatatattttaagaaaataaataaaaagagagaaggccagcgggccatatatttatagtcagctgtagcacggattccaaaacacagtgtgtatatgacaggtgggaccaagtattaataatacaatatataactattgtatgaatgagctattagattagttataaatgaattggagctagta

SEQ ID NO: 50182 - DNA, 1384 bp, Oryza sativa
tcctgcagcctcatctccttaaatatcttctagaagcgaaagaaattgcaaagaaaaacactgtcgttggcagctgaattccatcttgaaccagttaaacacaaaactgaaaaaaaaaacattatatcgaaaagacaaccagtgtggaataatctgtcatattccacccaaagcaatgcagagagtcattggcaaactgcagattttctttttgatgaaaagacaaggtacagatttgtttgactaattacaacaatttattctctattcttgtagaagataaagagctttgcaagaaaataagaattagaaaaggaagtcgttggcagttgaatttcatctcaaactagcaccctgtttagatgggactaaaacttaaaacttaatctctatcacatcgaatgtttggacactaattatatatattaaacgtagactattaataaaacccatccataattctgaactaatttgcgagacgaatctattgagcctaattaatccataattaggatgctacagtaaacattctctaattatagattaattatgcttaaaaaatttatctcgtaaattagctttcatttatgtaattagttttggaagtagtatatatttaatactctaaattagtatctaaatataagtactaaagttaagtcactggatccaaacaccacctaagcacaatagcaaaaacatcatgtcacagttttctgcttaatttgaacatataaaacacacaggcgtgcacagcggaaagaatggagaaatcacgaaagctaaaagaaaagctgagagatctcctatgccattccaagtacagaagaaacagtgcatgtccacatctcaaagcagtcgtggtcagaggtgacatcacagactcgttgcttcgagattgcacaccacctgtttgctgaaaagcagcagccaaccacacaccaaaactaaaatggaaaaaaggaaaggcagaaatcagtcgtcgtcgtcgtgccattctcaggccgtcttgtactcgacgacggcgatcttggcggcggggccgccctggatgtagacgatggtgagctgcgcgccggcgtcgagccgtgtcatccacgacgggaactcgtacatgtccttggcgttcgtgcgggagacgccgtagatctccccggagagctccttgatctgcagcttcaggtaggtgatggcgtggccgcacgtgttcttcgccgtcaccacgtgccggtagtagtccacgccgtttgccttccacgtgttcgtcaccgtgtgcacgaactccaacggcgacccacctgacaaagaaacgcacgatcacttggaggagatctcaatggtacaagttcgattgcattgttgatttggttaattaattaccatt

SEQ ID NO: 50183 - DNA, 6377 bp, Oryza sativa
ctgcagcccttcagaacaatcacattgcaaaatctattaccaattcttcgaggaagtggatttttgtccctcgggaggacatcccctcgttttatacatctcactcaaaattttatcaatttttttttaaaaaaaaattgtcaagatagattaatatatgacatctttcgtaaacatgcgagttaaaattcaacttatacaattcaaaacaaaaataacaaatttaaccttaaattacacgttctattcattgtcaaatttattatttttgtttttatttgtattaattgaatttgaatttgtatatttattaagagtgatctatcctactaattttttttatgatcatgcaaaaatgaggagatgttttcttaaggatgatttgagttttccatccttggaagaagaagaagctagcaaggatgggatggattaccaggggtcatcttgacgttgtggccgttgttcttctggaggcaggcgcagaggaagaactcggccttggcctgatactgcttcagcgtgtcggcgtagccggcggcgctgccgccctgctcgaagaggaccttggagaggaggacctggaggccggcgtacttgttgtcccaggagaactcggtgacggcccagccggtgccgccgaacgcctccgcgttctgggacacgtagcggaggtactgctcgtcgccggtcgcctcgtacagccacgccgccgcccacagcagctcgtcctggtagccggacgccgacgggtagaacttcttggcgctctgcagcgagtcgtcgtacttgcccctgaacgtgtccgcgaacgtgaacagctgcccccccaaaaaaaagagaaaataactcatcagaatgttgctgctgcatttgctgattgctctcatacgctggctgcgttcgacagcccctcctcccgtcccgcaaaacaaagcttatattattataaaattaattaactattaattatttttttaaaaaaaatggattaatatgattttttaaaataactttaatatatatttttttaagattaaattgcactttggtccctcttttatttcccaagtttcaatttggaccacccttaaagctatctttttaatttagactgggtaaatttaccactgttacggtttgtactatcataaacaacttttctcatcatgtataacttccctttcggcaaacatatgaaccatatatagaggagttcggccgcatactagagttgatgtgtttaagctcgttggttgtactgaaaaaaaatcgttcgtggtaatccaaattacaacaatagtaaatttattcggtccaaagtaaaaatatatgtttaaaggtggtctaaagtgaaacttaggtaataagatgtggcccaaaacgtaattcactttttttttataaatcataccgtttaatagtttgaaaagcatgcgtgcgaaaaacgaggaaggtgggttggaaaaatggacgaagatcacagccacatgtgtctctgtacctgcttggagtggaggaggaggaggtcggagtacatgcggtcgtagggcttgaaggccttggcggcggcggcgagagcggcggcggtctcgccggcgacctccgacccggggttgttgatgtcgatcttgaacgccgtgcgcggcgtcgacatgtcctcggcgcgctcccagcacaggtggtcgctgtcgccgtcacccacctaatcaaagaatccagaaaatttttcttgagggcactagtgggccgtgttgggctcttggtgagatgggccttgagtgcgtgcgtacctggacccagagggcgttgtgctgggtgtgggccttgacgaagtagttggtgccccagcggatggcgtcgaggacgcggtggagcttgttgccgtcgaccatctccttctcgaactcgaccaccccccacgacagcatcgtcaccgcgtacgccatcgggagcccgaacttcacgtggtcgccggagtcgtagtacccgcccaccaaatccacctgcaaattcatccatccttcgattcaattcgcgccgcattactcaacccgatcgagcatttacccggccttgccttttacatccaactggatatacacggccattgcaatagagaactttgtcccgtggacaacacaatctaaaatttacttctataaagatttaaactcaggactttaaagtactactctaacgactgtaaccactatcgagcatttggttgattgaaccggaggcggcggagatgtatgtattaccccctgggagaagccgtcggtgagggcggagtcgccgcgccaccggacgaggcggtcgtcggggagcttgccggagcgctgcgcctcgaagaacaggaggcacttgtcgaacgcgccggcgtagtcgaacgccgacgcctccaccgacgcggccgccgcgaggaggagaaccagcgacgccgccgccggtatcagcaggaaggtggttgccggcgtcttgttcatcgtcgccgccattgctcgacctcggtagtggaatactggattgagggagaggcccgcacggcggaggagttttataaggtcgccatgatcgacgacgtggaggacggtggcgcgcggccgtggcatcgtgggcgcacgcgatgtgcctcgcacgtagcgaggaggagagatacgacgacgacgacgacgaggtgagcttttggcggggtttgagccatgcacgtcgtggagccgaaactgcagaaatggttgcaactcaagcgtgtaatagtttaattggtaatataataatagttgaagattagttttttttttaaggtaatggagttgaagattggatgcttgtagttttaagggaagattagaaaaaaaatgaaaggctgggtgcctgggtctgatgatcattgtctttttttttttttgagaatttgatgatcattgtgtcaactaccaattgtgtcggcttggatcgacatgaagtccactccagttacactgcgtgatcttgtgttgcaaatgattttccaatcaattttatcacgtttgtgccattgatctggatatttgtggaaggtcaacccagatattatgcatatatattcaaggtgagctgagccaaacatctctgtaccttcctgctgttcaagagctttcacagcaccatctgcactcgatctccagtgcatcagaaccgaagtaccttccttgctctcctgtgaatcctgctgtatgagtttcggtttcctttatctcctgagacaggcagaactccgtgcatgttcttaggaaaatgtgtcattttcaaaaaagaaaaagaaaaatgttgtgtcctatagccaactgttggcttgaaatcatctataatcaacttaatagccaactcatacaatagttacctataaatatatactacataattaatatttggtctcatctatcatacacacatacaccttgaagtctgtgctgcaactggttataaatctgtagccccgctgtcattctctctctttttttattttttcgaaatgtgtttatagctggcttatagcctgctattgcacctgctctaagcagaccaaatgcacaactgcacactggttttattcagtgtaactgcacatcgactccgccatggcacggcatcgatctaccatgccggccaggccgatttactgaattcatcagcagccaagaataaaattatcgatcacttcttttggttgttgccaccaggagtgatcagccgacgactagatgtgccagctttcagctctcgagcgaagtggcaatggtgtcggagctacgcggctctggatttccggcgaaggagacggcgcggctgacgtagagccgcaccaccctggccgcgagattcgaatccaacggtgtatgtacgactacgagccatcaggatagcgatctacggacagtttccactcggccgcggtgatcctgagttcctgaccgcttgattcggatccgacggtttccgtacaggcccgtacggtcgctaacgatgcgcagcgtcgcagcgatccatgtcgagcaaggactctaaagaaaatactaacaacaaactgagggctcttttgcaaaagtcaccctgtgcttacgcgatcgcagccatgaggttttgatccaacggtgtcagttaatgccactcctcctctctcttcttcttcttcccccggcgatctctccgtcccagccgccgcggcgtcgctccggcaggcgcatccgccggaatgggacggcctcgtcgttatctccggtaaactcgcctctcagagcctccgatcccctcacctcctccgcagcggggccgtcccaacacgctcatcggccggaatggtgaggcctcatcgtcgtcgtctccgataaactcgccacccaacaccgccctcgcctccgctctcaccgtcatcaactgcggcccggcgccccagatccagcatgcgcgtcctcagaacgacgaagcgttgtcgtttcctccagtcaatccaactcgcctgctcacctctgtcgcagtgtaatccttgtaacgtatgcatctttcactggtcatggactacaccccctcccaccaaaaaaaaaaaaaaaacttcaaactatatatttagatatagactatgttcaaatacagaattagaagttactctctccatcacataatataaggcgtccacatattttaagattccaccttcaaaacattttgaccatcatttagtacaatataaattgaattttacttgctaaaaattatatcattggattaatatttgaatttattttcatatggttataattttgttactacaaccttattatatatatgagaaattataaaacaaagattagttttggagactaatataggatagagggagtagtttcatgaagaaaagaatggaggaagtagttgttagtcagatggcgtcaatttgagccttgtatttaatggtcctgcatatgattgagaaaacatacttcaaggtggtggttttctttttgataaagtttaagaagatggtgggtgatgtgttctttgataaagaagtttaagaagatgttcttcttaacgaaaacaaagtctacttgggagcaaaaaaaagatgataatgctattgagtattggcaactctttcaaactagacaaagatggtgattctattgacgatgcttccaaactacaatgattccattgcaacttgaacaaccggaaatttaattagttgttgagtgattttactctttagcaggtacagtgaggtatcctttttttattaagaaacttggtatacctcttctcttaatacctcggctattaagagataccaaaatctacattaaaaaattgatctctctaggtatccacaatacctcggctattaagagaaaccaaaataaaaaaaaaatgatctctctaggtatccacaaagacagtaaaatttctcttgttctacatatgggatatattcaactgtcctacattccgacattcctcctggtggcaaaaaaaattgcctcgcgaaaataacattgagaacattcaaacgagcccatcctagctacagaactcttctactatctggcatataaaaaccgcctggaggatcgatctgcatggacaaaaattcccatttcaagcaagcaacagcatacactacaggccttgaacccatctgcaggtacccagaagcaacgctctaagtcttaaaggatttacttaaaggggcaagcatctgaagtcgaaaacccacgggccgagtcgctctttcaaaaaaccaaaaaaaaaaacccttcgggtgttctgctaccagtctactactagaaagagctaaagctcatcaacttccagccttggtatgatggtaccgcgctagagcatagtctgaaactctgaatgttgggactatggaggtgcttctggttctaggacccatacagtacaggtaatggagagaacatgatgtatttcgatgccgtggagatcatgcaaccattcagttagaccgagataggaagaattcatagtctggatgacggttgatagacttctccccgttggccttgggtatcaccatgcttgacataactgatgcaccatgtcttaaagtcttcagcctctgtttcaggacttcagcacgatcagttttggggccaacgtctaatgacattggcttgatctctgggtttctcagttgaaaccattgctctccctgtaaacaaaaaatataaataaggatgagttcagcattaaaatatctatgaaaatactaccagcaagaaaactaaaaggtttttctagtacacaaaggtttccgccatctggtataataacagaaaactttatattcctttactaatacaagggctgcagga

SEQ ID NO: 50184 - DNA, 727 bp, Oryza sativa
ctgcagcccggaactgaagctgcagatgatgtggttagttttatttttgtgcaaattctagttttgctagctgtatgtgttgtcgtaatttttgtcgtacttcgatttacaggctactggccttgaatatgggaaggtatcttcaaccgagctggtacaggcagtccacgatatgctttcactgcaggggtaaggatggatgctacaaaggaaacgcttctacagactactctttccttgcagaccagcttaaagaatctcaagtggctctactcgtggagcaggtttgtccacttcgatatcttcttgggttgttttatattcatttttattgtcaacatcaagaatatgttttgatcagttctgtataccataagagagtagttgtgacccgtaatctgtagcggcacctaaagaaaattgatgtggggaggcatttgttgttgaacgtcatactattggatgctgctgcacacgctgtgttcaccatgctttctttgagatggagatgagggtgggttaagaatttttctaggatcttcaggcattcctttttatgttcattatttgcacagagaatgtatactatcaggttataaacaagctaccaattttagggagccccaaacttcataatttgcattgcctatcatattatattgtatcgtatcatataattactttcttagctctttctgcttatgttgtatgttgtgggtattgaaat

SEQ ID NO: 50185 - DNA, 931 bp, Oryza sativa
tcctgcagccctggtagacgaacgacaggcatgcctaacatcacaagagcctcactgagatcatcacttcttgaaaagccctcgtcatgaagcaaactctcagctggtgttatccaagtcccacctttgatctccgagtgaaatactggagaggtgtaaataaatttacagatttgttccacgagatactccagggctcctcgtacaaaccagttggccataaggaataatatgatattttggagtccaaaactgtacgcaactgtagcagcagttctctgaacaaaggagcaacaacatcttctaacaataacatattccagtcagagcgaagcttaccacccctgtccatatcagctccataccaaatgtcacgtcggttggatgatacttcaaagtaaccattcacatgcacagataatcctgtctttactggcaaaggaagaaaacagaatgcgcggccttgtctgagaataacttcctgcaaattcagtgattactaattaccatagagtaaccacagcaaatgctaaggtgtaaaaaacacactgaaatgatgcaccacgttctgaagaacgtctgatatagcatgaagtccattagataacataaatcaaacacacattttttaagtcaaaggtattataatcaattaagttatgcagtgtacaaagtttgttcaaccagaaaaaaaaatcacatcaataaccatggtcatattgttaatgattattttaaaaatattcagcatcagataacaataggcaacgccctactgttgctaaaaaattggtgataatagccataataaagagaactgcaaaacgaactagatattacctcaggtcccacgttggagatgcaagcagcaacagaagcccaaggtagtaggtgaagatcataatccttggcagcagttgttgcaaaaata

SEQ ID NO: 50186 - DNA, 5930 bp, Oryza sativa
actttacttattccgtcaataagtggaacgatagagtactaacactattatgaaagctttgattgtaacaaacctggttacgccattttttatgtccaagacatttactattccaaaaaccgtaactatggtcaaaatcaatttatattcactgcacggatttacagacgagatgtcaggcggagtatattccattccagggtccgtttattccattccacaagtcacaagttacagcttcgtgataattgttgttttcctgggcgcgagtagatgcagcctccgctggttgttggcgcgcggacgcggcgtgaccgcgtgagtcgcggcgttttcaagcccaatgatcgctgatgcgagcaatctgaccgtcttctgagttcagatatagaatcgccacaagtggagtagacgatggctcagacatgggcgccacgcacaactagcacacgtagcacaccacaccacacagcccataggtagatgtgatgtggctgcttctgccgtttgctttgctctgcaatcctgcatgctctcccaggccggatcgcgtgccatctgcaaagccaccaactttgcctttgcctgctgctagtactagttgtactactgtgatctgaacatggagctttgcactttttcttaagaagatatcaaatcatacagctagtgacaattaacaaatcagattgtgatttgtgcaatcgatccatatcgaggtcattaggaggccagagacgctgcaatttggtgcttgtagttggagaggaaatcaggaaactgaactggcacctaacagcggcactgatacagcagcagcagcatggatactgcaggcgatgaggcgtggctgcatgttttgcgaggaccgaacgaacgatatggattgcctcgtttcaatatccatcaaaaaaaaaaaaacaagatagcaaccattccatacctgtcgctccagacaaacagtggctaccaccaaacctgtcaaaactaaaatgataatgagaagtccgcaataacttcgtcaattttaacctgtgacaacacatcaagtatttgtaaaaatagagtgtgcgtgtttgtttataggatgagtatgcttgtgctgtgagcgcttacgtttacatcgtgttttttttaaaaaaaataatcgctctgttcttttcaaatttgcagcccgtgtcttttgtacgtcaggatcacatcagtaagtgaaactgggtagtagctgatgacaaaactctctgaaccaaagttgttgggaggatttcatcaaagaatggggccaccgttttctcctcatgttgcatcacctctcttaccttgacaaaggaaacaacgtcaccgtcttaagtgtgggtaggtagaacaagataaactgcattatgcgcctaaaagaaagatacttcctccgtatctagctagattcattaacattaatatgaatgtgagaaatgctagaatgacttacattgtgaaacggagagaagcatgtttcattattgacttggttcaggtaatccgatctaaattatatgtcgtgttgatgatcaccctctctcaatttgaggcaggaatcataacccctgatctgtttacagtgctctcgatgttgccagcggtgtagttgccagcaacctgtgcatctaacaaaatggacgaacggaaatggttaagtatagaagcaagggcgatgtgaattctaaatcaaccgcgttagcgaaaagccggaaaaaacggatttgtacatcatatgtgaggttgcttaattgaatgctaccttgtttggacgattagggaggtggagttttttttttgttttaaaaaggtattcaataatttggtaatcgatttgagcagttgtagacattatcaattcgctaacaggcttagtaaaacttagatcttttttagccagctgtataagagattaatatattttctatcggttataaatattctctatttataaaagaaagtcatgacagtaactaaattctttcgtgtattcttagcactaaacgaatcgactgttccactaataaaaaaacgaaaactttgctgggctacttgtaccacatctatatattcatcatccgtacttctaatccgtacctcaccttattccaaactgaatagaccacccgagcaaccttcatcgagtaaaattattttgtaccaccgatgatataatcatgctaattagttttaaaatgcggttaggataggaatggcgcgtgatgaaggaggacaagcaggctacggagatcggtctaaagagatgcaatggtagcggaggcccagaacgagcaaggtcagcaatatcatgacaagaagaacgggtcctgaaagaagggggtgatgaaaaaaaaaagacaatgatcacgatgaagtatatgccacggtaccgccgttatcaatagtcggagatagaaacgactcatcggagccaaggaaaaggggaaggcgaaggggagtataagagagagtgtaggacacaggaagatagagtgtagtgtattactaccatcttatataaaaaaggcaaaggtacattgagacaaatgcaacccaacagaatcgccataaaaagacatctgtcgatgaagaggagccacaccattatcaccaccaaacctcaaaggctcaacaagcttgagtgcaggacaccaactcgtcgtctcatggttcatgcttgacacccaacagtgtcacatttggaagcaaaatgacgctttcagcctctgccaatcctcggactggcacctaaccaccaaaacccaacgacggagagaagaaaagagagatcaaaggcgaagggcaaatcagaaaaaaacgtgcctcgtatgagctcatatatataatttttttctccgaagaaatcccatcattttctccgggggctatttaacgggctcatctggtcctccacattctccccctcctcctcctcctcttccacctccaccctaccactctccaccacccacccgcccgtccgcctccctccgctccgctgctgcagccagccaacccagccttgctgcctcgcgggcgaacaaaaacccccagaattctccgcgtcgatctcgccccgccgcgtcccggctcgacgcgggccggcgccgtgagggtggggatcgcatgtgaagcgcattggagcggataactcgtctctatttgggggaattttttttagttttttgtttggggtttccaatcctttttcttcggcggagccgcgagcgtaggtgcgtctatctgctccgtctccggtggttgttttgattttatccgatttcgaggggggttcttgtgggcggtgtgattaggcggggtgatctcggctcgatcgatcggaacatcatctgcaggggaagcggttggcctccccccctacgccctttgaggatttttttacccttggtgtgatgagatagatgtgtgctgttttggggattttggtaggtcgatcggatcatcggatgcgctatgccagcatattcttgtcgtgtttcctgatctgagcactaagcctcaggcagtgatgagagttcggtggagctcgttagtttagtcgatcgtgctgctcaccctagagcttttcccccttttgtttaatggagaaaaactcataagcatactgtttctgttgttagcttagctgtctattgggatttcttttggagagtttagatgcagcaacaagtagagtgctaggataggctattatttatcatttgtttatctgtggctgtgatcaatatggagcatcttcaccactacctgactgtaaataagtaattgatagtgttgactaattggaaacgtcactatcaattgatagtattgtcgatttctatgtatgttctccccttcaatctgaattaaacttaggctggcccgggtgaaaaagataatgctgaccaatctgtagaccctttgaccactgtgttttcatcaatacatatacaaatacttagatctcggcactactataaatgtatggcgcgaaatgaatcttacaatgtgttttttctttcacaaaacaaagcggctgaaattattgtcggtcaaatttgaacgagagaatcttcgcgccaccgccgtgtaggcacattgtgtaactgaaatttgtttcttctgatatattcacgtgcaaagcttttgcgtttccgctaataaatttgaatgagagaatcaacggtatcagttattcgaaaacggacggaatatatttttttgtcgtcttctatgctcttttcagaaatatatatttcttaaatagcttcataccatttttagattagcttatttctaatcaaaagtacttcgactttgaccttgttatatgtttagtattgttgtaaagatataattaaagaaagtaaagccaaacattgtccaaattgcaagtaaaaatacagtgagtagtgtgttcatgacatggttgtttggcccgaactgcaaaaaattgtctttgaaacattctttttcatctacttgattagtttcccctcaatgtagcacgatatgctgcggcaacctgcaagcacctctggagatgttgatagaattgcaaacaggaagcatcgtcacatagtgcctaggcgttcaacagaaaagaagaaccctcataacatccagtttgtaagtactaacttggaaagagagatatggtgtagcgtgcattttttttggagaatttatttatcctttttttttctgttttgttattttgcaggaacgtcaagtagctgcgcttgaatacaggcaggaagaacagaggaagaggtacgctgatgtgctctaaaatcaatgtgctttgataaatcattgttttgtattatctccagtatactgaacattttctagtggttttaataattgatcagtattgatttcatgtcactattattagctgttattattactctttgttcagcatgttagttgaagaactgcattaactttcttgcctggtttgttattttcagagccaatggtggtcgtttattcttcacattgtctttatcatcccatctcgtggaaaatggagatgaacttgagacatccgcatcaccatcattgttactttttcacttcaatgatccagaggatttggcaagatgtttaacttcatcaagggcgttgctagaggactcccaacaatcagacaaagcccctgataatgatttctcagtcaacaccttcagcaacgcgagtgtggacgtgaagcgaacttcacgaaagaaaagcaaaaagaaaaacaagaggcacaaaagagtgcatggcaaaaaagtatctgaggcatctgacacacagtctatgcagagcaagggtgcttctcattgcatcgatgttgctggtggtgaatccttgacactttcatccaaccatgtggctcatgctggatctgaaatgcggtgtagaaaggagactttcccttctatggctgatggaggtgaaactttgacactgcctccaaaccatgtggctgacaaattgtttggggatttgtcttctgattcttcagtgagagaagtttctgcggagagacctgatagtgaaactggtaacgatggttctttcataactctgatatcaagtacatcttgtagtgatgagatagaattgtctaggcatgcttcttattttgaatgctgtgagcaatctaacagcaataactccagatgtttggacagtgcctccacttccactcttactgattcctctttggatggccattacacagatagcagttggaacttcagtgatgataccgagaacttgttgattgacaaaaatgagtgccctccgtgtgttcagtcaaaagtgacagatctcaggggttctaaatgtggtggcagtgaaggttggctaaacaaagcaaatcatgataaattctcctgtttcagaaacagtgctgatgc

SEQ ID NO: 50187 - DNA, 1026 bp, Oryza sativa
tgcagccctatctatctatctatctatctatctatctatctatctatctatctatctatctaccctttcctgtccgtaccaaaataaactaatatataatatcttccgttataaaataaactaatatagtatgggatattcacgaattattaagtatgtgcgactactgttgataaattatacttcatccgtcttaaaataaacaaatctaattatatctcgtattatgttgatttaattttagagcggagggactagagttcgtctaacgatagtcgtacatacttcatacttcatgaaacagtcaaaataaagatgacaacagggaattcaccttcgggggtaacattttcatatcctgataaattcatcccaagttaaaaatcactttctaaaatgagtaatataaattattaaaagtctaaaagaaatctcaaacactaaaatacgtgcaagaaaaattcaaaagtggcttggagtatttttattaaatcctccatgctttaaatgggtccctaaattttttacttgaattttcaaagcaccagaaataattttaaaacaacaaaaaccaaatttagagttaattaaaatgaaaaatttaaaaataaatctctccttgtccttgtgccgctttcgatcctaaggccatttttccttggaataagttcacttcatgaccctcaaaagtgatcgaaatctaaaccataaccctaaactacaaaaccagatatctcgacccccaaactcctaaaaccggtacaatttgactcccggagcggttttgggaggcggttttgctggcgtggcgccacgtggcgcctacgtggcaatattgaccgagtctttgttacacgtggcgttgacgtggcacctacgtggcggtagaaataaaaatatgcgtgggacccattagtcattcacacaaaaagaaatgtgggcctactgacatgtggggcccacatgtcagactttcttcctcctccctctctcccttctgtctatttctctcccgttcttcccctt

SEQ ID NO: 50188 - DNA, 1964 bp, Oryza sativa
agaaagagagagaagggagtgagggaggaggaagaaggactgacatgtgggccccacatgctagtgggcccacatttttttttgtgtgaatgactaatgggtcctacgcatattttttatttctactgccacgtaggtgccacgtcaacgccacgtgtaacaaagactcggtcaatattgccacgtaggcgccacgtggcgccacatcagcaaaaccgctcagggagtcaaattgcaccggttttagaagtttaggggtcgagatatctggttttgtagtttagggtcatggtttagatttcgatcacatttgagggtcatggagtgaacttattccttatactgggcgccgtatcgagggaagtatcgaccatgtattgatgccgtatcgctcatttttttttatttttttggctaacaaatcagcgatacttctccgataccgtatcgctcgcgtatcccacgtatcgccgtatcggatacgtatcccatacgggaacggcggcaaactgccgtatcggtgcatcacaggtgaacactcaaaggcaaccctttgggtcacatgaatttcagaaacaatattattgccttgatccatgtactaactccacgttttaatgcatgcaatatttctttttccccattagatgtggatgctgaactgccggcatcaaccgtatcgcgaagaggatggtaagctaaggattgttggtcctccacaccagcacgctcatctcaaacgcgttcgcatcagtggtttctttggccacaaagaccaggtggagctagcacttcacatccttcgcagctccatgaccctcgagcagatggtgatcaccccaaagctagagattggcaacgatctggcgttttcagacccttgtgctgatgagtacgagaagaagcattacgtggatggccatcgagtcgccactgaatttgtttgcaagacagaccatcgcaatgttgtcactgtggaacgggtggtgccagagcctgccgacggcgaggtggagcgaaaacggagaagggcaaattagacttttgtctagaatgttaaatttgttagatgtgctcatttttagtttttactggtagtatcaaacaaatgcaactggtaaaaagatgaagattagttctacctccgttctaaatataaaatactataaggagttctcgttatgtgttatgtcactacagaaattgtgatttgtagtgagtgtgtggccctttttatggcactgttcttcttttttggaataatgactcaataggttgataattatttgaaggcaccaacaaatgagttagtaaatactataaagttaaaaataaatttaaagtgatattataaaaataataaaatatctttcttcgtcctgcattagttgccgttttatgttatttaaaaaactaaggtttagtaaaaatgactacaatgtcttctattaaatgatataagattgagaatgagaggataattagacttggaatgtgtatggtgtcttgattaatgtgatttaaattatacttggtcttgatatataaacatatatgatgatcaatttgataaggagggagtacttgaaggtgataagctttttaagataagttttgaattaaaacgatgactattttagaacgaagggagtataaaggtcccattcatttctccaataagagtttgatgcagataaagatttttgtgacacgcttttaaaattgctaaacggtgtgtttcgtgcgaaatctttctatatgaaagttactctaaaatatcatattaatctactccctccgttttagcatttcccgtattcatattgatgttaatgaatctaaacatatataatatctagattcattaacatgaatataaatatgaaaaatgctagaatgcattacattgtgaaacggaggaagtatttttcaagtttacaataattaaaactcaatcaatcatg

SEQ ID NO: 50189 - DNA, 2114 bp, Oryza sativa
gtgtcttttttttttcaggatctgttttttggagagatttgatgttgttcttgaaaaaattagatacagtaaaaatctactgatagcagcgagccgcgagcgacgtgtctcccgccctctccagccaatggcctgcggcgattcaagtggggcccagtttccagcgtcacagaggcgcctacgtgggggctcccacgtcagcacttgcatggcccacatgtcagtgtaaccatcgcgtcgtcatccccgtgcgcttgactctgctctcgtcttcctcctcctcgatctcccagatccaaaccgaacccaaccaagcggccgcggcgctctaaaacctctcccgctccacgcgcggggcgcatgaaaccctagcgagaggcgccagatctcccgcatccggatcgccgccatggccgccgccaccgcgctggactcgctgccggcgccgctccggtcgctgcggctgaagacgaagcagcaggagctcctgctccgggtctcggcgctggcgctcatctacgtgctcgcgttcgtcgtccgcctcttctccgtgctccgctacgagtccatgatccacgagttcgatccctacttcaactaccgcaccacgctcttcctctccgaccatggattcagcgagttctggaactggttcgatttcgagagctggtacccgctcggccgcgtcgtcggcggcaccctcttcccgggcctcatggtcaccgccgcgctgctccaccgcctcctccgcgcgctctccctcgccgtccacatccgcgaggtctgcgtcctcaccgcccccttattcgccgccaacaccacgctcgtcgcttacgccttcggccgcgagatctgggactccggcgcgggcctcgtcgccgccgcgctcatcgccgtctgccccggctacatctcccgctccgtcgcgggctcctacgacaacgagggcgtcgccatcttcgcgctgctgctcaccttctacctcttcgtgcgcgccgtcaacacgggatctctcgcatggtcgctcgcctcggcgttcggctacttctacatggtctccgcgtggggaggctatgtcttcatcatcaatctgttgccgctgtacgtgctcgtgctgctcgtcacggggaggtactcgcagaggctctacgtggcctacaattccacgtatgtgcttggaatgctacttgcgatgcagatccggttcgttgggttccgacacgtccagtctggggagcacatggccgctatgggagtattcttccttttgcaggtatttcttacacatattgttatgaaatgatgtaacaattcatccgtagcgatgaaagtgccttctaagattagtagctagttacagctctggtttattagatggctagtttagtaaattagcaacagttgacataaaaaggtatgattcagatgaaaagtcccgccactttaggaaatttgcaccacccgtcttaattgtcctggaaatgagttaggattatttgtaactgagaaagggcgaaacacttaattgaaggcaacccgatcttggtttgtaggcaaactatggagtaaattggacaggtaattttgtagaacagttaagatcaaatgacctgttagtacttattgttagtttcatataacccagatgattagatggaacattggcatttgtgtcagattgctgctactctcattttgcctcttcagatagatcatgtttactgggtagacatgttatggaactgtgaattcttgtatgtttgcagtgtgattggtggcccatttatgcctggctgtaaaatgtgagatgctatactctttactcttgaatatgtcccacagccaacataactcaatgtcgttattgtgtttgttgtgtgtatatatcaaacatagcgtacctttgttatttgttaatatgaatgctttgacaaatatctattctattatgaggtactttgtgtactttgtatagatagagcagtatagcacatgtataagagagctatcataaaccatttcctctttttgcaggttttcttttcttggactgggtgaagtacctgctgaatgatgccaaactattcaagtcattcctgagaatcaccctgaca

SEQ ID NO: 50190 - DNA, 1825 bp, Oryza sativa
ccattgcagcatcagctacaataaaaatctgactacctgattcggacaaaaagcaaaagtccacaaactgtctctggaaaatcatctggctcaaaggcagctgcaaaggtattcccttttttttttttgtctatgcttgcttgcatgctttatattttgtatatggatagttgaaataaataaatttgatggagcttgaaatctgaaacatacttagataaaatcaagtggtacaattgaaatcctttgtttccgccaatcaataccctccagagtattgtgccatttgaaatgctggattgcaattttccagtttaccatgtgcatggctgataagaatataaaggatttgcgccttttctctgacaattctaattccagtaggttcaattgcacataattttgtggttttcagtttgcttgtatcaattattttaagtttctggttttcacatcactcagaagctgacttggtttcttgtgtaacagggtgcagttgatcaatccttgcctttccagcagaatgtggccattgctttacttctgggtgctttctacttgcttagtagatatgctgtacactgcacttgggtgacatctgaagcttactcttctccttccattgttctggccgcaaggggtcataatggaggcagggtcatatttgatgattatcgtgaagcgtattattggcttcgtcagaacactccttctgatgcaaagattatgtcatggtgggattatggataccaaatcacagctatggggaacagaactgttattgttgataacaacacatggaataatacacatatagctacagttgggcgtgcaatgtcatcctatgaagatgaagcgtatgagataatgcagtcactggatgtgaattatgtgcttgtcgtatttggtggtgttactggttattcttcagatgacattaacaagtaagtttatccactgaatctagagcaaattttaataaatcgatgttattggttttattcgaattagtattgaacattttttcaaaaactgaactacaaaatggattcttacttagctgcttatttccaggttcttatggatggtgcgcattggtggtggagtttttcctgtaatcaaagagcctgattacctggttaatggggagtatcgtgtcgacaagggggcagcaccaaaaatgttgaattgcttaatgtaagtatgaaacacactaatgagacttatttgtcaacacatgtactattttgttatttatccgtgttacttctatccttccatcacctctaattgtttcctctcttgtttgacaggtacaagctttgttattaccgttttggagaactgaccacagaatatggaaaacctccagggtatggcacatccttgccattgttattgcttttacttcattgatttatttaaatagatattacattgtactctgtattatattttggttatgaatggtttccctaataagccaggcaccataatttgctggttgtagcttgcattgtcctatttgtataacaagcctgtttttgatatggtaatggatgctagctctgctatttattttgtatgtagatacgatcgagtacgaggagtggagattggcaacaaagacattaagcttgagtacttggaggaggcattcacaacttcgaactggatagtgcgcatatacaaggtcaaacccccgaagaataggtcttgaggagaggaatcatctcttggttagtatctggtgctattaccttgaggtacattgtgtcaagtcaaaacgtattggagttcctacacgagacgggcaattgatttg

SEQ ID NO: 50191 - DNA, 1043 bp, Oryza sativa
cttttggtaccccttttgctgtaaaacctgactttgtggcccctggggcttaggtcccttccttttgtttttgctgtatgcttgatgtaaaatgggtctcccccccataatgggtctcccccataacgttgctgtattcggctttcaatgtaagccgggcctaaggccttttgatgattaaaaaaaaaaaaacccagctccatcgtgtgctcttcagccttatcagccgcaggcatcgtttatattttaaaagcttaaatcttaaatttagaaatgatttcaatgtcggtttcattgcagtttattctttgtcgttggcttttaagtagctaaaaatacatatataaacagttttattccccagattttttttctctgaacgactttataacctgctgtaagcaaaacgattggactgttctatctatcaaatccaaacagctactaaattaaatatatccgatcatcttaaaaataaattctcttcatccccaagctggtttatactctattttcttagcaagccaattaacactgctattatttctgttattatattatcccgatcggtaagatctgaacttttgtcgataataatatcaagcgtgcacttaatcgaacaaaataagtccagaccaatgtggcgaactgggccaagaagaggcacgaaaccgcaattctgggccgtgcaacccatcttccacgcgcggcccgattctctgattctctcctcgcttaagccctcctcctcctgcttctgcttgctccccacgccgacccagtctcgccgccgccctcgccgccgccaccgccctccccaccctcgcgcgctccgccgccgccgccgcccctccccgccgtcccctgccgggcctccccgcgctgcccccatgtcgtcttccgcagcggcgctcgcctggcgccgctccctccgcgacgccctcctgcgcggctccgcgtggcgcggcgcgcccgccgccaactccgccgccgcgcggttggccagcacggcctccgcatccgaagcggcggctggtccgaag

SEQ ID NO: 50192 - DNA, 1447 bp, Oryza sativa
agcataccatttgttcacattgattggttcacactagttttgcgcacgagtgagagtgggtggggagtgggtgatgggtggggggctttgaggaactgttcagcaacgaaaaagaaaatgcctcttttcggctcttcggtcctgtccatctgttgaatggtttgtgctcagcacatagagtatgggaagtaatgacactcaactacacttacaagggttcctttttttacccctgtttgtatctgccaaggtcggccattatgttaagaatgatatactttgaactgcaggtcataaatgtctcttccccaaatactcctggtcttcgcaaattacaaggtagaaaacagttgaaagatctcgtgaagaaggtcagtcatttccttgaagtgcatcctttgtttgtcttcatacaaactttgtttgacctatgctgcatgtacaggtgcaagctgcaagagacgagatgcaatgggctgaagatggtcctccaccattgcttgttaagatcgcaccggacttgtctaagcaagatcttgaggatattgctgcggtaacatagttaacttagccttgttttctgtgctcttccattattgagttgaaaattttcttatgctttctcattatgttctctaggttgctcttgctcttaggttggatggcctggtaagctatggaattcttccttattgattttactgacgttaactagcacactcctatttaacttccatgcccaatcattttacgcttctcttctggttttgtactgatgtttgtttattcttttattatgttgctaactgcacagattatatcaaacactactatttcaagaccttctcctgcagacacacatccattggctcaggaagctggtggactaagtggcaaacctttatttgacctatccactaatgttctcagggagatgtatatccttacccgggtatatttgttgcccctattgctttcttggatatatagtagcatacctctttgaattaacatgatttttctgtcattgtattttactccaatgtccatgaatgactcctgcatttctgttacagggaaagattcccctcataggctgtggtggtgtaagtaggtaatgtcagtctctgcatttgcttttttaaattaaaataccaacacccaatattcaatcaaagtttatttatgttattacagtggcgaggatgcatacaagaagatccgttctggagctacacttgttcagctttacactgcatttgcctatggtggcccagctcttatacccagaataaaggtcataagtgaaacatatttgttatatcccaagctcgcatcacatgctcactatctttgtcataatggactatatatacactgctagcctcttcttttcccttctattttttttttagagaaagaccatacggcccatcctatattgaag

SEQ ID NO: 50193 - DNA, 706 bp, Oryza sativa
acttttttttttgcgggtactatagtatacagttgtttatgagttgtatgcaagtttaggtacctacatcttatttaatttgctcttgatcgtcaactgtgtactcctacattctagaagtaaggcatgcatgattattttcctcactcagctaaataaagtgtacccctccgtatttgtaaaggaagtcgtttaggacaatgtttaagtcaaacattgggaatataaatcatgaataactctcaagttgttgagtttgaaaatgtaaaaattatatgaatagatttgtcttgaaaaatactttcataaaagtatacatatatcacttttcaataaatatttttatagaaacaagaagtcaaagttatgttttggagaccgtgtcgctgttctaaacgacttcctttacgagtacagatggagtactcgacagttaaacttgcttgaaaagctgttacagcttcaccttgtctatgccatgtctgcttgcttaaacttgactatggttctgttcactttgatgctatttttaaccttaccaaattttagtaaagttgttaaaaattagctatatttagggcatgttcactttgatgccaaaaaaaaaccttaccattttggcaatgccaaaattttggcaactataccaaaattttgataactcgccacaattttgacaggatttcttatataattatcaaaattt

SEQ ID NO: 50194 - DNA, 1523 bp, Oryza sativa
tcctgcagccctctttttcagagaaaaatgagttgcagaccctggcttttataccagttgcaaacgggactcgcttagtcacagtgaaatcactttttgctcgtctgacaatcaacatgtcgccttttgcttttgaacttccaagtctttatcttccatttgtcaccatcctcagagaaattgggatcaggaaacccttacaaacacttatgcaagggaacttcttttggatatacaaaaagcatgtggttaccaacgcctgaatccaaatgaactccgcgctgtgatggaaattttagacttcatgtgttctggtgtcaaccaagccacagatggatcagaagacatatttgattcagtaataccggacgatggttgcaggctggtatcagctgtatcgtgtgtatatattgacccatatggttctcatttactgagtaacatagatacatccaggataagatttgctcacccagatcttccccagaatatttgcaacacgttgggcataaagaagctttctgatgtcattgtagaggtactactattataggatctttctttttttatggctgtaagtttaattaattttgtatttttcaaataaacataagttttttcccttgtcaggaactggatggaaaagaagaactaaagatggtgaatagcatttgctctgttactctggacaaaataaaagagaagctgcttagtaaatcgttgcaagatgcgttaaggattgttatgattggtgtatccaatcattttccttcatttgaagcactcaatctggcgcagatagaaagtgtactaaaggatatatcacagaacctgcagtttgttcagcgtctccatactcgctttctattactccccatgctccaagacgttacaagaagcagccagcgtcctccatttcctgaatggtcaagcaatggaaagcacagaagtgtttgctttgtgaacaaatccacgggtcaaattctagttgcagagcccccaaactttttgacaatacacgatgctattgctattgttgttagttacagattaggggcacccgtgatcttgccgattgcttcagtatttgcatgcccagatggcacagagaaagaggtgcttaaaatactccgtctgggcactgacattggagtttcaaaacgtgaaggaaggtacaatggttccctgggagcagagttgttgtcccaagatgctcgccaggttcaattccttcctttaagaccattctatagtggagaaattgtggatggaagacggggaaagagggtgaaaagctcagatatggcagggtccctgaagatgtaaggccatcagctgccaagctctttacaggtttccagtagagacttctgctggtgaaacttgcatgctactttccagtcaggtttactcatttaaaagcgtttcaatggctgatctctctcccgcaccattgcaactggatagtggtagagctgcaggtggacagcagggcttctcacccatcaacacagggctgcagg

SEQ ID NO: 50195 - DNA, 1793 bp, Oryza sativa
ccatagttcagctagttctctagtttttttaaaatacaacgttaacaactcggtatttttttccaaacataactgctcgatcagcgtatgttgcattttttttttagcaaaattactgcagttagggaagctgatgttgccaagtcagcatggtcatgccgtatatgccttaatgcaaggtatcgtgactataataacatgtggtaacgttctttgtaatcgatgctcaagttcggtttcaagatgctcatttagccaccttgattttttttaagggtctgtgtatacaactttcgctgctacttgtatgtagtcacggtagttgcttaactggaaaactataggcccgtaaatcatgggtgtaaatatacattatggtccatgtacagctacgatgcattttactgtgtagattctttaaaaaattgaagtgtttggtttcagtttgaggcgaaatatatatagttataagccgctcagtggaggggcaaaattcaaaacagcaaatttcgaagtacaatcattctcttagcaaattgttgcatggttggtccaggctatagatggccaaacgagctacccgatccggcacggtctaggcacaacccggcttgggtcgaggtcagttgggctgacacaacccgatctacacgccgagctaggctgtgccatgtctacccacgggctacacctacggcccaagcagggctgtgccggtccggtccgaaggcacaacagttcatcgtgtttctccatagaataattctgtttttcttccctcatctctttgggttttgtcttatatggctgaaatttgtattccttgtctttgggctgcgacttgtctggctgaattaagtctattttcgatccttgtagtatttttattgactgtgccatgccgggccaacccaacatgccaaggcatcagcccaggcacagtccaactgttggaccggggccaagccaaatggacgtgccgtgggccgtgccgtcgggtccggccatatggccatcgatagtccaggcgttgccgcaaccggggcaaacagcaaggggaaaatatctgtgccaagcagcaagagcaaaaagcgaaaagcgcaacgccgccgcgaaatatctcacctcacgtagctctcgccccggaagacgccacccagcgatcacttctgctgtactactggccagtgaccagtcacttacttgctcttctcccccattaattgagctccagccgtccgggagacgagataattccgttcaatttcaagttaatcccgcggcagccatggctgcgcttctcatgaacaccggcgctgtctcgatgcccttccccaccacgcgcaccgccgcgcgacggcgaaccagcagaagcagatgccaggcttcatctagcggcggtagcagcaacgaaggaggcggcgagagctaccgcgggaggagcgggcgcggtgggtcgacgacgtgggtgacggagtacgacctgtacgggctgctgggcgtggagcggtcgtcgccgcagtcggagatcaaggccgcgtaccggtcgctgcagaagcggtgccaccccgacgtcgccggcgccaagggccacgacatggccatcgtcctcaacgaggtctactccctcctctccgaccccgccgcccgcctcgcctacgaccaggtacgttgcttcatcgatcgatctctcgcatatacgtacgcacaccaactgttcgtacaattattgatgaggcaatcgatctgcacggaacgcatgcaggagcaagcgaagcagtcggagttcgtcg

SEQ ID NO: 50196 - DNA, 705 bp, Oryza sativa
gccggagtcggcggcggcggcatccaggagcacgtcggtggcgccgccgctctgggtctcgtgaacagcttcgagctcaagatcgtcctagcctccgtgacatggttcatcatcggcgcggcgattgccggattcattcagtttctcgcgaggagcgaagtgaacttcaggaaatgaagcgaatacatgatttattcacgatgacataaagatacataggatagatgaagtatacatagtagtatagatgcatgtatataaaggttactgcaattaaggaatttattagtggtgaaaaaatgagatataaagtagagcaaaatgaaatgtacgagacgtatagcattcagcttatgtggtttggacgagaaatcagttctcttgtagggtgcaagaactgctgttttttatgaggcagcgagtactgagtactaactaatgagatgatgcaagtttataggcatcatttattaacataaaaacgactactgcgattgccacaagatgatgagagctcacagaggaaaacagagcaaccacagttaagttattcattgttgtcttcaacaccagaaaattgcaagtgtcccgtgtaacccgatctaaagttactacgcaaataagctgttgtgcttacaaaaacatctggagtactgtcataccatgctcagcaatcaaaaagtactcggtcgtcgcaattgctag

SEQ ID NO: 50197 - DNA, 10675 bp, Oryza sativa
  unsure (1)..(10675): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattcctttttttctgttattggagtataagtagcagtagctaagtttccatttgtaagttttacaattcagtttgaatgaaagaaaccagaaaattgccccacaaattctctctctctcgcgaagttctgaaactcagtaaaactttgctttctctgttctgaattccttttctgcgttcttcagttttctcgtctgttgccgtgcccgacgtatgcagtgtgcgcacacggtgttcgatcgggtgactcgtagctaacaaatcttgtaccagttcgtgctatttcttcgtttagtgatgcagccatgtttatttgatttgtgtactaatatttgcaacaagagaaaattaacttgatggcgctacttaacttggtggcaagtacgtacgtattgaacaatgaatagctaaaattagattctgtatttttgttattaattacttatttcattttatgttgcaagaaaaaaatgtaatgttagtacttactccctccatctcaaaataactcaacctagcaggagatgtgacccctctagataaaggtagtccagattcattatactaggagagatcaaatcctctcgtaggttgagttttttttgacggagggagtaattagtatgaacctataagtagtctggccaaatgattgagaattcgttgtcaagacaggaaaataaagaaagctgtcgtgatttccatgcatatcgccgtcctcatgttcttcacccaaaaaggcttagaaatttggaataacaaagcatgtttttcttttaatacgctccatgcgtgacagaactttagaatacgtgtatattttcaataaggtcattgcgtaattctagtaggagtgtgttgcagaatatttacaaatactgtcttatgcttgtcgtttactctgacatgtattttatccgacgacctgttgtatgtgtgtaggcggtctgtttcactttcttgcataagacaatcatgttcttaagtttcaacacactagaactcaaagatccacagttttgatgtgttagtcttaaattaatatttgtgttgttactgtggtcgttaccgagtattagctagtgctctaccttctctctaagtagaacatagtctaatttaaagaacttttttttttgatttttttgtttttctttttttttacccaaaatactactaggcaccgtccagtagttttaatttaaagaacttttacggggtagtaacactataaaaacgatttcgtgtacagagactttatattgcagacggaccataactagtcgcgtctgggaagataggctcattttcgcttgcggtccatttatgaggaccacacggttcgatttttccgtgtggtcctcttaaatggaccacacgcgaaaatgaacatattttcgcgtgcggacctattaagagagccacacataaaaatacccattccctctttccctctttcccactttaaatcttctcctatttctttcctctcctctctatctctttttctcctcactccccttcccccgcacggtgtctctcatctcctcactcctccctcctctcctctcctcccgacagcggcggcgggcataggcgatggttgcgcacgacgacagtggcaacgcggcggcggtgggtgtaggcgatggcgcgcggcggcctcctccacgcggcggcggccgaggcgcgggatccagcgggcggcggccaacccccgcacggatccggcgggcagccgccctccccccacgcgggatctagctcccctcccctccccttccttccctcctagatccggcggaggggaggggcgttggcggcggtgcggccggaggggagcgcggatcgggcggtggccggcatggaggccggcgggagcacggatcgggtggtgggtgtcgcggaggcagccgctgatgacgacgagggtgggagcagcatcctcggctgacgatgacaacgagggcgggagcgacgtcgtcggccgacgaggaggaggcagcggctgggagcggcgttggcgctgccgattctaggactttcaacttttttgaattttttcagatttttgtttttccgtgtgggcgatataagcacccgcacgcgaaaatccgactttcgtgtgcaggtgccaaaaatcgtgatttttcatacccctgggtgcgtgcgggccacccactcgcacgcgaaaactgattttgaccgcacgcaaaaatctttctcgtagtagtgtaatcggtattaggattaattaatttgtctcctgatgtaaatgtacaggtaaaattatctttccatgctagtatttggtgatggcaattctgtatattttctcctctcaatcccattccttattcttgttatccttcaccacggcaaggcgctgctagccatcatgagttcacgtacgccgccaccaaccattacaatggaaggactaagcgcacgaaagtactaaagtaccatttttaaaattttgtgataaatttctaaattgacattatactaccagcatatatattgtaccgtaaaagaagtcggaggtttgtacgtactgcagtaaagtatttgcctttagtgcaaaaatgcaatgtataacaataattggtgttagttgtaactgggaagagacaaattattaaaaaaaacataagtacatagcaggaagaactagtaggaccgaataccgatcaactggatctattccggtacgaaaatattgcaagagagatataaggaaacaatagcataattatattgaatcatctttcaatataatataaattggcttgggaggcatagggcatagggcgtgtttggttagttggaagattgctcgcatgtgcggatacctaaggaggttgtttggttgcctgcacaaccattggggcctagaacctcatgtgagaaatggcctctatagctaggccctaaaaaaggctcaagttgagcttctctccctatctaggctgggctcgtgcaggtggcgtgacatgcggtgcaaaccgtagatgcaagaggatgaggggtagttttaaaggtatgaatatattcaatattaaactcatttttatatatttaaaatggactatggtaattcaaatggttcttaaaactaacatatggtttaaagcataggtttgataaaagaacataagaatcatgattggtattggcctctataacatgtggggcctcttgatgcttttaaaatattcttgcatgtagttatgttgtgatgttagtattcttaacacggtcttgacaatcaagcgtattgctcacttagtcgtaccgatgaaaatacatcacgcgataagatgataaagtgcacacatttactatattaatatacgaaaacgtttcatgttttaaacttgggaccttgtacatatgttatgtaacataattatttttgacattaggcaaacattatattacccggcttttagaagaaagccaaaaaagaaacacacagagccttgttacaggaaaaagaaaaacaaaaatatcgaaacatgaattcaccaataataaaaggggaaccacacgagatctaaaagtggatggatgcggagacaaggatttagacaggttcagcccctctcaatgagaggtaataccctactcctgtttagggatttgaatccgccgggtgtagtatagatctgacgatcaggttgtgtcaggccccctagagggcctcctgcccaccttatatacgatgggggcaggattacaagatagaaaccttaaccaatatggcatcggtttcctaaatctaatttacaatattatcaaaccaggactttaggctgtttcataatatacaaggaaacataatacccaagtcatgatccgttacatatttgataggtataagctatcccctataaccagtcggataaccatgccgtgtgggtatggggtacccataatctctacagtagcccctaagaccttcacagtcgaaagataatcttctctcaaaccagattactccaaagccgagtgcttcaatcatctttgccatggtctcctgagtacttttaccaaatctgaagactgtggagggctgaaaaataattaaatgtaaacttaggtgcatcgactagatgcacctaataggtgtagcccccgactatgtggttagttgaacaaactaagcatatagtcaaggagtaaataatccaaccaactgagtggttttgataattatagtcaaccgagtgacttgatatcaatatacagcatatgcggtgtgagtctccgaataacatgatccgagtgatataccaactgctttgtaaaatacgatgcgagcaacctaaagttgtgtacatcatgaaaaattcacatagcaaaacagctatagaagaagcttatatgcggtgaataaagaaatttctaaagtattgggcatacaccatgcgcacactggtttaacaaatgtgcttaagtctctaaaagacacaccgtttcaccacacccggaaatatatggcatacgtggtgtaaaatccaagtaaataaactcataaaggatttaccaaccgcctggaaaatgaccaaatatataatcagcctaagccataatattggtcaataaaaatgcacacttacgtggcaaaaagcaatgatattgtatccaatcaattgctgtataaacccaaacagcgccttgactatatataaaaaagtcagcagggcagctataaaaaacttcactattgggcaccttttaaaatacattgtaccaactcctaaaaagttgagtaactgtggtataaaaggattttaaggtattgggcacttgatcacgcgcactttggcctaagcaaaaagtgcctaagtccctaaaagaacgtgacaggccacacctgaaaatatgggctgtagacatattaggcctaggccaaaaaatatgccttcgacaccctttaaaggatgacgcatgtaatatgctcccgagtaataaatcttccgagtgatatagaccaagtatagctcatatgaatagcttctgatctgagtgattatcccttatgggatacttcaaaatagatataaaagttgaatcccgactggtgcaagtattcggttgatagcccttacggggaataacgaatagtccagacgttgagcataagaaatcgactcacgaccataaattcatgttgaatgtattcggaacaagtccaaattgaagatataatcctcgcgcttgtattgatgagcccctaagcatgtagcttatccttctgttgtagtcacaattgtccattgatagtggctgacgtggtcggcatggagacgaaatgaccaacatgaagatgatatcacccatcaaagctgacgaagatgttggtagtggtaaagacaatgacacaattcaaaggtgatgaagtcgcatagccatgaaggcgaagaaaccagtcggcagcaaacaattcaaccagcagtgaagacgaagcacccagcaatggcgacagagttgcgcagccatgacagcaaaataatcagtcgataacagacgaggcacctggtgaagaagacgaagacgcctatcagtagaggcataataagccagccgtgaaagtgaagactccatgggcggcggtggaggcaagccgagataatgacgattagcagcaacagagatgataagctgtgaagatgaagttgccaatcaatagcagaagagtaggctatgttgaagaggcttggcaagatgttgatgaagatgacaatgtcattgatccagtcaatagcagtgtagcagccaatgataataaaaatgatgctcatcagcgtttgtgtagtaggtcagccgtgaaggcgaaataataagtcagggccgatgaagcagaggtgctggtgattatgtcagtgacaataatccatcaaattgttgagaagatattgaaactcgagtagtttccttgatgcgagcgtgtgcataatgaagactgatgcaacaccctttgatttataaagatggcagtagaacttagagttgtagatgttgcagatgcttcacttgaaggaaagtagaaactgttgtccaactcgttgaatctgagttaattggttgataactccaacctcccgaatatgtagattaaatctcaaacttgatacttgagaaatttgaagtaaattgtggcggcatgaagaagccaaaattttggtgaaataattgaagttgctgaagtagaacgtctgctccgaagcaaagacgaagaaaatgactcattggctggttaattgattgtttcatgttgagataacatctgtcaaattttgagagtcttgtatttgtgtagcccctgactctttggttagttggtaaacaactgaacatagagtcgagaactgtagcttcttgtcgtcgagtagtcattgcttgagtgaagatatgtgttgaggatgtccgagtagaaatattgaagattggaacaccacttgttgtagtaaaataataaggcatcatatttggtgacgcatgccaagatgtcgaaactcttgtagtcgtcgtggttggtgaagtagcaaagcttgcgaagtagaggcaatagagtttgtcggtgccgaagacaatgaagatgaagtagctccaccatggtgacaaagttgcatagccatgatcacgtagacacaagtcggcggcacaaaagcaaaccagtacgaagacgcacgtgaagagagaaacaccagtcggcggcggcttaaccagcgatgacgatggcgccagtcaatgatgatgaagacgcacagccgtggagccaaataaaccagtcggcgtcagacaaggcggccggtcagtgaagacggcggcataataggccagccgtgcaggcggagacaccagtcggcggcggcgaaggcaagccggcggtgaagacgtagacgcccaataacgacggcataataagccagccgtgcaggcgaagactctagtcggcggcagcgaaggcaagccggcggtgaagacgtagacacccaacaacggcggcacaagaggccagccgtgtaggcggagacaccagtcggcggcggcaaaggcaagccggtggtgatgttctgactgatcacttttatgcatatctggatctggatcctacagaacaaacatatatgatgagtagtatctgatgtaaatataatactcgagaaaaattcaagtattttaaaatatttataaatatgtatttcttctcttgtcaattttgatttccccgagcagatgactccttacgtttacacactctgcccgactagtcatagcccccgagcactgggagtcggcctaggcacttcccaaacatgcatatgagtgacatgagttcgtcattaatggaacaaagtttcacggatcggagtttactactcaggtacttttgcaattgtttagagcagaaaataaattatcttatctctatgcttttgatttattccgagtaatacttagcaccttgtgttactcggtccatccaacgagcccccaggtgctaggaattggcccaaaggcaactatccatcggcaaaccaaacggaaagcataggaagatagaactccataactcaataggcacttttgtactcagattatgtcgcaagcaatcaagatagatattatgaaaattgttgaaaaaatatgatataacatctgtagcccccgactcactagtcaacggcgaaccagttgacgtagtgaggcagaggaaaaggaaaatatcatataaaggaaattaatgatgacttagctttataatattccccttggtgatggcagaggtggccaatgtgggaacaaagtcatccatcaaaaacaatgaagacaccagtcggcggcaacgaaggcggtcgacggtgaaagcgaaggtgcccatcaacggcggcataataggccagccatgtaggtagagacactagtcagcggtggcaaaggcaggccggtcggtgaagacgtgaacacccatgaacggtggtgtgaccaaccaacagtataggcgaggacaccagtcggcgacgacggaggcgagtcggcagtgaagtcgtaaacgcccaacaacggcggcataattggccagccgtgtaggaggagacaccagtcggcggcgacgaaggcaagccggtcgatggagaagtggacgcccatgaacggtggtgtgaccaaccaaccgtataggcgaggacaccagtcggcggcgacgaaggcaggccggcggtgacgtcgtagatgcccaacaacgacggcataataggccaagcgtgtaggcggaaacaacaattgacaacaatggtgccgtagcattacatgtaaacaacagaaaataccaagagattaatatgacatttagagatcaatctaaaacaacaataagttgaaaggaaagaaaccgatgaattgacggttctagttgtggccgtgacgatatttgccatgcggtcagctcaaaagaagtccatgcaaatatatgcgtgattatatagtaaattgtgcacgttgatcgatggatcaactcatgcatgtattcactccaggaaaatcgcagggaggacgccttggcagcagcaccagttgcagcgtggaggctgccgtggggcgcatcaggcgggtggattgatctgatctgctcgggagatgacgtcatgaagtcgaacaagctgcccacgatggtccttgtttgatacggagtacatgaatacatgccaacaaaatagccaaaaaagcattaattaatttgtaattagaaatcaatccaattagcaatagaaaattaatgatctggatataattaaggtgcatgcgcgcagcatccatgtaattagttgatcaatctggttagcagcaatccaaaatcgatctcccgtagagacgtatgctaggtccaccaatgcatgcttgccgtcagcgaaagggccaatttgcaccgatccgacaagcccggctccggcctccatggacgaagattccggggtgggttgctcccgcaggaaaatcgcagggagacgccggggcagcaacctcttcgtcggcgatgatcggcatggaaatcgcaggcggcgcagcgtggtcgatggctgctgcgtttctttttctcctgataggttgttaccagcgatggccaccacaaatcagttggcttcgacgatattgaagattggttccatcgcacttcttgatagggaactcgacgcactgcgcgccaactgtcgagacatgaattcggcaataataaaagaggtagcgtacgagacctaaaagtggatggatgcggagacaaggatttagacaggttcagaccctctcaatgagaagtaataccctactcctgtttggggatttgaatccgccaggtgtagtatagatttgacgatcaggttgtgtcgggcaggattacaagatagaaaccttaaccaatatggcatcggtttcctaaatctaatttacaatattatcaaaccaggactttaggctgttccataatatacaaggaaacgtaatacccaaaacatgatccgttacatatttgataggtataagctatcccctataaccagtcggataaccataccgtgtgggtgtgaggtacccataatctaaaaaaaaaaacacagaaagctaggatcaccagcaaccatccggggcaccgagacttatggatcctaaagaacgaaacaccacctcataaactcccaggaacgctaaaacatctacctcagcaaccataaggaccttatagagacccttcttagactagtgcatcgacaggcaacacatccttaggtcgcagatcctccaatttgcgcttcatcttgtcaagcaaggaagacagagcctttcgatctttttcttttaacagcaacatccatctctgcatcagcgaaatgatcctgaacattgcctgcaagggggacttgatcaatttgttttcaaacacaaaatcattccttacaagccagagcccccaacagcaacttgcacaaacgaaaagacccacattcctccctagtttttctttaagaaactttaccccatcccaaatggtagaaggagcaagccccccttcaattacttcagttatgagaacccaaacaaacttagctagaggacagttaaaaagtacatgattggttgattcaatgtccaggcaaagcttgcagaatttatcccccccccctttccaattccttttgacaagaagatcagcacaaggaattctatccctcccagccaaaaaaaggaaatgtttaactttcaaaggaactttgcaaccccaaatctccttcatatccctgtctacaacacccccaaatttcatcaatctatacatagacttagcagaaaacgttttgtttttttcatgaggccaaaccacagagtctggagaatc

SEQ ID NO: 50198 - DNA, 10917 bp, Oryza sativa
  unsure (1)..(10917): unsure at all n locations
aaactggtaaatggtgcgttttttacaaaaagtttctataagaaagttgcttaaaaaatcaaattaatccattttttaagaaaaatttagctaatacttaagtaatcacgtgctaatagactactccgttttccgtgtggagaggatgggttcccaacctatcgtatcgaatgcagccttaataacacctcctgttgcaattgcaaccaccggtctcatcaccaagaaggtggcacacagtacatgtattcttaaccgctcccatgttacacatgccttaatcagctgacaaaagattaaaagctgtcatgttagttagccatttagctaaaaatatgcatattcctgaaaaaaaaaagctacaaatatacatagcatatatagctgtaacaaatcccaaccctactgttctaccttctattcttgttggagaaaaagatgatttttttttgaccaatccattggtggtcgacacattgagctctgcctccggcaggcatctatgacggtcaattccattttgaccattgcctggtgtgagtcctttaaccatggaaggcatattggtttgatcgaggttctgtaatgaaataatgaaataaagtgttttttacttggcatttctgagttctgatctcaaataaaagtttacagtagccctgtatccatttgaatgcttggaattgaatttgccacaatccttataaactttaattagcattgcacatccaacgattaaatttgattcttggtcatattgtcatcatccaaaatgtatgaggagtttgtgttattttgcaagttagcatccagttttgctatttttgagatagcaactgctccttctgtccacaaatataatcgttattataccatttgtaatttatccacacatataatagattttagagtactactcatatcactcaaccatccttatttaatttttgatacaaggacacattgttgatggatgttttttatttgaactatagagatagacatagcaaaactcattgaattaaagtagcaattctgaaatgcaacatcaatgcagcaaaaaatcagggcatttcaggaaaaaaataacctagtcaagcattaagtacttgcatttatatgactgtagaaaatctcccatcgtgcttattgccatggacaagaaagctttcatatcactgcaagaagaaagaaaaaatatcgccataagtagctgctcttctctctatgtgttcagatcagatgactagaaatacacccaacacataccgtgcatgtgttacctagctgaaaccatatcaaataatgcaagttgccatctctaggcatgaaaggagtcaggcatgtcgccataggactctattggagcaaaggtcaggtgttatcaattatctggacaacatgccgccatagcaggataggatatgggttgttcgatgctgctttggatgagtacaagttagcacgatctcccagtcagtgtaggattcgcaatttcagactcaattttgaaccaaatgataggtttttgtaggattagccagacagtttgccgagtctctcaatttggattttttttttggttgatgttcagcaaacaacagttccaaatctgaaaacgtgttctacatattgtaagagtggcattcatgcattggtcatggtcatgggaggcaccggggatctctacagtttgcaatcaacgttgcatctgcaagcacagcaatttaatttggctattgaagctacattagtgagtcccttcgatcaaccagcagaaagccagaaaagtacacagcaatttatatttccctgaacatgaagtaaacgtgcaacacacaaccagcaaattctttttcctttggcaacgcacaggcgactactggcagtactctggagtctggacaattacaactctgcgatcttaatttgttaatttcaatgaatgatgcagcaaggtataaaattctgttcaattatatgattagattattattattatcaatctaactgcgtctggggtcatccgtctaaactggatatggcgaacatcctcccaaaacagtttatgataagcatggtaatttcatcggattcaaaattttcttgatttggcactgtgaacaaacagtttatgctctgtttaggagcaaaataatctttaggagcaaaataatgtcttgtttatgagagagaattgctacatgatgtttcccaaaatcaagtgatggaaatatgccttttgatatcttagttcagccatcctaacaaaattaagctttgcaatcgttcgcagcactacttttttcacacacaactaacacatacagctttctcatgacaccttaggatcaacacacttgcgttaaacaaatacacctgatgaaatatttatcggaatattgctaaccttcgtgcagattttgggtcacttgatgtacttctccattagtgctccaagacttctcctctaactccggctacctcctctttccctctgacgccgacacccttatgtaggaccgaatagtaaaaactaagccaaccaaaaaggggtgaatggttgtagtagccaaaaaccgaaacatttagcggaattaaggccccgtttggtatagctccagctcccaactccaacttatctagagctggagctgaaatggtacagattctcatttttggagcggggttggcaaagctgctccacaaatttgtactacgagggtggagctggtttttctgctccacagctctactccatcccaaaaaacctactaccctttaatttttttaatgtatttacacaaaaatgccactgaactacccctaaacaactccttccattctctttcctcatattctcccatcatcgccggtgagactggcccgattcggcggtgaccggcagcgtgcgggctggcggcagggcgcgggctgctggcggcgcatggactggccgatggcggcgagcggcggcggtggcgacacgctggctgaccggcggggcgacgccaaccaagtgttcgacgaaatgactacaagggacgtagtggtgtggagctaacaagtttagccaagcactttcacacccacctcaactcctataggagctagctcctactagagttggagttcacagttagaagtcggagtttggaactctaccaaacgggacctaaaagttaccctcaactcgatgtagactggcctacccggagtagatgcgccgcggtctgaccgttcgatgtactccggcctgaccggtgtagtacctccggtctaagcagccaacacgctgcatatatttacttgccggtaggggacgaaattgacaaccctgctgggaagggacacaataacaagacctatcgccactgaatctgtagagaacacacaaacatgccacccatctatggcagagttacaaacatctccagggaaaacatggtacccaaaccgaagtcacccaaaggtctcatggatttcacacaaaggtcccatcagtggagaaaaaagtaggcccggtaaaaacgccctcaagtgggatcgtctctcatttccatggacacaaatgtattcacactggcggagaaaccgtctttactctcagtttgtaacaccctgtagtcccggttttccaatcaggactacgaatccgggattatagatcgctataatttacttgtatagtatcacacactaataattatataatataaatagaatataacataaaattaaacataagtataatataaatagaatataacataaaattaaacataagttttaagtaaaaataaattgaacataagttcacatatctatctattatatactaaaagtccattaacctttctacaaacgctcccaagctgtcacgtggcatcctacaaactcttataagccgccacatggcgttctaataaattaggaaaaaaaaaggtggacccactaattaattttgccaattaaatctccattaaaataaaaaaaatctggtatcccaccaccgtacgcacacacgtacacgtactccctccacaccctccgaactcccccctattctcctattctcccccctattccccttaccaactcacctatccggtacacggtggttactcattaagtgttacttcctccgtttcaggttataagactttctagcattgcccacattcgtatagatgttaatgaatctaggcacacatatatgtctagattcagtaacatatatatgaatgtggacaatactagaaagtcttataatctgaaacgaaggtagtattattttgtctatgcctacacgaatcatttaacatatatttaatactctagatgacttcaaatatggcactatctcttatcaacatatattttgggccgtcagagtttttcctaactatttcctcgtgctggaagaaagcatcaggtaatttaaatatggatttatctctgaacaacatgacttccatttgactgcttggatgatatcacaatcatattaaccacttaatcttgatcccttttctacttgaacccacgcagcacttagttcactgcgcagaggttcttggaacaccaatttgttggggattacaagtatggacggcaagcgcatcggaactggatgcctcttcccctgccacgaacaatcgatgaggaaaccgctcaggaaagggaagcttccctttgtgcttgttgtgggtggtagaagcatcggtgaggagcaacctcagctttatctacactgcaatcaaatggttcttcctgatatcccagtggctgttcccaggctgtagtctgcaggtgctaatcccgattcctcagatcttgagaatctcaactctgttgctcccctgcaattgcatatgcggttgagttgggaaattccgaagtatgtgaagatgtggagataataagaaaattgtcacaaaaaacacggcgggggggggggttaatttgatctgtatcgttgcaaatatgtctatttagataaatgccattacaattcgtctattcgtagccgtggtactgaaattttacaaagttagaactatgtcatcgccgtcacgtttttcattttcttccccatatgcacgtgggacccagtgttagattcatcttcttctttttgctctctcttatcatcttccttcactctcccttatcgccttcatatgcaagttgttcttcaaatatttgtttgcgatttcttttgtcttggcagattcgaatcggagaatggaggttgcaggttactacgaaccagttcgacgaggaggcgcgtgcagcctattcggcggaatgctcaagaggaacgccatgctcaggccaccgcgccatggcgagggggagatgtcccagcatggaagggggaggtggaggcgacggcaatggcgatggctaaagtaacgcagttttgctattttccacaatatccgcctcttcttttcaaggttataggcggcacttttctttgtgattgttgctagcacctctcctagctaggaaggaaagagttgaagaggtcatactttactactgttcatgttatttgttttagcgttatcaaagttctttggtacaatgatcagattcatagttccacgttccaactatatataagtacctagctcagtatgatgtttcatggtggagtagtagtttgtagtaaactatgaaatagtacctctgtctcagaatataagaagttttagagtcgacacaattattaataagaaagtcggtacaactaaatgggaagaggttacgattggtgaagtgaatgatggaggattatatatggttggttgagaagggaatgttagtggataagttgttatattttgggtcaaatcctgagagctaaagttgttaatagagagtattaactaaatatttgtatttgctacttgtagtggcctgacaaaaacatgttgtgccaatatttgtcgtcaaaattcaaaattcattgtattgagcaagcaggcattatgctcagtatccctagctaagtcaacttaaatatatattagaatgcaaattatagaatcactaactggcggctattgagtctgaatacaactcaagtctcaatttcatcttaaattaaataagagtttctcaagtcaaaatggatacacaccagtatcctgtggctcagttaaatctatagtatccatatgcgacatccttgagaattttctaggtaatgaaggtgtagtaagtgttggactaccggaagaaacttggagaaagacatactagctcccaggtttcaaattatgtgtcgttttagtttttttctaagttaaacagtcctaactttgactaccaatttctacacatttgtatatagtttaacaacatgttatgaatgtatttcttgtagtcaatctaaaaacataaaaattttattgatatattacacaaatttatagaaaatgattgtcaaagttaaaagaatgtttgacttgaaataaaactagaacgacaaaactaaaacaagtaatttgaaagggaagaaatatagtattatctctcaaaagatctaataaataaaaaaaggtagaatcatgatttattcgtttgtaaaggtttaatttcaaatcaatgactagcttgtacatagaagaaaagtagtgtacttctacaaagacttgacaaaaacaaaaaagcagtctcacatggcacaataattagtttagtacacttgacgacccatattgccagtcattgcaaccattgaccaattcccacaatgtaggacaataaatttggttggagttaggaaaacatctggcatcagcattgacattttgtttcaagttcaaagtcatcactttgaattaagaaccggtcagcaaaaaacagtccagaccagtcgctatcctctgttagctagcagccttttggcaccaataattcaacttttactcagacctgctatctcactatatataagatagtctcatgggtttcatggtgtgccaaattgtacatgcttatttcaaaaactcagctcaaaatggcttctaggtctcctgtgctgctgtttgcgttgatggtttgtcttgtcatcgtctcgcagggtgtcctcgctgcaagggagcttgtcgagacaaccaaaggtaacatatatctctgtttatacttttgaaaaagactgaaatcttggtatgtcggtggtcaccacaatttcataaatatttaaaatttaacaacttttgcctgaatttaaataaatttgaacaaaatcataaaaaaatagaaaaatccggaaatttcatacgagatagttgcttccgcggggattcaggaatttcaatctgaaatttcaacccctgcatgtatccgttcgtatcaaatgctaggattttctcgattcctatggccagtcttctcattctgaaagtctgtacatatattggaatttcctcatacttggtgtgtgtcactcgaaccttttgttgacataatgtttgtcattttgatttctggtcatcagagggttaatgtactgttcttaaaaacatcacaaggttcatatatatagtgtgttctgcatgtgccaccaatttgaatggcatggcaggatcgaatatcaacacatgtcattatctaactagagtttgcctgctgattttgcagttgtggtagatggaatgaaagttgagcttcctgaaggccgcaaaggtgcagctgctgtctcggggtatggaggcggctggccagggacatacggacactatccatgatacaattgtatattctggatatataaaaggattaatttagcttaaccgtgtatatgtgcatctattttattgtgtatttagaatgtgttgtatcgttataaatctttaattttacacatgtatttaaagacgtcctgcgaagcaatcggagaagacaaaacggaacaccagggactgaggaaactagaagccgttaaagctcattctttttaagctagccattttatttgttactataaaaatcatttttccgggcatgcagtcaaaaagatttgcacaaacaatgaacaaaccacccctaataaaagacatgcgaaaattatcaaaattttcacaagcgatattactcgcatgtgaaaattaatttttgttggttggtcatctcaagacacctgcctgtgataacattgttttggaaataaatgaactggtgctcacaaccatcgcagcggaatgcggagagccgttgccgtcattgctgctgtcagggaggcgatggactagatacatcatacaagagccttgtggtcgtcctcacagacttggttcccccaactccagtacgccactgctagatccatgagactcgtagtcattgttgcagccttagctcccccacatccactatgataccgccacatgcatccaggagagcctcacgcgcggtaattattgccatagcctcgactccctctcccctaatgcgttactgccagctctaggagactcactcttttcgctgtagcatcgactccccatcccccatggtgccagctggtcatcgtcgtagccatgactccccctcctccactatgctaccgccacaagaatccagcagagcctcgtgtgcggaaattgccatagcctcggctccctctcctctaatgctatgctgccagctccaggagactctatgttatcgccatagcatcgactccctatcctccatggtgtcggccgatcatcgtcgtagccatgaccccctctcctccactatactatcgccacatgcatcaaggagagcctcgtgcgtggtaattgccatagcctcggctccctctcctttgatgcgttgctgctagctccaggaccatctctgttattgccgcagcatcgactccccatgctccataatgccggccggtcatcgtcgtagccatgactccccctctcctccactgcgccctcgccgtagcatggtgtaaaatcacttattgtcatatagtctcaactttgtactctgtatccattttttccccaacacgtgggagacctgatagtttaagagtaaaacttttactcctacaaattctatacttgaataaaactagcactgtggccaaacatgaagtctatcttgattgtatgtttagtttatatagataaagccttcccaggggctagcttaagaggcttgcttaagaataagaaagatatatatataatatatttcaaaatagtagtgtggaatgtatttatggtgattccataaatattctatcctaaaaatcgaaataatagggacttttcaaagatttggtactgttactaattcataatctggcatatacatgatgaaaacatcattcttaattctacaataacttttataatagcgtttctttttcttccaatgaagtttcattttttctaaaatgtaccctaattttgggcttagtcctgataattgattcaacttgttaaaagatagaacttggttttattttgtcttcaacaagttcagtaataagcataacaactctattgttccaatggtgagaagaacatatattagctttttgataaattttcaaacgaataatttcacagaattatttggctccaatatttgggtcataaccatccttttgttaatcagatttgcaaacttttccacgcacaggtatatatataccaacgaattccagaacataaaatggccattacaagtatggaagataaatggtgcttcctgtcgcggagaatcaaatgcatgcatctcgagtactaaaactaaagatttataagtgtaccaaagtaacgaaagatatatgtttaaccnnnccaggaaaatatatgtcgtttaacaaaatagaaagacgaacatgttggtcaatcccaacaatttattaatccattacatgtagaatatatatgtggcgtgttcgcaagtataaatcatggacgaggtgggctgggggcgtacgacgccggcaagccgctgccatacgacgatccatctacgttgattgcaaaaccagcaaataaataaataaattgcgattgtagcctctcagtacttggatacaattgatacaacttgtaagagaaaattttgacagtacttgagcaggtaccactggtggagaaaccatctttcgtcggtcggccgatttccacaatagtcctggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggtcatgtcaggcccccccgggatccaaccgggactaaagtcgtaactttagtcccggttggtaataccaaccgggactaaagatcccggtgatctttagccccggttggtgctaccaaccgggactaaagtcccacccctatatatatgtcttcttcctcctccagctgcccgagcaaacttcaaaattttttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagtttatttgtaaacaaggttttataaaatagttgagaaggaaaactccagtgaaagttaatcttaaataatagaaaacaaactaaaataaaaattaaaagaagtaaaacacattaaaattagtttaaaactttacaaatagtttttaagaattatttggtgtaatattttatgattttgggctgcaggaa

SEQ ID NO: 50199 - DNA, 23310 bp, Oryza sativa
  unsure (1)..(23310): unsure at all n locations
cctttttctgtatttttgggcatatgtttcctgaccacttctttacacactcctcttgtttggtatgtatcctattcatgatttggctcctaatcttttcaagcatggataaaattggaagctctctggcttcaagaatgtacttgttgaatacctcggaattgttgttgagtagaatatcacacttggggaaatcactaaagaatgctctgcaccactggttgggtggtatttcctccaggtaggcataagcatctttgctaagagacttcatcttttccatgttaaattcccactctggtatagtacttgaccttgcaattgcccacaactgattctttagagtctcccctttgtatagaacatgaaaattttggtacaaatgcctaacgcaaaatctttgttctgaatctgagaatttatccctcacagctggtaccaatccctacaaaatttaaaaaggaagggtgagtactaatccattgaacagtaaataattcaaatattttaaaaaatgacaagttgaacaaaatcaaatatgatggaataaagtcataccttctgtctgtctgtcatgatagtataaggtccagtgttgtcgataaggagatcttctttcaaagtattcaaaaaccaaccccaactagctctactctccacctccacaacagccatggctataggatagatgcagtcattaggatcaatgcctactgcagtcaacaaatgtcccccaaacttggttttgatgtggcatccatcaaggaatatgataggtctacaaccacttaggaatcctcttttgcaagcatcaaatgacacatagcatgtatggaagcacatattttgtaggttcaagaaaaatttactacctggatttgaagtcctaagctcttgtccataatctcacaacatatcgtattgtgctatttcatcaccatatatcgctttcatagctagtttccttgctcgacctaatttatgtcttgatggtgttacatttagttccttttgaactactttagagaaacttttgagtgtcatcctatcattgtccctaaagctttcaacatatctatttgcaagatacctggcagttacataattcaactcccactccttctgacatttgtggccatctatatatctttttacataagacaattcgtcctgctgtcctcagctacatccaacatccatgagcactcttctttactttagcctcaatttttttcttggtatttcttgtaaatttaattgcgactctattcttcacactgtattgttttattgcttgcctaacttcaatagcatcagagaacaacatcccaaccttaaagattggtgactccatgtccacagcagccacaaagttcttaaatttcaacttaatgccttcattatcttcatcagatgactctggaagcaacaagccttcatcatcagagtcatgttcaggaagcttaacaaccatcttgctgctagccacttcttctatctcgacacagttgtcaaaagcatcatcatcccccttgtcagcctcataatcactgtcaacaaagtcaggatctacatcgatgtcatcgtcatcgtcaatgtcatgaccttctataggtttaacatctgaatcttttcgattcattgtagacctctcacggctagccacgataggtatagaagcaggggtagaaagagcaacatcatcccaattgatggattccagaatgtcttggggatccacatacaaaagcaatgtcctaaaccttggtgctaatgcaaccatgctgttggtgcttgcatcagagttaattctccttagcccatcactgaatgtcttcccaggcaataaccaataaaccttggccttctcagacatatcatatcctagttgctcaataaaatcatcaagccataatgaagaccatgtgtcactgtcacaataatcaaaccaatccaccttttcatccaaataaattctgctactaccaactccagagaaaaaaccaccatgatgtagttcagttgtgaactgttcatccttgcagcctacatcacaagacaaatcattctgatttgtcaaattgtaaataattatctgatctgttataaaaaaaagattataaagagtacatattcatgattagagcaaaaattatttctaatcacaaactattcgtgaaggattacttatatgacacctagccttataaacacccaagcagtggcggaggcagcgccgggccaccacaggcaattgcccaggctccatgcgtacaacaacactgctccaatgcatatacaacatattactcattaaacatatacttaatcactttgtctcataggttataatggagattaattaaatgaataaacagaaacgaggaagcaaggaccaaaccatcaaactgtagatacagacaccaaacaacacaatcacaagattcaagaaaaaacagagaaacatgcaattaccggtacaaatcaatgaaaccctaactttatcaacaacaatcaattgaaccaaaaacgaaaatatgtaatcactagggagttatttaccataagaaggaggggacgccccaagaattcgccgagtcggcgccatcccagcgcacgaggcgatcacgtcagatcagttcgtaggtctgaattactaagcgcaccagtttgggatgatctcagatcagcgtggctcatatatgatgccctcgcaaccggcgcagaggcgatgcagttttgctgtgcactcgctgctagccaccgtcgcctctcgatctgttgaggtgagtaaatcacggacagaaaaacagaaccaaggcacatatattttttgctgtgttaaaacaaaagaaccatttagaatataaaaactagtaggaggttttttgtaaaatgagatgggatatcactctatgatgctgatgctaacgtgggactttgtccaagatggaaagctgacgtggcaaaaaatcttatgtggcagccttttgaaccataaacgcacccacctagccaagttgttgcatcggtatgtccaattttcaagttctcgcacttaatcgcacccacccgccaagttcttgtaccgtcaacgcaatttactctttaaaatatatggaagtaaaaacattactaaacactaataagtattatagggaaaaatatgaagtgcaaaccctatatgtaatgcaaacgtagaaaataccgttggatcgaaaaatggacgcccgatattcgtccacgtcaacatgagttaaaattttactcgtaaactgtacagcaaaagaatccctgtgagttaataaattgctctagatattacgtttatagaagaaatattgatcagttaaaaatttactatcacataccgaacaaaaatacccattagtaaaaatttcaccaacggcatgaagattttttcactggaaggatcgcctgtcacgtgtatatttcattgaaacgtacaccctccgtcccaaaataagtgcagttttgcactattcacgttcaacgtttgaccgttcgtcttatttgaaatttttttatgatttgtatttttattgctattagatgataaaacatgaatagtactttatgtgtgactaaatatttttaattttttcacaaaattttcaaataagacggacggtcaaacgttaggcatgaatatccacggctgcacttattttgggacggagctagtacgtaccacggcagccaacccctatgagtaattttttaacttcaattacgcccgctccaagtcaaattttataatgagtaatttttttactcagttgtctgttgctgtgggaggggagcagggtggtcgataatcacgtgtttctctcataaaccaactactgtaactgatttagcccacggtaatttttttactctgtttgcacctgcaggatggggatgggtggcgggtctgtacgctggggatgcgggctcccgctctgagtggcgccacggtttagctggcgcgcatcgcctgtgtctcgcgtcacgtagcgtgaccttatatatatatatatatatatatatatatatgtatatatgtatatatgtatatatgtatatgtatatgtgtatatatgtatatgtatatatatatacatatatgtatatatgtatatatgtgtatatgtgtatatatgtatatatgtgtatatgtgtatatatgtatatgtgtatatatgtatatatgtataaatatatgtatatacatatatgtatatatgtataaatatatgtatatacatatatatacgtatatatgtatatgtatatatgtatacgtatatatgtatatgtatatgtatataggacactcatatggggcaccatggtgcccgggcaccatggtttcaaatgcacaaaattactcaaatttttcaaaatttttaaattgtgagtatatacctagttataagaattcgattcatacatatatctatcaacaaaacaactcaaatttaactttatttcacaattcatgattacatacctaactaattatatgtatggatgctatatacctagaatcaaaatctaacaaaaacaagttcagttcaaacttgctttgaactagttagtaaagtagttaatgttaatacctaaataattgaaaaagtttcatactcatttgaattggttatatactcaatttcaacaatggtgcccgggcaccatggagcaccaaacaaatttactatgtatatatgtatatgtatgtatatgtatatatgtatatatgtatatatatgtatatgtatatatatatatatatgtaaattaactggtgctacatggagtatgggctccaagattcaaattgagtatatacccaatttgaatgagtacgaattttttttaaatgtttaggtatgaacattaacttctttactaacaagttcaaacaagtttgaactgagtttgaactttttttttttgttagattttggttctaggtatataacatctaaacatataattcgctaggtatgtaataatgaattgtaaaataaagttgagtttgagttattttgtttttaggtattggtatgaatcaaattcatatacctaggtatatactcacaatttaaatttttaaaaaaaattgagagattttgtatgttttataccttggagcccgggcagcatggagtcccatatgggtatcctctatatatatatatatatatatatatatatatatatatatatatatatatatatatatatatatatatatatagagagagagagagagagagacacactatactatactacacatggggtgtagtgtattaaaacacaacccacctcctctcgccgcacctcccacccctacccccctcccctgctgcatcccacccccatccatagtatgtgtaatagtaattttcttactaccccaccaaacctaaactaccggtaatctatttactcacctattttgcaatatgtatattaggatgcaacggaccatcccatcctattttcctggatctagagtccatccactcccatgccggttttcccgcatcgaccaagagggagagggcacgggagaaggctggcggtggaagtgtcctccagcgacgggcggcggacgatgggcgaaatcggttaatgacgagtgaaatcggtcggaggtggcgatggtcgcgggtcgccgacgtcctttgcgccgagccatggagaggtgaggtggttctggctattttcctcgctcgatctggtgctcccttccccaccccgcccatgaatcggcgtcgacatcgacaggatctcttgaggaggagggggcggttgacggcgggatgcggggaggagcatccggctgcgttgaccacaccctgattcctccctcgaaggatctggcacggatcaggcctcccatcgctgcctccctcccacagcggtggcgtcatgatctgtgatgcacgatgataatgagggtaagcagctgagtccatgcaattttgaactttttactttgcatctttgttgttttaccgatttgctgctgcagttctgctaatttgctcctgtattctgattccttcacattctgcagtctgcactcgtgccggtcggcagcaggcgctggagaccctggccacgcaaagcaggcatggggatggcggtcaggaccgatggatggatggatgtcaattcgtatgtgttccaatgaaagtcaggatgttttatttgttttattttctctccatgttctatctactcaatcaatctctataggcaatagctacttgtttttctttgaggaagcatagctgccatgtttgatcaattaattgcagcttatttgcgggcgccagatatgtgtggtgattgcttgtgttcgttgatgcgctgtataacatacatgcatgttccatcgatccattgtagatcaatttgtagtgaatgctagatcattctgaatttatgattattcttttcattaagaacattcggtccatttttattcttgaaatcgtttttcatctgaaaagatggcaggttttgtgtagcttataacttgtatgttattaatcagagatatatggatattttagcctgaagtatcccaattacctattctacatttttcagccaactgcattcttaattttcttttttgtagaatgtcatcgatcacagatcgggactaggcaagcccaggaactaccgttaaggaaacataatgtgacatccatgcttgtctgaataaaaaatgatctgttggctaaaagtaggcatgaaggaacctaaactggtagttcaattttttataaagcattttatttcttcttcggcgaatcatatctcatttagagtcatttatgagtgtaaattaaagacttctcttagatgatgtaatcgtttttgtttatatccaggtggctgtgggatgcctctctagatgttcgtgggtgatggatatctgtcgatgggagacctaaggatctatagtgctttgtcggctcaacatcgatatgtggcactagcgccgtcttgtttgttggattcgtgcatgtaatagtaatttagttactaagagacattaagaatcatcggtgtaatagtaacttggttactaagagatttttttggcaatatcaatatgttatgttgagattggtgtaatagtaatttatttactaagagaaatcttgtgatgatatatatggaaaatcatatatgaaccaaagttcatatgaaccatgaatctcaaccgtcggtgagttccaagaagcgtgcccaagtgcacaatggttagcaggattagggctggacgaaaaactcgtagctcgttagctcactcggctcgtcactagctcggctcgactcggctcggctcgttgtgaattcctaacgagccgagccaatgttttagctcgttagtcataacgagccagctcgagctggctcgcgagcagctcacgagctaaacgagctgaggtcaaaagacagcccaacaaaaatatttggaggcccagcccaactagacatcaggtatatatgcatagaaaccctaaatccccatcccattatcgatctagatcctagcctacggtcccagcgccgcaccctcgctccccccgtctcacttcgagcctccaacgctcccagcgcctactcgccctcccccatctcaccaatctcgcgctgccgacagcagggtcgtggccggccgcgggctgccctccatatctcaccgtcggtcatcgcttggtgaatggccggttgaagacccgagcctatatcctcgccgccgtcggcatcagtactgatctgaggccgtcaacatcgagcaagcttgtattccagccgttctgttacttctttcattgccgccaacactgaagaccggatctgttgttttctctttttttttgttttattggcttgtttcatttgcaattttcatagttactatttgatattttggtacttctttgggtgaatcgctgattggctatagattggaacatcatattatggatatatgcatttgctttatttgtttctgccatcttgctcactggattgatatgtgctagctgtgtactgactgaaccttgcagttttattgctctggctcacgagcttaacgagctggctcgagctttccaacgagccgagccgagccagcatcctagctcgttaggatcggctcgttatcctaacgagctagaccgagccgagtcgagcctagccgagctggctcgctatccagccctaagcaggattgagagacggtaacagtactactatttgttaatttacacttactgccccgttagagcaaggtcaatggtatagccaactaggctccaattcatctatagccaatctaatagccaatttatacaatagttgcttactatactattagcatatggtcccaccgtcatatacacattgcgtcttgaagtccgtgctgcagctgactacagatttgtagcccgctgctcttctctcttatcttttatcttattaaaatatatttacagctggcttatagcatgctattgtacctgctcttacagtggacacgtcagggatcgtggagacatgtcagcttggcccactgacacaaaatagaaaaaactattcacgtacagtagctgctcccttgtcacgctttaacactctgacgagcatggctatgacttgtcttctctcgaacatggctgttgatatttgttgaccaactatggatgtgttttagttatttagtgtaaagtctttaagtatacgggcacatatttaaagtatgaaacatagactaataataaaataaattataaattccgcatgtaaactacgagacaaatttattaagcctaattaatctgtcattagcaaatatttactatagcatcatattgtcaaatcatggtgtaattaggcttaaaagatttgtctcgtaatttacatgttaactgtgcaattgttttttaaaaaaattattagtaataaaaaataatttatgtgtagcatcatattgtcaaaatgcttatccgataaaatttattagtaataaaaatattttatgtgtaaaatatttgtacgtatatccttaacaattaaaaatcaaatgctataaataagccaatcataaaatcaacttctaaattaagtttaaaactttaattttattttttaaaagttaaatgagaacgtggttaaaggatgaggacatggctgtgtaaccccctcctcccggcacgtataaacgaaattcgttttattgcatgactatttaagtattaactattttttttaaaaaatagattaatatgtttttttaaacaactttcatatagaaagttttttataaattacaccgtttagcagtttgaaaaatgtgcgcgcggaagacgagagaggtgggttaggaaaatgggcaccggtagagaaaccatatttggtcggttgcccaaaatccacaataatcccggttcgaaagaaggcaggctgtgttagaccccccactatgataataccaaccgggactaaagatccaattttaatcccggttgcttataacaaccgagacaaaagaaaaacgaaaaanaatcgcactgcgcctccttgagaggaccaacagccttatcctctcatccactcatctctcctcctctcccttatcttctccaatcttctcctcccttctcatcttctcatctccttcttctcttcttcccccttccttcccttcccctctcctccccctcccctgcggccgtggcagatccctccccgacacaagcgtggccgcgcgcggcgagcggcggatgcagccgcggcggcggctgggcggcgggccggcgaagggtggcggcggcgcaggcggagcgtgcggcagaagcggcggcggcagcggccgtgcagcctggcggagggtggcggccaggtgacagtggtgaagcgatgaatttgcttttgagaatttgtgatgtatttgatctgtgcgatgtaaatatgtgatgtatttgtgatgtttctttttagaatttgtgatgtatttgttttgattatctgtgatgtatttggatattgtggatttgtagatgatcgatctgggattcggagatgatcttttgttctgtgattttggggatgatttggggatatggtgaaatcaatattcaaagtaaaaaacaataaaagaaaaaagaaaatactaaccagatctggtttcatttttagtcccggttggtaacaccaaccggggtttaaaatggctccatctttagtcccggttggtaccaaccaggactaaagatcgatttttagtctggggtatttgaaccgggactaaagataacgatctttagtcccggattcgtagttccggttgaaaaaccgggactacagggggttgcaaaccgggagtaaaaaacgtttctccaccagtggggggaagaacacagcctattaagtcaggagctttgggacggtagcaacgcccatttatttgacactcttaatataattaacaacaagattccctataaaatattttatagatctcgtcaagatttattgaagagtttgaaacgtagttcaaagagattttctaaaaattgatccaagatttataacaaatatttggacctctgaacaatattaagaaatcagtagtcaaccaccaaaattacggatttcgttgaaatgcataattttgataaaatatttgacctcgtatgacctattttaaaggaacaattgcttatttgaccccgttttgagccctaactaccaatttgaccctacttttaaaagtttgcttatttgaccctccttttcaaaaacgaagctcccgtatgaccctgttctgttaagggcatctaacggtgttaactgaagcacaaaatgtctcttttgcccttactcatttgaccctattacatgtggaacccacccgcagttccctcttctcctctcctctcttctctctactcttgtattctcttctcctctcctccacggggcggcgactgatgggccgcggcggcggcgctctgagggggctgagggagaggggacggagggagggagcggcggcagcggtggctgacggagggggtgagttgcggcgggggcgcacggagggggcgagctgtcgtcctggctcgtggagggagggaggaacgacggcggtgcatgtgagcggaaggagggaggatgcggcggcgacggcgcaagcgcccggaaggagggaggaggcgggagagggggccggcgccggcgcaagcgtgcggaaggagggaggacgcggcagcggcggcgccagatctgagggggtggcggcgccggctccggctcttcgtcgtcgtcgtcagcagggcgccggcgctggttctggctcttcgtcgtcgtcctcgtcctcgtcagcagggcgccggcttcgctcttcgtcgtcgatgagccgccgccgccactcctcctcgtcgtcgttgtcactagagccggtgccggctcgtcgtcgtcgtcaccagggccggtgccggctcattgtcgtcgtcaccagggcggcgctgatctgagggggtggcggcaccagctcgccgtctcgccgcaagtcgcagccgtcgccgcaaggagagaaatgtggatagggttgggtggatgcatagggttttctaagggtattctgggtattataaatattagttgtatttctttttttattttaaatcaaaacttaacggactaatggaaacagggtcagacgggagcttcgtttttgaaaaggagggtcaaataagcaaactctaaaaagtagggtcaaattggtagttaggattcaaaacggggtcaaataagcaatagcccctattttaaaatttataaattcaaaaatcgcatcgttgcatggctcgtgtgaccacagaccatccccatgcgcacgatagaattgatatattttttataagaataaattatatatagttcattttaccttcgacctagtttgatactatatacgggatggattaatattgcatgctcttggaaaataaaattgttgcacatgctcctgttgtacggcaaagatgtaagtacccatgttaaatactttatccgtcctaaaatataattaataatttaagattgaatgggacgcatcctagtaccacaaatctgaatagctcactaatttggtaatataaatgttgctatatttttttataaacttatcaaaatatcaaaatgtttgacttacaaatgatttaataatatgaaatggaggatgcatgtgaccattgcagagcacatacatgtgacgacggcttgcctgggaaaaaaaatgttcttatagggtacgtataaaatattcagatagacatgcatgttatatgtaggcatgtagcttgaccagtaccgagacattaatttggtgtcatgtcgcaggtgtactcgctggtggaccaaggaaacaaccaacgtgcagtctctaaataggagaggaacgggataggtacatgttgcatcccattagaacataatggacgtgatccatcctgataaaatgcatacacgtggcacactgatgagcaaggagcatatgaaccgtggttcatattatctatctatctatctatctatctatctatatatatatatatatatatatatatatatatatatatatatatatatatatatatatagacacacacgtgggataaggagaataaatgataatttggtcaacaactaatgaattgtattaatttgaccggtgtattaaaaaactaaaataatagatctgccctggagaaaaggatcggagaggttaggaaaacgtacagatgggttgatgcatgccttttcttccgccgtttaaagatccaaacgcacctcctgtgctctactcacaatataattaagattgattatcccgccgattcatcataatataattgagtagtacttctcaacttccatccttttttctgtttgctggtcggtgaacatgcatgcgtgacatgcaaactcaacagtaggccgtgcagatgcaattcgaattgccgtctgagcgagcgactcccggctgcgctgaagtttccgatcgtgttaatggaaatggcaaggcgaaagtcgctcgcgttcgatctactcgcggccttccgttccaatatgctatctgcctctctctcgattagatatatttacatgcctcttccgaatacatttgactgaggaataagttcactttgggtccctctatttgtggaaaacgcttcgattaggacgtccgagacgagcgcaaatatcggacgtccttatgaccttatccaaacctctcgaccgcctctccccaccattcccttcgttcctttcattttttctcctcttactctctctcttctcaaaaagtcacgagagatgccgagggcgaggcgtcgtcgccgtcgccggcagccacacggcgacatcggcggtggggcaaggtggtgcatgcataggtaggaggtgctgaacctcgccggcggccacaagatggcgatgaggcaaggcggcgcgagttagggaggaagcactggacctcgtcgatggggggcgtggtagggaggaggcgatggacctcgtcggcgtccacgggacaggcaacgcaggattagggaggagtcgcggtggcttgcagccggtcgccggaattgctatactccggccgccgccgtctctagcccgggatccgcgccggccttcctccgccgcctcgtcactcgccttcgccaggcgtgctgcggcgcggccgctctgggtgcagctcctgctgtcggtggctcagtgcaccgccaccgccgtcgtctcctgttcgggatccgcgccggccgtcctccgccgcctcgtcgctcgccttcgccaggcgcgcggcggcgcggccgctccgggcgcagctcctgccgtcggcggttcggcaagtccctggcttcgtcgtgggcacactgctgcggcggcggcggcgggtaggagccaccgaggccgacgaggccgtgtagactgcgactgaggtgagaggggcttgcttccccatcccctcggagggtgatttgtgcattttgttgcacaccacatgtttttttttgttgcatatagtgtgtccgtgatgttgcaatccgtaattttctggatgtttcttaaatcaatactggatgatgttgcatttggtctcttcgggatgttgcatatattggttttttgttgttgtagacaatgttttttagtgttgcattcgattgaaacatgttcgataatgcggtgaaacatcttcgataaagcggtgaaacattcctcaaagataaaacatcaagaaacaattcgtgttgaaacattttttttgagcgatgaaacattgcaacattcattcaacatactgtgaacattttttgagcgatgaaacattgcaacattatttaatatacagtgaaacatcatccggagattacgtccgatccgtagctttccccctatttgtcggccagtctgattttcgtctctcgatcgcaaaaccggataagacaggtcccccaacttacgaaaccgtttaactaagatccctcagtagtatttgactcggttttggctgaggtggcgcgcttatgtggcaatttgattccaaaaataataaaacctatagagcccacatgtcagtttcacccacacaataataaaaaatggtggggcccacgtggaccccatctgtcatactcactactcttctctctatcccctctcattctctatcctctctctatccccctctctctctcccctgagaatggcgagcggcgagcggcggcgggcggcgcagaggggcggcggcgagcggcgagtggagcagaggggtggcaggtggctcaccgtgtcgaggtcacgccccagcacgtacgtcctcttggccgccgtgtcaaattgctcccgcagccgcatcaacgacctcgtcatggaccgtcgccgcctcgccggccttgcgactaccgccgccgccgtcgtcaccttcgcgaacccgcacagctccgccgatgcctccgcgctcgccggcaacgacggcgcctcgccgtcgcatatcgccttcttgagcctctcccaggacagcctctcgccggcgggtaggatggggcagcgacccaagaagcccggcgaggcaccgcgtgaccacctcggagccgatgcctagctgccgccgccggcgtcgtcgctgctcccgccgacgcagccggagccgcccatccgcgccgactgcctcccaaagccacatctggataagagaggcaattcaacagtgcttatcccaaaaagatcaaggaactccaagaaagcaaacagtgcttgtcccagaagatcaagaaactcgaagaaattgagttttggaatcagggcaattcatgtgcccatcacaccaaggtgagatcagtagagaagaaaaaaagagatagatcattgagcttttcgtcatctgtttatatgttattgtgtgtcagttcattttgccatcaataatgctgagaaattctggtttgtattggaacacagccatggaatcaatgagcattgaggagtacatcagcacgctgcactgaaggcgtcgttcccgcggaattgcagcgaatgatgcaccggaggacgtcgtcggagatcgagctggcgatggcgggctacttcgacgccagcgacgaggcgtcggagatctgtaagcagctgctgacgaacatcaagaacacgtagagcaactacctgtccatggacagcttcctcgccaccatctccgacagcgtcgccgctaccgatggcgccgcggcgatgacagcggcagcgccgctcgctgccatgcggagcaacccgttcagcgacgtggcgacgcggagtagcttccggcagatccacgacaggtactcgtccattctccatgccatcaagtcgagccacgggaaggcggcgaggaagctgaaggtggtgagggccatcaggaaggtctcccgggcgtgcggcgccgcggcggccgcctccgtcgccgtggccgcgcacctcctgttcttcggcctcctcgtcggggtgcccggcccgctccttcccgccccactccggccgcggccactcctccccgtcgctccgccgccgacatcgctcggcctgccgctccggtgggagagagaagagggagaaagatgatagagagagggggatagagagaagggtagtgaggatgagaggtggggtccacgtgggcctcacaactttttattattgtgtgtgtgaaactgacatgtgggtcccataggttttattatttttcggatcaaattgccacgtaagcgccacgtcaaattaagaccgagtcaaattagccacgtaggcgccaccttagctaaaatcgggtcaaatactaccgggggaccttatttaaacggtttcgtaagttgggggacctgtcgtatccggttttgcgatcaagggacaaaaatcagactaggcgacaaatagagggaccaaaagtgaacttattcctttgactgaagataagagcagagatgggctatggaaagagcccacaacgttaatggtagatgggcccatgatgttaaagcattgttgcatctacggttcgattgaattacttacataatcaatggttagatttttctcctaaaaagtgctcaattagtataggtataggtatagatagatagatagatattggcccaaataatgtcaatcgaagcatgttgaattcttctctgtatatccagataatttgtgtcctctgattcaaccagtgcagccacgccgacgcgacgagcgtcaggaaccctacgcagaccagcgcgatggtggttgttgctgccgccgtcgatcgccgccgctccaaccggctgcaggtggcggtgatggtgtacggcgagaagctcccgatcccagagattgtggccatcgacgaccagtcggacggaaagagctctctcctggagggcggaggcagtgtttaattttttcggtttggccgattctatcggaggttgatcatcgatataccgcaatttcagaaaataaatttcggtccgaaattttgaacaaatgttggttaaatttgaacaaaatattaccaaattcacaaaaaaaatataaatttccggccaaaataatatgtgtgtgttgttgtggggggggggggggggtccgaaataaccgaaatttcattctcaaaccctgcctggaggccctccttgccttccgcttcaatatccacaaggtcgggataggtacccaccgccggccgtcttctcatcctccagatggttcatgacgacccaactgtcctcgatccatagtgccactcttccaggtgcgtgtttcgcttccttccctaggcggcgccctccaccagtggtagctcctgtggtgcctttctagctccccagctgccaccacatccgcgcgcacttcggccccgtttggacttcaaggtctacttctcttttcacactgacaagtgaggctagacatctgccatataagcgaaacaggggaatacgtaatctgcatatgtggcagataaaataatggatgttacatattctggtattgaggataatggatgttaatcaaacccggttttgtatagtttaggagttaaaatttctagtattaagaataacggatgttaatcaaacccaacataaagttgaaggacggtaagtggacttattccgcataccgaagataagtgaactggcccaattaaaacattcaatgcccacactgtacgatgttgtggagatatcctcctagtttagtggctgtgggtataagatcaatatttgagttgaaagctaaaaacttgaaaaagtatgcattgttatcacgtgtttggatgggaaaatatgtggtgaaatctatacaagtagtagaaacttagaaactattggatagatgcctgagatttttgtccacatcaccggtagtaaaaatatgatgtagacaaatcttaagcatccatttttagatccaatcgtaatttctaagtttccacaaatatatgtggtttacagtatatattttccttctttggttattctaaaaaaatcccacatctagtaaaattatgatggattcaatacactttgaacatgtttactattctcatttatttagctagaaatgttatcatggatattaaggtcctctgggtttagatttattggattatactttttagccgactttttggtttacatggtttataaagggtaatagcaatgcgtcacaaatatttgccagagctcagatgccacgtgtgctaaggaacagtgatagacacaaggctcacaatgcagcaacctcacgtggcgtccacaaaaataaaattttcttttttttttctccacttttccccatctatctccctttcctcgagatccacgcttcctttcttatccccctctctcacgccttcccctatctctcctatcatgctcaggcaccggcagcgacctgacgccgctctctctcctctcacgctcgggggcggccaggcaaagcggtggtctctgcggcgacggagctagctaggcggagcagcggcccagacagagacagcgccgtggcagccgggcggagcagtggtgggtcttggtgctcgccggcgcaatagtggtgaggtcagcagcgcaatagcgggggacgatgggagctcggcgacgcggtagcaggggacggtgggagctcgagcgcttcccttcctcctcttctagccgccgcggatcgaggggcggcacggccggcagcgagcggagatcgtcgtggattggggggtagcatggctggcaagctccggtgggtgcagatcgaggggcgcagcgagcggaggctgttgcgaaggtgggggctgcgacgagccccgtggtggtgcctcctctctccccgttggcgcgggagctcggactcggcgcatatgcggcttctctagcgagcttctcccccttctctctctgtcctgctttctcgccatggttgtcaatgcgattctttctcagtgaaaaagctgttttcttctgatgaggttctcggagccaaacaaggccggcgcgaacctggtgaagacatgggccccaccccctcatctcctccacacatgcaatctgcctagctggagagttgaggctataaatgccacgtagatgcactatgaatagcctataagccagtggttttgaagcgttatgtttaattgttgagtcccgtctcccctttatgagaaaagaaaactaggagagtcttatggctttcaaaagaaaaaaaattgcgagttggtttaggcatagatcttttgacttttataagctatagagtacaaagatggtctatgtgttttatggaaatttactttttatgagctatgctactgggaatgaatctggggtgggagccgatcacgcagaaagcatgagctccaactgtttatggagtgggagacgctgcagttgttagaaactcgctaaacaggtccttagttttgtttttcgtgggagacggtggtggttgtagattgtgtgcaacatgaggaaggagcgaggttgatggacaacttaagtggtaagattagtatctgcaggagtgtgacacaaggagtaaatacaatccctggtctaaacatcattaagaaaaatatatgactaaaacatacattacatatatataggttcataagaatagcacactataggggctaccggccggtgtgtccagtttttagagccttcccttcagggagacaacaatgacagggtacatagcccttcctttctcaagatgcttggcaacaagggggacatacacctggaagagctcgtcaacgatggactccccgaagtggtccgtgatgagcggcttgatgacggccctgatgctgcagttcgcgatgctgtcggcgctgcgggcgcagtcggccaccgcatcgccgttggacttggagtcgtcgtgggggtcccaactcgactcgaagacgcccgtgtgctcgacgtcgaagaggccactctcctctatcagctcagtcacctcgtccaccgatggcgcgtagaacggcaggttgaaggtggtcagatcctcttccttcacgcgcccctgttggcacaagattacacctccttatatactccctccttttctaaatgtttgacgccctgacttttttaaacatgtttgaccgttcgtcttattcaaaaacgtttgtgaaatgtgtaaaactacatgtatacataaaaatatatttaacaataaatcaaatgataggaaaaaaattaataattacttaaaaaattgaataagacgaactgtcaaacattttttaaaaagtcaacggcatcaaatattttgggatggagggagtaatttcaagtgaaggaattctgaacgggtttgaacgaaagtagcatggctagaaaaaacgatttttcacagcgaggtttataaattttacaggaggatcttatttttagctgtgaatatctgactacgaagttatatagagagggatctaattttccaccgcctgcaaaaaattattaattttcgcaagcctgtaggtacatgcagaggttatggctgcctgaaaaatgtgttttggctgtctgcaaaatatttttttctagtagtgaatttgaactaaatatttatgaaataaactgcacatgatttgtgcatgcgctccaaagaagtccctaatacttgattctgtctttatttgacattgagacaattaagtttagatcttccggcgtcaaataaaaagtaggaggggaaactatgctaaataccttttggaccaaaatttggagagcttcggcaagtaattcccacatggtgtcgacgtcgccatgcgccagcatttctgagctctttcggcctaggaatgttagcaccatgcagccgccacttacgagttcctctgagcgaagtgcgaggaacagtgagaagtcctctttgaacttcttctggaacaatttgacgacatgtgatggcgtagccttcccgatgcagatgttgcctttattcagatggacgccacttgagagctctttagggacctttcaccatggatttttttcagggaggattataatgtaatgctgatcattgatttatataatatcaatataaaaagacaaatattacatatcactaccaggaaaaccatttgtggaggtagttgataactgatttatataggcggatctataataaatatattattaaccacctgtacaagtggatccacaactgcttgtgaaaatttctgatttttcattttcatgggaaaaacctaaaaaatatttataacttagtgagcatttatacagcaataattactcacaaatcgcacgatttttcatgcgaaatatagaattcaaaccgatatcctctcattcacgtgtaggctacttaccagttatacagcatttcaaaactatgggagactttatgtccctaaaacaactatcttaactatggttcaagtcctcaatcagatttaaaatgggttttctatgaattttcaaagtttggacatcatacagaaccgcctgtaaaaataccttattttcaaaaaaaaaattgatatgagagtttataataaatatatttggctaggtaaacgatctcaaacgatttcaaatttgtgaagactgcacgtttagctacatttaatttgtcatatacatgctatgtttgtgtagttgtgtgtaggggtccccttccggtgagaaaaaaatgttgtgcagtcttataggcgatcggatttcctcttgcatttttttttgtcaattttgggataatttgatcatatgcagtgtgtaccttggagcgccacatgagggcgtaggaacagtggaagaggtggacactctggcaagggaagagcctagtgtagaacgatcctggtagaccagcgatgtagtatggtggctccaacaatctctccttccggtcagcaagctgcttgagctgctgcagcgaccggaagacgtagttaaagtcattgccaggtaggtcattaaggaagaactgtagttccgtcttttccgggtagccactagtggagatcatgctgatcactcccgacacgactagcagcgtgttgggacccgacgagcagccgaggtcagcgatgacgatcttcgccggagctggagaggatagggacgcaaaaaccccctctattgccttgcagagcactggcttggtctccatgatggccttcatctgcagatcatcgaacagtaaaatgaataagagctagatcaacaaactagcaagcgtatatatgtatggaattgagcagagaactacaggtagcctggaattagtggcatagctgtcatttccatcgcctccaaccatgtgtagggctcgctctatctccatatggcactggctgtgtatggctgtttgaccctattagatttcctgctctcaaactcctccatatggcccgttttatagagagatggggcgagcatcttctattattatattgtactacttggcaaatttgcatcaacccgtgcatccccatgcgcatacgggtaatttaatttgtatcaagcatacttttttgatatgtagagtatttcacacaggattaagagaaaagtaaaattaaatagggaattagtggcatgagaaagcaggaagaaaaattaaatgaaagatggttgtgattggttaagaaaagattaaactaggtagaaaagtagttttattttgaaataaaatttgaatgttagaattagctacattgattatggaataaagggagtagattctaaccaggtaatgtaacgtatatatatgtttttaggtttcttcaagattttgtgagaccaactcagagtgcactgcatgtacgttggtttgattatttgctttgttaaccatattgtgcactttggatagaaatatgtacttcctttgtttcacagtgtaagtcattataaaatttcccacatttatattgatgttaatgaatctatatagatatatatgtctagatttattaacatcaatatgaatatgggaaatggtagaataacttacattgtgaaacggagggagtatatagaacttgaacggaactcaacatactaattggggactaaaatcaactcgatggatgtgatattttttcttattaatgtggaaacttttaacagtttctgtttaatgtatgaattatataatgaatatattttccccttgcacttaaataagcggaag

SEQ ID NO: 50200 - DNA, 3876 bp, Oryza sativa
  unsure (1)..(3876): unsure at all n locations
tcctttgtttcacagtgtaagtcattataaaatttcccacatttatattgatgttaatgaatctatatagatatatatgtctagatttattaacatcaatatgaatatgggaaatggtagaataacttacattgtgaaacggagggagtatatagaacttgaacggaactcaacatactaattggggactaaaatcaactcgatggatgtgatattttttcttattaatgtggaaacttttaacagtttctgtttaatgtatgaattatataatgaatatattttccccttgcacttaaataagcggaagcttaaaagaacatcattctcaacatcagatcaatttcaattctaaaaatatagtaggttatatgtatatagaatcatttgactgcaaattttaaattttcatgtttttgaatcaaattcaatgtaatattgaatgccagtttcagtgcatgctgtgtgtgtgtgtttttgtagaattttcttcaaatttggttcgagttgatttaattcttttaatataagaagcatatataataaaaaaatggttatttgtgtaatttctcttatgaaatttctataaattttgattgcagtcatttgaaaattttattttttcttttcaaatttagggtcaaaaacatttgttcccttcatttttttcggaactaaagttttttaacttgacaaatatgtcttataagttcagacttgagtgttaacccaaaacatgcgttcagactcctgcaaacctagtaataaattaaattatagcagagtgagtttatttttaagtatctgttatcatatcgcctccttaaaattatattcactataaaagcaactaatctaataatctaaagctgctcttttgatagcttttgattggttcacttggtgcctcttactttggagaaaaatcataaatctatactagagaaaaaaatacctaataatcatatgtgagaaaaaatctagagaaaaatatcacatatggattccagaggcttccaaaactatcttccctttccaaccacatgaacttttactcctttaccttctataaatataccacccctacttggtactactcatataactctttaaacccaaaattattaagaaaaaaaaaatctaaaatagcgaatttacattcattttccttctttaagtatcatacgcctacttggtactactcatgtaactctagaatatatagtaaacccaaaattataataccaaaaaaatatgcaaaacaaacaaagaaagaagacaaccttattttcttatatcatcatacctactcagccttgttttcttatatcatcaaacctacttagctaaaaaatgattgtgttttttttttacacaggatatgttaaaaactctaaatgtactaaatgcttgatctttcaaaaattcaaattcataagaaaatatatttgaatcaattaattctgataaatctcaaaatttcttttacttgtttggatttatcaaaatttatgtataaaatgatgtggcacttgtagcaagtacttttatattcaggctgaagaagcgatataaactgttaggttgttccttatttggtcttttctaatgcctaatgcagtagcacacatggcaaattggcaatgcatgacgttagtattaggaaataggaggtgatcttctaccactaatgtgagatttaatgcaagtaagactgtttgtttaagaatatactatataatataaaatgcagtgtgctagctaccagtagtacagctgctgttgtctttttatattttagagtttatgtatgcatgaccagtatgcatggagtcataaaaattcatacacgagatggttgggaaacttggcgatgatttttacctttaagggttgnnaaagaggtatgattgtttgatattgatacatacttgttggtggagttcccattgctggtaactattacattctgggtgtgctgaatgattatgcttggtggtagggtgctagaggaggtggcttggtggtagggtggtagactaggtggatgtggaggtccaccgtacaacggtgccgacatccatggcctgcatctagatagtatgtttctcattctcttataatatttcaagaaaacatcttaaccatacaatttgatctagatagtatgtttctcattctcttataatctttcaagaaaacatcttaaccatacaatttgtgttttttcctgttagatttcaatcgctacattgtgagatttaagggagttaccaaagacatgattgttcggcagatgttttgtattatgtctaatcctaatgattttgatctgcttcccgataatgatagcctcagtgtggtatgcttctctctattagtttctcttttttttctcctctatttttctaactataagtggcagtttgtcaggaattatccaagaaaaagggtacattgtgagatttaagggagttaccaaagacatgaatgttcggtagatgttttgtattatgtctaatcctaatgattttgaccagatagcctccgtgtggtatgctgctctctattaggtttttttgtctcctctatttttctatctgtatgtcttaatgatctgcttttgggatgttggtagagggtgtgtgtctgttcccaatatggatccagatgctgaagaagaagacgaacaataagtctacgtgtttgttggtctccacgataaccataagtggcagtttgtcacgaattatccaagaaaaagggtaagacacaccaatggcaggtaataaaaagaaactggtcagtaggctttttgccgcgcggtgcgccggttagacgcagcgaccgcgacgccacatttgaaaacactcttggacgactagttatattactcttactcatataagtacatgcagatgcaaccatcgatcgacacgtgttgtatttgaatatatatgaacctgactcatatgtattcctaggcatgcaacacatgtgttgctgtaactcagtaggatttataatatgatgagggcgtgtttctgttcccagtggatatggatccagatgctcaagaagacgacgaacaatgagcctgtgtgtttgttggtctccacgataaccatgagtggtaccaagaagaagaagggtaagacatattttttcatatctatgttcacatgcagtaggctaggcagtagatagtaatcatggctggtcggtaggctaatcatgactggcagtttgacagaatttagcagttcaaagtacactgattagtaggctaggcagtagaaaattagcaagttggcattggtgagtaataaaaagaaactcgtcagtaggctttttgtcgcacggtgcaccgggtagacgcagcgaccgcgacgccacatttgaaaacactcttggacgactagttatattattactcttacttatataagtatatgtagatgcagccatcgatcgacacatgttgtatttgaatatagatgactgatatgtattcctaggcatgcaacacatgttgctgtaactcagtagaatttataatatgactaactaaattcatagtggatttaatgtaggacaacaactcttaatggatccaagggtcatttcggattgctgcttaataattataaaatgtgccaagccaattaatccattggtaactcgattctttggccgaatttggattacaaccaacttataaccacaaatcaatgtcataacctaccaaattgctgttggtacggacagaacggtaaattaagaaccaaaatgcattatcattaatgcattaattggtcagattaatcagaaaaatgaaatcagaccatagtccacacgaactttcaggaacatgga

SEQ ID NO: 50201 - DNA, 3500 bp, Oryza sativa
  unsure (1)..(3500): unsure at all n locations
tgttagatatgaaccgtgctagaactacatttattttgggacggagggagtatatgacagttgagtcggatgtataacacagctcgtgatgaaaagtaactgatgggctggggctagatccctacccacgcaagggccccatgaaagcaaccgatttttagtgtttaaaagatactcctaattaattaagttcaggaatagtcctgccagattggtgccctgtgaccgtcttagaagtatctgtcgtttgtggtgccaaggaagtgctaagtactcctagatcagtccaacaagcttctgcaaacgatgttatattattaccatctttaaactatccaacggtttctgtgatgattagatgcaactgatcacaaacatatatggtacacgtgttggcttggaaacgaagaagggaaaagaagacatttaacattgctttcgtctcaacttagtggagctatattttcataatacatatgattgagtataaaattacaatgaaattcaagtatcctttagatcagagccacattgtatctctgtttcccaacaaaaagtacataatttcttttgtgtgctgaatcaaaatttttaacaatagcaccagcaacatattatcactatattggtacaaactaatacgtacatataagtcatacgaatatttatgtaccttcagttttcattcgtatgactaaaaatttatagttacacttatacatgtaattaagcataatcctttttctttctatataagtgcatccttaatgttgagcaacataatcaggacagttttggccatctcaagtgaatcagattattggatacatcgtctcaaaaaaaaaagattattggatacatgccacaataaatttactactttggaaaatatagcttactagttacaattctctatttataaccattccattgcaacactcgtgaaattagatctatgccatgttatacancttgatacatgttttgaatcttttttggtatatttttttttgtactcctgccaatcctctcttaaccatagacccaaatcccaccaaccgaagctccaaattccccaaatcccggcagtagcgatgcgcggcctggcgacgacgatgaccttagcgccaacttgcgtgctatccgagctgatccagcaccggtggcggtgagctcagctcaagcagatctagtggagacgacggtatcgggtctggtgttgagctacgacgtgcggtctgacagaggtgacatggccaacggtgacaagaagcgtagctgcactgcatggtccgacaacaacaatgagcttagcagagagaaatatttaaccatttgccacatttagatgtgacaattaactttttgccactgaagccacatgtaataaatacatgtggacccacatgtcattgagatagagatggcaaatagttgtttgccaaatctaaaagtggtaaatagttaaaagccgtcgatgccaacgacggtggggatgggatggccggctcgggtagtcatcatggatagcgaccgctccaccgccctttcttttttattatttttccattttctaaatttcttttaccaatttccccctttttcccttgtatgtataactatgtttaccgaaatttaaccacagtttttgagctgtagaagatacggatatttgggtccatatataaatacagtggataagaaatgattcaaaatgtgtatcaagtgtacggcatgttatggatccaattttaaaaatgttacagttgtacaaataataataatggtattttttcgaactagcaaatttataatggcatgaatccaattaattaaccagttctatttccttgactcactcgagtctatcgaaccatggatggggagctccttcctcttctcgattcccttcctctcgtttgataataataaccaacaattttgttccttgataaatatgtaataataaacccggcttttcgatcaattatcctgcagccttgtacttttgacactgtaaatcttggccaataattttatctgttctttacattgtccatcagatttatctctccactgaaacttgattacttgatctctccactactgatttattggcaaacctgttgcgtgatcttatatagttgtcaataattaatatccctttttctcttgctccattgttcacagagagtttcgtattacaccctccgtcccacaaagactttacctttgagttttatgtccaatttttgactgcacgtcttatttaaaaaaataaaaaataaatacacacaaacaaagtactattaatgttttatcatctaataataataaaagtgctaaccatataaaattttaaataagatgaagagtcaaaccttatattaaaaaactaaaaaatagagtctttgtgagatggaaaaagtaaaagttagtagtacattacatagcaatcctaccgtaaggtgcagggtatcaccgtattatctatcacccgtctgtctcatcacatcgctctagtaagagacaaacacaagaaggcaaatgggtgttggccggacagcctagcttccagagcccctgaactgatcaagtgccgctccactgctctgacgaagtcgtccatgatttcatctgacgctgcaaaatgctgcactattattggctcaaatacagctcttacgcgcaaggctaccatcttcagatcgagcaaggctttgcccgtgccgtcatacggatcgtgcatcatcatcttgttgacctcaaatgaaccctcctcctctatgatgttgttaacttcactgtccatagggcagcacaagggaatgtagaaggagtcaagcttttctttgctgataacaccctggcattgaattgaagaaaattcagtataacagagtagatttgtatcagtgtagctgctttgtataaaatacatataagttgtagagtaattcaggtaataaattaacctagtttggtgcctacatatgcacttgtgcaagtacccctatgagctgatttatttcgaaactcttttaatccctaaagggaggacgcctgaaaagttttgcagcacatgttctgtcactcaacatccaactgtcactggactggaaattttgtgggacagtagatgaacgcacgttgtacatatgaaaattattttcagaatttaattaagaggttattacccgtatgccattaagaaagatgatgctggcctctgtgccactgaaaagttcgagcctccctctatgccatcgtcgaactttatagcgccctacacaccattccgtcctttttgtcctaacggtagaaaacagcgcatctaaatgacttagttgccattaggcgttcttgccaacgtgttcgttcgttcgtccccaaggcgccgaggaagggggaggaggggaacagctcctggccgagcaccgacgtgacgagcgcggccaccacgtccacaagcagcgcctgcgcgccgatgttgtgggagg

SEQ ID NO: 50202 - DNA, 7456 bp, Oryza sativa
cggtccacgatggcgagcacggagaaggagaggaggaggtagctgccgtgcggccgccgccgccaccgctgctcctcctcatctcttacccgccagcccactctgacacccggatcggcgggaggagggatccctccccggacgccgccgctcctcgtccatcttcttggtccgcgacgaggaggagcccgtgggctgggatgatccggaggcgccgtcgccggcaaaggaggaggaggaggagccggccttcatggcgttgagcttgcggaagtggagctcgatggtggcgcggagggagttgtaggtggcggatgccgccgatgccacgggcggacggggagggagtcgtcggcttggaggacggggtgagatttcgatttggctgtggagtggattgagtgtggtgggcggcgtggatggaggtggcggtggccatcattccctacggcggcggccttgccgccgcgccaccccacccctcctggtcgccgcgccgcgccgcctcggctggctgccgacgccgcctggccgctggcgccgcctggccgcctcgcgcggtcgcctgcctcagcattgtggctggccgcttttccgccgcgccggtcgcctgactcagcgccgcgcctggccgcttgtccgccgtgccgcctgtcctcttttgaaagggcaagagcgacatttttcctacccgggcccatatgtcagatttgccaaacggttaaacccacacagaatagcgacagaatggtgtggagggcgcaataaagctcgccgatggcatataggaaggctcgaacttttaagtggtacagagacatgcatcatctttcttaatggcatacaggtaaaaacctctttaattaatcatgtaggtcgtaattaaagagttgacgtgtgcaaagacatcttgtgtgtgcttgtgtccttttgtttttgtttttgtttttgtttttttgcgaataagagcttgaagaaaaaggtagatgaatcagaagcaacaagggaacagcagtccaaagagattatgtgtgtgcttgtgtcatatgtgattggaaaacacgaacataagactgaattggtatgtgccgaaattggtcaactcacccttaatgccatgtcacttaaagccgtcaccgccggcgtccatggttgaattaactcagtgtcaggtttgtccgagcgcttgaccaacagtgagacaaccattcggcctccagggacaatctcctgtgccctcaagctcaagaatcgcatgaaatccttcctaaactgccgagcataagaatccgcgacaatttgatgccttgatgatctcaactgttcatcactatcatgcatcgggattctactcttcttgagatcttcaggtgcctgcagttacaatgcacactacttacagaaatcaaaacataccccctccatacatggatgggtaatcaacacaattagttactctctccattttttaatatacgacgccatttgacttttgagattcatttgacaattcatcttattaaaaaaaattatgtaattatcatttattatattgtgacttgatttatcattaaatgtttttttaagtattacttaattttttttatatttacataaaaattttaaataagacgaatgatcgaacgtttgttaaaaagtcaacagtatcatatatttaaaaaacggaggcagtacttacctcggataaccaatgcaagctgttagccgagcaaaccaaatgcaaggagccacgagcgaatagcctctcgtagaacgacccaggtaccataccggtgatcacagcagtagggcgagcgagcgcttcatcaccactgtgcttcagtgtgtccaagctcttcgccacggcgttgaaatcgttgtcaggcagatcgttcaggagcacgcacatctccggcggcagctgctcgtgctgcgcgcagtagcggtggatggcgtcgacggcggcagagacgagcgtgagcgcgtttggtccggaggagcagcccaagtccgcgatcaccatgttctttgggtgaggacatgagcttgtgcataagcctgtgactgcctcctctatcagagtcttcatcctatcctgggctgttttctgcgtgcaaattattttcagatatgtctcaatcagatcttgcaagcaagcaaagtaaacattgaaatagttggcttttttggccacacaatgcagggtgggtgtagtatgatgattttcagattacggcggggtttagttttcaattttttcttcaaacttccaatttttccatcagattaaaactttttttacacacataattaaactttcaacttttttctctgaaattctaattttagtcaaacttctaattttggtgtggaactaaacacaatcgtcaatggatagagttaccagctgggaatatgatgaaggccgagtttacttcaaactttcaacttttccatcacatcaaaacttttctacactcataaacttccaactttttccttcaaacttctaatttttgtcaaacttctaattttaatgtgaaactaaacacagccgtcaatggatagagttaccagctgggaatatgatgaaggcagagtttagttccaaaacttttcttcaaacttgcaacttttccatcacatcaaaactttcctacacacataaacttccaactttttcctttaaacttctaattttagtcaaacttccaattttagcgtggaacaaaacacagccgtcaatggatagagttaccaactgggaatatgatgaaggccgagtttagttccaaaagttttcttcaaacttccaacttttctatcacatcaaaacttttctacacacacaaacttccaacttttccgtcacatcgcttcaatttcaaccaaactttcaattttagcgtgaactaaacacacccaaaatatgaatgcaccaagttaaactgtcaaacatcaaaattataaaatttatatgcgctcaagtcagacaactaggtagattggttccatgtgaaacccattttttttacacaaccttcaagctgactctatttagcgagtgattttataatacttgagaaggtacctgcaagtatcatattttttatataaaatttggtcctctcaatacttccagtagcaagaggtatcaaatttcaactaaaaattttaatatctcttggtatctcttaagtattgtaaaaattctcctatctcgaacatacctcgatgcatctagtatcatagttcgaaaaaatggtgcaatattccgttacattaaaattggagtatttaatttgaacaagtgagcatatcctagcttactataaacttatcccccactaactccttaagcttaatatgcaaagatgccacataatcatccactaacaagatgccatataatcatccactaattaacaagatgccacatcatcatccactaacaatcatcacatttaaacatcatgcaagcatgctatatctttatagtttttataatttaagagcttttcaaacacaaatatgttaaattatcatctaacataattcacataatgtttcaatgtatatcttcatactaaattcccgcagcaatgcgcggggtttcacctagttcttaaaaaaattgtcccaagtaaacatagttatatgatcattttgggtaaatagccaatacggtcccttaagtttcacttcggactcaatttagtcctcaatgtttcaaatcgttcaaacgagtcctccaaattaattatttgggttaatataatccttggaccaaaaaaatatcacgtgagcatgccaagttatcctcgcatgtagcggtatgaataaaatgaccattctaaccttatataatatatagaaaagaaagaaaaaacacaaatagaaaaaaataacaggctagccgaggcccaacgatcggtgcttgactacagcaatcgtaagtgacaattctaaaacgatcatacacctgtgaaacatttgtcttcttttcttttctttcttttttatatggtatataaggatagaatggtcatttcattcataccgctgcatggcaggatgacttggcatggcatgctcaagggacacttttttgagttcaaggactatattaacccaaatgattaatttggagaacttttttgaatgatttgaaactccgaggactaaactgagcccaagcaaaacttcagagaccatattagctattcagccgatcatttttatataaacatttaggccattaaaattagcttccaccatattaatggcaattcctttccttattttgtcaaaaacaggtgaataagattgcattatgaccaaaataaatccatttctctgttttttggcaaatatcaaactgtcatcaatttttgtacaatagaccttttataaaaacaaaaatatctgatcagtacaaattctgccttgactggttcttatttcaatgattcaattcatttataatctgctactgtcagttccttcagatgacgaattagtacaaggcatgtaatactcagaaatgaggcaacgccctcaactttcgacaatcataagaagccggtatagcactttgaagaaagagcaagcatctctggccaccgagtcagagatttgcgccaatgggcttggtccaccccactcccactcgcgcctaacgatgagaaccgattccctcggtctcgagtgcacattgctctctctcttgtgcgatgatcggacgcgctatctacgtaacggactcgcccacgatcccctcaatgcacaaacatataaagggaacgttacccgttcattggcgacgatcgatttacggcttagccaaaaccaaaactctcagactttcgatcttaaggtgtgttgaaggggaacgaatggcgaattcccatcgccgtcgccgcacggtgatcttcataaccggtgccttacaacaccgtaccgacgcatctaaggcgaccatatggtttcttcatctagtcagtacaccaataaattccacataagagaaattaggtgatcatgcatagcctaagtttgtgcatttaagagttaaacacaagcatacctgaagtgctgagttctgagcatagctcgtttcaccttgccctggattcatatgcacactctgtttggagttggtggccatgattcagtttctttctcttctcttttgtgaagctaagctatctgattacctacttataaccttgcagttttcatcagtggcatcatttgactggttttttgttttttgccccagtatttgacttggccactttggaaatttgtgcactgtcagacaaatgagacggtccaccactctacctatacctacttcagaaattccacctttacagttttaactacttaagaaatccatatgtgcaaatattaaactatattcgttttgaaatacagcgagaaacagtaaaatttgtttaacaaaaggaaaatagccttgtcttatctgttgtgaagataacaagtgttggattgacaaccacaaagtgttgatgtgatactctgatgcatctccattatctgaagtgataactccaaaactgttggcttctgtgaatatataaagtagatgaatcacataggtaaccaaaataatgactggaaaataatttatgacaagaggtaaaagattaactgatttcgcagcaccaaccatagactccttcaagcctgacctttaaacacacaactcaatgcatcggtcaaagcaatcaacgttcacaacacgcgcaccctcacccaacccatatgatgaaagtatttagatctattggtagaaatgtgaagcgtgttattgttaaaaaaaatatggatgggtataatcgttatttagccatgactaaacttgttttctctttctttggtttatttggatgcaacatgagcaatgcctgtagaatggatgaccacaaatcgacctagatagggtgaaaaacataaaataacaaaagttacttttaatcactatattaacaaattactaatcaatatattagtaaattactaatttattcttaataatagtgaacagttcagatctatcaccggtagatagcatcggatcatcgctcactccgtaagtatgtgaacttggatcaaataaggatgcaagtaagaaacggaattggatccttaccgcacagagctacagcgttcagattagattcaatatcctaagtttgatctaattagtaagtgtgcttcagattaactgtagcgcacccgaatactatctccgattaacttttgtctatattctgaatatattttatccaaatacatagttagtagttgcaaaattataaaatggatgtagtacctatatatcagtgaaataatgcattttagtatggcaaaagagacattttggtgttaaattcgtcgctctctgcaataaatgcagatgattatttttttgcgaggaaactccctactcaaagtaactagaagaaaaaaaaatggaaattcaacagcgtgcttagaaaatttacaccatatgtgcctagtcgtttcattgtcaacagcgtgcttagaaaattgaacagcgtgctttggttcaggttttgtcaaaacttcacctttttagttttgttcagaacaataacaataagttgctgatttgtaaaataagaattaatatcaaacctacatcacgattataagtgctcacttttgattgatccaaaatcatattaagtttctttttaccatagagaaacttttccaaagaacttttcatataagaaacttttttttggtcaaatttgtataattttgacaatcaatcaaaacacatttattcctgtgacacttagaacaagaaagtaactaatgagatttcacaagattctctatacgctcaacacaacctatttaattgcttccccctcagcctataggcttcctcctgggccttggtgtttgtcattgagaccaatagtgtttgtcattcggcccattttctgatgtctcgatgagtttatgagcccaaatcttctaggatagaattctcctccatttttgatggtctttcctctcaactttggtggtttattacatacatttattcactaacactcgtgggaattgttagaattaagtccaacactatgttgattaatttcaaaatgcactttgagtaattttaagaaaccaatatatctttgtgttgattaatcctttttcacacaaaacattgaataaagaactcgcacaaaatgcaactttatattttttcaaaattaaagaaccttgatgtcgcctataggagggatgaatatgcgttcctaaaatttatcacaacttcatagcatattacaatgataagaactttcagttcaaatcagagcttccgatatggaattggaaattttggtctccacaaaaagttcagcggataacaaaataaaacact

SEQ ID NO: 50203 - DNA, 1953 bp, Oryza sativa
gcaactcataatagagacgtcgagggcgtccagctggtatacttcgtagattcccttgaaattgatccagagaatatcatctccttgcaagaagtccgggtccctgatcctcgctcctatcatctctctaccggtggcgctcatctccacgtacagttgatggaacttgtacatttgtgtgggtagggactgcaccagctcgggcttgacaagcggtttaccgagttcgtacatgtatttcaattccgcattttctattggttcaactcctagcaattgatccgtagttagaccggtgtcaataataaattcttctatcgtcatgtcttccccggtcaccaacggctcgatctcctggtttggttgctctccaagctaagggactggtttggactttctagaagatgctttcttcagcgttcgctctggggtctataggaatcttcttttctggacttcgaggcttgaattggctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcggaggagtaggtgtaggagcacgaggaggagtcgagcaggatcctgaggaggagtcgatgctggagcctgaggtggagacggagctagcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcaacaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacttgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatatccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagctatcagctgggttgagcgttccaccgtgagcatagtaccagaacttcgatcgttccggccaattggctgttgccggttcgatacccctctcaatcaagctagcctccatctcctcccactttggcatcgcgacgctatagcctcctgacctcaagtggtgatggtacttcttcttggcggtattttctttgtttctttccatcatcgcctgcccttgttcacctgtcttatatgcaacgaactcatcccagtgatcccttagctttgggaatgtgtcgaagttcggtgtctgccccttcaggatatacttctgg

SEQ ID NO: 50204 - DNA, 1887 bp, Oryza sativa
ccgcacaacccaatcgctgtgacgtacataattcttggcggcttcggccggggcactaggacgtccatcttcttccacttccgttataatgtgccgaccctcaagtttcttcgctgcacctcgttgcccgcgtgccctcttctgttcaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtccaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcgtttatattattacgtcacttgcctgctccaattccttctagggctagctcttccactccggcttgacagacgactccgacaacacgtcttttctgcaagatacaaaaagatgtattaggataaatgcgaagtaacatatatatatatatatatatatatatatatatatatatatatatatatatatatatatatatattgcatttcacgttaacgttcgtcctcgttctcgctctcgttcgttcgatcgttctcgttctcgtacacgttctcgcggcaacgtacgttgacgtgttcgttctcgctctcgttcgttcgatcgttctcgttctcgttcgttaacggcggtgtgccggcatcgggccgccggttggcgcggcggcgaaggtagcggcggcgtgtcgacggcggcggcggcgtggcgacggcggcggcggcgtggcgttggcatgcggcggcggcgttgcgcggcggcgaaggcggcggcgtggcgtgccggcggcggcattgcgcgcgcgccggcgaaggcggcggcgtggcgtgccggcggcggcttggcgcggcgtcggcgtggcgcgtcgtcgtcgtggcgcggcgtctcgtggcgggcggcgcgacggagagagatcgagatgaagggagatctggcggcgcggctctcaccccagagatgcggcggcagcggaggaggcggaggcggcggcgaggacgacgagttcgagacgacggcgagatatggcggcgtcggcgcggggatttgccctaggcagtggcggcgaaggagagaggccgagtgagatcgatcggccgaaaacgtctaagtgttggtgaagaagacgagggcgcacgggaa

SEQ ID NO: 50205 - DNA, 2814 bp, Oryza sativa
aaatatctttagtcccggttgttcacaacaaccgagagtaaagaaaagatctttactcccggttgttgagaacaaccgggactaaagatatttcgaaacaaccgggagtaaatatcttttcccgctatttcgaaattctttttaaacccggttagggttaagaaccgggactaaagattatagcactgcatatgattttcgcttacatatgtgtttataaaatagaagttaatacattaacattatttaaagtacaaagattaatgacaattacttcgaaaaattatttttgtctgtaataaattaagtggataaatcgtaataagcaaatatatgacttataattaataaaaattccaataatcatatatacttagcatatatatgaatgatattattatattgataaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgttgagtgagtaaggggtgtcttcatataataggaggatgatagggtcaatcgtcaccgtaaaagggggttgcccatccaactgatcgtaatcctcgtcagtcttgtcctcaactccgacgatttttcttttgctctgggagaaccacttgacgtttaggctcatcaggccttgtgcccttctttcctttgctagacatgtccttcacgaaaaagacttgcgttacatcattggcaaggacaaaaggttcgtccgagtatctaaccttgttaaggtcaacagttgtcatcccactgtcatcaatcattacgcctccaccagtcaacttaacccattggcaccggaacagaggaaccttgagaggaccatagtcaagttcccatatatcctcgatggcaccgtaatacgtggcagttgttccatcgtgtcccatggcatcgacacgaacagcgctgttttggttcgtgctcttcatgtcttgggctctcgtgtagaatgtgtactcattgatgtcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacgtaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacaaacatacttcttcagaacgcccatgtaccactcgaaaggaaacatgttgtgtaggtacatgggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggatggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtatctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgtgtgaccatcttcgctctctataggctggcttccaggcctctttccgaaca

SEQ ID NO: 50206 - DNA, 8496 bp, Oryza sativa
  unsure (1)..(8496): unsure at all n locations
cctgttagggacaaggcatcttgggtaaagatgaatggaccaaaggtgaacccaccgattaatgagaagaaagttggaaggcctaggagatgtagaagaaagcagccacatgaacttgaaggaggaacaaaaatatccaagcatggtgtgcaaatgcattgtagctactgtcaaggagttaatcacaacaagaagggctgcaagaaaaggaaggaagatataaaagcaggaaagcagcaagccagtgctgctccttcacaacaacatggtaatgaagattttatgcctctgcaggtcatgcctgaagttctgaacagtcagactagcattttaaccagccaacctagctatgatcagttacaaaataccatattgtcttccttgacgagagaggttagacaatgctntgccaattttccattttatagctntataaaacagttttcacaatttcaatgtactttctgcagaacattataaacaactcttctagagttgaccttggtccactgccagaatcaaattttattgccacaaaccanaaagctgcagtgcagccgccaatgacgacagcccaaacccaaaagaagggggcaaggggggccccccaaaaaaaaccccccaaaaatttttttccccggggggggggaaaaaaaagaaaagctgagccaaggaagagaaatacgcaacccaataagaaatcagagttgaagaaaagggaggagacaaagaaaaagtgaacaatatattcaacttgataaaaaggattagcttataatttatccagaagttatgtttattttttgccaaccaattagacatgtttcattttggagtgtgctctgttacattgctctaatttccaatttaggaacatctcttgtttttcctgtttatacaacagctatttatggtaaaacatttcagaatattaggagcacatttctgccaggatttgtctatggacaagaaaacataccacatatgtctgtacagaaattgctactggtcaaagcaatgttagcaaaattcaggttatcacttggacatgcagttccaaaagagagaatacaaccagtatttgctacatcgtgttcaccattcatttaagtagctgaaaaattcttgtatcccttatataacaaaagcacttccagagtatttacaaaagcacctacactgccattattcactcacatactgctttgacagcaacaaagagtcaaagagtcctctcacagtggtacaccagatgcagttatcatgatgctgattccactatggacgaagaatcccatagaattacagcacaaaaaaatggaaggttcagattctcatcagaagggaacctactacggccatgggcggcgacggtggtttcgagatctaacaaccccctgcactggctttgagtcctgatggctgccgtggccgggcttcgtgtcccatcgaccactgacccacgccggtttcgagtccccgaggaccgccgccaccagctttgagtcccgacgactgctgccgcacgccggctttgagtcccaccgaccgccgcagccggaagctacatatttaaggtcctatccctcatggtgattaattgatccgtactggaaaatgtcctcaaatgagaaaaacagcaggggatttgtgcaaaattattatgatgtgtaaagggccctcacgtagactttgtccaaggtggaaagctgacgtggcaaaaaaatcatatgtggcagccttttaaccacaaacgcacccacctagtcaagttgttgtatcgatatgtccaatttttaagttcttgtacttaatcgcacccacccgccaagttcttgtaccgtcaacgcaatttactctattttaaacatcactctcagtgtgttcatagtaatatacttactcaatctgtccgtaaaaaaagtgagtgaaaatttttaagccatcaaaatactagtatcgttatccttttatggggcatattttgacacatacagtcaatattagattatggagtattacattcaatcatatgcatatcaatcgtacaaaaaatcgcccgtgcataacaaactacaggaccaacaaagagaaaaaaatgaaacgaaaccccgtccacgggaggatagaaacagcagagatgcggatgacccgagaagcatgccgcacgtggtggtgctgcatgcgctaggcttcctccagatccggcgcagcaaccagcgtctacatcggcctcctgccctatactcatcgacgcaggcctggaagctagtcgccgggccttaagaccgttgccgccgcgcaaggtggaaagtaaccttcccctcctttctggcttgaacgttgtttcagggccaccactgccgctggccgactactcgtgtgctccctgaaccgaccatgaggcacgccatggacgacgtagccggccgccgccaccctcacgggctccgaagaagaacgaccaccggcgccggccttcagatcgggcaccttcaagaggacggcaatcgccctctcctacctggatgcatgacgacgccacccctcaccgatggatctcctcgccaccactcggagctcggcctccacaccatcgccccgacgagcagaccggtcactcgtcgccgctgaatccccaatttctcagatccgaaaaaaatggaagaggacgggagtatgaatgggggtttggatacagtgagatggttatggatggtataaatagaactattggtgtgagtaaaaaaattactattgtttgggcaggagcgttgacagggtggggtgggggtggctcttagtggtgcgcgagttaaaaatttactcggactattggagtggggtaggggtgcaggggtgggatcgagattggtcgtcgatgagttaaattttaactatatataaaactaataagaagttggatagcatcaagtaaaaaatttactcggactatgggagtgaggggagggcgcgcaaaggtgggatcaagattggtcgtcggtgagttaaattttaactgcgtactatggacctggtgggagcgtgggtgggtggggttggaggctgtatgaggtgttttttaatacgtagcaccttagggtgttgtatagtagttatatatatatatatatatatatatatatatatatatatatatatatataattacattagatttctatatcatgattgtgggcgtttgcatgcaaatcgatgcccatgctaaattgctaattgctcgctgtatcctcacattaaggcatgttatccctccctaaaattttataccctgtcacatcgaacgtttaacacctacataaagtattaaatataggctaaaaaataactaattgcattaaattgcgactaatttgtgagataaattttttgagactaattactctatgatttgacaatgtggtgctacagtaaacatttgcaaataacggattaattagggttaataaatttgtctcacggtttactaacggattttgtaattagttaaaccgaaatcatctatctaggtgttatcatcaaattaggagcgacatatataaaagaacagtcaagacacagcggagcttcctaattgttaaatttacatcaataaataaatgaaatactaaatttcagacccccaatgaggagggacaatctcatattttcaattataattttcagaattattaaataaaaaaatttggattccaaggcgagttcatttttttatattaactgtgaggccacattatctatgatttttctattttgagaactattaaattagaaaataaaaaactagaacaaggttatagaaaagcataaagaacgcatttgatactctagcactttgcattgatcatcaattctacagtttaaaattatttaataaaaatataaaatcaagatattttaatgtgtagaattattaataaacaaaatagataacaaaaagtaaatttggacgtgatttctatagcaattgcataattattgacattttgagtttccggggaagatgcctaggccaccatgcatgagcagagtatctttcagtggaagcattggatgctaaaagcgaacgtcggtgtggagtaagattttgtacatattattattattatcaaaattcacaattattttcaataggaaaattaaattactttgtttttattaatctatctgtcaattaaaaaaatataattctatgtttaaaaaaataaaatttatacatattatatatatatggaaataaaaagtaagagttctatgtaaaaataaagattcttttgaattctatctccacgcaaatccgctaatatggaatccactaatttcctgtatgagatatttttgaaaataaataaccaatattctagaatatgattaagatttttaaaattttaatatagtccgtgcaaaacacgggttgacggctagtgcaaccaatggatttggaatgtacaaatcaattttccgtaatgttcgtaacacattaaagtttaaacaaggataaactgaacgcagtgcaatatcatgcaacaattcatcaattcgattccctgatagaatacactttcgtgcaatcgtgctcgtacaaagccaatgctgaagaaaccacaccttaaaattttgcatctcgatctcaccaactgccacaaagaggtaccaggagaaggacgagcacttcagcagcgagagctcgagaaggcttctcttcacgacggccggcacggcggagtcatcgaggaggctgcaattgacggcgaggctgcggagcgcgccattgcctactagaatccggcattcgtcgacgggaacatctgcaacaacagcgaccagaacaccagcatttaattagggggaaattgatttggacgggagaggagcagagcggaggggatgaacactcaccgacggcatcctcgtctacgagactacgaatacatgagcaacggctccctcgctgacctcctcttcaaggccggtagcggaggtggcagctacccggccctcaatctcatccaccggcggttgaagccgttgtcgcggcggcggcagcgaggcacggttgcctactgcgctgagggcgaaggtggacggcgttgctgagagggattgccgcggagatgatggagttacacgacaggagaggggccactgttggtgtcgacggcggttgggagggggagagatcgggaggtggggcaagggagtgacggcaagcgccattgttttcctcccggtgatatggatgaagcgccgagaaagctatttggcaatcagtcacgcgtgcccctccccgcacgactggacacatgtcgcgcagagagaaggagggaggagctagttttctgttttttttcttgttttttttcctttttttcgtttatgtttggttgattttttcttttttttatccgttttgttcgtttcggttcggtttggttttttttccaggttctcttccgttatgttctttttccggttgctataaagatgtatgaatacaaagtttgtactcatatgtaaaccaagtttatattcgtacgtatgtaaagtttgtatacgcgtatacgtaatgcattttcttgttttttatttttttatacatatgcatataaagtttgtatacatcatatacaaagtttgtatatgtcctatataaactttgttacatcgtatatagactttgtatacgtcatatataaactttgtatatatgtatatatttttaatgcgttaaaaatatattcataaaaaaatatatacatatgtatatagtgtatatacatacatgtgtgtatatatagtatgtacatacatatatacatatgatgtataggagatacagatagactagagatgaccgcacgcgcgcgtggggcgcgcggctgatcgcgtatcagcgccccccatgaagtgtggttgccatagcctggtcggctgacaagtgggcctgaacatctaccacgtaagtaaaaatagtgtaaatagggtttaaactgccatagaacatgtcgacgagtgatactcgtggactggatgaatagagtattgaggtacgttggaacaggggtctacgtagtacgacatcaaaacagacaaaaaaaaaaaggattatactagttcaggccccttatcaggtaatagccctagtccagtttatataggattaatgatgatgagaatagattacaaagagagtaatcaaaataagcaataccgatgagttcgtagtcgaagaattcgacgagatctcccggcgagttggctccgtggactccggcttcgtaatctttggtgggtgtgttggcgatgagatgtgataccctttgcctctcccgaagggtcccttttataccgtggaataccatgaccctcaagtaagacttggggatatgtaaaccaacacggcatactagaaattttgacctttccgaataggacttctacaattccttaactcatggagatattttccataatctgagacgaatttctaaaggtgtatacgggaactgaccgtatacgtgaagatatatcttatcgatatattccataagtagtaggatagagggtatgccttatccgtaaccgacagaacataattcggttttatacagtttaggggcgaagattaatagtgtgaagggacggcaataggacttattccttgttgtgcatgtcggagcccattatcttctcagacggcgcaacgtgcgtcagcgtggactagcccaggcccctgctctcctgctcgttctcaagcgcatatgcatttaaatggatgggtgtgtataaatttatataagcatttgtgtttgtgcttttttacgcaaaagaaaagtttaaaatcaagtaaaaagtttcccatttgtagaaaaaccgtactcacttaagcgagaaatttcgtagtgccggttttttagcgcttagtcaaatcgaggtgtattttttttaatgcgtgctctaattttgtcgccgaagatttttttttttggtgatttttttctcaggtaaaacaccttattctctagtacacagttgctaattaatcatttttgtatggctcatgcatgcagccattgattgctaaatgggtggctgagacagaagcaacagcaaaaatccctatgaagcatgaaactttttcatgcttatgctcagcagttttggaaggattgctgaaaattcttatctctatgaaaatttctctaactaaaaaaaatatgtatgctcatgtacgaacagaatatattttcagtattaattgtgcacttgtaactggaggcactgatgatcttaaggagactaagagcttgaggctatcaaggcgtcaaatcgtcacacagatgcttatgctcagcagtttaagaaggatttcaagcagtttttgagcctgaaggcccagagggtcaaatggttatctcagtgtacatcaggtgctcagacaaacctaattctgagttcctttctgttgagatcataggcatataatgatttaatatattctataaataantcatggcataccagtagcattaacacatcattagatctacacatgtaaactaagcagtaanacatgaacagatgaaatatgcgtaacatgtcgaacacgtaccgagctggcggaaagaccggttgctcggcaggaactactcgcggttgcgggcgtcgacgaaggcgcgcagcacgcgagcggagaggaaggcgagccgtcgtggacgaacagggagcagtcgcgcgaagcgcttcccaaaaaccttattgcccccttctcccggtgcaggacgtcgaaggcagaggttccggagacctgctctcccgatcgccggtgcacgccggcgagcgggatggagtagtctacgagtgacggcgcagtatagagtaggaggcaaaccatagattgatttcgcatgtgttgcgtgaaggcggcggctcggtttatatagagataggtcgcttgatcagggcgcccgcacgatctcccctccgcgtaaccgaaccggataagtcgcgcgtaacttatccggactccacgccgttttcacgcatcggatttttcggaatgtttccaaaaacaaaacaaatccgaattttcctgcagcaaaacaaaactgcaaaaggaggctgcatctgcacaagggtgaggagccaattttgcggaccaatcgacgcgtacgtcgtgcacgtgcgccgcttgccctgctaggccaggcgagcgagcgcgtgcatgtgttccccttcttctctccaccatacatgcttcaagtggctaggagggcatcctcccttttaaggaggtccccctctcctagaataagcaaggtagtactaaactccacatgcatgccatcccatgtggtgggattttgtgattttccaaagattaaaccaaagaattaatcttccagtgggctaaggcccatccattaattccaacaatccccaaccaaatctcaaaatcccactgagattttcctt

SEQ ID NO: 50207 - DNA, 1769 bp, Oryza sativa
tacagaaaagaatgtatgatttggagaaaaagtctgacacaagtgaatctgtctagttatttgaattgcaaagttggctccttagcgaagccccaagcggtaaccaaattcctcatgtgacataacacatggcctgatggttaaggaaaagtgcccttttcattttttgagtgttataatatatgttcttttccccctctataacactacatcaaggttggcacactgataactattgctgcaatgaacacaaaagaaagccgcctattcatatggtaaactggctactactgctgattaacatgtgtagcctttctacctatattataaggattggtaggagttttctatgtgaccacaatccattttgctatatagagtatggtgattaagtccagtaccaatatatactgtattagtcctactgatcagtgatcaccacttttctacccaagataacaagaaatcagtatatatgtgtaaatattagtgctcatggagaagcagttcagattgatataagatgtgcacttacattccgatttgtcggacaaggtccagtagtataataacaccgcatatggctcatccgttgggagctctgcttttgtagtgctcctgctgcctgggttacacatgaaataattcgaacccctccttggttcctgcactggttgtatgattggctccatgaccagcttaagctgctccttgcgccactcttccctcttctgaatttcctcctcagttggaaacttgggtacatatggctctgaaaccttcgcccaatcagattcctcaggagattcaaacaacaagctgtactcgccttctccttcccctccccctgatagtgtcccaggtagagataacgcattaagcctcaactcctcgttttcttgctgcttctgctgatacagaagtccctgatcttcctctgcttctaatgcaaagatggcactgagtcccaaatcatgtcttctctttctgtcattgcggcatttagccggcaaagcttcctattgagctgaacaagcaaacttgaacacgatattgggttgttatcatcgaccctccattctagaatttggtgtgtccagctctctgctgaggtgcagggcaggaatgtgcagttgtcgtcatcatctccgctatggatgcccaccgtgattccactccacccagtaagaatgatgccatcgttgagccgtattggtacattgtctactaggaacttgaaactcaaaatctgatccacctgtgtgtgttcttgcggcaacaccgatagcattgccacaggtctcaacgtctctatatagcttctttgttctgtgaagccaatggtctctgggtccgaatagccttccacaaatcctactacttgaagcttcatcgtcgtcaatggcagaataaacctgccatcgcaggcaagcctccggcgcatgacgcgaggacattcctgctccacaaagttgcagcgaacctccccatcagtgcccattgaagtttgaaccttcggtgcatcgcttcacaaggcgattcccactgcatctccccatggcctagagggatgcaggcaagaggcatcatctccagctcctccctttccctgttcagctcttcttgcttcctcttctcctgctcttgtttctcctgaagcaccatctttttttgctcctcttgttcatcatctggtagagagtcctggccagatcctccaatgcggccgtaatgttgatgaaatcatggccgaccctagcatacaactt

SEQ ID NO: 50208 - DNA, 783 bp, Oryza sativa
aaattaaataaatccctaaatgaatatacaaggtggtggatcttattgttctactcaagggtgcacctgcgcacattctacgtacatgcagtgcataaatatcgtacacacatagtatgatttaatggtttgtgaaaaattaaaaccctattatgatgaaagaagaccagatttaactactatattttctaatcatattaaatatatacaggaaaaggtccaaatatccctcccgctcagtggcggatccaggaaaaaaaagtagtgggggctgaactaactaagccagcataaatcgaaacatctcacatataaattggctacatgtatagttcaaagtagacacgtcaaattaatgataagtagagaattttgtccataccaaaccaatatccaatagatgatgtttcaatgccagtcacttattattcttcattagtaatctgtacaaagaaaaaaaaagggcaaatgaacgattaatcgaaaatgacttattttgaattcaaataatttagagacttagggagagaatggaggcatggagcataccactaatttctgttgaggcactagcattcgacgctttttcatctcttcaaagtgttggatgattttttcatcactaatacttctaaaaatctgcttctcagtgtagcaaatcatcaagtcattgagccattcatcccccattttgtttcgcaaatctgtctttataagagacatagctgagaagaccctctcaactgaagccgttgccaccggaagtatcaatgataactcaat

SEQ ID NO: 50209 - DNA, 744 bp, Oryza sativa
agccaatcaaactcattgaaccaagttttttgaaaggatctccactcaccaccttgccatttacgaggaaatatagtaatattaggttgagttgggccactcaatgcatatgccctctttacttgatctctaatttcaggtggataaacttcaattggtttgcgaagccctggatcaccaattatatctgattgactaaactctgccctaggcctcttcggctgacttaaattctcggtgctaggtgaaggatctgtgttgcttgaactagaataatacgtgagtagtgttctttttgacatgttgacaatctaaaaagtaaaaaggtataggaaacaattataagtttctgtcagagaatcactaacttactgaaattgaagtcactgaaaatctgaaattgaactcttgacacaatttatattcagagaatcagatgttagtagtttacccaatggccaatgcaaagtagcagtctagcagactagcagtggcctgcccggctgcccctgtgctgtggctgtgcccaactgcccacggcgttgccggcgccgctggccgcttgcggcctgccgcctgcccgcccgccttgcggcctcgctgggagctgggcagctggcagtcgagtcgccggcgcgccgcctcccctacagcgcggcggcgctttcccgccggctggcccgcgcggccgcgcccgccttctgttcgccctgcccgcctgccttgcggcctcgctgggcgctg

SEQ ID NO: 50210 - DNA, 2378 bp, Oryza sativa
cttagaggcactttaaaaaagtctaataagtgtcttatggtgaattatctctacaaacgaaaagacattttataaaatgtctataagatggtagaggcattttctagagacattaaattataccacaaacatatgaaaccagcattttctagagacattaaattgtaccacaaacatatgaaaccagtctaaaaaagagacattttataaaatatctataagatggtagaggcattttctagagacattaaattgtaccacaaacatatgaaaccagcattttctagagacattaaattgtaccacaaacatatgaaaccagtcccaaaaaggagaataaaatactttctttgcttttgtcaagccttgaacacaaacatatgaaaccaagtctaaaaaaggagaataaaatagtttctctgcttttgtcaagccttaaacccatgacttcttggagaaatcttttctacctttaatgcactaaccaactcaactacatgtcattacttgtatgtttgtgcctttagttacttatatttactccttcagtatacattatcattctaagaagtgtctttacatagtttaaaatgtctcaagaaaatacttttacatatcagtgccgaaatattgcctctacaagataaaatctaataaaatgagctgaaaatatctctagagtaaaagttttctaggtaatttttaaagtgcctctataaagtgtctctacactataaaaactcatgatcttagaagaaatttgcaaaacacctctacaaaagtatctctatatgaggtttttgttgtagtcctcttccacaaggattgccaacatggccaacttgcattagctaaggcaccactcgagaggacaaacttctagaaagagcatgcccaaactgttgaaaaaagtttttgccaaggaagcctcctagaggacgtctctagggaaagaagagacgataagacccgccgcactcgttgaggtcttgaggagaaccaagacaaggtttttacccagcaacccactagagggagagagacgactcgacaatgcccctaagagggaaaacgacacctaaagcggtgttgttttcatcccagcaaggtcgggctaggttttacacctattgtccgccccttgccgatccacaactatcgcttcattactccatcaccggccatccttcgtcagcgggtggacaccactataccgacgcctttcgtcggccagcttccgcatgcctctatggcatacccattgtcaccggcctctctgttgtcactgcgtcaacctctcgcgccattagtcgggctggcttccctaccgtcacctacaccgacctcctaacaccacctgcgctagccacccgcggtcgccgtgccgattccgaccagaaacttataccaagtctagctaaaacttgaatatgggcaaacaggtttcactataaggaacctaaccgtttgagctactccctccggttctccggttctataataattgacgttttggataagcttaaggtcaaacttttataactttgaccatcaataactttaaaaatatttagtttaaagaaactataacaacatatatagatttgtctgtcaaaacactataataaaagtaagcatgcatttaattattgcatatattataatagaaaaataaggtcaaagatatattttgtagaccgtgtcattgtctaaaatgtcaattaaaatgaaaccggaagaagtatgtttactctgcatttagtgtcctaaatattgaaaacttttgtatgactcccaaaagtggtttcggatgttggtactgtatatggaaattatctctagctacaaaagaagtagtccaatctcctcctattgcttaaggatgtggcactgtttattgttgattaaccatgcgtcgtcgtcactcgtcactgctcagtgctcacaaagaaacctcatataaatcacaaagactttcgagatttgtattggaattaattaatcctctacttgaatacatttaattgggatctggaacccagtgaagaggggcgtgtcgaaggtgtccatggatcgagaatcaatcgatcgagaatcaataaaggccgagactgcagagaatgataactttatagcttgggaagcacacaagtcagctcttgtaagattaatgatgtatataaaaaaaattagatataacaatgtttaagtgttacaccttcatcagtccacagtttgctcttcagcttaccagctacaaccaaaggccccatcggtaggttcgtctaataaaccaaagcaaaaagttaaaatttgaatttttaaatttaattttaaagttgattttgagatattttcaacgtattgtatcccttgta

SEQ ID NO: 50211 - DNA, 12053 bp, Oryza sativa
  unsure (1)..(12053): unsure at all n locations
taatttggagctagtagtggactatactattaaacttgctcttatagtgagtacagtagataacgtaagcgggttgtacatgttgtaacatcggatttgtgcttatgtaaaagagagaagaaaatcaagctacatatgtacagccagctacaacatgacctctaataaactatgagagatgtatggattagtttttttttcgggggattagttttttttttcggggaattagttattaatgatacaatatatatttacaactaactattgtataataagtggctatagataatgtttagtagtttttaaggttaatagctgactatattattaaacttgctttaaaggagactcagacgatcaccccattgcctggtgtacggtattgttacgtcgagtcgagagcaagtcgtcttctttcaagttgttgcattgcggtacaaaatgggaaaggtactgaaactacttcgatttacacggtatacaaggttgcaggtggcagaaaatgaaaaccctacaacaaccagaggaccaggctgcttgtttgaccattggcaccgcacattacgtggtttcatttgcacatctcaggggaaaaaaggcgcaaattgacaatgcagatctatgatccttgggaatacagcaactttataaaaatctagtagtaccaggaattactccaatatctagaaaaatactccctccatctcaaaaatctcaaaatatagcaacctaatttactggattagtcataccatagtgcaacgaatctgaacaaagaacctattcaaatccgttgttaggttgtatctaatctcgtactataaagctatattttggagtggaggggctccaatatttcattcattccagaggtggcataaccgcataagctacagcagtgcacaaaggtctcgatcacaatacatacacggctacagcagtgcacaagggtctcgatcacaatacagacacggccagaacgtcgcagtgcaggataaggtaacaatagaactagatattgttcgttgtcagatgattcgtttccccagttcagcttggtgaaaaaacgaaaacggtcgcagtgggtgaaaagaattctagtgcttgaagacgatcagcacggcagtgcagttgtccttgcacgcctctcacgaacagcttccttcacgagccgccgcactgccagagtcgctgacgaggtctcctgcaatgattgacggttgaacaaagttttagggttgagaaatttggtgttcatatacttcatccatcccaaaatatagcaacttaaaataaataggccccctaggatatgttttctccgatcctaggttgctatattttggaacagagagagtaatgctttgcggaattgatcgtattaaattcaatcataatcgggtcacatgctttagattttgtgtgccagcgtaatctgatcataaatgctttcactacggtagataattgctgttagatggagtagtggggaaaggaaacgaatgcacttggagatgcaaataacagaaacaaacagcaccttcaattgattctgcacaaattcaacagcatcacctggtccaaatacctggcacatccatttacagcacatgttaaaacaacacggaaaaagtatattactgaagcagaccacaagaacgattggcgataaaggggagaagagaaaaaggacgtactccccataagccatcacacccaagaataataaaatgatctttcctcgttacttcaaaggagtggacgtccggtgtagcaatcagcccaacctgcagagtggggcacataagagatcgtaatataaaaatgtagcaatttcctatggctaaagcaggctttccaaaagcatgtcaaaagaccataggatttcacattttatctttgaaagaacttcacaagaccaggcatggccagttgcccaacagaattcatacctactataattcaatatatgcaaatggcacattgttaggtttgccatatcgagaaagccactgttagtttatccaattatccagacaaagagatgaacagagaaacagggaaatatactagtatcataattttgtgaaggcttgcagcctcgcaaagacctaaaacatgctagcaagcttccacaacgtctgtttacaacttaaatccccagcagttaatagggtcgaacgttagctgaaacaacagtgctagcatatagccagaaatctgacacttcatagttggttcaaaaagcaatgtggaaatgtgcacaactgcttatgagaaatgtatctgcaacagcaaaccttcttaaactgacgatcacccaaagctctagatacttcaatgcgaccttgtaatctgccattagggccaacagatcctccagcctttgtagggaaaacatgttaaaatgaatcaagagtcaacacaaatcaaaatcaaaatcaaaatataatgatagaactaacaagctcatatagtaattgccaattcatcaaaaccacaagggactaaactaaataaacgacatgaagcaaatcaaaaaaggatctgaaaccttttgcaaagcaataaatcaagaaatgataacatactcataatataaacaagctaactgaaaccacataaaagtagggtaatcaccggcatatgattgaagcacaaatgcattaagttgttcaaggaataacccataatgaaaacggatattaacaacgcagagctacattcatatttgcagttgtgtagcataatcagattaggtttaacaggttacggtgcatgcagcatgattacattggaaaatctagagcaagaaaggacttcattatattaaataacagtgcacaaaacagaatatacttttaaactttcaaaacgaaactgagatgaaatttggcaggaaaactgaaataaatgttgaaagtaaagcaacaagttaccttttggattcgagcacgttcttgtggaaagattgctttatgttctctggtcaaaacaatagccttcagttgacttttggcatcatccactgcaccttcaccatcagctgatgtggaacgagctaatacagctttagcatctccagcatttgcaacaaccacctttttttcaaaaataaaataaacaacaatcacataatcgacaatatatttcactacataaacaatagaacagttgtgatccagtagttcaaaatttaaaactatagagcacagagctgaaaccaaagcacatagcattgaaagaaacaaaatagtaaaccacatgatttaagcttatacaaataaaaagtagattggacctacgtacagtaaaccacatgatttaaacaactcagcaagaaatgacatgcagatgatcacgatataaaatatgggccctcatgaaccatcgagaacctctaactaagagggctgaaagtaagcaccaacacatttctatcacctcttaaatcttgtcactatcgatactcccaaagtcaaaatccaaaaatataataatgtgaaaatattatgagtacacaaaattcccttgttactgaaaactaaccgtctgccccaggacccagacacagacagctgttgcaccatcttgccagtttcctatagtataataaggaaataggtagaaattcagtagtatagagtaaaaaatcatatgaaacaaaaatgaaactaacaaaatttacataatagagtttcaaaatctacctcaatgctgggcacaatacaatgtttattattagttgtcaccaaaacagaaatgtattccttttattgttgtgaaataggaaagtcgaatgaaatccaatctgattaaataataaatatctctccttgtccaagcagaaggaaaaggagacaatttgagcagacctttagtatctctaattagctctgctgctcaccaaaataattatctcattatatgcattttgttgacagcatcagctaaactatacactacgaaccactagctacaaattttaaccaccaaagaaggctatttatggtcaggtaactgataacaatgcagaacattaagtagatttgcaataacattttcagccaatatagtagaatggccagatattattcttatctgggccataaacctatattgggtcagaggtgactgtaaagcagaggtctatggtaaatgtgcaggccaacttttccacacgaattggatattgcagaagagtaatggagatatgggaaaatatgtagtggaacctacaacttagctggaaacttttgcatggaagttcagaaaatatataaggaaaatcacaaatgtagggaagatgtaattagacaaccatacaaaatttttaacaacaaattcagacttcgtttgtgagatataaaattaacaatggcaatgaagaaacactatacctgtttttttgttattttgtttttcactgtttctcgatttcctatctcatagatggagaggagtttcatctgatattttgtatgattgtctaatatcaccttagccatatgtgatatttttcaaatatttttaaaattttattccatggtttctgcctagatatgaatatatcctcgtacctttagtactttcttgcagtaagcactcatcagttctacgaaaacctgaaaagatccaacaaagtaagtaccagagcataaaatcagttggtgtatcagtaatgtactaattaccgatggaaaataaatacttactgaacggaaattaaagagcttgaaacatcaaatgtgtggagagatagatatagtaagtacagagaagagtagtgctatacgtaagattcttttaaaatgccaactgtttgatttaataagttggttgatggaaaataaaagatgcgaaagtgtaccatttcagtactggtaaaaagtttgtaagaattttttttgtagcacatcattttcttacagggaatatgctaatatgaaggaaaaacaataataaacagagaaagcttggaattgaaattgtgttcctcttagcactggaactacacgtaagatggcaatgcctgttgtcgttttccataaacaatatatttcttctaccaaaccagacagtgaaattaaaactaaaggattgcacctggactcatcatcataaagtactccctccattcaagtttgatcatcattttttttaaaaaaaaaactgattttcaagtttgatcgtcacatttgcagttggcatgcagttgcatctcgtccgacgtgctggccgtttcagttcgcacgtgaaattaatcagccactgcatggacgcctcaggagcactgcccgttgcatgcatgtgaaattaatcgcatttacaattggctacagatcattggttccgctgcgatcatcatgcatgcatgggctgttacaataggcatgctgacccattggcctgngagtagattangaagatgataagcatgtttgctgtccttggtctttgtgtcaggccaaaatatgacagacaaacttgaatagagggagtatatgggatgctaatggaatcaaggtcaatgtgtctatgtacagtacataggacagtttagctgaccaggggaataatcttagccatcaaaaatcaacaagtgtaatcctagtctacagttatcagcaagtaactaagattcatgtaataaataccttcaatgatggccttctttgcagctttaacatccatctgtaaatccatttttaattactattaggtaactcacaaaccaaattactgtgtgcattgcattcaagcaaaaaagggattaatctagagataccattgaaataaatcaagtgacggacctaactgaaatgactcattaatggaaggtagcataagaggaaataaaacataaatctaatgatggaatactcccatatgataaaaaaaagaaaaatagagaaacaatgaatgcgcaattttgctaacactaaactatcactcagtgaggaaaacagaagttcagatagaacatgaatagtgaaaacattgaaaggaagcagataatgtaaacagaccaactcacgtggtaatcctgctgcaataacattctgatgcaaatgtttctgtgcatactctgcagccaggcgaccaccatgtccatcatatattgcgaaatgagcgcacctgcatcaagctacacatcaggctgcaagtattggatgctaggagttaaactgaacagaaagaggcagacctcaggtttcccggagattccatgctagcatcaggaagcagcacccatgcatcttccatagtatgcctgcaacccttgtcttctgcagcatcagcttccacactagtcaaaatcaccccatggccacttgaaacattcgagttggttgctgctttctcatctgaaacacacgggtttgtcgacaccgtgttttcctttcgagaggcatctcctccttgagcttcatcgccattcgtttcatgcgaagcgtcagatgtcagaatgtgctccttttcagcagcagcgccgacaactttggggcgttttgatgcccactcttcatcgccaccgccgttgtcgctggttgcttcacgcttttgatgagccatgacgacctgaactatacagcttccaagttccaacagcctcttatcaatttcaccagcgcactgaaatgcacaaacaaacagaaggaaatgaatgaaatgtgagtgcatttcgctatatactttatatatttgctaaaagctaaatcaaaatatgagcccctcttcatcatctgcatctaccagatccccacccctcttccccaatctcccatgaaccaaacccttccaaatcgaccccccaaaacctagcactagtagccattctcccacatccccaccacccgaacccttcgttcccagcatcactcctttgtccccagaccacatcgaagcgatcgagacgcgctctaagagcgcgggcgagcgagctcatcgcagcagaaatcgcagcggcaaaaaccgtaaaaagggagaggagctgaacagagcgcacgaccacgaaacctgaggaggaggaggaggaagcggagtacgggagcccgccggccgtcgtagcgccgccgtcgccggtgaacgagagggtcggagagagaagaagaagaagaagaagggatttggcgattttagcctcgtttgggttgaccccaattttggcccatccacgtattcgggccgggctggaatctcggcccaccggaagtggatgggcctgggtttccgcctaaccagggccggattccgcccacgcgggaacaattcctgggccagatgaacggtggagcccatgtcacagggatttcattctatctttttcctttcttgtatataagtctttgctcttcataactactccctctctgtgcctctgtggttataaatattttattttaaagaataagtttggatcaaatttcctaaaattttactaccaattctatatttaaataattttagaaatataataaattaatgatactatgatagtacttgtaaaacagaactaaggctctgttcaggaggagggttgagctagcacgtaaaacgatgtttgtattaacgcatgattaattaagtatttgttattctttttcaaaaatagattaatatgatttttttaagcaactttcgtatagaaacttttttaaaaaaacacatcgtttagtagtttgaaaaacgtgcgcgcgcaaaatgagggtggggagttgggaaccctagggaacaaacagagcctaagtagggctcaatttcatgtatttgacggatcgagtttaaaaagtttgactaaattatgcattagtcgcacagtccttcctcactggtagtgtagcttggcagcagattatgttacgaaccccttttagtgcatattagatcgatcaggttactcgggctctattagggctttaagatattattgtataaattagccatcacatcaacctaacctaccctcctctttttatttgcactagtaaggctcaggggcaatgattagttttttttaccaccgttcatggcatatcttttttttcttttgttgttgtatgagagggaacagttgattttatcccccttttagtacgtatcggttgtttgacgatgcggatcaaccaaaagtagccacgcgtagtccttactggtttatgggagatgagagcacaccaatgctcagaaatctcagctctgcttacacagatggagatcctcagcaagagcttcatagacttcaatttacattttattagccgaaattgtaatagggtagcacatgcttgtgcccggatggtatcccagaactctcgggcggtggagtggcttataacccccttataaccccacctgacttagggatatcttaatccaagattgtaaccctgaccgtgattaatgaatctccggtcgccccccccccccaaaagaaaaaaacaatatgcaatttactctctttctcctttatgtttgttatactagtttataatattgtggttgagagcatcctcatatgcttgcccatccatcattttcggtggatagttcctagagtcgagacaaaacccacttatgacacatccttaacatttactccctccgtactcgaattagaagtcgttttggacaggattgtgcttaccaaggaatcattaattaaggggtattcttccatgtttgcccttattaaatgaggctgcgggtttccttttacaagaattgttcatagttagattggttaggcagccgcacccagtctgggcggcgagtgtaatgaacaagcgctattaatgcgcatgattactgcggacggcgagcatgcgcacgcaggggcaaacacatccaccttctatcctctgagcgtgccgcgacattctttgtgaaaacaccagtgacacccaaaacgacttctaattcaagtatggagggaatatacatggtttaattatctacgacatggctcttgatccaccacttgttgtgtgtcgacgagcagcccctgtagctgttcaaggcggccggatgctggttcccaaagtgattcttgcccatttcacacaaataaaaaagaagaaggtaaagatcatgcatacaaattaactgaaaaaacataattaccatgcattatatgatgcactgtcttcattgtaaagcactaaggcatatagatgatcccaattaagatgatacttttccttgataaaagatcagtttcccctcaaatgtctctctaaaagaaaataaagatcaccaggttttagagataagattcatttcaggttacagcgcagctgataacggcagctagaataatggcagttgctgctgatgactctacatgtgtatttagggataaaaacggatcggatattttcttgaccgttcagccgtttctaccaaatatggcaagtattttttctaacaccaggaatattaaattaaataggatatgcttttatcttaaaaacgggtgaatgggttacctaatacttttttaggttatctaaaactcgtactattatctaaaaccgatattcggattaacagatttctagattatatcaccatactacatgaccgaatctcacaccatcatagtctaggatttttttagacttataagctaacttataagataaaaagtctactcctaaccaacaaagcaagttttttgtttggttttttttaaagccatataaaccaaaagctccatcattttcttcaacagaatgcattaattgtcctgcgatctcattgttgaagaagcttttttggtttacgtgatcaaagtggaggtatgactcaagcattaaataattaaaatattaggactttaaataatcgaccggcttataaaacatataagccaaaaggttgacttgaaaagccaagccaataaatctaagcccaaataaagagagcctaagcaagtagcttattgctctttttaacttccgaggccctccaagcacgtggatgggagcataactggcatcattatttaatgcatgccggcctatccgataatttcgacatgttcataaatcgagctgttccactcccatatcatttccgacatccgtgtatatatccaaaagtgtacggtgtaagatatagtatgattataaccgtacgtctaagtacactatgtttttatccctacatatattgatggatgctatcttcctaaaactagctactacccttgtcctaaaaagatttatttttctagatgagtttccatagttacgtttccacattttgtgtagaaaagtgaactcctttttgaaacagagacaacaccagaaatagtaataatatatcagtatatatggagatgatttatcccgtcatgatatcattctagccttagctagctttgcagataaaatggatatggattactccaaatcaaaatggttctttggcatcattaaatctatctcagaaatttatactgcatcaatgcactccaacctaaaactaatctcatttcccccattttttttctttttcgcttttccagacgaccaaacgagacgcacgcatagcgtctctcgtcacgagaaaaaccaaaacgacagtaaagagcgctcgcgtcatcactgacataagggcccccacccccctggttggcccctagtgtcattgacctagtcagatggacttcctgacctcggagaccgcacacgcgacccgacccgcgcctctcgctgaccgccctggcccacgccacccgtggggcccacacgtcagcaactcaccccgcccccacacccctcctccacagctgtcgcgtgccaaacagagagacggaactcttcctctcgccgaccggtgggacctcccgaccggctcaccgacccaccgcggtcgctgacagtggggcccacatcctcgcgtaccccacctgtcggtgagtgtggcgtgcgtggccaccggtggcggcgcagggcgtcactgagggtgaggcgctcgcgcttgcggttgtagcatataaagcacgccgcgttcacatcgtcgtagtgccaaatctaccaactcttctcccctccccctcctcgcgatctcgcgctctcgacctcgtcgccgccgccgatcgccgccgccgcagccgcagccggacggagagtcggagaccgtatggaggtgatgggagcggaggaggcgaggacttcgagggtggtggtggcggcggcggggcgcagcctcaacccgaacgcgaaggagttcgtgccgcggtggcaccgccacgccgccgccgccgacgacgacgacgccgccaggaggacgaagctctccgcggacgcgccggagttcgtctacgaggggttctggcgaggcgttgatggtctcaccggctacggctacggctacggcgacggccacgacggcgcgccggaggagctcgtcgtcgtcgtctcggagcgcctcaacccggacgcgccggagttcaccgccgccgcctcgatccgccggagaagatcgccggggagcgggaatggcatctcctccacccgccactggagtgtaagcaagagccgcttcttgcactccgtaatttcttccttcgatctctttcagatcacaaatcgtcgatgaaacttgattttggtttcgatttcgatttctcgtttcaatcgtgttcgtatgattttgatttcgatttcgatttcgattatttctcgtttcaatcttgttcgtggcgtcttggtttacagttttttgggtttacgctttccttttcgggtggcggtagttgcatgtgttgaaaatcagggcgaagaggcgcagatcggtgggggagggggtttatgtttttggtatagggatagcgtcagatcgaggtggttgcttatttactgtgagctgcaagaaagacaagagggagttgttgcatgctttgagtgtctctctctttgtacatttgaatacaaggagggtttatcatctattattgaagacaagaaaaggaaaattctatgcatacgtactaaattttgttttactaaactcttactaacatcaacgtgttacgctgtgag

SEQ ID NO: 50212 - DNA, 2843 bp, Oryza sativa
tatatatatatatatatatatatatatatatatatatatatataaagagacagagatatcatgcattttttttctagggttcaatttttaggggagatagatccatgtttgggggcatgatctgtgatattatctggtttgatgtgacggtcacatgaaagaaactacttcaatctttagatgcttgatttgattttggttcttcaggcagggtggaaactgaaatagtctttccccttggtttgggactttttcttctttgtcttaattagatcttttcctatttagtccgtttccacttttggttcgtcctttttccccctcttttggccatgaatagctactttcctaaagttccatggatgcatacatggtgcatatatatgtcactaatgctctctctctctctcactatgatctactatatactccctctattttttaatagatgacgccattgactttttctcacatgtttaaccattcgtcttattcaaaaaatttacgtaattataatttattttgctatgagttgttttatcactcatagtcaaacatgtgagaaaaaatcaacggcgtcatctattaaaaaacggaggcagtattatattacggtgccatcatatatattccatcttagacaaattcctaaaattttgaggtccctaattaattaattcctatctactgactacatttttacagaggaggggtagtagaaacttctcagacaaggaagatcagccccgttttcttctagggtgcgaagggcccagaaggaagagtttgtgagaagaacaatatttgtcagtgatatagaccatactgtaagatactgatatttccatggattgcaatgcgatgaattttattttctatggcttgcatatatggagtaatttgtcacatccaaatataatgtgtgacacttcatttgtttctgaaagataataatggtatgcatttgtgtgtttcaggttactgaggacatgttagctgaactgttcgggagctattgcagcgtacgcctcttccttcccatgtgtatatatatgtgcctgagtaaacatttttttagctccactattttttttatccttttctttttgcgaaacacagtgtagatgcaagcgtttatataaacacgcgcacacttagcttcactagttttctaggtatataactgtgatatgtatggtgattgagtaagactgctttcgatatatatgaaaaacttttgatattgtgatatatatcattcatatgcatatgtatatagtaaccaaagcatcatcatttgcaagtgccaagcacaattatgttcatgtgacgcactaatttcttttttatcctttgaaaggcttgaatcaggtggtggaacgtactctttagaagtatgtatatgccagtttgtaaaattttatggacatgcatgtttacttcagaagatttttgtttataacagggtcctcttaattatttggttctagctagtaaagatagtgttttcataaagttagattttaagtgaaacgaataatcgcttcgtgctatgctgggagcaatctaaaataacatgattttctctagtttgtaatgtcctaaacgccttaaaattcgttgctctagtttaatttgtccatatgttgcaacaggtggtggtggattgccgcatctgtggagatcactcatctggccttaggtttgcatttattgaatttcaagatgagagtaagtggcacatttcaaacctgaatcttgtttttcatcaatacaagtgagaggttcatacaaatataatctggagatataacatggaagccccctttttttttcaggtgatgcttatgctgcattggatcttgatgggtatgttcttggcatttgccctcttagggtttcaccttccaagactgcaatcatgcctgtgaacccttcttttcttcctcaggtcagtacagcccaaggaaccatgttattgccatgatttataatcaagatagatcatcccattttcaacatgttgtgtactcactcttaaattaatttgttcggtagtctgaagctgagagggagatgtgctcaagaacaatctattgcacaaacatcgacaagagtgtatgcgaaaccttaatcctccttgagaaaaaattctccaataattaagcagttgtctccaatgttaataattaagttccttgttaacttttataggtcaatgtaacagatttgaaatacttctgcgaggaacactttggtcaggttagaatataatcatctcatgaattgatattcctcttcattaattatttttcagcagcacacactgtatatatttgagatttattctggtccaacaaaaaatacctcgagatatcggcacctcatagtaccaaatcgtttttatcgttggatctacctggataggattggcattgttggactggagcaaatctcatatatatttatctgaattttttgtaccgtaatatatttatctgaattatctcgctttcttccatttcatggattatatgcaggttttccgcctaaaactgttaggtgatgatggtcaccccacccgcatagcttttattgagtttctgaggtgactctctcaaatatgtcagttctcaatgcagtaattttcgcacattggttggcttgaatttaagtatagtagatggtgtaggagcaatgtaataataaacatcctcattaatttcctcatcctaataagcaagctgttcttcttaatgatcgataatcgatcactagctcttggtttagatcgtcctagcttacagcccatttatatgcatatatgtaaatgccatgcacat

SEQ ID NO: 50213 - DNA, 2179 bp, Oryza sativa
ctttaaattaaataaaaaaatatataaaaacacttatccgcttcccgtccctaataggagtactaacaaacagctgtactgtcctatcctatatatttaatgtattactgctatattattaattactagaaaattacccgtgcgttgcaacgggtaaatacgttttcttagtgattgaaacattgcgatcactatactttatgattaaaaaatttaatgaaaatcctaacactgagattgctatccattataattaaaaatttaatgaaaatcattccttcgttttaaaccgaaaactcactcgttccttcctttaaatccctaggccattatgtaacctccactcaggctgcctcactttgaaccagccaacaagtagagccgcaggctcagaagattattgtctttaacctcccaaagatagaccaatgcccatacgacgtcggagcagatctttcccatcaaatctgactgaattttgctcgatctcccaaaattggttgagggctttcaatccactcgatctactctttccgtcttccaaaatcagaggtaaaactcacgataaaaacaaccggggaagatcgcctatagtcggagattaaatctggtaaattaaaagtcgcatcaaaaggggaaatcatgtagaaaatgatgagagaagagcggggaatcgattttttaatcaattagagtagataatgcgcaatcgacatgaaggcggcatggcgctagggttcggcccgggcagcggcaggaggtgcgcggatggcgcggtggaatagatcggggaataaaacggccaaaaaaaacccagacggaaactgaaaaaaaaatggaccaaaaaaaaccagacggaaattgaaaaataaatggacaaaataaagcggtgcaatagatatcagttgggatcgggataaaaaagctgcaacaaaagaaatgatagaaaccgaaataaaacaaacagaccgaaataaacagaagctgtgattgtggcgtgttcgcgagtcggacaatgcgcgggagtagataaaaaaaattaaaaacctaactcgatacctaatccaacatggatgacgtactaaaattctggcaaaaatatctttaatttttataatagtaaagataaaaaaaaactcgtggaaataaattatatacttgctcactgatatattagtacaattttttttatactagaaaaaatgcccgtgcgttgcaacagttaaaaacattttccagtggtacaaccgctattagaaactgagctatattagtaagttgtttggattcaagggttattttgagagctatttgacctttaatgtatctttccatggagagatatagagaaaagatatttttttagcgggcctacccaaaatagccccaattagcacctcttgggtgggatattttttgggtgggttatttccaaatagccctcaaataactcatccttttggttctttttgggttatttgggctatttgagggagggctagccattatgtagtcctagtatactctctccgtccaaaaaacccaacctataatgaaatgagatatatttagcacaatgtgtcaacctcgttgtattagaatatgtcacatcacatcttaagttttttttactgagggagtaattagtagtagtactccatatttgttttgttattattcttttgtgagagagaattaaattgctactagaaacgaagagggagacgggtaagatgggccgtgctgagcctgggcctgtggcagagagagggagagagatatatgcgtcagatggaaccctaactgaaaatccgaaatccatccatgtccaagtcgatgtcgttcgccggaacaaggatgatggccgcggcggcccggcgcgccgtccactcccagcctccgtccggccccctcaccgacatcgcggaagaatcgcaggttgagatcgtctgtttgtttggttggttttggggatcgatcgatctttggttgctgctcatcagttgattaattgaattgatcgctaggtgatcagctccctttatgaggtggcaaaggcgaagaatctttcccgggtgccacggcagttggatccttcgacgcgggtgcacatcgctctagatatcgagcacaaaatcagcatgatcaggatcggtgctagtccttccgaaccgcaagg

SEQ ID NO: 50214 - DNA, 2116 bp, Oryza sativa
ttagcaccggttttcacttcgtgtagcagatgccatcactgaccgatggtttcccagtcaaaagttccagcaagttgtctccaaaactataaatactggcagccatcgccaacctcattgtgtatgcatattctgcaatcataattcaacagaatttagtttcagtacatatctgatatcccatagatttcggcagtgttatccgctagatgacgggagggggatgggggaagaagaagggcgggagaggcgctgggagggggaggggattaggtgactggtgcgcgggtaggggtggcgctggcagcagaggacgtgatgtcatgataggaatcggatgcggatgaagcttagagaaacgacggacggaaaatctgtggcaattggaaaaatacgaatttttttaagtatatataggttagatatgcataataaaaatgatgatacgtatgatgaactaaaaattgatcttggtttgcgttgcagatcactccgtggggacatttggtttgacaactgttgggcaaacaatctttctttagtttgtcttttatccacattgtttggggtgtgtgaggctcgagccaaggagaatcaacagtctgaccatatgtcctcctcgtcaccaccctcgtaataaattattatgtgtaaaatcatgagttcaaatggattttattagattatagtataatatgtacgtcttgttatcttcattatgattttacctcttgtggtatttatgtactccctccttttcacaatgtaagtcattctagcatttttcacattcatattgatgttaatgaatctagacagatatatctagattcattaacatcaatatgaatataggaaatgctagaatgacttacattgtgaaacggaggaagtattattagtaccaacctccttaatttaaaccttgtgtgttcttaatgcattactacctccttaaatttaagccttgtggtctttattattagtacctcagtaatttaagccttgtggtcttgatgtactaacctccttaatttaaaagccttgttgtcttgatccattagtacctccttactttaatttgtaggcagtgtcacaacttaagagttaagagtaactttaagtggtacaactatatgtttgtctcgaacttttttatttgtgcatgactccatgcacccaaatacaacttgctcacttactttcatgatgccttgtggtgaactgtttgctatgttgttaagattgctgaaatatttgtggttaagacgcatctttgttcattgttaccgacagttaattgatgctttatgaacctcctattctcaaacagcttcctagcaagatgatatcttgttacttttttttttttttgcctataagatgtgcttgttttcctaggtggctgggctggtgccaagcgcctagtcattcttggtggctgccaagcttcttgtttggtgttattcgtgttaagtgatgcataattgcgatgagcaggtgcttttgttcaaataatggttcatactgcaatttccatcgggtgtcctttcagcagatatttcagtgctattggttatgattacctgttgttattttgctccgacgtgtacaataaaatcgccgaggctgagagcctttatgaggcacaagcacaagtatagcaatcaccttatagtatcacccttatactaagtggaaaaacaaaacttgtacaccgtaataacccctcaatttttttctttaaaccgtctgctttatatcctaataactcaattttagtatcacgcttactatggcaaatgctgtaactagaaaatgtggagtgaagctgagatttgtaggtcagtgcctgtttagcacagctccatctcttttaaagttagagtcaactaaacagtttcagctccacctaaaatgagagcggagttaggtagagttttatcataaaatgaactagagatgtgaagctaggtttagacagctgtacaactccacttcagaccaactcttataactaaatttaaaaatttgagctctaccaaacaggctgtctgtactactacccgcttgattttgcaaatgcactacacgctagctgctttctgttccgggg

SEQ ID NO: 50215 - DNA, 24410 bp, Oryza sativa
cctagagttagtctctgtatacacggtgaatttgatgtttctatattaaattacagtgatttaagattttaaattttttatctatattaagattatttaaatattatccacgtaattgtaggaatacccagcttcaaaaaatcttgaaataaagttgtgtcaaagaggactctgtagtgatggttaacgaagggccattttggtttaataccaaaaacatgccctactaatttattagcaaatgtaaatagtttgtgtgttagtttagattgaggtcaaatatttggtagtgcccctatcctatttggttatattttagaagtttcttcactaaactataataatattcctttatattggtagcaatccaaatgttagctaaataattttaccctatcaatattttagtagtgctaaaatttacctagagtgtgatattaccaatgaattgatagggtaaggaaccaaacaagcccaaaaacctcagcttcaaaagaaaaagaaaaaaaaagaagaatagacttcgcatacatgatgatcatcacctggtaatacaaatcgccaaaggattaaagcatcaccaacataatgtatataatccaccccaaaattttgttttggtttcttaaactgaaaatagaaagtgaactcatctctttaagagaaagcctaaataaaaactaaaaatggaccattcttttaaactaccaatagaaatctcccattccatcaaagatcaacgctgatctccctccccaacgccaatttcccccaccacaccatcccatgtcagttgttctttccctctcccctctattccccactgttgctgcccccacctctccctacttgcaggggcggatctagaaaaaaatagtagtgagggctgaataaactacatcatcataaatcaaatctccaatccccacatcttatgaatctatggaaaaaaaatagtgggggcttaagggggtctgcactgtcccgggagcggtagtggggtctcaagatccccctccccccaattgtgagtccgcccctgcctacttgccctcgttctgctaaaaaaataggaatatgagtcgtcgaaacaacttccttcaaatgctactagacgatgagtcttcgtcggatgacgacgatgaattaatttttgaggtagttgaaacagtgtatgatagtaacagttttacatttagatgcaaaattattttgcatctaaaatgttgaaaatgattttcataaattagaaataccaaaattttccaactaaagacctaggtgagtctaatataacttgtgcctatatgaaactttgtgaataatttaaacatttttcctttctaacccaaaataaaaacattttggattttacttgcattgcataataggtcctataaataaaatgtagggagtggcaaagttcttcaatcatggccacacctaggaggggaagcaaggagttgaattgaagatgggggaagagaagctgtgaagtgttttacaaggatgtcgagcttgccaccgtagaggctggcgacctcgcggagcatgcgttccggctggtcccggacggagacgtcgcggactgagccggtgacgcggaaccccctgccctcccactccctgaggcgctcgcccagctcggcctcgttcctggagcaggtatgcacggccgcccccagcgccgccagctcgtccaccaccgcacgcctgcgcatgaattccccgcgttgatcgtagaagcaacagaaggctccgcggcggaggtctccctagccagcgagaaggggataagtgtgttggggtgagtatccgatgccgccggcagggttttaaatttcgaaattgctatttctgtcgaggacactgaaattttagaaatttcgaatttttttgaccgaaattatttaaaagtttaactgattttgaatgaatttgaatacaatttgacaaattcacaaaaaaattgtaaaaaaacgaaaatttcgggcgagatatgagcttgccggtgggagggcaaaattaacgaaatttcagaaattttgcaacgaaatttcaaaccctagccgcaggtgtcgccggtaatgagggtcctcttgctggccgaggggccatcttcccgcatcgccgctggccatggccttagtactgtggttcctctttgctctagctatggcaatcctgtcccatctgtttgcaggaaggatgggggtattttgcgaagaagtcctatatcggatctgttctttagaaaaaactcttcgaaaatatatactgtaaagtttatatagtgtacaaacctagaaactaacattggataaaaattggacatataagatttattcacatcactcttagtaaatttttcactatttgtaatttttttattaagagtataaattttactcacgataatgtggagaaatttcatacgtctattttttcatataacgattgttttatatttacactacttatcggtagttattcggttgttttgtgaaaagatcagaacgcggtaagcctgtaatgatcagaaattttcacataaggtctccagactcgggagtccggccgctatgatcgatagcggtccggtctctactactctctccgttttacaatgtaagtcattttagcattttctacattcatattaatgttaaagaatctagacatatatatatatatatatatctctatttagattcattaacatcaatatgaatgtgaaaaatgttagaatgacttacattgtgaaacggagaaagtatcaagcttcctccggatgaaccgtgggatgctggtcagagagagttagcctggagcgttggccagttcggacttcggaggatacaaaaaagtatctaaattcacaacacaaccattctattcatgtcttcttcaccagcaacatctgttcaatctccaaataataataataataaagaaaaaaacctaattaaacaacatcttcagttcacctgcctttagcgaggcttcggttggctttgtctgtaagagcttggtcgatcgctgctgtaatcgctgctagtgtttccctgactccccggcgctcttcttgatcgtggcccgatggactcacccgattccatgatggaactgtaggtatcttctgcgtacgtagtcctaaatatagagtttagatcttctccatgcgtttgtccttgcaagtgcttcaggatctgaaaggagaaaaggaacttcttgtcacatataggagtatcaaatatcagttatttggttatgtagttattgttctattttattctggaacaaggcactaccactacttgtacagttgtactgaaggtttagcagtttcggtgtttcaaactcaaaacttttcagggaaggaaacgaacctgaaccatggatggacgcagatgtgctgattggcgcacggcagcggcggcacactccatcattcgcatcattttgttttcatcataatcatctccaatatccggatcaacaaggatatcaaagttgccttcctccatagcttctgaaatcaagggttttgcctgaagaagcaaattcagaaatgttctatcaggctagacatcaaagttcctcttagaactacatttattggagtgaaggaaatgtattagatgtcaaggaatgaattttgtcaagattcaagaacttctttttgttagaaactgacccaaccaactaacgtgctgtccatgtaagactcagatgactgaaccggcagccttccagttatcagttccaagaggacgacaccaaaagcaaagacatcggctttgtcagtaagcttcccgctagacaggaactctggagcaatgtacctgcagaaaagaggatttgctatgaatacaatgagggataatatatacttgtgctatagatattcatgttcagaaattagaatgaacaaactcggaatacatagggaatgctgaagagaagtactgacccaaatgtgcccattattcttgtggaaacatgggtgtggtttcctggttgctactttgctagaccaaaatctgcaacctgcaaaggatcaagacatactgagtataggactgtgcaatataatggcatattgtttgcaattcaaacttgtcctgggattgcttcaaaaaaaaaacttgtcctgggaaaaccagatcttcttgaaacgttgaataatatgtgcagagagagtaccttgggctcaaaaccatgatccagaagaatattggatgccttgacatcacgatgtataattttaggagaacctgaatagtataaacggactttttcgtattaaatcacagttcaacactagatacgaaactgaatataagtgtataacgcgaaatggatgggtggagtagaactaacagtcatcgtgtagataggccaaaccccttgcagatcccacagcaattttccatctttgctgccaatccagaggtggccacttgtcccctgaattaagttcaacagtaacatgatcagatcagagtaaaaaaccaagactaaaaaaacattgactaaacagtcaacggatgcatttgacagaagaaaaaacaaatatgtaaaccattattttttttattcattttagatgtagacataggttttataccgtgtaaatgcgtgtcgagcgtcttgttggggacgaactcgtaaaccagcagcctgtcgttgccggagatgcagtatccgacgagggagacgaggttcctgtggtgcacgcgtgtgatgatgtccgcctcggcgcggaactcgcggtcgccctgcttgctctccgtcttgagcttcttgatcgccacctcggtgccgtcctgcagcctccccctgtacacgcacccgaatccgccctgcccgatgacgttgtcgggggagaacccgcccgtcgcggcggccagctggtcgtacgagagcgagccgccgtcgatggagatggagtgcgggcgctcggagccggcgtcggagaacgtgccgccgctggtctgcggcgccgtcgggtggtggtgctgctgctgcatgaagacgaatggcagcggcggctggtcacctgcaagcaccaaagtgtggtggatatctccgacgacgacgacgacatggacgtacgtacgtacacgacgtcgaacgtgacaagaatcacaagatgcgcgcacctttgtagtaggggttggggttgtataacattggcggtggtagcggaagcggctgggcctgttgccgccgccgccgccgcctccatcgccggatccagagcgcgagcacgtacaagcccaaaaccagaccgacaaccccagcggccactttgacggccacggaattcaagaacgagggcgagcccgtctggggtgccgcgggtgccgggtcggacgccggggccgtcgtgatgatctcggtcacggcacggcgtgctctctgcccgtggccggaggagatgacgacgacaccatgcaccgtcgtcggtccaccggtgatggtcaccagggcggccttggcgcgatccaccacgtcatagagcctcgcgaaagctgaggctcttcagggggtacatactgaggcggtgggggtacgaacgctgccggccgtgccatctcggccggttgggaataccggaaacgcgcccacatcacccccgtctgcggttgtgcgtgtgcacggctcggtgcgcgcgaaacggaggcttttataatgggttatggcgagagatttttaggtaaaaatatgttaaatgtaattatagtataaatatagtgtaattacatactaactatgtttttaatagatcacatcgttgacttttgaagatatgtttaatcaattcgtcttattaaaaattttatgcaaatgtataagatataaataatgtttaaaatactttcaatgataaaataactcgcaacataataaattataattacgtaatttttttattaagacgaatgataaatgtatggcaaaaagtcagcggcgtcttctattaaaaaacggaaataatatatatgtaatttagcttcttagggcatccacaatatagtctaaaagtggtccataagcaatacaatatttgtttcagccacctagcaatattgtggaactagtccatagcaaagaaataacaaaaactacccataagcatataagcatatgggctaccttccatactcgtaaaggaagtcgtttaggataatgtttaagtcaaacattgggaatataaatcatgaataactctcaagttgttgagtttaaaaatgtaaaaaatatatgaatagatttgtcttaaaacatactttcataaaagtatacatatatcactttttaataaatatttttatagaaacaagaagtcaaagttgtattttggagactgtgtcgctgtccaaaacgacttcctttatgagtacagagggagtattatttgtctctgtcctatctatatggattattttgatatatacattgttgttgccattacaatataaatacacgctgatacctttttcatgaaaaatttgatgacacagaagtccgtttgtaagctctcactccttctgtctcgctgagctgggctggcggttttctcctcaactatgcggcgcgtcatgcctctgtttccgcgcgaaaacagagtgcaagttgccacgggctgcacacgaaagcggagacgaccactcggttttggaggtgggaacagcagagacccactggaggcatccaccaatctgtggtgttggtaacaccgtaagtactcctacgtaacaatgacagaaatgagcgtggcaaatccgtgggccgaacggctggagatggcagcacggaccgggacttgtgctatcatccaaagtctaggtttaatgtgttggcaagtgtgtataggaatgaacagttgtcgctgtccagaacaatgagttgacgttcacttttcaagacattaaacgtgtaatgagtaatcagggcgctctatcgtgcgagggttaagtattaacaagtcaaattcaatgatgaccttcatcaacgttaaaaactggataagttaactagctggccattgtcagcccagcagttgtgccagtagatcagatactgccaatatgtagaagcgtgtgtttatactacgtcgtacaattgctcgtatatatatatcttgagcagcccatcgttttacaatttaatatgttgatgaagtacaatactctctcaatcctaatataaatataactttgtattgatgtgactgtatgctcagatttataactatagaatataccatatttgtacaaggtaaggtttcacttgtattgagacggagggagttggagggagtagagttcaactactttagtaggtaaaactataagaataatatgtaggcctagaatgagataagttcatggggaaggattgggatcctttgcattagagtacaaaaatttgcaccatccattcacaatcaattcactaaacgaagcattttcgagacttccgcgaaagtcttcttttagcttgagttcatcggcctgttggcgtcccattttttttccgcttattactatcttctgaattaggtagagtgggagcactcgacgaggcatctacgacagtagaggctcttcctcgtttttggccggacaattctataaatagaatcaaaaaccagaagaattgtgagaaataaatcaatttattaagttgagacacatcgagggataaaacatttcatactatcataagttgattccatttacaattgaatttttttttctttttatgtgagtaaattttattttgggccatgtatttttacccatgttgcagcttgggctaggttttagctgagtttttcaccttggatcacttaatataaccatttgtttcatcctggaccatagccgctcatcttctccgagtccaacaggcgataacccatcaccaacgtgcccatccgaacaagcgttggcggcagcggcggttactgatgcgcttatttgatttgatcacaacacattagcttggttgctccatgctccacaatcccagccggccagccaagttacacctacaaccaaatgggcaatggaacatggcttccgttcactgaagcaacaaaaattgatgcaacatcattaaaattagaacaactcaaaccatgcatttgtgttgcctctgtccctaatgtaagcatcaacaaattactagttgctatttgaatcgattcccttgcctcgcctcgctgttgtcgccgatccgccatgagctcgccggcctcgccctcgtcgacggctggcgtagtgcatctcgacaacacggcagctgagagggacgtgatctagcaagccaaaatggccctcatggcctagagctaacctgccgtcggctgaacggagaagtgcgccgcagtgcgaatcagctgtgcgttgctgctaaactcccctcggataggactaggagctattggcattaatcaagcacttatccccttgtgctcaccacatcctcctcccatcgatggcccaaaatgctattcatgatgatagtgatagcaactcaagcagtactaacgcactgcccctggtccaaactgctatattttgataaagttagatggtgttaagtgaaaagattggtaaatccctggtgcattgtacaactaggctaataaaaaggggtccaagataaaccgaatcgaacaccgaagaaaaaaaaccgatatttaggttcggtcctttgattttcgttttgtttttatttggcccaccacaagtcaatcgcgcccctttcttctccccaaagaagcacaagaagaggaagagcttggcgacgatggcgagcggcagcatcgtgaagaaggaggtcggcgagaaccacgacgtgctccgcttcggcttcaacaacagcgtcaagggcgacctcgcgccgcagcacccgatccaggccaccgtccacaaggtacccgtcgctgcttcccctctcctcgccccctcgaaaaccctaacgcgctgaatccgggtgattggtggtggggcttgcccgcgcgcaggaggccaagttctgggcggataagaagaggttcggggcggaagccatctacggatccgctttcaacatccgcaaggatctcgatgcccaaatcctctccaagtaatttcactatcctatccccccatatgatttcgctgggaaaacgatttgttcgagtaaataatcactgcggttcatgttaacattagataactgtgtcggtattacatagcatatattggaattgttagggtcaatgacattttgggtggaattcctcaactcaaatggccttattgtgggacgagatatgtttctttgaatttgatgatggcatgtattccccctgtgtttgtctgttagataaccctcgcagtacataaaaaaaaacctcgcatttacataattttctgtaggcttcaattaaaaaataaactcaaggtctcgaaggatcaaattaaatatgtacaaatgaaaaaccccaaacaaccagatgttgcgtaatcattagcatgcaaatcaaacaggaaattaggggatttcgtgggttagggaaaataatctcacccgatcgctcgctggctcattgttgcttctcatgagacaccagccatcgcacttgctgtgtttgtgcgtctacccgaggacagtacaaggcaaagagacaaaccaacaaacaagttagtttcaggttgcgataacaggcatgttagctgctgttgtgtcgggtactcggatgttgtttatgggttgagcaagagagcaaataatggaccaattatgtctgagtattggtgtcaaaagacaaggttctctggtgtcacccatgagagaatagaatagagcacttggaacaggccaaagccattggtatcatgtgacaccactgctataacgttggatccacccctattttgtgtgtctagttgtaaatccgttagctctttgcatttactgcaactattttgctcttattgtcgtatgcatcaagtgtcagtgatgttatgttttgtggtcatcagcggtattctgctaactgttactccctccattctaaaatataagtcacaaccacctttaacctaaagaccaaaaaacaataatcacctcattgtttgaatcatcataataaatactaatgcatgcaccctatagaattagagatcttgagggtgaaggatttaagaaataataatttagtggagaggaggtgctagttaacagcctcatcttttggcttatgcttatgtttataagccaaaaattgaattttcaaccttaaatttggaattgattttggggttttttcatcatagtttattttccagcctttgtcttttagatcgctaaaaacacggatataaaaaatttatttgcaaattattttctgtttacaaatatgccgtttcacttattctgtcaataagcgaaacgatgggggtcctaatttcaatgcatgcatgcacaccttgtattatgaaacgtgaaaaaaagtagttgtgccgtatattttggaatggaggtagtagtttgcaagttatttctgaaatttgttctcgtggctatgtgcagtattttgagcactgtttttaaggtgtttaattaggtcctgtttcttcaagagcatttccacaaatcaaatattaggactgctaagaatgtattaatgctttgagtatgctaacatggatggaatgtctggattccttggtctggtgaatacacaatcatatcttgaggttgctcttgtttgtctctccgtctctccgatgtagtaacaactaacaactagcacatcagcgcaactgtgcaaataagggaaaacagcgtgcgcaactcatgcccaggctaacattaaagatgttttggttgatgatttatctgtttgcaggttccaaaggccccctggtgcattgccatcatctatgctaggatacgaggcgctgactggttccttggatgatttcgggtttgaagattatctcaactgtaaggcttgttgtcctttgatttcctatgaatcttcttgctggcctttcacatttacgtgcaactatttgctcaccaacttttgctgatttattagctgcatgtttgatgcttatgttcttcattggaattatggaatccagtgctatcaagttctcattacctttatattaattctagtttttttattttagtagaccaaaaccatgtagtcttatgattccttgggagtttagaagttcttgggaaaccaagggtcatgaaatgatacttgtttttcatttttcatacttctagtcggtacatcttgataaaattttgctattaggatatacttggaggaatgtataataattatcacaaagtggttattttattctgtcctcatgatatgatatattaacagcaaagtacatattttgctttgtcatccaagcttggttggccttactttgcatggcaaaacatacatctcatcaccattttcagtgatgagatgtatcaccagaaatacagcctctatagactatatatatttcagtcccacttctgccctgggaacattttttttttcttatttacactcgctgagtgttcttcctgttgttggaaatgttacttagccttgtgttaattttctttttactttggatcatgttgcagtgccccaagattctgacagcttccatgctccagacatgcaccacggaatggaggttctccttggtttgtcaaagggaccgatttgccctagtttcaattgatttcacaaaatgtatttctcgtcttgcactgttctcctcattcaatatctatgtcgctctttagactgagatttcgatgcttgttttggttcataaccacacttgtgacgagattccttatccatcatgtagacctcacatgtcattgagataaaagagtgtgacaagagtgtctcattctagctaaagtgtggctccaattttgttagccacacattaggcaagttggtcaaaacattgtgtcaaccttgcataaatagaaatactcaaccaaacagtccattacgcttatacaccgtcaaatcaaaatgggacagtttcagacttggccgtggcttccatccatcgtcaatgcttcaagtgtggggacttcttcaacagccccatccattgtcgtaccatgtggttgatctaatataaaggcattccgagttgagctatttaaacaacccaactaaaatagtactccctccatctacttttgatagacatatttccaaatctgaaaaatttacttttgatagccatatttcaattcaatcatctatcctcttaatgactttctatgatttaatgcgtgactctccattcttccacacaagattggctacatgggcatcgagaaatgtaaatattaatgaatcgcttgtttacgaggaataattagtagcatgtttaaatggatgataagtagaattatttttccttggtcattgtgtcaagataaaatatgactatcaaaagtagatggagggaatagtattggtaaatctctctctgcgagtaaagttcggcggcatgagttcttgctttctttggaccctcgttggtacatgcaaatacagagcagcgagtaatgcaattctcgttccctcattgcatgaactacgttccaaaatcatctcgatcggtgcaggtgtaggcctaacctttctgaaaaatcatttgcgtctctgaaatactccactccaggcagcacccggcaaatgctagttaggtccatcatagttttcacttgaaaagaagcctgccgaaggttccaataatttgaacaagcaaacagaacactggaattgcatgtatgtctcaaaatcgcagagtattgactcctttttcggacacgttttatttgtcagttgcgactaaaaaggacacatagaagaatggatgtgctaaaaatgatcgtccgtcatatgaaagatacatttaatgtgaagagcacttggggcacattgagttgtttagagattttgcataacacaaggaaatatttagtggaaatcatcaaataaatgaaaacccatgaaagccatacttacatattctctaaattcaagaaaaatttgctagagataggtatatgcaagaaatacattcataccagatctagaggcgatagtggaggccgcggggtgcggttgccaaatctagccccctctcgttcggatctggcttgtccggcgctggaggctgaccctcaagccaccgccagcggagaggtgacgacgcggacgtggaggtggcagggtgaggtaggaaggacgcgacgacacgccatcgatggagggcatgcccgcgcggtgccatcggtggagaagggaggaagtggggcaccggctaggagtggccagtggcggcggtaggctggcgtggtgatgctaggaggcccacccgatggtggtaggactatggaagtccaacgcggcgtggcgatgcaagaggtcgatgcaggcaggtcgatgcgggtggcaccagcggtagcagaaggctggcatggacggcatcgggaggttggcgcgacaacgacaaagaagccagcctgactgatggcgtgaaggtcgacgcacgcgccaacggcaaagaagctagcctgactgatggcatggaggtcaacacagtgatgacagggagtccaatgatggtggtgtgtgccactaggcatgctgagactgactgacggggggtgtcggtgcagcagtggccacgtgcctacgaaggatggccagtggtgaaggaatggagcatagctatggatcgataggggtgagaggtaggtgtaaaatctagcttggtcttaacggcctgggaaaaacacaagggttaacgtgctcaagtgaattaattatacttctatctctcgataattcaactgaactgttgtcttccttgtaaaatcaaacttagttatgctacttcctctatcttaaaatataaaaatctagtaccgaatgatatatttcctattgctatgaatatgtatctatagaaaatgtttcattcaaatttaggttattatattttaagacgtaggtgacatctaaataccgttagtatggatttattgcttgaagttgccaacgtgtggtacgtgtgtgccatatgcttacgtcctcgtctatttaggcgaacggaacagccaaaagaagcaaatggaagcccaaaatggaaggcagaaggaagattatacaaatccattgtgacttgggtttaatttgtgggagcgccggagtagcctgtcgatttcagtaatgccggccagggccagtgtgcactgtgcagcgatgaaactccatccatgggcgcggtcaaatccgggggggagagagagagagagggaatgggaatgcgtttacttggccgggacacgacgtgcagcctcgtccacgtacacgcgagcaaagcagtgaaatcgcccgccgcgacaacgagtggatcggaggggagccaactgtgaagtactagtactactaagtgcggtacacatgtactacctgccaggccgcgactctctccttttttttaaaaaaaaattacacaactacaacaacacacgcgcactcacctttataaacacacgcacgcaaaacctacccctatgaatatctttgaagactagaccatcaaatccttaagattgacgaagtcactacagacatctcgctattgacgggtacgtcgcctaccactaaaagcacaactccgataaatctagaaaatttgctaccatggaagttaaacccagtacctataagatatacaggttttttcgcgccgcgactctctccttggcaaaagccggcgcttgtatgcatgacacgcgtttgtgacagcttacccaagtctaagtacgtctttgtgccctctttgactagttcaatattctctccgttctaaaaaaagacaaaccctgggttttcgtgtccaacgtttgactgttcgtcttatatgaaattattttataattagtatttttattattgttagatgataaaacatgattaatactttatgcgtgacttgtttttttaattttttttcatattttttttcaaataagacggacggtcaaacgtttgatacggaaacctaagtttgtctttttttttttgacagagggagtattgaacagttctcatttccatacttgttatcgtgcaaaagaacttttcgcacttctaatcactagtttagtattcagaagtttggaataaattgaatttaagcttattaataaatatgaaaattagaattcttagacgtatgtactttgcttctaagttacacacaaaatatatcttaatgttttttattatattatattttgtggatttgatttttttggaattactcaatacaagattgtcatgtggagtcttaataactattattgttttattggctgtttttaaaatactccctctatttcaaaatacaagcatgtctaatttgtttaatagaaattaaggtttaatacaaaatactttgatgcccctcatgaatggttggggtgagagggtatttaaaggtaagctgggaagaaatttaaatgatagatgattgatggaataaatagtaatccgaacagtattagaattgtttatatttgataaatttaaaatgtgataagtgtttatatttttgaacagatgatgttagaaccaatatatacataaaaaaagtttctaggatatgattttaacaaatgattcattttaagaagtttgttttttcttggatgaaggggtagttaccatttactagagtttggattttctttttcatgttcaatatttacattactgatagtgtgagatggaatcttcatttatttttatgttgtgttcgaatgtgtcggttcggaacatatttctccaacatgaaaaatgagataggttgttagcacatgattaattgtattaaaacaacttaaatataatttttcaaaacaaatttcctaaaagatgtataaaaacacatcgtttagctggaaagtgtacagccaaaaacttgagagcagaagttgagaaaggagacatttgaacgcagccttggtctccttggacaaatggccagatttactcaattttattcgattaacgtggacgttttaggaaatataagcatggatattatgcatataatgattggaatcagtccgctggctggcaggctgatggtggaacagtgactggattcatctacagaaagaaaattcaagatttaacaatcaccaattttattctaaataacattcattttatgagacggagaagaaatatcccgcagatgcacacctgggcaccaccggaatctccgtcccccgctccggggcgcttcactcccgtgccgcactggcccagccgcctgagacgacgtgaaccgtcgcccgagttccacacgcccaccccatccacaataatatatccaatccacccatccatcctgggagaaaattggagttgggacgcgagattctcaggcgagcacacgatctcgcggcgcgctcacgtccacgccctcgcatccacaagcgccgcggttaaaaaaccacgaggcatccccctccccctcccccgcctcctccgcggccaccacccgcccccgtcgtgctcggcgccgtcgctgctccgcctgaccaggtcgtcgcggaggctacggctgcgcgccgcggcggcggcggcggaggaggccgacgtgctccccgggcctggggccgagggggagatggcggcgggcgggaggctggaggagcagcccgaggggccgatcgggggcagccaggtcgacatcggcgggctcgccttccagggcgacatgggcggaggagggttcgccggcgggagcgggggcgccggggccggcggcggggacggcaacaagatgctcgaccgcggcatcaacacggccatcgtgctcggcgccagcacctacgccctcaccaagctcctcaccgtcgaccacgactactggcatgtacgggaacctttgtcgattccccccaaatcgttttgttccattttgtcttctcttctctgtgctgttcttgatttgattcgattcgaagctaacatcgttccgggcgggctgttgttcatgattggattgggtgcagggatggacgatctttgagatcttgcggtacatgcccgagcacaactggtcggcttacgaggaggccctcaagaccaacccggtgctcctcggcgactggattgcgcaggtgtgcaaacgctttaattttcctcttatttagagtaatagcttttatgcagctgcgcttgcatatttgctgattctgttgctgttgatgcttgcagtgctacgaaggcaagccgatcttcgagttcgaccgtgctcggatgttccggtctggcctcgtcgggttcacgcttcacgggtccctttcacattactactaccatttctgcgaggtaaacatcgtggtcttccatgctctactgcctaaagctttgtgtcatgttcatatatggtgaatgatatgaagccaactgtttttcttggctcaggcactgtttccattcaaggattggtgggttgttcccgcaaaggttgtgttcgatcagacggcctggtctgcgatatggaacagtatctacttcgtggtcttggggttccttcgtttggaatcaccggccactatttccagtgagctcaaatccacgttttggcccatgcttactgaaagcactgatatttcctttgttataataatgccttaattgagttcccatattctatattcttcttttttttttaagaattgaaagtttatgaaaaagctgtagttgtgcagttgatttgttgtcttcagtgttcttgacagcaaaaccattgcctgtggtcatggtttttggtactatgatccttaatttgttgaagggattcgatgaattcattgctctgtatacaagtaaattttttaggttaatattaacattttgtcctccaattattcttgccacatctattttctcaaagttttaggtctagaagccactattattgaattaaactagtataaaattacaacaaagctatgagaagtcattcaaattttgaactttttaatgttcaaataattattcaattttcccttctaataattccatccataatctttctataatcactgaattatttcttaatttcaaaacggtttttacagtgttttactgctaacagagaccttatgctgggtttcaattattattataggccggctggaagttgtggccttttgcacacttggttacatatggcctagttcctgttgaacaaagacttctgtgggttgactgcgtggagttaatctgggttacaatactgtcaacgtaagcccaaacatgtcaatttcactttattactacggcagcctgattaaatcgcgaaagataaaaagagttcttcatttcttataacaagagttcttcatttcttgtttggcagttactccaacgagaaatctgaagcaaggaactccgaggacgcatccacatcaaatgcttccaatgtatggaacagtttaattaaaaattcattctgtcagacatgttatcgttcgttctaacacccaaaattcattgcctcttctacaggacaattcaatatagcgaacggtatagccagccaagctgccctttaccttcatcattttgggcttgtatatattgtacaatttgtagctgcagctctgcaggtgtaacctttttgcaaagatatattaaacatataagatgtgtagcaactgccaaaggcaatcagaacgaaattaccttgcactggatcaactgttgacgagattatgagctatgcaattttggtagctattcttttgatctttgaaaccccttttcagtgaaatcaaccgtcttgcattgaaccttatatgatcgacaacgcaagcaaggagcaaaacctatacaatattttggggtggttacaatttacacagtattctatagacgctagcaaacaaacagcttgctcatcatcagacagaacatcttaaaacaagttttcccttgatgcgaacaaaatgctgtctgtacattttttcgtttttgctggcatgctttctgtacaatctgatgctatgagtaatatacaactaatgctactatttcgaggaaaaaaaaactactgcatggcatgggcaggtgtgctatgcccgtatttgtaatttacaaaattgcgatacttgtaagtttgaagcatgaaaacctaccagaattcatgaggccgttcacacgcatcgtttgcgagcacacaaaaaggagcatttccaaattacatgtatgaatccaaccaaaacttttctattgtgcgcaactatctatatcaattgttagctactgttgcacgcttaaatagttaagcatcactatactgcagcagcctctgtatctttgtgaccagcaatcagatctttaagcacagcctttgatgccaactttttcgccaacttgcagggacctgattttgttgcggagtatgtagtctctccagccttcacccgagcaatgaccgatgagactccatcaacatggtttttttcgtaggttattttgaatgatctacgatcacaaaattcttgcagccctttcaccgggtcaggctcgatggtttcgggggtggcaagaggttccaatagccgcttcatgcttctccaaacaacctccttgtcacacttgctgtcgagataaattgcaccagctattgattcaatcacatccccgagaacctgtttgtttgcaagtaaagcaatagatccagcttaagctattcgatggaaaatattacagaagtgcacaaaaataggttagtccaaacatataattctcctattccagtttacagtcagactaaagacattttgtggtcgtcatgctgtgatgcactatgcatcggaacctagttaagactatctttagttctttttataaattctctagcaactctttaatccaaactagaaataatggatctgatgcctggttaaattttgatgtcatcactatatggcatagactataatgtatccgaggtaatggtagagacctaggaatactgagtaatgactaataagatttaaaataaaagacaaacaaattaactgatcaaattttaccataccagctaggtgcattttcttttgcagaaaaagagaaacaaactctgctatcagactttcagaatatatgcaatatagccacctacaccaattacaccgtagagaatacacacctttggtagaccaatgcccgcttcccagccataagatggacctgtaaatgactgcccaaggtagtagctcatcttcctatgcagttctgatgatgagtgaaggatatgcttgtttaatcctgatttaacagctgcatgcgcgtaacaattgttgttcacagaggcagatctaagatctgtcaacaattctggagtacagtcagggtatttgctgtagtaatattcagtgaaaagatgatccaaaatagcatctccaagaaactcgagcctctgcaagggacacaaacttgtcattcaactcaaaaaagatcccaaactaacaacagctacttgagaagtttgattcagataaaaaagaagctagacaaaaaggcaaaggcctcatcaaaaatcctaagccttcagagcttcaagccgatgcatgaggccatcaacggtcaccgcagtatgaggaaggttctccaaagcagcagcgcacccatggaggatgtgacgtgtaaacgccaccaccactcggcgtaagctgaagcaaggttttcacctggagatcagtatgggctaggtggaactacaccataacggcgcctccaaggaggggaacagtgcccaaaggcgacgctgtcattcaaccagccaatggctcaacaaggttttcaccagttgattctccatccagcccacacaaccaatccgcagcacaatggcagtcgccggatcaccacaccatccctctagcaaccatgcccatgcatagcccgacagctcaggcatgctcataggactaccccgtttccggccacgccatcgacatctcctgatgatagccacaacttccaccctccaatcaaagctccccatgaccaaaactacagtctccagccatagaaggggaggagctccaagaagaggaagatgcttggccggcaaaaatggaagacacgccgtcaccactacccagctgcttcttgatcatcgcagatgcccagctttggtcgttgtcgtacctcgcacctccaccctgttgccaccatccatgcaccacaaggagctccaaaacgtccaagcggttgggaggagtcctctcgctgctcggatgctagcacgccccgtggctcggatccctacccctagcgaggacgcaccagatccagtcgctcaccgcggcagggctgcggtcgccgttgatgccaacttgaatagccaggaacacagcctcaaccaccgcccacgcggcccacttttgcgactaggacgaccgccaaacgcccatgcagctgctctgccgactgcactcgagcaatcaccacagcgttccggcggatccaacccagaagccccgcatcctgcctaaccggtgccagccactgttgcagcctctcctagcgctgccggctttggctaccatccaaagccgtcccaccgctgccgtagcaaccaacgtcacgcttagatctagctgccatccatcgtccgtgcgagagcccaaggaaaggaggcccgccgccacacggtttccggcagccagctccagcggcggcaaggggtgggaaggaaggaggtggggtagggccggcggctggaagcgccgcccgagtcgctgaaggagcgaggctagtccttcagttttcaggtttcagataattctacagcaagttaaactcaaaaggaaatgaaacatatagaggattgctaacatagaaaaaaaatgttgttgcaatactgtttaatcatttgcactttgttgagtaaagatcaaaaggcataataaagccgtgacacatactaaatagagatgatagatgcttttatatcaacctgatagcatgaagtagggccagaagtctgatatgagccatgtgtcaatgcttcgagcaataataaagaatcattgaacttgtaaccaagcattccctctaagctcctcacatcaatgaactcttcagctttcattgaaattttcctttcaactggaatttcagtgtgaaattctatattcatccctaatgatttcatcaaaagaaatgctgccttttccccagcagtactgaggtaagccccaattaaggcctcaactgaatccgcaatcctcttacttttaatagacattttcctttggctgtacataccattgggtgccagaaaggaaatttttttgttaccacgctcatcatagtccaagcaagggatgatccaatctcttggattaaactcctcagcatgaatgtaaccctgccaaccaaacataaagggcaagagtatcatctagtaccagtgataaaagacagataagtcttctttgaaacatgaaaaggtgaatagaaatattttatggtacttgaaaaataacacaattcattttgtgatgaacaaatttgtatgcaaagcattattttatttcatgacatagccctagccacatagcaccagaaacaaaaattagacctttaaaattgattggctgaaaggattacaagtcggttgagcggattaaagaaagctatttactatctcactgcacacgccgaagatagaatccgtttcaaggataggcagatgctaccattcttcccgccattcttgcttgccaggcaaagtaccgctgcttcaacggtcatgaaagcagaccacgtcaagccaacctcagatctgactacaggtgccatgtgacctgagggctaggtgttggcccaacaaggagtaatatggtctgagccacagccttgtattaacttagggtcagcaccacaaggttttggtcacctacaatagtctatattggcaacttggcaaacaattcaatgcaacaatagagttcccattttcctaaaaaggaaatatgtggaacattgcctaattgtgatatagcagttgcacaaaagaattgaaataggctgacatggtatgaaagatactgggagatgtaggactattaatattgcataaaattagcaaggatgtgcatgtaatcagttctgtagtgtgtaggtgtgtgtttctaaggtccttttacccttctttaacgcaatgatatgcagctgtcctgcgtgttcgataaaaaaaatttctacatgcctagctcaataagaaaaatacagttagcaacaggatctagagtaccacaagattactgctgcaggccagctggcacagagctgcattggagatcaagtttttcttcatttttgttaatatgccttcatgttgaagcctgtattcactaaaaaggtgccgagttgtaacatatttgaggaaagaatccccaagtgtttctaatgattcctgtgaaaattcttcttggcatttctttgttgttaatgcttccaggatctgcaactcatgaaaaaaatgcagagaaatacacatgtaagaaatatgcataggggaagtaatttattcaggtaacaagtaagaaaattcagattgacatgtacattgttaacagtggggcatccaaaatattaattagaaccataaaatactccacggattcaaatattcttatatcttatttttacaatataggaccatcaatccatacatggttctatagagtacaacacaccatcaagcacctccattggagtgttaatgaataatgcagacagctttttgtatgtgcttatatagttacattacgcattaattgaaggtatttatatgcataagaagttattaagtaccactgcctcatcaattgctacaaaaataaccaacttctacatggcaacaaaaggaattatttctttgctaagtgtccccgaaatatcttgcattatacatgacttaagacctgtcatgtttgcaagtagaaggaaccaaaacttatgtttgcctcattaatagatagtcacttcgaagtgctgaacatattcttactaaggcactgttgctgcattaaacaactaaaaaaatcagaacctttagttttcactgtcaaatgtcatcactcttcctacaacacctactggtgtgcccaagaatgcacttatatccatttttattttaaattcttcaaaaaataagggaaatatgagttttcttatatgacgacatctagttgatctaggtacttcaataattcataaatag

SEQ ID NO: 50216 - DNA, 4356 bp, Oryza sativa
  unsure (1)..(4356): unsure at all n locations
aaggaaaatttaatagtagcaaaaaatatgtctacaattaaaacaatctgcagtgccaatatttatatcagaagagcttattggtatgatgtacactctcatagtaagtactcacagtagaatgaaatctaaatttcataaaagtagcgctaaaacatataccatattcagctgaggatattaaatttggaaaactttacattcaaatattggaaaattttaaattcaatgtcaagcaagagtttacattttgggctacatatttaagaattcaattagatgtacagaaagttcagaagggtctgtaactcgtagaaactaaaacacctaaaaattttgtcatcaacaaatattaaaattcattatctaatcatgtttataaatgttctgcataatttccaacttagtaacttcgagggttttattacagataattgagtcaacacatgtagtcaaaacggaggatagctggagaaaacattatgtaatattactgcaaccagagaaaaaaaaacctttttcttttttatagtagtagttgtggaggaagttccgcactttcacatgtttactgccagccaagagcggctgattttcaaaagtcaaagtaagaccatgcctgagaaacacaggaaacaagtagatgtgtgcattcatagcttacaggagcatgtatgatacataaacatgaagtaataccgaaagggaaaacatatacctagtcttaaaataatctttgtaggtaacaacagtcccatcatgttgaggcaaacgggaatttgcatctaagtcaagaaacccactaataacataaaagatgttattatgaggggtacacacaatggaatttttaaggatgcacctgcagaaaggaccatcttttgtctgcagtaaatcaatatctctacaagaatggcaatgtgtcatatgtttgttgttagcttcatatattggtgaggatgagaacttcatactgcaccaatcaattctgccagaaactaaaggcagaagtagatagactactccaataggcacttgcatctcatggaagtatttaataccattgctaacctccaaatggtcatcaccaataagaaacgaaagaatagttgtctgaaatcttctagcaataattacctggacaaacaaaagttatatattctcaatgaaatggtctaaacaacaatagcctagttatcaaagaattagagaacataaattgacaatttacctgttcttgattgagatggatgatgccaacatatttcatggtaacactagcattgtcttgcccacctggcaatttaaatgagctagaagtaaagtcagatcccaaatcacacttcaaagctaacagtatgtcagttggagaagctgttttgggacatccttccaatgagatcttatagcaataatatatgccaagacgagaaaaggagcgccaattatccacaaattcttctggaaagtaagaaggctgctcaattttgttctcaacaactatatgagaaacattaaggcaacattagtgcaaagccccaatatatatcacacttaaaagccaacttcaaaaattacgacagatcttttactttcaagattagtgaagatatcaaatttagcaaacaaaataggtaaatttgaacaaactacgttcgttttgggacaggcatcatgacatgtatgtatccactagaccagtaaattatcaagtccatgaaaactatcaagtataaatcagtaatgcacgaaacacatttcctattgtaccttcagatataaccttacccaccatgcatcaagttttccttaaaacacatggtaaataattacttgcaaagtgtaaattgagtttaaaattttgatagcacgtgtaaaatacttttacttatgtgttactgcattatcataactcgcacaataaactgctccctgaataatcaattggaataaaatatataaattgcaacaactggaacaaattgaattaaactgcttagctgaataaccataccgatgtcaggttcttcatcacatggaacatctaattctggtaaaagagaatctgtgagtgcaccaatggcatgtagttcttggcaggccttaagacaaactgtctccttgagaatagaaccttctccttctacattaactgtctgcacaggactgctcttaggaagatgcagagtgcatgtgccagatgccttgtctatatcgaacgctggagttgactcgacacggtaataggtatcctcgcacaaggtgttctcaagtggttgacaagaaattgatcccaatctcagagattcctcccgcattatttgcccacttgcgagaaacttctttgcattagtatgagcttccacatcccccctgatgcagaaacgtgtataatgcacagtaataaaatgcaaaataggtcaagtaacgatgacaacaaaaggaggttatcgtgtcatctaaaatcagaaagatgacggataaatccacagcaagtgcctacaatagtcataggatctgaccaggtccaccatccaagagaattttggcagttccatactaaaaattcaaacaattatttcagttgaaacttattaccaggatgatacaccagttacctctggttctggaaaataccatcaggaaccataagtcaattttataataaaaaaaagctttataaactgctattactccctagtataatccagcttggatttaagagtcaacgttaatatttagtgccactatggatgatttgattcactacaaaaaccaactgatgaaatgggaaaagcaatcactaatataggtaaccactaacaatttcctggcactaaccagggatttttttttttatccagtgcatgcaactcttttgatgaaatgtgaaaacagtgaacagagtccatggaagacacaaacaattcactaaagatggaacagttaacaaatttgcacagagaacaaacaaagcaacaaaattgaaaacgtgccttccgacaagtaaaagatagtcagagttttccatcctagctcgaccacgggactgtataaagctgcatactgttgctgatggatcaaagcgaattaccaagttacaacttggcacatctaaaccctcctccaaaatttgtgtggcaataattatatgtacctgcataaccatcattctctcatcagagaactatcatactatgacttaacagaatgcctatagcatacttaacagaatgcctatagcataaaatacaagtaccaatatcgaacctttccttttcgaaaagattcaacaatttctgtatgatttttcctgctctgagatagcaaaccaggacggcttcctgccatgtgcttaacattccacccagacatttgatgaatagatgaaagtaggggctctaatactatgcttgtgataactctctgaacaaacacaatgcatcttaagtcttgcatatgcctgagagagagagagagagagagaggtgttacttattgaatgatcaaaagaacaaaaagttttagtacaagaaagtagaagcataagcatctcttacaatcaccaagttacttattgaatgtcgttttgcccgcgcggtttggtctttaatccagtttgcttcgaatattagtttacctaatagtacaactcatatgtttgggcattggataagaagacaaccacacaatttgagatctttggtcttattaggggcaactaccactatttggtctatttggctttgcagaaatgatgtggtttttgaaaggaaaaacatatcttcccctttgcaggttatcttttttattacacattggctctgctcatgggctatccttcagaaggtcaatttgcggggtactatcattgcggcttgtcaacacttggagctagtggccatggagttttctaccccggcgcatgggtggcgttctaggctacggttagagggctcctgaagttctttttgtccctgctattttggatgatgagtttatgttttgtttctttcttgttggctgtgtgcactctttgggtgcagaagccagaggtgctctcagaataattgtatcacttgatagaatttactgagattaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50217 - DNA, 1788 bp, Oryza sativa
  unsure (1)..(1788): unsure at all n locations
acaactgagatggtgtacatcaagcacattgtgacaaatttggggctcaacacttggggttttgtgctctacaacaaccttctttcgctgatgatggcccccttcttttggttcttgacaggggagtacaaatcgctcttcaccgcgatagaatcaaggggtgagaggtggtttcaggttgatgcatttgtggcggtggcattgtcatgtgtgtttggattgctcatcagcttcttcggtttcgcgacgaggaaagctatctcagcaacagcatttacagtgaccggggtagtcaacaagttcctcaccgtggcgatcaatgtattgatctgggacaagcactcgagcccgttcggtttgatctgcttgctcttcaccattgctggtggagttctctaccagcaatcggttacaaagaaaggaattaccgcgccgcagcatgaaccagaatcatctgagcaaaccaaagatgacaatgagggcattgagcttgatgaggagaaacaaagtttggttccaacttctaaaagctccaatgcttgacttgcatgcttagatttacattcagagatcctttaatcttgaaataggcttttgtgtagtgtgaatccctgcaacaaatcacaatgttaatctagaagcaacttccttgtgtcacccaatttcttcaggaatactgaatacaaatagcactgctgttgtttttttcgtggaatggcttattccaattgtaaacttgtaatacactgctggtatggagtatggacatatcatagctgacaaaactgatcattgaacatggatttctcttattgtttctattggatagataatagttactggcacttcttgattctgtcttgtgatggtattcaattaaacatggtctttcttttacttgtgctgtgatgggcatttcaatatttcagtgctaatttctatgaaaatatttcgcatgttgcaaaatatcatagaaaaaaaagggcatattacaacaatttgtccttctaaccatgtacaccagcatttggctaattcctcggaatgtcaagtttttctttatttgcgggtttcatcattgagaagttgatggaaggtaagcactagtaatgaaatgtgcaagatcaatcctcttttctaactgatgatatctgaagaagtagcagtcaaaattgacacatcctaatgaaatttgtctagaggctaccataagcaattcatgcacaggaatcagaacaaagattattcccagttgctactgagtttaactaccagacctctgtcaagtacaatcttcaagtgctaatgtgtgctcatgtaggctgatcttacatgaattggaattggatgagatgtcactagaatcttcaattcatgcagtcactttcaccgcgcaattggggaagcatgtatatatcagcaatctcaaaaccattgggtagaaaattttacattctgaatgaaggagcaaagaaatagtaacatgtatatcacactttacataaaccattgaaaccctggtcaagtacaatttccatagtaagatctcaaaaatatatataaaaaaagggctgaaacagtgctggttctagctagaagcacacaagcagagaaatgaattaagaaaggactgcgctcagttagatccgtgttagtgacaactggacatctncagcatacataggggcaaggagcataaatcagtcttctctccgccttctgtttccggagttcagaaagtgctcaaaatatcagacttgttctaatggcaaaattcgggaccaatgt

SEQ ID NO: 50218 - DNA, 4742 bp, Oryza sativa
gatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttgcccgtaacctgccaaccaaagcgagaacaaaacataacatcaaacgaatcgaccgattgttaggtaatcgtcacctccacaaagagcgactcgctgtataccgttgcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaacgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgctatgtgtacagatgacaagaggaaaatttattgtaccacttgattgtgttgaaaatattgatgttaaatactttcaatttcatcactcccattccatctttatgtgtttcaagtcttcaacctaatcccctcttaagagtaaaacatcaaacaacaacctagttgcttacatagcacatgccatatgatatagattagttcataggagatcaaaagtatttgtgaagcattttgaaggaatcaaaactgatgatgaaaataatgggcagccatgtgaaagattgagaaaacaaatttgcagtgcaaattaccatattgctaaacatgcagaggattagcattttaccttgacaaaactatacgtgtctcagacattaactgatcaagcttcctaacatccttcagaagtgaagaatcatcaaagccactactggacacagccatcaactgtgcatacacattggcattctcaggtacaaggtagtttatccaagagttatcttcacaaagacccatgaactgcttcaatatttgtaaaattgtttctaggacttcatcaatgcccatagggtctttcagttgtttcctgcatattttcccatgaagtattactaagagaaacacaccatgttatataattctaagtaatttgaagcgaacacggaagtctggatacactctgatgaatcagtgctgtttctgtacaccctctgtcccaaaaagacttgatttctggctatgcacctggacaggtctttttgggatggaaggtgtaatgcttatttcagcaagtaaaactgaaacactcttctttttttctctttatacattaaatgctaaagtgctgatcatgttggttatacaatactccctccttccaaaagtctaagtcctatttctttttgcaccaagaccaaggtgtagttaactcattcatcatgtgacgaaaccaatgaacatgcaaccaataagtactaaaatgacttcttgagttcctatcaaaaatttaatatagcacataatgactacaaataggacttagacttttggaaaaaccaaagaatgaaataggacttagacttttggaaggagagagtaataaataaaaaattggtgatgtaatgaccatatggacagggaaagaaacacttactctttcaagatttctgttgcagcatgctgcatctttgtaattaatgcattgataccatatgtggcaaggtaatcagcagttgcaagaaagtctttgtgcccgcttttgctaaaggtgtcagaaccctcctacaaatggagacatttcaatatcagcaaatagcttgggctcaaatcactcaagcataattttgaattttaaccttcaagagaacaagcgtcaatacatgatgattaagataaagaaatatcatctaagcatctcataactttcatatagtagaaatgactgagaacaggacatggagggtaaatattacctgtaattgcgcaccatccgtaacacgagcaaaatctaagtagagatgtctgcctaatatggtgacctggactctaacatataagctaagcaacgtcatcgcccatattgaagaaacagtccttgtgaaacctaaaacaacaatataaatccataatttctcatagttcattggacaaagaaaaattcaacaaggcatgcaacacgaaaccatgtaagataagaagaagcgtactcaaaattttgatcttctcccaagtgtcatacttctcctttggtgtcagggcaggggcactggattctcccttcccgtgcattagcttctcagtcaggtgtgaaatatccaattcctccatgatccttgaacggagataatgcatagcaaaaggcagtgtggtcgtgtctgagatcttctgcacattttcaaagtgggtctgcaatctacaaaaagaagcatagaaaacgatcacaaagcagtctgttttggaaacaatggtatactcaagatttcactattctctatacatcagagacagtacattactacaacaacagccaaatcacaccttttctaacatgttgataccttatagtagattcttgttcttaaggtatgtaggatcaataacataaactccatgaacatcaatcacagcagtcctcatctaactagcataaataagagagaataagattttctctccatccctcttataaaaaaaaggcgatgtaaatcgtctaaaatagttaaaaggaccagaatgacttgggaaagtaacaatgcaagaacagaaatccccaacccaactgaacacaactaagaaactaatcccctgcaattagaacaataggcgcaccacaaaaggtttctattttttcctcaaaccccaaccgtagaatctataatcctaccctcaaacccccaactttgctgttgctaggctacccatcaaagacgaacacagcatgatagcaatgcaagaagaagaaaccccccgattaaaccccactcaagtaggtagcaagtagacggaggcgacgaggccgcgagcatcttactggttcttgatgatctcctcggcggcgcgctcctccagcgcgcgctgctccacccggacgagctgcctccggtgcgagtccaagtacctgtacgcggcgtagccggcgccggcgaccccgagcgagaccagtatcttccgccggtgccgcccccagaaccccctgcaacacaaatcccccaccagcgaatcaaatcaaatcaatcaatcaatcacccatcccacccaagcattcgccgaacacctcaagagcaaagcaaaaggaggagtccgacatatcccccccaagaaaccctcacctcgcggaagccagcatggcggcgccggggatgggtggtggtggtggtggctccgcccgtcggcgagctcgattggctcgtcctggatcagcaaagccgaggaggaggaggtgggagcgaggtggaggagagagagagaggggaacgaggggcttcgaaggaaatagagaggagttggaggggggaaaacgcaaaaggtagcggaggagacagacacagagcagagccgtctgggattgggtgtcggatgagcaacacaacacaagctctgctaaaaccctgtgtgtttagcagcggatttgtaccctgttttttctttcttttttcttttgagtggatttgtttgtaccttgtgttttattttagttctgcgtgtcgtgtttggctgggtttatcacggggagattgaggttctttttaactatttgccactcttacggagtggcactattgagatgctactcttccaaacttttttacacaaacaccacataagagaggtatttttcctaactagagtgccacgtcaacaagagggacttgaaatgacctttttacccctaatttgagaaatatgagagattatatacaaacatatataagaaaatattgtttattattcttaaaaaag

SEQ ID NO: 50219 - DNA, 1792 bp, Oryza sativa
agaagagacaaaccaaataacatgtcagcttctttattttcagattacatagggcaatatcccatgtaaggatatgatcacaactgtatatacaaaaagtgatttgttagtttagagaaccatccttgcaaaactaacaactactagatgatcacatcatcataaattctagccatcgtcatcagtattgtcatgacatcatggagcttaccaactgcacaagctacattacttctggaaattatacaattttctccccaacggtattgtatacccaacaatctggagaatttctgcaagaaccagaatagcatttaggatgaaattacattcaaataaggcggtatataagcagaaaaatgcaataccacagtgcaatattatgaaattaaaccacaaaatcatctcctcagctaatcaactagactgaatattttcacaccaaaagggattatcctggattccaatattattagggaagaacaacttcaaagcatttgcataccctaatctttgtcaaaacttacaacacaggaactgaaccaaaccagcacgcagtgaatatttattttttagaggcagtagggagtaagatttcttttttcccgaatgcgcaagtgtatcattacattacattaatagaagatgaaataaggcacccaaacacgctaaagaacagcaagaagtacaggaactcgcgccaccacaaaataacacacatgaccaaatataactcaaagtaaaaaagaacatcgataaagcaaaaaagaacactactgggttatgcccaagacttgcaaacttttcaggatacagtaaagcgtatggattttgcactcaccattcagctctgtccggtgcaccagccgatcgcaatgcatctctgattcaccttcaagcagctcagagagtcccctcctcgtgggcatgtccatgatgtcattgcagcgcttcatattgcaatggttttgcatcaccctcaccatcttcgctatattattgttctgaaatcctgcgcgatatttaaggaagagtagttcattgccgatctttatattaggcatgacagtaagttattgtatatactgcagtgtacggaataaccattagctgaatcctttttcagaaggtctagcagaaatcttgccaggcgtagattattaaggagaaacgaaagcatataagaaccttggtaggccaaagaaagcctaataaacagagcgcaaaggcgggttacagtgctacgctaatttagtaggccacaagaacttaattactgcaacggaaacttaccaactcagtgcaataatctccaaaagatctcaggaagaaattcggtctctttgtgatccatgaaagaaatttttggaattaattcatctcttgacatcgcatctatggctgaagctggtaagtgcaaaactgcatcggagacagaaaaagcatcctgatgagaaacaatatttaaacctttactagtttccaagatgatgaaatcggtatatatcatggcgcatatcaatctcgtaggtcaaacacaattcgatgagttattcatgtcccctaaaaatgcataaaacagtaggcataaaggaagcaacggtaggaccagtaaacatactgaatcctaaaagcatcagctcaatgaaccttaacaactcttgtttggcaaaaaataaatgcatgctataggtggtaatttgagtccatcaattaagccatagcagtaggcagtgtgaaatttacttaaaaacaacgccgccacaaaaattcaacaagagtagaattagga

SEQ ID NO: 50220 - DNA, 3236 bp, Oryza sativa
aaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcattgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccactgggctgcgctcaacacgagctggcgtcggagtagacgtgcccggaggagtggctgttggtgctggagcgtgtggggacaccggctggggtggtgtcgacgacgagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgctgcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcaaagtggaggtgcccgaagcgctcgtgccactgccacgcctcgtcgtcccgacgagcggcgaggcaaactggatgtgcgacttgcgcgctgaggatgtagagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgt

SEQ ID NO: 50221 - DNA, 6189 bp, Oryza sativa
cctgcaccattttttgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgtttctgggaaagcgagaactgcatctcggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctctgcttctgcctccgccctggctgctgccaactctgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgaacgtcggacatggcgcacctccggggggctgctgcgtggagagggggaagggaaaggggaaggaggagcagccggtgttgctgctgctggtggtggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaaggcaccacaagaccaagaccaaccagccaagacttattcctacattacatgcataggatggtgtgtgccatgaagaggagcatctggtaccaaacagaaatccacatccacatgaggtactataccttgccagaatctttccatggagtcttgccaaaatcagcgatgtcggtgggagaggtgctggggctttgttcccagtaggagaagccgatctccgtctgccggcgaagcatcgatatcagaggctcctccagtgaagggcaagcagtgatctttacccttcgaagggagggaagcacgttagtctgacctgcttgcaatccaccgttcccagcagtcacttcacagcgctccttgagcccaactatggtctctaacttgctgcacgatgatacggtgatccctgcaagggcatggagatttgacagtggaaggcgcacaagcttgtgtgagcccctgatgtcgatcgtacgaaggagagggaagacacaatgtggatggttttcaggtagccaccattcctcccatgcaaccaggttctgtaccaccaatgtctcaagacactgaaatggggcctcgcaatcgccgtagaactcaggccctatgcttctcaatttccacaggctcgtcagcttgagctgcttcaggtttggcaattgtccaagtggtggtagatgatcagtgtagtagcacttgcacagctccagttcttgtaaactaaacaaggaccggtctcctagccatgaacagaagttcaatcctctaaaaccacttattacgagttgtcggatgtagttgtgaggctgcagggattccagtacaacctcatcatggggtacgcttttgtaggaaggcagaggattccacactagttctaagcgagttaattttttcttgctcaggtttgcactccttggttcccaaattctgtcatgtgtgatgttctggagatccatgatgcagagctgcccttgaagagtgttaatgtccttgatttcatccagcgtggcagctccgctccctgaattggccactgcaaatgttgatagtgactgaagtttggtcagccggtggattcctgatggtattgtgacagggaactctctcggaagaacaaggtgacgcaggttggacagtgccgacacatttctgggaagagatatcgtgtcaaaagggtatgtgtttcgtagagtctgcagcttgtacattttgcaaatagcctccggaatttctctctgacagatcccaaggtagcggagatgatgaagaacccccaccgatttacccagcttgatctgatcacttgatgatacatccaggattcgtagatacttcaggtgtggtgaatgcagcagacaaccttcaaggttataccaccactggctctgaacaagcacctgaaagaacgtcctcaagttatttctaacacagcttctgagataagttctccatttactctgaaaagacagtgatcttaggggaaagtgtccagcaaccggaagagtaaaaggcaccaatttattgtctgagtagaagggcgttgttccaacaagaacagctaaatatcgaagatgattattggcactagtattgcaaccaccaacagatgaaccacaacactttttgacaaggatctctttacccccaattgatttagcaaggtcatgaatgaggtcgtgcactatgacaaacttctcccgtgaaccagccaactgcaaattttgaagaaatgatctccgaaccaattcatttacatacaagtgcccaatttcttccatccttttcacaccgtcctcctgaatgaaacccaaagcacaccacatatggaccagctcctctaagtcaaatttgtgacctctcggaaaggcagcaagaaatgtgaagcatcgcttcagaattgcaggcagactgtaatagctcaatttcagaattggaaggatgtggtcccatccagggcccagctcccagagatcacttgtcagtacataattccagaactccaagcttgtgtctaaagataacattgcacctagagtcttcaggactagtggcactccatcactcttttctactattttccgcccgattggtcccaactctgtttctctacaagcattgtcagggaatgacaatttacagaacaacgcccaactgtcatctttttgcaacccacctagatgaattaccttcttcgcctgcacaattgtggagacattctcgttgcgagtagtgatgatcatgtggctccctgtagcaacagcagaaaatggccgtttcatcgtctcccatttgatggtgtcctcattccaaacatcgtcaaacacaagcaatatcttcttacccttgacctcctcgtgcaattgcctctggagtggctctagctcagtcagatcacagggtttagcggtgaccgactcgattgctgctttggttagtctgacttcatcgaatacttctgaaacccaaacccatgcttgtatatcaaagtgattttgaacccttgcgtcattatagacgagcctagctagtgttgtcttccccattccacccatggcaactatagaaataagccttacagcaccagctttacaagtttcatattcatgttccttcaatcttctcttcttaaatgtaaggcacccatcaagcaaagaagatattattaattttttctcatcctcccggccgtagacctccaatggatcaagcaaagaactggtgcacctactaatcctagattctttcctacacaatccttcctgatcaattagcccaagatctacacgatcacgacagatctcatcaagaaatttcctaaccttgcttatcctgtctagtatattctgttgaaaagagggattgtttggtccaaagtctgtatagtctgttaccttctcttcctggacgggggtgctgcggagcaactcatagctgtaatcttcaagtatcccctcagcttcccatgtcacttgcttgagctcagagatccaaagcttcatagtctcgtcagcgatttccctttcatctgcatcaaccaacaccgcggtgattcggcgcacagttctgtccagcttggcacctcctcgttgacatgatcagtcagagatggtagttcagctgatgacagatatgattgttgaggaagcgcaggtgataatattctggatttcatcccaaaaaagtaggagaatagtgaggaagccatcatgaactcaaagagaaatactaaaacataatcttcagatcaagaaactgatataaggaaaatggcgtttgggtcaagtcaatgcctggccttgctccaatccaaaaggaatgagcttttacggtgttgcccctaagcatgcgactaaaatatattttttgcaatattcaacaagctcctatgagtctgtaaaaaactattgcacggtggcaaaactgcaggagtacaggaatacaggataaggccatataatgttcctggaaattgcaaatataaagcatcggtgttgttttagatcgaattttatttccatggttggaattatcccctttcagcagaaaaaaaaagtggcaggaagtgagaaatgggtggttacctgcaggctgcagaaaaaccagaatttgaagttgatttgggcctgaaaagtcataaggaccaactaatacatgttagtgatgctgaccagtgaccaccaagcggctactaggaaagtcataaggagcagctagtacataccggtgatgctgacttcaagtaaattgtaaggttattaaaatcagcatcatcctgaaacagtttaatctatgtacgagcacctagaacaattttatgcagaagcagtgatgttaatcacaaataaatttgcatgtacatgttagaccaggtaaatgaattctctacagttgcattgggcttttgtagataatatataacatgcttcttgtgccctgttacgtaggtggaatatacaaagttccagcaacagtaaaaattcaagtaagtagttagcattccagaaaaatcttaactgaactgaaattaaacaagaggtgttagtactacgctacaactgccctgcaatatagttaccgtcctccgctgattcaaccaactcactcaagagtcaagaatgatccagagaatatatataacagggaaactgttttaacaacttgagtggatgtctacccgtttattgcatatcatttaaataattatgaaaaaaattgaaaaaatatgaacaagatagatcaatatgtaatatatcactccacaaacatgcaagttaaaattcaaattctacaacttgtagaagttgaatttgaacttgcatgtttgtggagtgatatattacatattgatttatcttgtcaattttttgtaaccatctagttggcatgtaataaacggatggacgtccactcgagctattagaatccatctccatatataacatggttcttgcgcgatatggtgccagtcgaatatcagcaacaggaaaactcaagcaagtagttcgaattcatgaaaaatcttgactgaaaattattgttaccggtggaatttcatggaaattctggtactgtccccgtgatgctgcattgctgttgcattccttccctgcattaatccaagtaactcaatagtcaagaataatccagatagtagtatatatttccccaaacttgactaatcctttctcgttacgaaaacgaagaaggagaactgcgattccagaatatgaaaaacagattaaaaaacagtgcttggtgagcactgagctcaatcaacaagggcttgattagccgcagcagttgaactagccgt

SEQ ID NO: 50222 - DNA, 1104 bp, Oryza sativa
tatcacggcccagtggcctttcactagaagcaaaaacacaatcctattgacatgtatgactcttcctatgttctgtattcttcttcctctgtttcacactcttcttcctcttcttcctatgttctatattcttcatcctctgtttcacactcttcttcctctatttcatactcttcagacccctcagaacagtccacatctaattcagaatcctttaaatgaaataagcagatgagagaaaacaaacaattagtcatcggtacatatggtaaagcataagtaatattgcttataggccatagtcatattgaagcatgctaaaagattaataattggagattggactggttttgttaagggaacattgtgccggcaaaagaacttaattccagagtcttgtggatacaaaagagggcatgctagacaacaaattgaagaaaaatggagatattgcagtatatatgtatgctaggtaaaccatttagaaaacatgccatgctatgtatgaaaatactggaaataaataaatgaaatgtatcttgcagactttatattagcattcaatcatccatccatgcattgtgagcaaccattgttcactaacagtaaagacatcagtttcacgctctactacaataaatcattgaaacaacaaattatacatttgtcaaagcaaatgtacctctctttgtgactcccaccttgaaagtacctcctcaggtatgtccattccaagcttctcatatactgcctataggcatgcaagttaaatttgctaattggatttttctgtgaggggaaaaaaaataaatgaatcagagattaatttagtagttattacctttagcattccacgatgttcttgtatcattccacgctgttcacgtatcattccacgctgttcagtcacttcatggcgaagttgtgcattctcacgcactacagcattgtaagaattcgtagatccagatattccagatttcttatgtttaacagcagcaagaacttcagttttcttgaaaactccgttgcccattgcaaaccgtccatgtttcagtccaccaaaagctttatataccacattcccatctaactcactgctca

SEQ ID NO: 50223 - DNA, 1749 bp, Oryza sativa
acatgtgatgaaaaaaaaacaatcaaaagtgttgatactatatatgaactattgtcatttatttaccaggttttgttgtatagtgcagaatggaagagatcctccctgctgttgagcatagtcttcattagcaaaacgtgcatcttgacctcttttgcgcttctccttgtacttatctgatgtccaccagtgacaaaagcacttccaagcgtccacattaatccaatctaatttgcatgtcatgtactgctcaaaattgagttcaatggcgctggcattttttcctttgatccctttaccatagtacttcttcatagcatctacacgtgcctggcaaattatctttggaactctagcttgacatagttgtcaatattcttgtccagctcctccatgtcttcttcttgggtagtgaagaatgactggaaaaaaaaaggggggaaataagtgtttactatattatgtggtgtccctacatagctatgtgagtattggcagaaagctatgcaatcctaatacttggaatgggaccatagtagattgaacttctaacactttttctagcaatacagtaaaatcttttgaggaaaacacatacccagaattcatcttttactctattaccagctgtcatgccattatgatccttctccccaaagtagtgaccccatgacatggccaatctctttcttttacgttgtccaggacctgcatattctttaaccaacccaggatactctcgtcttaaagatgtaccaagcacagaacctgtttgtcgttccatctttggcttgaaatgtgtgtaagcgaaacccctatatacaagacgtcacattagtatatatagtgcaatacaaattttatacataacagataaataaagggatgtaaggagctacatatgcatctcccctgggagatatctcaatcctcttataattcctaggtcttgtaagttgtgttgtccctcttgtattcctttcctcctgataagttccacctccagcagcggtagaaatggtagacccactaacatccctcgaagatgatggttccccgcgtggatgcataatacgactcatctctgcaaacattttataaataacattaatcacataatttattcttactgattatgaatacatgaagtaaaaagaacaataatatgaaagttcattttctaggactgaaacaattcttttcatacagaaagtaaacatgctgagaatgattttttttcatcattgatatagaaagtaaaataagaacaaccaaaacagtggcatgtcaaaattcattcggatcataaatctcatgatttgtctgatcatcattttcgttttcctcctcgctgtcgtcctcttctatattttgagattgatgatgtggtgctgttgttgcctttttttgttgcttccttagtagttcaagctctttagggtcagtgatttcatctgaacagtcaacaactgcagtgctagcttctaggtcagctccaagatcaactataaatgtactgtccagaacactctcttgaaagaatggcatctcatttgttgtcccatcttgatcattggaatcaggaatcacttcaagagcaggcaatctatcacgaggagtaacatgataaacaatgcaccagtcatgcagatctgttcttgatgagcatgcatatggaacgtaataaacttgcttgacttgatttgccatcacaaaggggtcaaaatttgacagtcttgaggtttgctt

SEQ ID NO: 50224 - DNA, 1817 bp, Oryza sativa
tagcaaagtacactccaatgattcaactacctggactaaatatacttaaatatatcatccatttcgtgcatgtttgtcatgatgtacaaataggctgctttgtactctttatccgttaggtcacgaggcccttggggacaaaagggtcgtctaggatatttaaaaatgctcaaatcacacaagctttcaaaggttgcagtaccatcatcatatcgagggttgtgatttcgacttgatcttgcagttgacttaaaatagagtgatagaaaatttgtggtctcctcaactaaataggcttccactattgaaccctcaacacgtgacttgtttccaaccttctttttgattttttgaataaacctagcaaattagacaatcataataaatgaatcaagactaaactagtccagaactgaatggtatgacaataattgattgtttgtagctccttacctttcaagtggaaacatccaacggaattgcacaggaccaccaagtcgagcctcataaggtaaatgcatcatcaaatgttgcatggagttgaaaaaaccaggaggaaatatcttctccaatttgcagatcagaataggtatgttctgttccaacctatatacattttccttattaagctctctggcacataattgtctataaaagaagcttaactccgccaaagtcacccatatactctcaggaaggaagccacggaatgctgcaggtagcaaacgctccataaatatgtgataatcatggcttttcatgccaaaaatctttttctgtgccaaattcaccccacggctaatattggctgcatatccatcagggaatttcagttctttaaaccacttgagaatggtgaccttatcattcttatcaatacaataagatgcctttggcttatgccacttgccattagcttttagttccaaatgcagccatggtcgatggcaaatctcctctaaatcttgtcttgccttcacattgtcattggtcttatcagcgatgtcaaagcaagtattccaaatagcttcagcaacatttttctcattgtgcatgacatcaatattgtggcgaagcatcaatttgctgaagtaaggaagtctccaaaaacatgatatatgtctccaattgtgctttttcccataattatcagaatctgttatggatgcattcatttgagcttgaacttgctctctgaaagttggcttggtctcccatgatgtattgttgtgtcctttcgaaatgcatttgattgatttcgaaattcgtgatcagttggaaggaaacaccgatggcaatcaaaccagcagctttccctccattatgagccggaatgcctttgattcacacaaacatgtggacatgctagttaccattggtgctccaacccacaaaatcaccataggcacgaaaatcatggactgaccaaagatatgctgccttcatagtgaagtttttcttcttcgaagcatcccatgttgtcacaccaacccatatatcaagtaactgatccaccaaaggttccaataaagaactcaagttctttccaggatgttgaggaccagggataacaagggcaagcattatgttctctggtttcatgcaaatacctggtgggagcttatatggtaccataaacacaggccaacaagaatatgttgcagcattcatgttgaatggtgtgaatccatctatagctagatcaagtctaacattcctgggatcttgtgcaaaattagaaaaatctctatcaaattgagcccatgcttcaccatctaatgggtgcatcatcacatttggcttatgtggagggtgtt

SEQ ID NO: 50225 - DNA, 3777 bp, Oryza sativa
tgacttgatggcaagaagacgagatgtggtagataaacaggagtgtgttgtctgactatgcactttctcatcagcactagcaaccattctgtagaaagcttgggcagaggctgttggctcttcctcagaaagctcatagtcaccggctatgtcaaccaacatgtcatccatccgatccaattcatcaaatttctcattttctgctgaagttgtagcttgatcttcttgaccaatagaacactcaccatgttctgaccagttcatgtaattctctttgaaaccctcacgacacaaatgcatctcaaccatttgccttctgtgtgaaacatagtttcggcacaaggagcatgggcacttaatttttccactaacaacaacatttggcatggaaaaagcataatccaaaaaatccttagtttgctgtacccactcatcagtcggtgcacgaccacgtttccagccagtatacatccactcacggttattttccatattgtggttctgtatgttccgtcatataaaagttattttcgtgtgtttaaactaactatctagttttattgcaacgacgcactatatacagtactagtagctatattaatacaattctatatatgtgcatatatatatctagatagtcacaacaatgtttagttggtaaaatgaagaggaaaacttaattcagcaagcacatgcatggtggcaggtaacttaaaataaaatttgattcaaaattgcatctcaagctttaccttgtaattttttcttcaacggatctgtttggtgcttggtgtttggtgtttggtgatgttactgatatttcttcagtagactgaacctttaggttagtccctatataatatgagaagaattcagaacctaaacatctatgcattaacatctgaaaatagtatgttattttcataagcacaaaagactaataagcatagtagaaaataaaatgaaaattaaatggcattgtttgacatgcacactgaatagcttgcactaattctgtattgacaattcaaaagctgatccacccattccaataaaagaaagccaccctatctagttaagccacgcactacacagatctcagaatgcttgcatccatttaataaaaagatagtattaaattactagttcacaccgcatggaaatcattttaaaaagcaagaaacaaggcttacaaattgatacaacaaaactttctgcattggcatttcatcaaacacctgaagaacatcaatcaccacaagatgtacagaaataatagagagaagaacaagtaccagaaggttgatgatgaagattggggagcacctagcaccaatcaccggagaggtgagcagcagcgacgcgcatcccacggcgaggagaggaacggcggcggcaaggacgccacccaccgtacaagagcagcactgcgccgccgacgagggtggcgaggttgtgtcggccggcgggcggcggcccatatctagacgacagactttgctgcgagttccttagagcatcaccaacagtctagctatctgattcccaaaactgattttaagggattttagtccaaaattagctccaacagatccccttctctcctacccgagttttggagttcccttctcccgattcctcgctccgtttatatgcggacgtgaaactcgctcccaatctcgcactcccgcccctctcctcctattcccgcgcgtggagaaagcgatctttctgcgcgtgaaagaaaaaaaactgaattttctgttggtagtttaacagaagggcccacttttaagttttggggattgaatttaggctatctgttggagggagtagtttttttacttcctattttcgatttaggaaacccaaaaacaaatttttagggaaagattatacgtaagctgttggtgatgctcttaggtcttcacaggcagggtggaataagttcactttgggtccctctatttgtcccttgactgcaaaaccagatacaacccgtccctcaacttacgaaaaccggacaaacgagatccctcgtcggttttgatagcggttttggctgacgtggcacctacgtggctaatttgactcggtctttatctgacgtggcgcttgggtggcaattcgatccgaaaaaataataaagcccatgggacccacatgtcattttcacacataaaataataaaaaaaatagtggacccacgtggatcccacatgtcatgctcaccccctcatcttcttcctccctctccatctcccctctctccatctctctcctctcctctctccagcctccaggcgccacggctcacagagtcacggggaggtccgtgaaggtgcactaaaaccccctagtgggttttggtgattaatgacaaggtggttaaaggggactaacgtgtttatcaagtttattcacaggagtttagtcccaaagcaagttgtgatggctaagaatgcaaggagaccccccaatttgaatgttcctaagtgcaaaaaacaccgaaggtgattagactaggtttttcactttcgaaattgagtttaggaaaaaccgtactactaagaggggttttaaagtgtggttctagggtatacaaagtgctcttagtcatatccatgaatcaaaatatttttagaatcatttttgaaaaatgattttctccccgggacagagagagctacctggaggttctggccggaacttccgggcgccatttcaaagcaaaattttcctaagtgttgcccggaagttcctggcacttttgcccggaatctcctggcaggtttccagttcaaacttgtgagtaactagccgttatatatatggattttgtccccaggtcaccctttggccattccacttcagctctttcatgttctagggttttctagccactcccaagcttcctttgcttcctccactcaaatctagagcctatcttgtgagattgagagaatagatgagagtgtaagagtgtaagagtgttttgaagatggcttgaagattaggtttgattgagcactttggataccttgtgggctgtcacttgggcttattattcctggagatcttctcctagacggttaggtgtcgcccgtgagcttccaaagatcttgtggatgtcccgggaaagtttgtgaaggttttcctcacctccgcaaggaaacgaggtaagtgagtaaagattcttatgctgagttttcagaggttgtcctaggtagagcaacttgcacttgtggtcttttctagaaggaattgtgagttggatcttggtggtcactcaattctagaaaacgacctagaagtgttgagttgaaggctgtggacctcttctgggatctttgcataagtgaggcaaggggttaatcgagacccggctctttggagcacctcaacggagagtaggatctgtgtgatccaaacttcgggaaaaaatcgcctttgtgtctcttgtgcatgatctgtgtttgaatctgctgatatcttgtgatttttaccttgtgcaaccctgtgcctgattttccctagctaggacctgtttttcttctcatatttcgtttatctctgttgcccggaagttcctggctcaaaaactccggaagttccgggctactcatcactgccaggaagttccggtgttcatcaccaggaggttccgggccctgtcaatttaaccgttgcgtttgttgagaaaatttcaggaaagcctattcaccccccctctaggctacatctctgcacgttcaattggtatcagagcctggtgct

SEQ ID NO: 50226 - DNA, 7395 bp, Oryza sativa
  unsure (1)..(7395): unsure at all n locations
gcaatcaaagagagcttgcttcaattgtggtgaatatggccacttcattgccgattgtcccaagtcaaatgaagccaaggctaagagaggcaagaagaagccggagcgtgctcatgtggcggaggcacacatggcggaagtgtggtactccgaagatgaagaagcctccgaggccaagcccaagcccaagccaaaagacaaggttgaaggagagggtggtgttgctaccgtcgccttcaagtcatcttcttcaagcaaggagcgtctcttcaacaacttgagtgatgacaacgacgactcctaccaatactcttgcttcatggctcaaggccgcaaggcatactcctccggtggttcaagttgggttgtggatagtggttgcaccaatcatatgactggagagaggagtatgtttacaagtcttgatgaggagaacaaaactcatgagaatattgtatttggagatgatggtaaaggaaaggtaattggtctaggtaaaattgccatctccaataatcaatctctctctaatgttcttcttgtcaattctttaagctacaatttattgtccgtttctcaattatgtaagttgggttacaattgcttgtttaccgatgaggatgtgacggtctttagaagggatgactcctccgtagcattcaaaggcaagttagagggtgatctctatcttgtcaatttcgatgtggatagagtgaatccggaagcttgtttgattgctaaatcctccatgggttggctatggcatcgtagactagcccatgttggaatgcggaatttggcaattcttctaaagggggaacacatcctcgggctcactaatgtcacatttgagaaagatcgtgtgtgtagtgctttccaagccgggaaacaagttgggaatctacatcctatcaagaacatcatgactacaacacgccctcttgagcttctacatatggatttattcgggcccgtggcttacataagtattggaggtaacaagtatagttttgtcatcgttgatgatttttcacgcttcacttgggtgtattttctccatgacaaggtgaggctcaagatgtcttcaagcgcttcgccaagcaagcccaaaacctctatgatctcaccatcaagagggtgcgaagtgacaatggaagagaattcaagaacactcaagtggaggaattccttgatgaagagggaatcaagcacgagttctccgccccctatgatcctcctcaaaatggcatcgttgagaggaagaaccaaactcttattgaagccgcaagagcaatgcttgatgagtacaagacttcggatatcttttgggcggaggccgtgagtaccgcatgtcatgccatcaaccgcttgtacctccacaagatcctaaagaaaacttcatatgagctcttgagtggtaagaaacctaatgtttcatattttcgtatctttgggagcaaatgctttattttgagtaagaggcctcgctcatctaagttctcacctaaggtggatgagggattcttacttggttatgaatcaaatgcacatgcctattgtgtcttcaacaaaacctccggtattgttgaagtcactagggatgtgacatttgatgaatctaatggctcccaaggagagcaagttgttgtacatgttgtaggtgatgtggatccaagtcaagctatatgtactaaggctattggagacatacgaccagtcgagacgtaggatgaccaagaagatagggaccaaccttcgtcatcgacatccaatagccctacatcaagtcaagagtctgttgactcggaagttccgggaccagatgatcggaacctccggacctctccaggccaggaagttccgggtccatctgccaggaatttccgggcagaggacagtcaaggcgtgcctacggcacaagtggatgggattgaagctgagggcactatagagcatcctgatcaggctcaggtcccctcggtgcaccatccaagaatacatcacactgttcaaagagatcatcccatcgacaacatacttggtgacataagaaagggggtaactactcgttctcgtgtcgctaacttttgttaacactattcgtttgtctcttctttggaaccaaccagggttgaagatgcacttggtgatccggattgggtgatggctatgcaagaggagttgaataacttcactcgcaaccaagtatggacattggtggagagacccgaccaaaatgtcatcggcatcaagtggatcttccgcaacaagcaagacgaacatggagtggttgtaaggaacaaagcccggttagttgcgcaaggattcacccaagtcgagggtcttgattttggtgaaaccttcgcgcccgttgctcgccttgagtcaatccaaatccttttatcctatgccgctcaccatgattttaggttattccaatagatgtcaagagtgcctttctcaatggacctatctcggagttggtctatgtggagcaaccaccggggttcgaggatccaaagttgccaaaccatgtgtacaagctccacaaggcactctacgggctcaaacaagcccctagagcttggtatgaatgtctccgagattttcttttgaaaaattgttttgaaattggataggcggatactactctcttcactaaaaaatttaagagtgatttattcatatgccaaatttatgtcgatgacataatatttggttctactaatgcctctttttgtgaagaatttagtagtatcatgactaaaaggtttgagatgtctatgatgggcgagttgaccttcttccttgggctacaagtgaagcaagcacaagagggcactttcatctctcaaaccaagtacgtgaaggacattctcaagaagtttatgatggaagatgccaaacccatcaagactcctatgcctactaatagccacctagacctcgacgataatggtaaatgtgtggaccaaaaggtataccgctccatgataggatccttgctttacttatgtgcatctcgtcccgatatcatgcttagtatatgcatgtgtgcttgctttcaagcggagcctaaagagtgccatttgattgccatcaagagaattctaagatatgtagttcatactcctaatcttggcttgtggtatcctaaaggttgtgactttgagcttttgggctattccgattcggattatgccgggtgtaaggttgatagaaaaagcacaaccgggacttgtcaattccttgggcggtcccttgtttcttggttctccaagaagcaaaattccattgccttatccaccgccgaagccgaatatgtcgccaccggttcttgttgtgcccaactcctttggatgaaacaaaccctaaaagattttggctacaacttcaccaagattccactcctatgtgacaatgagagtgctatcaaaatagccaacaatcccgttcaatactcaagaaccaagcacatagacattcgccaccacttttcttgagagatcatgaaaccaaaggagacatatgccttacccatgtgagaaccgagagccaattagccgacattttcaccaagcctttagatgagaaaagattttgcgagcttaggagtgagctcaatatcttagattctcgcaacattaggtgatgggtggttgactaatttatagccaaacatatgtcactaaaatgtaaattaaaaaaaatgagctttttgtgtcttgagatcacttcttgtgtagaagatggtcttgataccaggaataaagctcaaacattcccccttttttatccaaaaacctttttattgaaaatctttgcgaaattcctttgtgtgccttttattgcgaaaatttggtttttatcttctccttgtgatgtatattgaccattgttttgtattggttgcttgctggctggttatatacatcacaagtctctgcatgtccatagttctctattcctccttttgatttcttctctctaccatggttttgggcctgactgccctttatctgtcaggccgaaagttccgggcctccctgtccggaacctccgggtgtcggggagtatatatactcagggtgatttagaaactctagtctctctcctcatttcttctccctccccgatgacagccttagtcgccgctacagtgcccctagtggcgattttcacttccaaccgtggaaatttgattcatctccgtggaataaaccacattggtggctaggaggttcttcccgcgatcgatctgtgatttcctctctcaaggtagcacttttgatcctctcttttggttcatcatgtttttgccccgatctctaaatctgtgaacctagggagaaaaccacttggatagtcttgtttctgctaccttgtagatcaccgatctataggatttgttcacatgcgctggctatttttgaaacctctattcttcattcttgccagccggaatttccggtgttcttgcacccggaaccttcgggcgctgtccagccagcctgccattcttgcttctctcaaattttgcctaactactgcactctactttgttgattcctgttgcagtaagcactatgcctcgtgagaaaagacagaaagcctcttaggatgtgtctagtgatgagagtcctcctattcggtttcctcgtggtcgtttgggtaaagagaaagtggttgagggcggcagtggcagcggcactcgtacttctcctaggttcaccaggcaatccaacaaccgtccagttcatattcgggatgttgacagtggtcaaggaagtgatgctcctaatacaagaggttgtgggagaggtggtggtcacagttgtggggctggaagggcctctcatgatttcccgataggatctcgtgagaatcccgttcgactctacaagtctcttggatttgacaccactcctatgcaccacattggaagacccaagtccaactaccttcatcagcttgccaagtgcagaagggaccgtttgattgatccagagacatagcctgaggagtcacaggatcctcgtttcaggactttcactcaattggattggtataactcagtgattatggctagagaaaatccagtggttgagatgaagtggattgattgtgcttacatgaggaaaaagaacaatgaagtgttcaatcaagcgatgcaagtgtgccacaacaagaatcttggagatattcttgccttggagtatgattggaatgaagaggtcattgcacagttctatgcgacagcattctttggtactactaggaagggaactccttatgtgaagtggttgactgagggtgttaggcacaagatttccatggcacagtttgctgagatattgggcttagaggatgaggatctcaataggcctaatattcatagtgaagcacccctccccatgttcaagaccaagttcatgtatgctaaggatgctcctaggacttgtatgggaactactcatggtttgcatccaaattacaaggtgttgtactccatctttcgttggtctttgcttccaaaggttggagatgccacagctttgccatccaagcatgctcatcttctcagtcgcatgtgctacaatcagcctccctttagtgtgataaagatgattaagtcagtcaccggggtgttctacatcaaagatgggtgccacaatccttttcgcccttgtgctccaccttcctcttctccagtggtacctagatctattcctactacctcagctggtccttcttctagtgccccaccgagttcctcgagttcttctcccatcaagaaggcacttcaggcaattttctgtagtgtgctaagactgctaagaaagtgaagtagatcgaaaggcgttagaaggaagatagaagagaggctgggaaagaagtgtcagatgattctgaagatgaggtctatgttgatccatttgaggcttatgaggcagcccgcaacgttgccggtgaaggtccatccacctacttcaatgaagagtcttccaatttagatgatgatgatgatgatgatgatgagggtgacaccgaggcagctgctgaggatgctcccactgatgttgatgagggtgacacctctacacagtccgatgagtctcatctctccggcgataccgagattgttccctccgatggagatggagatgagtgattctcttcttctcttcatggtttcttgctttttggtgccttgatgccaaagggggagaaattgtgaattgaagggggtcatttaaatctttttgctaccttgactgttgtctggtcatttggccagaagttccgggtcctgtgatccggaggttttggccaggcagatttcctctttattatccctctcttatggacatgtaatcgtattctattatggttggatgtaatgactgctagatgctttattatcctttatgtcagtaagttagaccatatgaatgttgcattttgatgtgatgtagtgttcttttcatctttttgagtgattgccatgtcatctagtctttcttcttgcatatcactcatcattcaagcactcacatctgcatcttatttgtttgagggtagtgtgaagtttcttttgagctttccttcatttttatgcatattgtattcatctcatttcattatatgcatatctttagggggagcttcacacttctctcatcattccaaatttaaattctattatctttttgtgtgctttaaccatgttgtcatcaatcaccaaaaagggggagattgaaggtgcacttaaaccccctagtgggttttggtgattaatgacaaggtggttaaaggggactaacgtgtttatcaagtttattcacaggagtttagtcccacagcaagttgtgatggctaagaatgcaaggagacccaccaaattgaatgttcctaagtgtgaaaaacacagaaggtgattagactaggtttttcactttcgaaattgagtttaggaaaaaccgtactattaagaggggtttcaagtgtggttctagggtatacaaagtgctcttagtcatatccatgagtcaaaatatttttagaatcatttttgaaaaataattttctccccgggacagagagggctacccggaggttccggccagaacttccgggcgccatttcaaagcaaaattttcctaagtgctacccggaagttcctggcacttttgcccggaacctcctggcaggtttccagttcaaacttgtgagtaacggctagatgacgtcacctagccattatatatatggatttcatccccaggtcaccctttggccattccacttcagctctttcatgttctagggttttctagtcactccnnnnnnnnnnnnnnnnnnnnnnnnnnnnnnnnnnnnnnnnnnnnnnnnnnn

SEQ ID NO: 50227 - DNA, 3701 bp, Oryza sativa
tgcttgcctggggagtccaaaattttaatcactggtcaactcgccgatcagtgatcaaaatcccctaacaatctaacaagtgatggtcatgtggcagatggtgatcaacctgtacgggtgcaacatgaacaggaaggagtgggagtcgccggaggagtgggtgccggagaggttcgccggcgggaggctcgaggtggcggacatgtacaagacgatggcgttcggcgccgggaggagggcctgcgcggggagcctgcaggcgactcacatcgcgtgcgccgccgtcgcgcgcttcgtgcaggagttcgggtggaggctgagggagggtgacgaggagaaggtggacaccgtgcagctcaccgcctacaagctccacccgcttcatgtccacctcacgcgcagaggaaggatgtgaaccattatattcattggaagctgttgctcgttgaataatgatatatagttatctttgagatgtatttactattagcaaaatctccatgctttgttatggataggagaaaacatattataatatatcatggactatatttcttttatcaaatatggttgtatataacttgttacttgtttacttattctttgttatggataggagaaaacatatattataatatatcgtagactattaattttttatcaaatatggtagtataacttgttacttgtttacttattcaaatatatggtatttatttatgtgaactattcaatagtagcagaaaatatcagggtgccactgtagccttttaaaagagtgcaggcaaagaaccttacaatgttagcagtgaatctttcttgaggtaaacctcaaaagagcacccaatacgacaaatcaaccgtttcaaggctgagatattataatttgaccgacatccacatatatttcaaaccaatttcactaaaacaatcatttataaagccaattgttcattacaaaatattaatcatgacaatgatttcacagttacttatatttttctatatatatacttactttctctaatcgtacggttaagagttacttcgatttctttacggtgttatctaatcctatgaaaaattacttctattttttagttcctctagcagtgtacttgcttctaatgccataaagaattacttctatcttttaaaaagttactttcccctaactatgtaattacttttaataccatgaagagatattaaccactctaaatgccgtgggagcgctgagattttagagcgccatgtcagcgattttttttcatagaagtccccgtacttctggttaattatacattgatcccagttgctatccaccgtgaaccgtttgatctctctctagggttgatcccttgtggtggctcttccgcatgcgtgaaattaatcgttggatgcggaatggatggtgccgatttcgccgactgcatcaaaccctagccccgtcgcccccacccttgcatgagccctcgccctcgccctcaccctccaccctcggtgcatcaccacgctctcctcccctcgcatgtgccatagttgtcgctgccgccgcagtttcgcactcctccaaccatcgttgcggcgccaggcgccgtcctcctcgccggcgtatccggccacccagatgagatggatgcgagtcgctgccctcttcttccctttcatctctacgccgccacaggccatcgcttccctatccctcgccctctccactctgctcggcgaggtgttcatcagagtgtcacggttgtgccattgccggacatcacagtggcgacaaaggaaggagaacaggggaaagcgtaaagtgagaagacgtgtcttcgccaagaaagcgtattgtgtaaagagagtggtaggtgtgtgtgaatgccaagtagggcacaggagacagctgtgtgagtggaggataaaatcccctcgttgttgtactgatacgattacgaaatgagaaatgaaaaagaatctcacctcccccaagttctgtctcttcttctcgcctaagtcttcttcttcttcttccccatgctagttcgccgtgtccctcaactccggtgagctttgccgccgcggattgggttgtgacaagttggtatcagtcgctttgttcggtctcggggctgtctctcacattctctcggctcgatcagtaaatcctgtggctccgttcgtggtcttccttcgggttgtcgccgcggtaaatcatagtttggtttgattgggtttggaggagacgacgccacggcaccagcaaaacctagtgcgcaggttcggcacatggtggcggcgatggaatctatggaggagcgtttgatggatactctcaaggcactagcactcaaggtggatggtgtggaggacatctccaagcgtttgacgcagatcgacctcaagctggcgcagcaaggcgagtggctagatcgggtgcagacgaaagtggatctctccatgacgtccctcggccaggttcagcaagaacagagtcaggtggcgcgtgcactgaaggcggccgcggcaccaccaacaccaccactgccgccccctccgccgcctccgcgtcctccaccactgcttccatctccggagtagccgttgggagcatcttcatcttcatcaacaccaccaccaacaccaccgcctccaccacctgttcatcggtctcgtcaggtaccaggtcatcaaactgctcctgatgtttctgattttggggatttggggcgacgccagtggactccgaagatggattttcctaaatttgatggtactggtgtccgcgtgtggattgataattgtgaaacgtattttgccttttatcaaattgcggaggggtttatggtgtcagctgctgctctgcatctagtgggggatgctgctaattggtaccaggtgtggaagttagaagtgggttggcatgattggaccatgttaaaaatggctatcgctggagaatttgaggttaatctcaggagtcttaagatggatgaactgattttgttgacacagacggcacagtaactgaatatcgttccaagttcaatcagttggtgtatcagattaggctctatgatccttctctgtctggttcggggctaattaatcattttgtgttgggattgaaagatgagttgcgttcttttgtctaagcggtgcatccaacttctattactcaagcatatttggtggctttggctcatgagggggcacagcttggtaatgtgggcaagagacattttcagaagagagatcctgttgtttggaaacaacctgaaaagcctaagttagccactggggagttatggaaagcacagcaactcaaggaatatcgtcgagctcacgacctttgtttcaagtgtggggataagtatgtgcctggacatgtgtgtgtgaaaccagataatgctcagctaaaggccatggaagttcaggaggatcaggtgattttgtctgatgataatttggatgctgtggtggcatctgacatggtggaagatgattgcaatttatctttgcatgccatggctggtacatgttctgcttctactttacagttgcgagcaatggtgggcaatcaagttattctgattttggtggattcaggtagttcacacaactttgtgaccgctgatttgtgtactaggttacagctgcatcctgtgtcaactgtgccaatttctgttaaagtggctaatggggag

SEQ ID NO: 50228 - DNA, 2171 bp, Oryza sativa
actgaggcatctgttcatcaggtggttaagtggactcaaggcaattatatttgggctatggcagtacttgaaccagatttctctaagggctccccacctgttgaactagctgttcagtcagtattggataagttttcttccgtctttactgctaccaattctttgcctcctcatcgtgtgttggaccactctattgctttgattccaaattcggtccctgttaattccagaccttataggtattctccaacacaaaaagatgagattgaaaagcaagttttggagatgttgaatgctggtttgattactcctagttgcagtccatttgcttcacctgttttgttagttaagaagcaggataattcttggaggttttgtgttgattatcggcggctgaattctttaactattaaaaataagtttcctctgccaatagttgatgagctattgaatgaattggctggcaccaagtttttctctaaactggaccttcgcagtggatatcatcaaataaggatgttagaaactgatgaatttaagactgcattcaaaactcatcatgcccattttcagtttcgggtgatgccatttgggctcactaatgctccagctacttttcagtgtttaatgaattctattttcgctccattccttcgtaaatttgtattggtattcatggatgacatcttgatctatagtaggagtttggaggataacattcaccatatagagttagtgttacaattgctgcagcaacatcaattgtgtgctaagctttctaaatgttcttttcctcaaaataagttggaatcttggggcatatcatttctgctgagggtgtggctactgatccagaaaaaactagggttatgcaggattggccacttcctagcaatgtcactgaattaaggggctttttggggttaactggttattataggaagtttgtcaaacattatggcatcctggcaaaacctttaaccatgttactccaaaagaatgctaagtttgtatggacacctcaagctcagtcagcatttgttgctcttaaagaagctatgtgttctacacctgttttagcccttcctgactttgctaagccttttgtgattgagactgatgcttgtgccacaggaattggtgttgtgttgtctcaagaaggacatcctgtggcattttatagcaaggcattgggaattgtgaatcagcggctgtctatatatgaaaaagaatttttggctataatgatggcagttgatcgttggagatcttatttacttcggggtccttttgttatcaagactgatcacaaggctctttgtcatttagatgatcagactttggacactgagttacagaaaaaggcgatgactaagcttattggattacagtacaagttccagtataaaaaaggagttgagaacaaatctgctgatgcactatccaaagtagggcatttttttgggatttctgtggttcaatctgtttgggtttaggagattctcaactcctatgctgtagattcatctgctcagcagttactttgtgagctagctgtctcttctccaaatgctaagggtttttctttgtctaatggtttaatcaggaaggctggtaaaatctaggtgggtgcaaattctgctttatagactaagttgattgctgccttccatgcatctgctattgggggtcacactggtgtgctagtcagttatcagagagtaaagaagctgtttgcttgggttggtttgaaaaaggctgtggaagaatttgtccaacaatgtttgatctgtcaacaagcaaagcatgagcattgctcttatcctggtctcttataacccttggtgattccctctgcagcttggcaagatgtttctatggactttatagaaggattacctctgtcaaaaggtgctaatgctaatctttgtggtggctgcatagatatacaaagtttgcacactttttgcctctcaggcatcccttttcacccttgcaagctggctaaggtctatctgaacaactgctggcatcattatatgggtttgcctaaatctattgtctcacatccgtgataaagtctttactagcaacttttggcagactttgttcaagcgctttgagattcctttacatctgtccacaacctatcacccacaatccgatggaca

SEQ ID NO: 50229 - DNA, 1607 bp, Oryza sativa
caatcagcgactacggtgactaccaaaagatggcgaagcgtaatattatgattggcatgttaggttttaatgcacaggtacaaatctcagcaaaatttaaattcaatagtggattttgggtaccattagcactcagttaattgagctctaacaatgaaatgcttgcataaatttcagaaacagtttcgcggtacaagagagaggatgatcagtaacgtgttaagcactttgcataagttggtttctcttgacccacattcccctctgaacttcagggatgtttacattaatgagctgttcagcttgtccttgatccaggtttgtattacctctgaacttgaactctccagtggtccgtttgttacttccaatacctgtcatgattgttatgaacttataattgttgcaatttcgtagttactaggactgatcttgattgttatgaacttatatatatttgttacaatttcagagtttaggtgaggatgtgagttcagtttatgtggaagagtttgggagggagatatccaaggacgaaatctttgatgtccttgtgcatgagatgatgatgtgtgcagttgaggctgactggagggactacttcccctacctcagctggcttccaaacaagagcttcgacacaattgtgtctactacagaattcagacgagatgctatcatgaatgcattgatcaagaagcagaaggagaggattgcacgcggagaggtgacacaaaacttctattcgtatccaaaaataactttttttttctgcagatcatctgaactgaactgtaacgtattgcatgcaggcaagggcatcctacattgacttcttgctggaagctgagaggagtgcacagctgacagatgaccaactgatgctgctgctgtcggagtccatcctggctgcagctgatactgtcctggtgaccaccgaatggaccatgtatgagattgccaagaaccctgacaaacaggcaagaaattaactgatactacctccagttttattttttggtttcggacaacacatgttttagcatgttttctttgtaacttgtcgtaaacgtcaattaattttgtccggagggagtactttcaattatcttttgtatatactctttcttgtattgtattgtgatcctctgacataactttctcttgatatggtcattgacatgtcagcgatcatgtctctataactttacgagaaagaaagtcagaggatctcaatccctctttctttcaaatgcatttcagcattttgttgccaaccaaactaataaacaattgattgtttcttgttcttggcacatcgatcaggagctactctaccaagagatccgagaggcgtgcggcggcgaggcggtgaccgaggacgacttgccgcggctgccgtacctcaacgccgtgttccacgagacgctgcggctgcactccccggtgccggtgctgcccccgaggttcgtccacgacgacaccacgctcgccggctacgacatcgcggcgggcacccagatgatgatcaacgtgtacgcgtgccacatggacgagaaggtgtgggagtcgccgggggagtggtcgccggagaggcttcctcggcg

SEQ ID NO: 50230 - DNA, 1665 bp, Oryza sativa
attattgggctatcactaggaagtcatctcaatcgggacaaaaaaaagtgcccgattaagatatagtcacgtaaacatattagatgggtataaaactcagacccatcacggatgacatctatcgggccgtagtttaggaccgattgagatagcattccatatctcaatcgggccccaagtttacgcctatcacggatgacaatcatccgtgacgggcgccaacttaggcccgattgagataacaactaggcccgttacagatgactcattcgtgacgtgctgtatactaatgcccgattgagatgacttaatctctatcgggcccatcaccgatgagtatttttctatttttcatatgaaatgtttatatttgtaagttgacctgtagtaaaataattaactacagtataataatttattttatttgtcaaaataattttttgggtagtaaataatttcaaatggaaaaattatcaaccacaaggttatataacttatcaagatttacaacttttagtttggtcatttttctatataatttttttaacagtttgaatttgaatttgaaaatatgacaacttcaaaacaacattttcaaatataaatgatttcaaatggaaaaattgtcaacaacaaacttatataccttatcaagatttacaacttttagtttggtcatttttctatataacttttttttgaacagattgaatttgaatttgaaaatacgactaattcaaaataacattttcaaatactaaatgatttcaactaaaaaagtcatgaacaataaagttgtataactcgtcaagatctgtaacttttatttttgtaatttcttcatccgataaagtgttggtaacattgttcacaaaatttacatatatgtgttatagtttataaaactagatgaaaaatatgtgaattttgtgaacaatattattatcactttgttggatgaagaaatgaccaaaatgaaagttataggtcttgatgaattatataactttgttgttgatgactttttttgttcaaatcatttagtatttaaaaatgttgtttgaagtactcatattttcaaattcaaattcaaactattcaaaaaatgttatatagaaaaatgaccaaaataaaagttgtaaatcttgataagctatacaagtttgttgttgacaatttttccattttaaatcatttactacccgaaaaattatttgaatttcttatattttaaaattcaaattctatgtaattcaatcaaacccgaatagagaaatgaccaaaataaaattggcaaatcttaatgagttctacaactttatttttgacaactttttcatacgagttcatttagtatcataaagttcaatttgaaattcatttttgcctaaaagtctgatttacctcctcttccctctccaccacttcaaaatttcagcaaccttatcttctcttctcactcagtcctctctcaatctccaccttatcttctcctcttccctctctcactcaggcggtggccgggcggtggtttggcaggcgacggcgagacggcaagagcggcggcggcagcagagaggcttggcagcagtggggagggtcggcgacgctggcctcagggcggtcggatccggggttggtggccctggagccgccagatccgat

SEQ ID NO: 50231 - DNA, 1242 bp, Oryza sativa
tgatagaaaatttcctagtattaggatagaggaaatgtcatatccgattctaggcttctatattttaggacagagggagtattggatttcaacgggatgtgccaaggcaggtttgaaacaaggatatagaagaaaagtgtagcttaatcttgtgttatttttattcaaagcttgttttcttatggtccactgtggatatagaggtcagatttctatcaattatcttaaaaataacgcccaaaattttcagaattttccaaagttttgtgaatttggtcaaaattttatacaaattcggttaaaaactcaaataatttcgtgcaaaacaagtaccgaaaacacgaaagtttcggcccgagtggttgtgcttacctcggtgccggcggggacgtcgtagccagcgagcttggtgtcctcgtggacgaacctcggaggtatgagcgggacaggggagtggcggcgcagcgtctcgtggaagacggcgttgaggtacggcagccgtgggaggtgctcctcggtgaccgtctcgtcgccgcacacctcccggatctcttggtaaagccgttcctggcatgacaacaagaagaaggccaaaaataaaaagctttggttgataatgccaagaatgccaacaatgagctggaacagagtaacaatatttcttgcctgtttgtcagggttcttggcaagctcatacatggcccattctgtggtgaccaaggtagtatctgcagcctctatgagtgcctcccacactagcatcatcagttgctcatctgtcagtgtgttctctgccagcaagaagtccagatagcatgtctttgcctgcacatatatctcagtttcatggagttaaaagatgatctctgcaagtttttttttttttttggcatagaagcaaatatgaaagatgtcatttgtcaaagtatgcctttcctcacctctccacgcacaatcctttccttctgctgcttgatcaaggcgcgcatcaccgcagttcgtctagtttctgtagtaaacactcttgtttcgaagctcttgtttggaacccagctgaggtaggggaagaaatctctccagtcgacctcaattgcgcacatcatcatgtcggtcacagtagcattgtagatttcttccttcgaaatgtccctcccaaattcatccacatagactgaactcacatcctctcctaagctctgaagtttgcgacattaattgttagtgccagaaataacaaatcga

SEQ ID NO: 50232 - DNA, 1197 bp, Oryza sativa
tttcgcggaatggttatacgagatcgacggtatatttcttctaataaatttacattctgaatatttttgagaaaccaacgaatgaacagtgtatttttaaatttaattcttctctctgaccatctggtcttcattttagtaatgccgctaattaagcatatacttagcactccatgtagagcttgtttagatccctggcaaattttttcatcctgttacatcgaatgttggaaacatacatggagtattaaatataaacggaaaaaactaattacacagattgcatctaaattgcgagacgaatcttttaggcctaattgctccatgatttgatagtgtgttgctacagtaaatatttgctaataatagattaattaggcttaataaatttgtctagtaggttacggattaattaggcttaattcgtctcgcaatttaaccatttttaaattatttgagcccacggtttttattatttttccgagatataattgctacgtaagcgccacgtcaataccacgtgggacgaagacctagtcaaaccagccatgtagttggcacgtcagttaaaaccgccttctaaatcgtcaagggatcttgtttgtgccggttttgacagttcagggacctgttatatctagttttggggtttaaggacgaaaatcggattcggtgtaaagctaagggacctcaaatgaacttattccttatttcattgtcatgcagctgttcctggtttacccataatcggaaatctgcatcaattgaaagaaaagaagcctcatcagaccttcacaaaatgggctgaaatttatggcccaatctacactataaggaccggggcttcttccgtagttgtgctcaattcaactgaagtagccaaggaggtaacttagaagttgtctatcatttctatcgacttgcataactctaaaatgatggtctcacatttgatttgatcataaataacacaaaccaatactgtactctcttttgcaggcgatggttgcaaaattctcatccatatctacccgaaagctatccaaagcactaacagtgcttagtcatgataaatccatggttgctaccagcgacagtggtgatttccacaaaatggggaagcgttatatcatgttaagcatgctgggtacttctgcacaggtatacatctcaacaatttcatttttcatttttagt

SEQ ID NO: 50233 - DNA, 2579 bp, Oryza sativa
agtatgccccgcgatgggggcgtcagccacggcggcaaagacgaggcggccgtcgtcggagaggtcggctacgtgagggagaccaaagagaacggaaagccaccgaggaacggtggatcgccagcgcggcggcggcggcgcctcgcgtcgccggcgagctcggcgtcctactcttggcagccgagccttcacagcataaccgaagagtaaccatggtgcacgagatttaactttaacacatacttatgaaaacgagcgttatatgagtggtctcactaaaattctgttgaaagtccaaccatatgtatgtaatattcgtgaatataagtatttgaattcaggtgatgctttcccgaattcttttgtattctgtttggctgtctattctattttactccggcgagatcgcccagcctaatttagtttcagatcgttacaaattgcagtcaatggttttgggggaaaaaacgaatttgttcgctaatttcggactccgctgtcaattttgtgctgaatatgcccaacttagcataaacgcttggtcaaactctgggcatcatgtcaaagtaattttgtcattttaacaaagttttttttacaaagaaagtataatttctagcatttgcatcaaccaaggacgcacgcacccataacaaaatttgcaatctcattttaggctgttttggatcagaatttagttgaaacaaggcccgcctggcactcccctaggtcatatgttcagcataagatttagtccaactttcaaaactataaccatcaatttatattggaataagtttacatgtaaacttgtcaatcttaagatagagtgaagtgtacaaacaatgatagagtgaattgtgtggtgtgtcatctaggagtctcaactcccaaaatgtatttcttggtctcttaactagctaatacatgatgggtgtcatatacatccaaacaggtttcaaccaactccatgcgcatacgtggaatatcatagtggtgtctgagtattagtgggacccatatgccaataacatagaaataacaaaatatttaaaaaaatattttgtccactctctcatctctccctccctaaaatctccagtgtcagagaggagcaacggcgcagccttcatggggctcggtgacctctacgctagagagcaacgacgacctctgcgtcgaacacaagcacgcctgtcgtgcttctcaccattgtatttgtcctcgtcattgagctcatatgtccatatctccttctttagcggcgatagctgacctcgtcctcgagctcctccaagaaggaggatgtggttctagggcagggacagtcgctggctctgcccatcgtgactcatgtagttgcggcaaattagatagggttgggtggagaggacgaccaacgatgtggcctctagatccggaggcacgtagctatgggagttgtctaacagcgacatcgtggagcaagacgtcgaggtcagctcttagacgaggacgtggtcgctgccagcggcgaggtagccagataggcgcgctaggatagggcatcccaacgacagtggtggcaatggtttgacggcgggataaagcatggctgaagcagagggtggcgcccgtggtctttctagagagtcttgcaggccctctgcgtgtcgtcctcctccacctctatctccttctctagccttcgcctcgccctttgcctgttcctcgttagtggcatcacgggagtcgggcattgctccctacccatgtctcaccaccgtctctaggctctcctccaacccagctcctgccatgctccactgccatgacctattgcggcgcaccgaccgaatgatgaggacacacagagttcaggacgagctcctagagggagcattcggaaagctacagcggcgaggccgctgacgaggcatgtacgacgacctatggaccccgccccggcgcgcggacttcggcatgcctctgttgctcctcctctgcgccaccttggacttagttgccgagtcctccttcgaccggcaagttgtaagagagacatggggagagagggggggggggagaaaggtgtgagggagaggctgacatgtggccccatctttgcatgggatacaccacagcatgctatatcagcgcatggagcagcttggagccaatttggacctgtatgacaacataaagttcgaggatctgaaaatgcattgagagttgagggatctagatggcacactttcacaagttcagaaatcgcccgtgcacttcactcctgaagatacgtcggcctaatattttgtaagtgtttataggggtaggggtgtgcgtttgtgtattcataggtgtgagtgtgcacatttgtgagtgcatgcatttataccgtgtttctaaataaagtatacatgtaacttttccttaaaacaacggtgcatatagcatttgggccagtgccattggatcgatgtgttcatgctaggatccattcgtgcaaaggaaaatgacattggctcttctatgcctcccatgataatgtgttgacgagtgaaggcagtagggacagtgtctttcggcaccatggtgtg

SEQ ID NO: 50234 - DNA, 1162 bp, Oryza sativa
tattggataatgatggtatgcccttttgttgtaagtcttggaataagagttcaaatatgcttatatcagtcggcaaaatgtattgttttattgttgttgtggtctaatagacacatagtgtgacaacgaggctgagagcctgagactatgcctgtggtatggatcaagataggtaagatatgctagcaatgcagattgaggataaggacatccatagagaggttgactcgatgttttagtccgatagtagtggagcaaccaataggctggtgatcaggagggtggtgccacgacgagttcgagaagatgttgagccaagaggtggtgaggaaaccaagcctaatggcgatggtgtggtggagtacggagtggtgctagctagcaagcttagcttgagaagatgttgagccaggaggctgcagtgaggtggagaagggattggtgctgggatgctggtgagcttgagaggaagcggggcctggtagaggtagataggctagagaggaggtcagtgccagtgtggagtagatgcaggtctcactaggctgtgccgaggctcatgcatgagtaataaagagcaaagcccaacttctgttggattttttgcatggtaggttatagagagaaggcatgctcgatacccttgctacgtatgttagtgagcttctttttaaaagattatggatatattattcatatgaacaaaattactaagctatgaaaaatgcacttctgatcccttggacaaacaataacaaaatttatttccactacaaaataatataactgcataagttcatctactataacacggcctatatacgtcggtttgcatcatattgtttgttggcgatagaagtcaatataagccactatgtaaaagatgtatcaagccattgttcatcgccgtatagtacatataccatccctcaattgcacgatccaatgtcatctatacctaattaaaaataagtaaggtttctggtttttttgtccgtcgtttagttttccgattttgtcaaaaaaaatcgcctgtctccgattgatcgtagcgcaagaaaaaaaaagaaaccccaccgtgtcgcacttcgacgatcacgacgaccacaagccatagctcgattagttcaaagatgagattaggagttgtatgcgtgtgatg

SEQ ID NO: 50235 - DNA, 1557 bp, Oryza sativa
tgagctacgtagcagcagtaacccattaattttgctccgtgtccatcataaatactatatcgatttatataattttcggaatccctagttgtagatccgaaaattatattaccttcttttctttgtgatttgtgaaaaaatagatataattttatcgattctctcttaaaaatgcattatatgaaaatatatatgtccagatgtacgtatatactagttatacgttccctaaagctcatgttattagtgatttattttttagatgatgtggcaaattataaaggattgcttatatggattaattaatattgtatactcctttcgtttcatattgtactcctccataaacaaaacacttatcattttgaataactttaaagtttaaaaagtttgactataaatagtttctaatatactccaaatcaacctgttacgctagccgagaacttgaccatccccattaacacatcagctagcccgtccggatgcagacgagtggttgggtcaaatgagatcgacaatagccaacgttgacactgcattcaaagcggttgtggcataagagcaggtataatagcaggctataagacaaaggtataaacatattttaaaagataaaggaagagagatataagtagcgggctacagatttatagccagcggcagcacggactctaagacgtactgtgtgtataataggtaggaccagatattaatagtacagtaaacaactattatatgaattagctattacattggctatagatggtctgtagctaataattagctatactattaagcgtgtctcctaccagggaccgcgaggtagaagctaagccgaaaatcgtcccaataagaacaaatctccgcctcgacaacaaattaagacactccccaaacgatgccgacgatctccgacagcccatcgatcgaggggttggagggatcattgtcaagacaattgcgataactgcatgccgggctccagaccaagatgacaatcgtggccattgcgaggatcgagaatgaagagactctctcggtcaccccggcggcaagatgacaataattgttgttctcggaccattgctcctgatcacggtgacccttcctctttgtccttgtcctcctcaaacaagtagtacaaaactttccctttctttgttcaaacttcaatgattgactgcaaaattctaatcattattagaattaatagatgggtcttagcccattcaaaaattaatctttacaaaatcataaaagcccacctcataaaatgacatgcatggagaattcagcaccatcttatttattctatgagagggggacctccttataagggaggatgtaatcctagccacttaagcatgtgaggtggagagaagaaggggaacacacgcgcgtgcttgcctcgccttgtatggcatgtcatggcggtgcgcgtgcacgatggtacgtgtcgaatgttccgctaaaattggctcctcacccttgcgcatatgcaaaaatttagaaacactccgcgtggtacgtgtcgaatggcaaaacctctaatgg

SEQ ID NO: 50236 - DNA, 8014 bp, Oryza sativa
  unsure (1)..(8014): unsure at all n locations
tttagtagtttaaaaaacgtgctaacgaaaaaggaggaacagctaagctgaactagctcatttttccaacttaccactctccattttccacgtgcactctttttaagtactgaacagtgcattttttttaaaaaaaaattatatacaaaagttgctttaaaaaatatcatatgaatctattttttatgttatttttagctaatacttaattaattatacattaataaaccaccacagttttcgtgcggggagatgctgcgcgtaggtcgctgtccatggcgagaagattattttatttagttgtcttttttaccaatatcatgagcaatggttcgtaattacggactaaaaattgttggaatttcgggtctatcaaatccctgataaaaaaactgttttacccgaaagtttggatttatttggcaagaaatattcaaatttgacctaattttaattaaaaaataaattactttagaacaaaattgccgtaattttcgaaattttggtactgtcgatacccaaccgaaataatgaacactaaaacttcttatcatcagtagctgctccctccgttttaagtgataagacgttttgactttggttaaagtaaaactactctaagtttgactaattttatagaaaaagtatttttaacctaagaaaaatatattatgaaaatttaatcaattatagatttaatgaaactatgctggtgttataaatactagtaattttttctatataattagtcaaactgagagtaatttaactttgactaaagtcgaaacgtcactgaagttaaactgagagtagtttaactttgactaaatgaattggagctagtagttggttatactattaaccttgctctaacttttatataactgctgcacggtgaggagtccaaatggccggcatcacatattcatttattaattggtcatagccaccagtcctgctggtgtgttattattcaaaggtcaaaccatgtgttattgctctggacaaagttcagaagcatgtgcctgctaaagcttgaatcagttggaagtaatagttgaaattacatgtgtacgattaacatctatctattatattatataataaaagttcattaaacttcttacaaacgatcctaaactgccacctaacgcttcctacgaacattcctaaattgccatgtggtgctccttcaaacacttctaaaccgccacgtggcactttaaaactaaccatcgatttttacttggtgagtttgttatttatttaccattaaattagatccatttaaaaggtccccgcttcagcttattatcaggtatatacaagataatttttatgagaaaaattgggagggcgctacgcgtcgggcgtccgatctggggtgggaaaatcgaccacccacgacagctgacgtcagcatgtatacgtgcatgcaaaactactttaaactattttttctgttaaattatttattcaaatcatgatccgattgtaccattaaattcgttgcaattaaatgtttaaaacaagacaacacatggatatatttcgatgaaaattgttttagcttattattaaattatttttaaatgttgcacgctgttccactaagtatatcagaattgtttcactaagtaaatcgaaaatgtttcaatcgtttaaatcgggcgttgtttgaccgaagttgaccgtctacgtggcattccacgtaggcagctcatttgcaaatagccccttcgcgctacagtagagcactgggcaccacaaaaatccccaaatctctcggccgcctccgtcgtcaccttgcccgccgccgcctcatgtcatcctcgtcgccgcacatcgtcctcgtcgcgcaccacggctgtgtcgcctcgctcgtcaagttctccggcctcgccgtgtccctagacgtgcactccgccgcagcgatcgcgtccctcccggcgtcctccgtcgccgccgtcgcgctcccggaggtcaagctcgacgacaaccccaccggtgggctggcgccgtacagcccgccgtcgctaagtacctcaccatggacaccccgcaggacgccgcccgatggcgagatcctccacctgctccacctctactacctggttcttgccaccgaaggacaggacaagcgacagcggcggcggcggcgtgggcagcaaggaggaggaggacgaggcgtgggacgagtggctggcgaagccgatccacgagcggatgccatggcagatgccgccggcgacggagctgcaggacgccggggtgatgttccgcgccaagaggccgccgtgcagccttgtcgacgtcacgttcagccggcgtacgtgacggcgtgctggagatccccaccgtggagaactacgccaactgcgccatacccgctaacctggtggcgtacgagcagaaccggggccggtgggagatgcagcgggtggcgagctacgtgctcctcatgtcgtcggccgcagctggaggccgtgaccaactgctacggcgagctgtacggcgacatgatggagtattgcggccggagctggaagcctggaaccggcaccgcgccatgctggtgcatgactgccatcccaccgttcaaccctactacctgttaggatttacgtgaaatattgtttcatacggtttggatagggttgttagctctagataaagtttgttgttatccctctgtattaggagatgagctcaacaaccctgccggctgtatatatgcatgtataacttgtgatcagcctgatttgaggcttctgaattaacacgaaaccacccaccgaggtgttctccacgcttgcacctctgttctttacatggtatcagagcaaaactccatctagattagtctcatggcgagttcctcctcctccaccgcttttgcaaaccctttgttcggcgtccaagtttctgagaaactcaccaagcaaaatcactccctctggtcggcgcaagttctcacagccctaagtggtgcgcgactggagggccatgtcctcggaacatccgttccgccagaagccgagcttgagcagaaggaaggagaaaaaggagagaagaccatcagagtcccaaacccggcgtatggcgaatggtttgccactgaccaacaggtcattggttttctgttcacctctctgaccagggagattctgtcgcaagtcgcagacgcaccgacggcagccgcggcatggaagacgatcgagaacgtgttctcgacacgatctcgcgcaggcgcgatcaacgtcagattggctctcaccaccactcagaagggccaatcgactgtcactgagtacgtcagcaagatgcgtgctctcggtgacgaaattgctgcaacagggaagccaatagatgatgaagaacttgttgcttacattattaatggtcttgattcagagtttgatccagtggtggaagccctcgtcgccaagaatgcatctgtcacagttgcagaggtctactcacagcttcttggctttgaaaacagggtgaagatccgaacggcgtgcgctgctatgagtggaaaccgtggcggtggaaatcagggacgtggtggcggcaacccccgtggccgcggcgctggacgcggcggcagtggccgaggtggcgggcgcggccgtggcaatggacgcggcggcgctgacaacagacccacctgccaagtctgtcacaagaaagggcatgtggcggcggactgctggcactgctacgacgagaactacgtccccgatgagaagctaggaggcgctgcgacgcatgcttacggtgttgacaccaattggtatgttgacaccggggcaaccgaccacatcaccgggcagctggacaagctgaccacacgggagaagtacaagggcaccgaccaaatccacacagctagtggtgaaggtatggatatacagcatattggtcattcctatgtgcctacatctagccgccccctccatcttaaaaatattttgcatgttcctaaggcgtcaaaaaatcttgtttcagttcatagacttgttgctgataattatgcattccttgagattcatcaaaagtattttttaattaaggacaaggtcacgaggaggacaattcttgaaggaccatgtcggcgcggtctctaccccttgcctgccggagatccaataaaacaagtctttgctgtgatgccatcgttcgagcgatggcatggtcgtctagggcatgcctcaaagcccattgttcttagggttattaatcaaaataaattgccttgtagcaatgagtctcctagtgagtctgtttgtgatgcttgtcaacagggaaagtctcaccagttgccatttcctaagtcttttagtgtctctagtaatcctttggaacttattcattcagatgtatggggtcctgcctctgactccgttggagccaagcgctattatgtgagtttaattgatgattatagtaagtttgtgtgtatctactttcttaaatttaagtctgaagtttttgagaaatttaaagagttccaaagcatggttgagagacaatttaatcgtaagattctaggcatgcaaatagattggggaggagagtatcaaaaattgaattccttctttaagaaaattggcatagcacatcaagtgtcgtgccctcatacccatcaacaaaatggtgccgttgaacggaaacaccgtcatattgttgagattgggctatctctccttgctcatgcatctatgcctttgaaattttgggacgaagcttttcttgcagccacttatctcattaatcgcttgcctagcaaagtaatcgactttgacacacatcttgcacgcctttttcaccaacaacctgattataaatctcttcgaacttttggttgtgcttgttggcctaatcttcgtccctacaatattcacaaattgcaattccggtccaaacaatgtgtctttcttggttttagcaatttacataaggggtttaagtgcttagaagtggcaaccggtcaagtctatatttcccgtgatgtcacctttgatgaacaggaatttcctttctccaagcttcagccaaatgctggagcgcgtctacgtgctgaaatttcccttcttcctgctgatcttacatcgcatgcatctgatcaagggggagtagcacatagcaatgatcatatgcataatatcttacctgttgttgctgattcctcttttgagaatgatgctgcagatgacactgaggcagatgctagcgacagcaatgcagagattaacgcagaacaacctgatggaactcatcctggtgcatcaaccggggtacacacagcagaaacagaagtggcggaagaatcgtcgtctcgtactgatcagtggcgcgccgtgcaggcccccgagcaacctgcgaccgccaccgaaccagcagccgccacgtcgtcggctgtacagagctcccgcgcgagttctcgctccatcgcaagccaccaccagcccggaggtgacacgtcgccagggcctcgtcatgatgcggcaggatcgtctgcggctccggaggttattgctgaaatagagcaaggtgagattaatggtagaccaaaaactagactccaaagtgggattagaaaagagaaaatttatactaatggtacagtcaaatatggttgttttacatcctctggggaaccacagaatctagctgaggctctaggagataggaacaggaaagagtctatggataaagaatatcatgcattaatgaaaaatgaaacatggcatttagttcctcctaaaaagggaattaatattatagactgtaagtgggtctataaaattaaaagaaaggctgatgggagtttagatagatacaaggctagattggttgcaaagggtttcaagcagaggtatggcatagattatgaagatacctttagcccagttgttaaagctgcaaccataagagctgttctatccttagcagtctctaaaggttggagtcttcgtcagttagatgttcaaaatgccttcttgcatggagttctagaagaagaggtgtatatgagacaaccaccaggatatgtaaaatctgaggcacttaactatgtgtgcaaattagataaggcattgtatggattgaaacaggcacctagggcctggtattcgaggctgagtacaaagttgaatgagttggggtttgtgtcatcaaaatcatatacatctctgtttttctatgataagaatggagttactatgtttatgcttgtatatgttgatgacatcattgtggctagttcttccgaaaatgccacctcagctcttctgcaggatttgaatcaggagtttgcactgaaggatttggaagatcttcacttcttcctaggaattgaggttaaaaaggtaaatgatgggctagtgctaacataggaaaagtatgcctcagatgtcctgagaagggtaggtatgagtgactgtaaaccagtgaatacacctctgtccatctctgaaaagttgtcaagtcaagggggagcgtcccttggtcccaatgatagcactcagtatcgcagcatagttggagcactgcagtatttgacattaacaagaccagatatatcattttcagtaaacaaggtatgtcagtatttacatgctccagctacagatcattgggcagcggtaaaaagaatattgaggtatataaaacatactgtgaaacttggtctacagattaacaagtctagttctttgcttgttagtgcatttactgatgcagattgggcaggctgtcttgatgacagaagatccactggaggatttgctgtttttgtaggacctaaccttgtatcttggagtgcacgaaaacaagctacagtctctagatcaagtattggagctgaatgcaaggcattggcgaagtgcagcagcagaagttatgtggatacagacattacttcaggaacttggtgtaaaagggcctagagccgctaaggtatggtgtgataatattggagctaaatacttaacagcaaatccagtttttcatgccagaacaaagcatatagaggtggattatcattttgttagagaacgagttgctcgcaagttacttgaggtagagtatgtctcatctaaagatcaagttgcagatggctttatcaagaccttgacagtaaggcagatggagatgtttagaaacaatctgaacctggtaggttgagattgagggggagtgttaggatttacgtgaaatgttgtttcatacggtttggatagggttgttagctctagataaagtttgttgttatccctctgtattaggagatgagctcaacaaccctgccggctgtatatatgcatgtacttgtgatcagcctgatttgaggcttctgaattaacacgaaaccacccaccgaggtgttctccacgcttgcacctctgttcttttcactaccatccccttcccagctaatcacacacgtactattacatgtatcgtatcgtcaccacgccgctgatgttggcgccggcggggacatcatcgagcttgacctctaagagcgtgacggcgtcgacgaaggacgtcgagagggacgcgatcgccgcggtagggtgcacgtccatggacgaggcaccacaccagctcgaccatcagtatgatgtggccggcgaaggggctggcgacgaggacgacgtgtggcggcggcggacgangtgacgacggaggcagccgagggatttggggatttttttttgtgcccagggctctactgtagcacgaaggggctatttgcaaatgagctgccttgtagacggttagcttcggtcaaacagggtatggaccggctacgattcattaaaagatctagatgtgcaatttataagattatggacctaagtgacacccgcactcaaatttaaggaccagcaatatattttactctaaataaaatattgatcacatataatagttatattgtagtgctgaatacatagggccgacataattatttttaaataacttagccaacatataataa

SEQ ID NO: 50237 - DNA, 1745 bp, Oryza sativa
ggaggggaaaaatcgggcgctgacatcagcatgacgcatgcgtgcaaaaccactttaaactattttttctcttaaattatttatccaaattaaatcatgattcgattgcaccattaaattcgttgcaattaaatctttaaaacaagaccatatatggatatattctgacaaaaaaaaatttagcttattattgaattatttttaaatgttgcacgatgttccaccaagtatatcagaattgtttcaataagtagatcgaaaatgtttcaatcgtttaaactagacgttgtttcactttatataaaaacaatgtttcaacaacgaaagaatgtttcagttcactgtaacatttgatctatacatagtgaaacattataaatacactagttgaaatatttttggtggaacaaaaaaagaaacgaattcccttaatagagggtttctaaatatgtgggtgatttgttgcaaaaaaatgtttcaatttattaaaacattagatttatacatagtgaaacattgtgaatatactaggtgaaacattttttgtggaaaaaaatgaaacgaattcccttaatagaggttactgggcctaacatgtagcggttgcaacatacgggtaaatttcatccaaacaattcaaagtgtggtccagtgattctcgaaacaatttggcccatcttttatttattcctttatttagaattcaatcctgtcagtgcaatgcctatgtttggtttgccaaaatactaaacatcccatcattctgttcgcagataatggaaatgctttacattttcggtctctaccatgatcaccacgaggtatatcgttctacttgaatagaaaaaaagaataacatgaagaaaaggaaaaaaaggcaatgtaaagcaaaggagaggatagattcttctgatcgtctctgcctaaaggcaggacaaaagcttctgtttccatcaaagggagatcaaaaaggaggggagaaaattcaagatgttcctacgcgagcagtggcatcaaccgctgtctccgtctccgcctccgtctccgagtgatatcaatggagagatcaagagacagagagtgagaagagacagtgacggagaacggtgcgaaaattgtggcgaatgcaaacttgattggctctcaaatcttcaaagggaatcaagagatcagagtttttgatttcaagcagcaacacacatctccaattcctcagaaactcaccggtgcgatgcgaatctcacctctctccaccaattcgccgatcgcgcgccactcaccgaggcggcattccatcaaacagtgacagcgggtgagtgagagagatgcagagattggtgggggggcggctgacctgggggcgcgttggagcgtttccttggcgcgatcacgccggccctctcggcgagcgcggccgcagcgacaaaccctccaactgccgccaccgctgctgccccgaccccgccgggagtacaaactaaagatcctaactttagtcccgattggtgttacgaaccggaatacaaaggtttctccacctgtgactcgtccaggaacagcagccagagctacgtgctgaccaagggatggagccgattcgtgagggagaagggcctctgcgccgacgagctgctcttcatcgactgctagaagaacaacacggcggcggccaccggcgacgagaagccaattacaagcagcgaagcagcacgtgtcgtgaggctgttcggcgtggacatcgccgg

SEQ ID NO: 50238 - DNA, 1377 bp, Oryza sativa
  unsure (1)..(1377): unsure at all n locations
gatcacacgctgtgcgcgcgctcgccgccgtcgccctcgtccgcttcactcgatcgtggagttggggaggaaaagcgacaactcgcgtcgcgcggttgcgatgcgagactaagccatatatagaacgagattcgtttttttttaaaaaaaaaaaactgccattaatctttttttttcgttatcccgacaaaaaggaggtgttttgacacgttcttttttctttcttttttagaacaatttgacacgtcccgaaatggcatctactacaagagcttagggaatattgttagtactattttgttttctttctttatgctaatagaagaatatacataaatgattgctctgtttttattaatataggacgttgtttcgttttggatggtgacgtttaaccattcgtgctagaataaagtttaatgtgcatataaaaatatgtaagtcataattaaagtactcatgcggttccatgaaacaaatcacaataaaaacaaggttactagtagttactataaaggagattggtgtatatattaagtttttattgtataattacttcttatatggtcaatgctcttcacaattttctttttaaaaacaaaaaaggttactagaaggagattggtacatatgggaagttaaaaaaaaaaaacttgcttcgagagcaatgaattctatcgtctttgtctcaattctaataaggccttgtcgccttgaagttatttttaaagagtgtcatgtagattttcataataatatggaggagatgagctacccttgtataagacgcacactctacaagatacaagagacgaaagaaaattttcataataatatggaagagatgagctaccctcatataagacgcacactctacaagatacaagagatgaaagaaaaggaccaataaattaagagtaaataagttaggtatttgggcagatatactacatgaaatatgttgtgtgtgtcctgattaatgagcactacactactactagatgatgccgctggaaaatcctagtgcacaaaatgatattttcacaagctttgaacgtacttctccgtgcgctaatatagattagtgcaaatgatattttcactagtttacgtaaacttgatgcagaaaatgtacgcagagagctgtgacaatgggcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50239 - DNA, 1411 bp, Oryza sativa
aagctagactgtttgagggagcttctgattctgggagaagctacagcagctagcagttctccccaaataggccctatgatagaaattgcaccatctgctcccaagcttattaagcaacccaagaagaaagtgtcgacgagtggtactcgtagaccggatgattagggtattgggaaacgttggaacgaggatctacgtaatacgacatcaagcaaataaaagacaaggattatactagttcaggccccttatcaggtaatatccctagtccagtttatatgagattgatgacggagaaccacagattacaatggaagttagcgaaagtgcgaaacagacgataccgacaagatcgtaatcgatgtattcgacgagatctcccagttagttagctccgcatactccatctttgtaaactatggcgggtgtgttgagatgagattcgatgccttgcacccctccatgggggtcccttttataccgtggatcatcttgattctcaagtaagactcagaaacattggatcttgtacgatataacacaaactctatcccttccgagtattactttggaaatcacttgtcttggggagatattttccataatttataacagattccaacagcgtatacgggaacgatccgtatacgtgaaggtataccttatctgtgtattccataagtcataggatagaaggtatgacttatccgtaaccctgacagtagcccccaacatcaacttaaatgaattcacgttgtcgcccgcgacttctccggccagcgccttgtcgtacttactttgtcgatctcggtgcagaaccgtggagatgcgaagttatcgacaacgctagagggagtccaatggttcaaatatgaatttaaattgaagtctgaacaaccgcccttaacaagcctcaggatttttcggcggcaatctctttccttccttggaatgcgaaccgtcaggtagtgcgcctatttaaaggggttttgggatccatttcaagttcgtttgccaaaaatcctccagcttcatagcagcctcggacccttcgtctccccaaaagccttaggtttcttcgtcttcctccggcgatccccttgcaatggcggacctcggcaaatcttcctccgatgcggcctccttgaagaatctctacacagacggggccatccctcccaagcaaaccatggcgagggaaaaaggaggtactaatccctctcctgctttaggccgtatggtagtggtagaggatttcatccgctgtggttttttgactcccccttcggaattacttttgctgactctcaacttctatggcatttcgcttttgcaccttaaccccaactccatcgccttcctgagcatctttgctcacctttgtgaggcctacattggggtagtgcccttc

SEQ ID NO: 50240 - DNA, 3183 bp, Oryza sativa
gtgagtggaatcctagatctctttttgttgttgtgttgacaggtcttctgaatgtctttctgatgtcggcaggacggcctcgacgatatctgcacagagcggggatgaggtcgcgaccagcgcgactcccgccgctgcttctcctcgtgcgggcaccacgcccagcgtcgccgaatccgccccatcccccgtcgtgcccatggctgccctgccacctcctactccaacgggaccatcaacctggtctcaaatgatggccgagagccagcgccttctcgagacggcttctcgagaggtggtcgccgagatgggccgtgtggccgcccgtgcaacagcgtcggatgggcgggtggcccagctgatgtcggagctcgatgtcgcccgcgacgaccttcagaagataagggagatcgtggccggcaatgagatgcagcgccaagggttggagctgcagatgaacgatatccaagatcacatcatctccatccgcgagtcactccggaagagcttcaccagtctgcactagctggccttggcgtgcggcgtgaagtctaccatcccggaacaccccgacgagacctctgtgacatcgtcgctgtccgagctggcaaagacgatggaagttatcccctccaagcacgctgccaaagtctcggaggagatctctaacgggatccacacgggggcttgtcacgtgctcgcgtgtgtgaagctcgctctccctgatgctgatctaaaagagatcttgtaagggggcagctgatgcaacacgcgaggacgtgatgtcagacatggcggatctcggggaaactgttcccctctatttgaggagtattttttttcttgtactttgtgtccattgtataaacactttgggtttgctctgtccttggtagaacagttgtccctttttatgccatggtaatttaatttgtagcttgtttttccttcatagatatcttgataccgaggacgtccagcaaggcggacgccttgataccgcgatgatcgctccggctttgccagccacggcacccgcttccgacgttgtcggggatatcatcgtgtttgagggcacgaatgtggtccctcgccgtcgggtttaggcgtggtttcgctccttcaagagaactcaggtgggatatcttaggactttcgctctctacccttctgggctcgcgaggcgaatttccttgaacccttgccttccgcagacctcaagagcatggtggctgagcgagatcatcgaatcctttactggaagacgaaatttgagggagtggagcttgagcggtccgttgtggttgtaaagaaggaccaggctatagaggcgctccgaggtcgtgaagtctggttgaactcgtacctcaatagctgctgcagtgctatgactgaggtttgtcgccagctaaagatcgatcgtgcggagcccgaggagactatgtgggctatttgtcttggatgaggggtgcgtgtgctcagctggaggacgtcgggcagcagattgacaactgcctaaaagaggagtgtcgtcgtgctagccgatacgctggaggtcacattctcgcctgcatcggagatcaccgctcacagatgaatctcgagttcctacgcaaagggtttcgccattcgtggctgtcagcgaacgagattgaccagctggcgtgttcctttgctcctttggctgagagggtcttctcgtccatgaactagcaatggccgtcgtggtagactccagcccctgtaaaagaaacgcctagagaaggatttgtaacatatggatatttgtgtcagaactttataattagaatggaaatccatctactaaatgtttgaacaagttgtgctgtgtgcgagtactactctttatacaggctgttatttgcctgttgtcgagttggatactctccctagcccccagccttgtccttggaggagcccgttcttggaggagaaggctcgacgacccgaaacctaccgagctgaaactgcgatttacctagcccccagccgtgaagttggaaaaatcaatttccgattacacggcttaattaattcgccaccgttgagcactcttacatgactaggttttacatggtcgtttggctcttagaatccgacaaaaccttatctgctctgggcatccccagccgaaattcccgtgggtttcttggaggcttgtcggaatggcgtaaagggtcaataggtccgattgcaacatttggtgttatcgtggtaagggatctctgggtgaaacactgttagagttgttttgttcataaagaactcaaatacctttgggtagcttttattgatcggatatttatgtagttgatcaatgtttcaagagttggatgattcacggccatcgcaatctgcaatcttgaatacacctggtcgtaagactggcaccacagtgtacggtccttcccacttacgcgagagtttgttccgccatgcctgggtttgaactcgtcggaggacgtaatcgccgatggcaagtgtacaagctctgatgcgcttctcgtgatatcggcgtagggcctgctgatatgcggctgctcgaacggcaactcgttcacgatgttcctcgagtagattcagatcgtcgctttgcctttcctcttgctcctcgtcataatatttccgcactcgtgtactctgatgcggctgctctgtggggagcatggcttctgttagttttagaaccggaaacatctttagttaccgattggtgttaccaactggtaaaaaatgcatctttagtaccggtttgtaacaccaactgagactaaagatatttttagtaccggttggtgctaccaaccaatactaaagatgccagttaccaaccgggactaaagatatttttagtactggttggtaaccggtactaaatatgcctctaggaatagttcgaaaagaaagcatatctatccaagtcagatgtgtgtagtaggtggaatggtaacgcgcgtgagggctgaggtgagagatcttgagtttgaatcccacatcccacatattattttttatttagtatacatatttattaccggttccttcaaccggtaataaaaatcgagatctttagtctcaataatttagctccgttgctataattggtaataaagggggttacaaaccggactgaaaatcgcttctccagtagcgaaggaaatg

SEQ ID NO: 50241 - DNA, 1722 bp, Oryza sativa
ttgcaacagtattatatataaaataccactcaacattgaaaatatcaggttggggcgcatgactgtatcaatcaatgcctactaatatgattcgtgttattgtccgtgttagtgttagtgttagtgttggatcccttcacgaggggtgtatttagaaatccggtatttgttcagggctaaactcgcaaaactacccacccctcccccccctctcaacgacacgacgacatccgcttgtatttctttcgtttaacttcgttctctcctctcctcttcctccccccacccgcctcgtcgccgatccgatccgcctccgcctccgcctcgcggcccggcctgcctgcctcgccgccggtggtcccgatccgaggtaaagcttcgtctcgtctccctctctcgcgcttccggtgccccgccgccggccaaaatcccgccgcgccgccgcctctcagcctgtttcccggcggattagggcgagtccgatccgtgtgcctgcgtccctgcgttgatctccgtcctcgcgagagcagcctcgccggcgccctgctgcttcccgccgcatcctcgccgttggtgccacccgtgctttcccccatccctcgcgtcgcgcctctctctctctctctctctctgtgccttatcgtgagcttctcttctagatctgggggcttctctctttgccttaaccgaattggtgaggtctgccccctgattcaggggggcgcagggcggagagattggctgagaggctttttcgttgttgtcggtggattaggatgatagagcgatcgatctcgttaggctaataatttgtttgatccgatcaggttgattgatggtgttttacctgcgtgcaggttgctcttgctgggcatcaaacatgggtctggtgaaggatggcgccgccgatttggaggaggggaccctggagatcggcatgggtgagtaacgagatcggatccattgcgttgtgcttttgcgtgatcagtggcctgtgagttttgtgttttgcttccgggcttctggcggcgtactggtgccattgcagctgaacagtgcctgcattggcactggcatgccagattttttgttatgaaaaaaaggagcctggttaaacttttcagaagttcagcaaattgtttgtgagggtccaatcttaatgtttgatcattggatgctgtgatagcttagttacccgctgaatgaagggtggaaatattggtgtacagatacttaaaattgctggttatcctatttataatgctatgctcacagtcaggttttgttcaagtacttaacctaatgtgccaatcatgatcggccctattcattgtcggcgttacattgcagttttaaccgtgcaacactatgtcatgtccttatgtcttaagtttaccatattcttttgtttgcttactatgttgatttgctgtgatttatagcacatctaaaagtgcaaatttcacaaaagcaccattcattgtggtatagacactgttccagctttccagtcttagtcataatgttgtgataacagcaacctttgtcaaacggcctaataaagatgttgcatactttcttttttcaatttgcagagtacaggactgtttctggtgtggcaggacctctggttatcttggataaagtaaaggtacgtgctactgttcctctacaaattttcaacagactaatctggtagcaagttatactgagcatttcttt

SEQ ID NO: 50242 - DNA, 1373 bp, Oryza sativa
gtagccaagcatttctctcacataaagataatctgactatttgatgacccagtgagatttgggctcacatatatagcttaataactttagttgtacatggaatcctacataagttcttgatttgaacatcctgttcttttgacaatgattggatgttggcattatagtttttgaatttttatggagaaaaatccatatggtatgctgtagagcaatttacctgttcatttttttccatggagacatttttgcatcgctgaatcactgcttatttgctgattacttttaatctccagggtggtgaagatgacaactttgctatcgtgtttgctgctatgggagtgaatatggaaacagcccaattcttcaaacgtgattttgaagagaacgggtcaatggagcgggtcacctttttctgaatctggtacatatagcagacttttgaagttctgattcataccaatttgttatgcatggaaactaattctgctagtgtatatgtgcttattttctgtatggttatatatgcatcatttttaacagaagttgacctgattgttaaaggtagaacatattttctaacaccaggctactctgtttacaggcaaatgatcccaccattgaacgtatcatcacccctcgaattgcactgacaactgcagaatatttggcatatgaatgtgggaagcacgtgcttgtcatcttgacagatatgagttcatatgcagatgcgctccgtgaggtattttgctttttatcttttatgatgttgtatactttgtttctttctgttttattacctattcttagaccttaattttaaggaatcatatactaatttgatgtcgttacttaactaaaatgtcatctgtcatccgtttggttgcaaattttcatgtttgaatgaattaaaatcatgaaaaggcacattttcgattacttcgcagcatgcatggcacttgtacaaacatatgtggcatctagactgatcactttatcagaaatgacactagcttggttatgacagtgaaaagttcgtgcattttcatttgatgatgtcaccgttgaccaaaatggctaaatgtggatgttaaagtattcatgtttctatttgcttctaacagtgtgttgtggttttctctatctaaaatggtagtattgcattttccatgttatacatctccttttatgttcgactgcaataaatgataaattgctgaaattttatttattgtgattggcactaatacaacacggtaattgtgcttatatgtaggtatcagcagcccgagaagaagtgccaggtaggcgtgggtatcctggatatatgtatactgatctggcaaccatatatgagcgagctgggcgtattg

SEQ ID NO: 50243 - DNA, 1540 bp, Oryza sativa
ctagctagtcaaacaactacatgcatcgtgcatggatattacttcccgacgacaactattgtaaaagtctgatcttaagttcaaaccacgtgagctgaccgcatgatcaacgcattatgcggataccttaattaagttcccaagtcaatcaaattgagggtacaagacgaaattgattcccccacacacttgctccttcttccacttccatcctgccctatataatatatatatatatatatatatatatatatatatatatatatatacttagtactgtacgtactaaaccggggattgatcaggagagtgcagtgcaaactcgcagtgaacctgtgtgatcgatcggccatggagtcgctgctcgcagccggtgcgggagggatcggcgtggctgcggcggccgccgtcgtggcggcgaccctcgccgtggtgccgcccaaggaccgcggcaacaacccgcctccaggtaaccggcccgtttcgtcgatcgttcgatcattcagatcaattgccgtgttttgccatccgcttccctgtggttatctacctactccctccattataaaatatagagatttttagagtttgatacagatattaaaaaagtaagttgaattaaatgggagaaggttgtggttggttgagaagtggaagtagatgagaaaattaaatggtggagagatgtgattggttgaaaagagaatgttagtggagaaattgttatatattgggacaaacttttaagagttaaaagttattatagttaaaagttattatattttgggacggagggagtatatatctatcttcattgaattgttggagatggcatgtagccgatgaccttagttagccatgaaaaatattagctagccatgaaaatggagggatagtttcggtttgctatagagaaaaacgaatactgatatagttcaaaacggataattattgaatagttagaaacatttttttcctcggatgtgaatacgaatattgtatagaattttagacggataagatattcagtgaacagtgatattcgcatattcgctcaagacataaaacatacaccatttctctctaactcaccttcaatatacctctttagattttaattgtagcacatctcatgacacaagtctacacaactaatattatttaaattttaaaatatttttataaaatatgctatattttatatattataatatcagttatatatgtatttttaccaatgttgttattcatgcatgtcgaacttaattagcaatatttaatctatgatcaacctttttataaaaaataactaattatgtgtgatggtgtttgtttctattaaaagtagtttaggtggtttttgtgtttccagaaatatttgttttgtattcgtgtctgtttatatttgatccttatttgcattagagataattttgtttttctttcatatccaacctattcggttttgtatatggtaaaaaaataaaaaaatggtatgagcattttccgttcatatccgctctattttcatcccaaaatt

SEQ ID NO: 50244 - DNA, 1442 bp, Oryza sativa
aaatatatgattttattgaagtactttttaagactaatatatatatatatatatatatatatatatatatatggttttcattttttaagataaatattttagaaattatttatagtcaaagattttaaggtttgattttatccttatttaaagcgactaatatcatcagctcggagggagtatgtaattttcaaaaatccctaggtgatgtgctacttatgtgaaaacggaggtaatggtactgaatcgcctcacatgtgagtgggttgtgattttttcctacatcccttgcgaattttaaagcaaatcgaacggttcaaatttatatcgtagttatatgtaagttacaatgtaattacactacaattatactatatttacatctgccaaaaccactaaccacctcctccatttatattactccctctgtcccaaaatataagcatttttagaacagtgctaagtcaaactttttaaaaaagattaatcatgtaaatttaattttattatatttatcattaaacgaactatcataatatgcaactctttttatttaagacattttacttttgtagatattgttgattaaagtatcatctcggagatcgtgtacatgtaaaaaaaatacttatgttttagaacggcggagtacttgtttgtgcacaataggtgtgctgtcgcagccgtgagtgctgttatagctcaaatcctgttatctacgccaaactgatcattcatgctcatttctaattgttgcgacaccagaaattaccattccatcaaaaaaaaaaagcttacgcactagctgaaacagagaaaattcgacatattttccgacgaacaaactaaccacatacactgccatctccaacagagatcaatcaatggagagagtacgacgaacaccgagacacagcagcagtgaggatcaaaccaattggagaagatcatttgatcgatcgaaacgaacacggcgagctggattaattaattacctggaggcgggttggcgcggttcttgcgcggcggcggcgccgcgacgagcttgtcggcgagcgcggccgccgcgacgaggcccccgacggccgccaccgccgccgcgcccgctccggctacgagcatcgactccatggcacacgatctgatcacacgcactctttaattaatcccggctttcttatttatagaggccgcagcacgtcgaagagcgaggaaataagaaagggcggcgtcgtcgctgtaccaacttgaagtcttttttgttgctttttggctgcgttcgaccgtttgttgctagaagaaagagagaggtttcgctccctttccacgtgagtactcccttaaacaacctctgatagattttttattggacggagggagtagtaatcatcatttttcttttataattttttctataaataaattacactaattttgttttt

SEQ ID NO: 50245 - DNA, 1844 bp, Oryza sativa
gtcattgtttggtagggccatgtacacatacgcttgcacattcattaatttgcgtttaatttcttctgtactccttgggagccacatgtagtaggtaggtattcatcgcgcggtcagctcacgtgctttgaaattaagaccagcctttatgccaagtaatacccatatgcaagtacacctgattttcgagtttcgactaattacttttgctgttctcctcgttattaatacccacttggtaattgctaaatatcgacttaaaagatttttcaatgtaactgtggtgtaatattgatatcacgacagtgtaattacactataactatatacctttatatatatataacttactataaagtgacatgcattttaatacttatatatatacaagttacataaaatttttagtgtagttatagtatagttatattggaattacactatagtagttatatttgaaagttttcactcaaagaatttacgtcagttctttatctagtgtcgaccatattagtttgccttaaaaaataaacacagaagttataaattagtccgaccatgatagttttcattaaggcccgatcaatttttaataataaaaacagtatctctgtcaatataaacacggtcaagaattttaaaaagataataaaaagatacgaagttatgtgacaaatccttatctccttcctgacaacaatatgcagactaaaataccgaatagaaaacacatatattttataataatattatataggaactacgccattcaaaataaaactaagatatgaccattggaacgggttaattaaaagttatataactgtaaagtgagcataactcaattgtttagatttcttatggtgaaacttgcctacccaaattcaagttttagacgtggcacatgtgctcgtattaatggctaatagcatagtatcgataaagtttcctggtcctcctcctcctcttgcctagggtcatggcgagggaggaagcggtcattgcgatcaaaatcagaacttcatagttcacacaatatgggggaatttgaaactccgttacttgtcttcgttgcttgtccgtggtggatttgaaaccccgagatccttggccatcggatttggcaccgcttgagcgcttcctcgtcaccgtcccgaagtgggaggaatgacactgatgaccatctccatcctttctttatctccgctctctcaactccgatatgatagtgggatagcagatgatgtcccttttcttttatttattcataatcagtactggcgtcttaaaaagtgaaaaaaaaacttcgcaacataaatttccaatcagagaactaagatttttagtatttgtccgattttttctagaattttctatggcatttgctatttgatatgcatggagtgtgtacgagaagtttatgtacataggatatatatttccttctaatcatccttttcgcgaactaaacacacccttagccaatagccaaatagccaaatagccaaaaggctgagaaagatattccttctaatcatccttagtttatcttaattagcgcaagatcgtacagtggacaatatgcggaggcttctttgcaaaaaaggctgacatgaagcggtgaatttccagcgatctacgcggtgtttaattagagaggttaatattcagttaccggtcatggtaaaaccgcaatgcttaattttttttggggagaataaccactatggtccctgaagtttcgctttaagatcattttagtcctttacctttcaaattgtccaagcaagcccttaaactttatcatgtagacatatacagtccttagcccatcaaaaattgcc

SEQ ID NO: 50246 - DNA, 820 bp, Oryza sativa
catttaatatcctttctcatctttctgtgattgccaatcagatttatctttagcaaaaaattagagtctgataacctgtaacatcaagagcgacatgcataagagctacatgtaatcctactgccattgagtgctacaaaattttcaagaaactcactcagttattgagttcgtcgccatgccgggctgtctggccgcaccatcctgggggttgctgcccgtgcctacctgggtactggccatcagcgtggccgtgggctggctgcccatgccgccggggctggctaactgcgcccgcctaggactagccggccgagcaagcctggagctggccactcgtgctggcagggtgctggcctcctgcgacggcctggcctcccgtgccgccggtccatgtcctcctgcgggcctgagggctggccatctgggggcacccgccagcgccactcccttcaggggcgcgcctggggcagccgtgccacctggagggatggcatccgtgccgcctgaggattcgtcgtcctcgccgcccgggggtcaccatccacgctgccggccataggggcggcgatctagggtttgcagcggcgtggagtcgaggcacgggtcagggatacgaagcacggggagagggtagttttgtcttccttccgtggggccatgtttgtttttacagtagagactaatgggagtaacaaaaaatttgagggttgtatagttagggaacttttgaagtttgggtgctagagagggaagagtatttttttttatgctacatagggaattttctcattttccgaagggcaagcaaacaagtcac

SEQ ID NO: 50247 - DNA, 777 bp, Oryza sativa
tcgatcgatcacacaggctcactgcgagagtttgcacttgcactgcattctcttgatgatcaatccccggtttagtactagtattatatatagggctgcggctgtgttcgccattgctggtccccaatgggaacagtacgcacggaaaacatagcaatccattagtgtgtgattaattaagtattagctaatattttttaaaaataaattaatttgatttgttaagcaactttcttatagaaactttttttaaaaaacacaccgtttagcagtttaaaaaacgtatacgcgaaaaacgagggagagggggctgggaaaaggggcagccgaacagaggcgccttcgctgtccgaacccgcatatatgttcatgcatggcgcttaatttcttttaccctcaatttgattgacttgggaacttaggtcgataaaattatgctgcgctcctagtattctgagcaccaaacatgtatcagcccaggtctacctcgccccacgtccctttatcccactcccaccgttatcgaagtaaacgatttatttcgataaaaacaactttccagtttccacatcccatcatcccgctcccatcgttattgaagcaaatgatttatttcgataaaatcaacttccctacttctggtatatattatatttttccatgtacccaactaaccactctcacccccacttcattttttcctctttttttttggatctaaatcgattcaccatcctagcccatagatctgtgacgcaccatggaggaggacgacgg

SEQ ID NO: 50248 - DNA, 829 bp, Oryza sativa
tgccatagcacccgttacaatgcaaggacattttttctaatatattaattaagaaaacagagatggtatgatcattatttagccttcatcatggaaccgctagcttcttctggctcacatcgatcgatcctagcttcctctgggcttgaggtgcacgtgcagcgggtgaagcttcaaggcagtgtactgcatggtatcctccttatcaccgtcgccctccctcagcgtccactggagctcctgcacgaagcgcgcgatggcgacgcacgcgatgctcaccgcctgctggctccccgcgcaggtcctcctcccggcgccgaacgccagcgtcttgtacctgtcggccaacttgaacccctcgccgaggaatctctccggcgaccactctccgggcgactcccaggcctcctcgtccatgtggcacccgaacacgttgatcatcacctgggtgcccgcggggacgtcgtagccggcgagcgtggtgtcgtcgtggacgaacctcgtggggagcaccggcaccggggagtgcagccgcagcgtctcgtggagcacggcgtcgaggtacggcagccttggtaggtcctcctcggtcaccgccttgccgccgcacacctctcgaatctcccggtaaagccattcctggacaaatttttaccagttttaattggttggcaaaatataatgctcaaattaattaattaatgcatctgacagacattaagaatataaatatatatatacaagatcattcttttttcttgcctgtttgtcagggttcttggcaagctcatacatggcccattcagtggttaccaggacagtatccaca

SEQ ID NO: 50249 - DNA, 2511 bp, Oryza sativa
aagccagctgaggtaggggaagtagtccctccaatcaggctccacgacacacgacaatatctcatgcacaaggacatggaagatctcttccttggatatctccctcccaaactcttccacataaactgaacacacatcctcacctaaattctgaaattgcaacaatcatgatcagtacaagtaacctgaaatcgcaacaattctataagtccataacaatgttcgttcaaaaaaaaaaaaagagaagttcataacaatcatgaccagtacgttcgactaactatgaaatcgcagcaatcatgaccagtactagaagtaacaaacggaccattggggtaatacaattatacaaacctggatcaaggacaatccgaatagctcagtagtgtaaacttctctgaagttcagaggggaatgtgggtcaacagcaaccaatttatgcaaactgcttaacacgttactgaccatcctttctcttgtatcgcagaagtgtttctgaaatttacgcaagcattgcattgtgagagcttaattaactgagtgtgacttgtatccagaaaccacaagtaccaaatttaaaacagttgagatttgtacctgcgcattaaaacctaaaattgcgagcataatattacgcttcgccatcttatagaagtcaccatagtcgctgatggaaaccatgtttttacggcttatcacagacaatgcttttggtagctttttagttgatattgatgagaatttttcaatcatcgcctgcaaaaagtagtacagaatatatatatgtgtttttattatttacagttcaatatgagattatcagttataggtaactattccagaacacgaaaaagaagtaaaacatttttttttgaagacttagatatattgaggaagcagagagttcaaagtctgagggatgatatcccttaggttgccttcatttttccaaacaaagtattgaagccaagaacaagaaggaagagaaacatcaaacatcatagcacccacatcatgaactagaagccagcatcatagcacaattgcatggaccaaaacgtttacagttttacccccatgttagaagagacagagaaataatataatatcagctctatagttcatgttgtagtaggattttccttttttctgtatcaagataaattggaaatattatattgccattttattaagaaaaagaaaatccagtttagaatcctaaacttctgcaagaatccaaaaatcaaccctgaactataagaaactggatatgatcgcacctcaaattgtcaaaaaccatggaatctacacacacacccctcaaactaaaagcacctccgttctgcatatatgtaggcttgatagtactattgaaaagtacaaggcttgtcgctaagggctatactcagaaagaagacaaatatttctttgacacactactacaaaacatcaaataggtgtcgccactataggtgccggaagtactaaaaccggcacctatatgccttttcccacttcccccagcttgaaatcgctaaaaaccaacacctttaagcaattataggtgcctgttctaaataagaaccgacacctattctataggtgccggtttttatagaaaaaccggcacctttaatatattataggtatattaaaggtgccggttaattaaaaaccgacacctataatatattatagttgccttttttaaaaaaaaatccgacacccacagaatcgagccgagccaggcgggtagatattcttccaacggtggggcccacacccacgggagataatgacgagacgtcgagccctcgagctacatccgtccagttcttctcagcttcttctctccctctttccacttcccttctctccatccttcttctcctctctctctctccgtgtggcggcgggaggggcgtggacaggaggtgcggcggtggcggcggtggacggcgtggaggcggcgggctaggcctcgcctccgccagatccggtggcgtggaggcggctgtggcccggcgggggcgggaggggcggccggccgggcgcggcgccctcccgttcgctagatccggtggcggaggggaggcggcacggcccgacggcgggatgagaggcggcggcgccctccctccgtcggatctggaggggggcatgcggcggcggtccggcggcaggaggtggtggtggcccgacggcggcggtgttgaccggcagtggtggcgccctccctccgtcgaatctggagggggtgcatgcggcggtggtccggcagcaggaggtggtggtggcccggcggcggcagtggtgaccagcagtggtggcgccctcctttgattttttctgatttttgttgttagtgaaagattgaagctgccgcattgagccatcttgtatgttgtttgggaatgatttttgtgaaagattcaatgttagtgaaagatttttagttatgtttttcatgtttgtttttctgtgatgttgtttgattggggattgggattg

SEQ ID NO: 50250 - DNA, 872 bp, Oryza sativa
ataaatttgatagaacattaacatctgcaggcttcacagtcaataaggcagataaatgtgtataatatcgctatggtgggggtgagggagttattttgtgcttgtatgttgatgacatactattatttgggacaaaccttgaggtgataaatgaggttaaatcattattgtatcaaagttcgatatgaagcatttgggagtagctgatgttattctaaacattaagataattattggtgaggatgggattacattcttgcagtcccattatgtagagaagatcctgaatcgctttggctacattgatagtaagccttctccaacaccttatgattttagcttgttgtttcacaagaacaagataattgctaggaatcaattggaatactcccaaatcattggcacacttatgtacctagctagtgcaactaggcctgacatctcctttgatgtgagcaagttgagccggtttacctttaacctgggagatgatcattggcgtgcgcttgagcgagtgatgcgctatctaaaagatactatgaaattggggcttcactatactaggtatcctgtggtactagagggataaagtattttaattggatctctaatgtggatgagatcaaagccactagtggatatgttttcacactatatgatggtgctatttcatggaggtcctgtaaacagaccatttgacgaggtcaactatggaagcaaagctgaatggcttgcaaacagaccattttgacacaaccattctgctactgttgagatagaatggctgcgtaatcttttgatggatctgcatgtggttgaaaaaccggtgctgggtattcttatggactgtgacaatcaaacggtgattgtca

SEQ ID NO: 50251 - DNA, 834 bp, Oryza sativa
attcctgcagccctgcaaaatttgtgatatgccaccctgacccacatgttattgactcatgtgggtcctaaatgtcattgagatacgggtggcatgtctcaaattttgtaaatatagggtggcatggttacaacaaaccgaaaaaagagaccgggcgaaagataaaaaaagcgaaaaaaataaaaaaaaatccgacccctatccgattccctctcagaaacgaaaaaaaagtccgactatagatccggttcccccttaaaaacgaaaaataaaaggcgccactccttttgagtccgagatacgagcgactactcctctcagtttcaatctatatcgtgatatctcacacatcttggtgaaacaaaatgatgttccggattgaaaatctgtttaaaaaacggaacctacaggtcgagagcattccatttttatatgattttaatttttgggtttgtacttttacatttgagtccctataatcttgcaataagctacttgaggtcgtttttgttaaaaataataataaaagagagagaacaaaagcagaaaggtgcataaaaagagaaaagagtaaattgcatcttagaccatatttttttaccatggtttcactttgggatactcttaacataatgttttcactttaggcctgattttattaccaaaacctttcactttgggccattggcccataatcagtctctcaaagcctatctctcatcactatctacctggtcatcttcgactcttttcgtccatggctctatagatcacaaagggcctatttagattgttaccctaccaattttttggtagtgccaaaatataggcaag

SEQ ID NO: 50252 - DNA, 1624 bp, Oryza sativa
aaaccatggttaaaaaacatggaccaatatgcaatttactcgaaaagagtaaggaaagctgcacaaagaaaagaaaaacaacaacaaaagttctgttttccctaagtggtgaaaaaaacaccatagatccaaacggaaaaaaaatccgattcctataaaaggacaaaaaaaaagtggtgaaaaaaaatactagattcgattccttgaaaaacaggaaaaaaaagtctgattcctataaaggcaaaaaaaccgaaaaaacaccttaaaaaagttcatccgattccctaagaaagtggcgaaaaaatggttcgtaaaaaaataaaaagctggttcgtataaaataaataatgcacacgagaaaaaaaatagaaagggcgaaacaaagtctgatttctaatcaatatatatctcttctttatctctaatataatctaactatttaaaaagagaaaatacacgagaaaataaaaaaacatgctaaaaaggctttccatcttccataaaaaaatttaaaaaacatgcgacgaaaaaaatgtcagaaaaaacgcgcctttttaaaaaatggttttaaaaaaccatgcatgaaaaaaacatcgtctattaaaaaaatcgctctgagtcggataggatccatcgattttttgccacctattacacggcttttatttcgtcatatattctcctgtattgacaaaaagcaaaaaaaaaggaacatttgaaaaaaaaacaagcaaaaaaacgcgcgagataataattgtcaaaaaaggcaaaaaaacacacgagaaaagaaaagaaaagaaaaaaagggagaaaaatatggttttcattgtaaataaaaagcaaaaaaaaacatgctagaaaaaaacttttagaaagaaatgagccattgctgaatggtttgagaaaatcgcgcaagaaaaaaactgtttataaaaaaaaggttctcattaaagtacaaacattgtcattgacatgattattcatgaaaaacgcatattatcattagaatgttttcacccgttgcaacgcacggacatttttgctattcttaactaattaaaatattcgtaattttcctttcgtcacagtaatttttcgtccgtcaatctgagaagcggcatcctccatacacacgcgcaattacatccatacgacggccaaagcccaaaaaaaagaaaaaaaagagttcgatacaaaatcaaatatggattaacaaaccaatcgaacatcatagttagtattagaactacaccgagagataatcctaccaataatctaatctcatggaagcactttccaaaaccagactttcatagttcgacacaaccaaatcggatgcacaaacaccataagacaaacacaataaccaaagattcacccaaataaaatcaacaaagggatccatgggagaactccaatccaccccaacaaaattagcattgcagcctaaagcaatcgacaaatcccttcttacatatccatcttgacctccttcttcagcttcttcagtagtcgcgccgccggtggggaggcacacggaggggcaccgacgtggggaggggcagctcgtggtgggaggagggccgtcgctggtgggaggagccaatcctgagccactgcgccg

SEQ ID NO: 50253 - DNA, 4044 bp, Oryza sativa
ggaggggcaactcgcggtgggaggagggccgtcgccagtgggggagagatgagcggcacggcatggattattggtgagaacgtgcgcccatcgcacctttccgcaccaccaccgacgacgatctcctcggcgctgcccctacacccatctcaccaatctgcgctgccagggcagttagccgctgctagagtcgccgtctccgaccccgatctacacctggacgcccccccttccgcgcccccattggccggcttggagagtaatgggggagagagagaacgagggacggcttggagagtaatgagggagaaagagagagagtgggagagagagaacgagagagtgagagtgagaggataaggatctccaaatttctctcctcggtaatgtacagcaacaatctttcttttcttttcttgaaaaaacaagagctttagattggactaaattgcagtcaaatgtcaatgtgtgtttttacattgtgctaatccaaggggattcaattccgccaaaaatattttattttattgagatcgttaacattatataaatatttcactttaatatttatttgagataaaaaataacaattgcaaaaaaaatccacgagacttaactccaccccaagctttgttgtcgataccgccacccacgcctcgagccgacaccgaatccgccacccacgacccgagtcgccaccagattcaccacccatggcccacaaccgagctccacctcttgtggcttgacctcaccgccttgaacttcgtcaccagtaccatcgcccattactcgagctccgttgccgccggtttccactcctcccgttgaatcgagaggggaagaagatgccgagggagaggacaattggatctacgggtggcggatctgacgggagctcgggcggtagggtcaagccatcttccttcctctaaaaaattttgaaatatcgttcggcgaaagttatttttaattttatggtgttatttctatgattatatttccttcagtcgaattgcgatatatggtttacgattttaatttaatcatatttctttcggtccaattgtgatatgtggtttataattttaatttatatcgatcaattttatttagaatccgttgcaacacacgggcattatgctagtctactattataaaatgtaaaaatgtttcatccaaaattttggtacgtcatccgtgttcgaatcggttttaattttatgtttcagtcaaatccttttcttttattttatgccaaagtgtccgtcttatccgagacgcgcgtaaattaattgggcacgcacttttcatacgtcccttgccgcacgcaacacccttgtgtgtgtgattttctgcatgccagattgggcccgcgacaccctcgcgtgcgcgatttgcctttgtcgcatgtttgattgggactgtatcgtcctcacccgtgatttaaaaattgaagatgttttttgtcgaaactatggaatgtcgaccgtatctgacggagcgcggggctcctcaccgggagaccgcacaggcccccctttgccggttcggccgggggctcagggtgagatcccaagctctctctgtatgtggaaagatcgcgacctatcgaaagagcatgaaacataagcgatgtatacaggttcgggccgctgagaagcgtaataccctactcctgtgtttttgtggatctgagtatcaaggagctacaaagtgtgagccaacctcccccttcttctcctttgttctcggtccccaatctggaaaagatccttcttttatacttcaaggggataccacatgcacccctctctttccaaactggacttttcttctcttcataaatggacggagatttgcacggttgtcctccgaacatcttcctgacgggacggcacacacctacctccacttctgccggaggcaggcgcgtcgtgggaatgtggctgtgtgctgacgacatgagcagtgtcagaccggtcacaaatcagtcattcttgtctaccacgcgtcagcttagcaacgtgcatgtttgcccttcttcacacaacatcttgcctgtaatggttaggatgaagcctggcatatatcgactggggctaacgtgccatctctgggatgtaacacgctagctccagctggggacgagtgcctagaagctctcgtcttgacgggatggggcgaagcgtgcgtcagaccgcctgtcgccacctaacccgcgatctgaccggtctgtgaccggtcacagaccggataaacgagtgcactgcactgcacttcgtgcggtgtgacacgtttagccgaggcgcaataaatgcggttaggtgagccccgctgggctcacccaacccatacacgcggaggagaaaccgcgaggggtcggggcgcctcggcccgtctggggcgaggcaggagtggtccgagcccccccctcggggagaccaagaggtgggcgcacacatcaccctcgggcccgacgtctcccgagggtgccaggccacgtgggtgattgtgtctgcctcaagcctctagtcatgatactcccggtcccatgtcaccgacagtatccgattcccgtcacgcgtaacattcattgcaaagtcattactcgcaaacgaactgcgaaagagagtccgtgtgatgtagataccaagtgaatgaaattcgcagactccgtatggatatcatgtacatcgttgcttagatcatccgattctattcgcattacacaacacgattcctaggacatgttagcataatttcaagtcagtctccacacatgctcgtatgtactattagggataccattacaataatacataagaatcaattttactttcgaaaagagcatgccaactaaaataaaaagatgatcgaagttgttgattccgtccgtcatcaattcttgcctgacttgagataaagctggatgacaaattgggctcgtgtttgaatgcctcattgtttggcttatgcttattcctataagccgaatttaaattttagaacttattgacacacaaatagccttttatttggtaataagtgattcaggtatgcacatgaatagacgaaataatgaactttgattatttatctactgacatatgttcaaattaaattggctctacccgttgcaacgcacgggcatcttttctggtaaagaataagtaaagggacctgagttagacttttgggatggatggactccacagggaggagggggagtactgggccggttgtagtgctgggcctgccatgtgctggaagaggaaaagatggcccaagtgtaataggatccttttggataattgctaggaatttttgtattttgccaatgagtttggattagaattttgaaaggaatttgtattagaatttgctctggagattgtaaatggattgtatagttggacatttatcttgcctttgtaattggactgttaaataggatgagatttgattcggctgcttagtcgatcaaggactaaacttaggatttctttgcaattgcctgaacgaacggatgacgatatcgaagaggggtttagaatcggcgcatggcatacaaattcattggatatttcaaaggtagggacaatttcaacgatatttggatcaacacacgacggtcgacttcgccgaacgattttagggttttaaatgaaaggcgaactcaaggattttgagtaaaaggaaacagggaaaaagaatctgaggaaggctgagtggagtgtttttcgattcaactctagtgttccaaagtttcgggaaaagatacgatatagcaacaattgaaaagggtttcgggacttctattagctttgcaccaaagtgcttaacgaaacagacggagaggggagaggacaaggaaggacatcgaacggaggacatcctttagaaggaacgatttaatcatagtagtcaaagattcaagggaatgacgcaatattgtgataatagggttctcgggatatgattatggaattgcaattacggaataatggtgggttgagaggtcaatgaagggagattaccttg

SEQ ID NO: 50254 - DNA, 5009 bp, Oryza sativa
cggaatttgaatcccaagggatttaatgtatggcgagagttgggatttacaaggattgatttaatcaagatctttggcacaaaatcctaaatgcactcaaagaaaacacatgttctattgtgcgagctgggctaggcccttcagggaggaaaactagacgttttcatgaattatgttgaaataagatctttttatatttaggtttgtaaatagagttttgatggcaaattctcactagcctttatttatagaacaaatataaaagattatttcttaaaaaggattttcaaatattaattaatcaatattgataaaataacttcctccgggaattgtccctaaagcggttttctttaaagatttaatgattatagacattcgtaaatcaaacacccaaagggggttctaaattataaaaacaaggggaggaaaatgatttatctttacaaatactttcttatttcataatcatagttcttttaataatatttgaatccaaaatagattttattccagattcccatccttgtggtccaagcacaacagaaaaggtaaaataagatccaataaactccagcacgaaggaatttggaaaaagatttttgattattccgaattttgtttttgtatttcaaattcgaaattttcaaggtgttacagaggcgccaaagtggtggctgcgcattgaaggttttcgaacggtggtggcagcagagtgtgacgggaacctttcgtgggaggggcgaaataattatgggcgaaagctatgccttcgggccggcaacgacgacgcctgtgggtgccgtcttcctcttggggcattgctgcataatctcgtctctcctagttactttcttctcggcgtcgttttgaagattgctagttcttgttttcgctctcatagcaggtgttgtggtagacgtgcggtgtggctgttttttcttttctgactatagtcttacaggactatagacttgtatttttctcctcctttatcaatacatgaaactcgcgctgtcttgtgcggttcgtttaaaaaaaaattctttatgtagaagcaagtatgctgctagagtacaagcttacatgtgtttaatttatctgttcgaagtaacaattaaccgtactttagagaaagtaagtacatatagagaaatagaagtaactgtgctaatattttgtaacgaacaattggctttacaaatgattgtttcagtgaaattgggttgaaatatacttggatgttggagtgaatgtgacttactaacgtcggtcagttgtgatatcttgaaatagttgttttgtctaattgtgacgctcttttgaggtttacttcaagaaagattcaccattaacattgtaagtttctttgtctacaatcttttagaaggctacagtggtacactgatattttctgctactattgaatagttgacataaataaataccatatatttgaataagtaagaaggaagtcgttttgacattagtcaaaatcaaaatgttttaggtttgaccaagtttatagaaaaatgtagttacatttttaacccaagacaaatatattatgaaaatatatttaagcatagatttaatgaaactaattttggttgtaaatattactatatttgtctacaaatttcttcaaattaagtttaactttagccaaaatcagaatgtgttataatctgaaacggaaggaacggaaggagtaacaagttatactaccatatttgataaaaaaaatattccacgatatattataatatgttttctcctatccagaacaaagcatggagattttgctaatagtaaatacatctcaaagataactatatatcattattcaacgagcaacagcttccaatgaatataatggttcacatccttcctctgggcgtgaggtggacatgaagcgggtggagcttgtaggcggtgagctgcacggtgtccaccttctcctcgtcaccctccctcagcctccacccaaactcctgcacgaagcgcgcgatggcggcgcacgcgatgtgagtcgcctgcaggctccctgcgcagaccctcctcccggcgccgaacgccatcgtcttgtacatgtccgccaccttgaacctcccaccggcgaacctctccggcgcccactcctccggcgactcccactccttcttgttcatgttgcacccatacaggttgatcaccatctgaaacagatgaccatcacttgttagattttcaggggattttgatcactgctcggcgggccgaccagtgattgaaatttcggactcccccagcaagcaattatatcccgcccgagaaaactttaggagaagtcaataacaacaagtttgtccggtacgattaaaatataagaatctaggaccagataggatatttcttaatactacgaatcagaacagaggaaatatcccatccagttataggctcttatattttggaacgggggagcgtatcctatgcacacaggccttcgcgtgtacacaccgtgtacaccaactaaaaattatcacaaaaaattctaggaaaatttatacatgtactttcaatagtattacatctacgtgcaaagtcgcatcttcaaattcattctacatagagaataacaaaaaagataaaattctgacaaaatagcaaccttaaaactgtcagattttttctttgttacggctaaaatataatgaatttgacgttaagattttaaccctaggtgtaatacaattgaaagtatgtgtatgattttttctagattttttggtgacattttttagttggtgtgcatgtgtatacacttgagggcctgtgtgaataggatatgttgccttggaacggagggagtattgaatttaacgggatgtgccaaggcaggtttgaaaaaaggatatagaagaaaagtggagcttagtcttctttttttttcttagactagaaaaaatacccgggtgaagtctattttaatcttcttattgttatatggtttagttaagatgaaattcactgtgagagttcgcttggataaatatatttttagaaaatcatgagctgtagttaggaatccgatcatcccaagttagcatgcgagtttttttaaatagatttcttatatgattccttccgtattacgaaaagtgaacgatcttaaaaaccgactcaaacatggatatgtatttccaaaagcaaacgaacttaaaaaccgactcatacacgatgacgcaccaaaataccggcaaaaacatcttcaatttttataataactagaaaaaatacccatgcgttgcaacgtgtgaagtctattttaatcttattattgttatatggtttagttaagataaaattcactgtgggagatcacttgtatatatatatatgtatatatatatatatatatataatcatgagctacagttaggagttcgatcgtctcaagttaacatgcgagtttttttaaacatatttcttatataattccttctgtattaccaaaagtaaacaatcttgaaaaccgactcaaatacggatatatatttttaaaagcaaacgaatttaaaaaccgactcatacacgcatgacgtaccaaaataccagcaaaaacatcttcaatttttataatagtagagatagagatagagaagatatatagattaaaatcagaacataaaattaaaaccgactcaaacacggatgacggatcgcagaaacatcttcaatttttataatagttgagatttcttgttttcttatggtccagtgtagatatagaggttgtatttttaaccattatctttaaaaaagcctttcattatcttgcaaagtttttatgaatttagtcaaaattttattcaaattcaattaaaatttcaaataatttcgtgcaaaaagaagtaccaaaaacaccaaagtttgtgaaatttttggccgaaaccgaaagtgcaaaccctgccggcccgccattgtcacatggttgtgcttacctcggtgccggcggggacatcgtagccggcgagcatggtgtcctcgttgacgaacctcggaggtatgagcgggacaggggagtggcggcgcagcgtctcctggaagacggcattgaggtacggcagccacggcaggtgctcctcggtgaccgcctcgtcgccgcacacctcccggatctcttggtaaagccgttcctgtcataaatgccaagaatgccaagaaaaagaccaaaaaaaaaagtattggttgataaagccaagaatgccaaaaatgagctggaacagagtaacaatatttcttgcctgtttgtcagggttcttggcaagctcatacatggcccattctgtggtgaccaaggtagtatctgcagcctctatgagtgcctcccacactagcatcattagttgctcatctgtcagtgtgttctctgccagcaagaagtccagatagcatgtccttgcctgcacatatatctcagtttcatggagtcaaaagaagatgatctcttcaattgaatcattttcctgatggctttagattgaattaccatcaaaatggtgtgttttcagtaaggccaatgtatttagccttaatcaataatagttatattgagagaaataagatcatttgaaaacttaagatgccgctcaagattaaaatcttcatgtggtacttgctcgaaggggttgttttaaccaaagataatttagcaagacgaaattggaatggaagcttaagatgttacttctgcatgaaaaatgagactatccaacatctgtttatggattgtcattttgcgaaatttgtttggagggcggtacagtttgcttttggtttatacctccctaataccatatcccatatgtttgatggttggcttttggggttgacaagaagaagagcaaactaatacttgtaggagcatctactatatgttgggctcagtggttgagtagtaatgatttgattattgacaaattaccatctttctcatatatgcaggcaatttgggctgcaggaat

SEQ ID NO: 50255 - DNA, 1632 bp, Oryza sativa
cagaatcaccacaagaatcaaaaactttatttccagttttcttaaagtgaacctcaaaattttgattaacaatttgtgaaaccgaaagcaaattgtactttaagtcctcaaccaaagctacattcttcaattcaaatttttcatttaccttaaccaaacctgtagcgagacggcatttgtagcagcatcaccaaagataatcgattcagtcttgcatgcctttttgagtgaggagaaccaatttttatcaccggtcatgtgccgcgaacaaccggaatccacgatccacacgttctccttccttaccaccaaagcctacacacaagcacaagtcgaagcctcagtactggggttagatgataataaaaattaatttaggaatccagtactgagacacatgaccagaagatccaataggcatatatccacgtgcaaaatcaatttttgaattttcagaaaaattcctccgaggccggtctgaccgaggtacagtggccggtctgaccgggggccggtctgaccgcctctgtaccgccgtctgaccggtgcccggtctgaccgacgctcagtagccggtttgaccggtcgccggtctgaccgcgggacccactgcggtctgaccggtttcttcgagggaaaaccatatttttgccattttgattttgcaaaagcaatctctctctcctttttctgtttatgagctaatctgaaacaaaaaccaacaatatgtccatctttgccacaaaaagaaaagtatatttctcacgatgattagacacattggtagaattagaagatttagcaacacaaataacaacatgagatttagcatgcacaacattggattttgaagaagatgcactcataatagacatgataccagtagatttaaacacagttttattagtatcaggtttaaccaaaatctcaccacttctagcaccaacacctaacacaataggaggatgtctagaattatgagcataaggattaaaacctaaaccacggttatgtgtgctaacctttgattgatccaaaatcatattgaggttctttttaccatcagaaaatcttagcaaagaatttttcaaataagaaaccactttttccaaattagcacaattttcacaatctaccatgacacctttgcttttacgacacttggagcaagaaagcacttcattgtttttcacaacatcttccattgactcaacacgacctaaagcatatttcaatttcaacttattcaaattacatgttgagcaatccagaacatcatgaggttgttttaactttttagcagaaatcatgttaaacatcaaactagcatgaaaagcaatttgatatttttgcaacaactttttagtaaaaacaactcatccaaagtgcgtgtgtgcaaagcaaaactacaagcaagagaagatttatttttcaaatcatgtgcatcattaacatctctaatttttgaaatctcattcattaaaacctcacaattttcgcaatcatcatcattaggaataagagattttaatctaccaatttcagatttaagagattcaatgataaatccctattttctatacatcttctcacacttcttattcttttcactcaaaatattaatagcttcct

SEQ ID NO: 50256 - DNA, 11297 bp, Oryza sativa
ccgtcatgtcgacaacagttagataggctactccaaatattgtactggtgtgattatcatgaataagagcaataccggcttcggccaacaggatgtagggttattacctgacaattcaggggcccgaacctgtataaaaatcctcgtctccatctattttacctcagtctcgcatatatcctagcactgacaatccacataccatgtaataccagaattgcgacatcaaacgccgacagtggcgcgccaggtagggggattttggtgcttcaggatttcgacaagatgggttcaaaagatggattctccgacaacgagctactcgacgacttcagctgagggggagatccaacctaaccagatcggagccatcatcgtcatcgacaacttggtctatcgagatcatccaagcctcaagctccgcggcgtaccaaaagatgtcagatcgcatgatatcgaacgagtacgcaacaaggtaattggtagattggttttttaaattgatctactaatttcgtaaatacatccggcatgtatctacaaaggtacgcaatattttatctgcaatttatcgtacctattcagatcatacagtattgtcagatctataatttattatgtttacccagagcatgttctttatacaataatatttgttgcgcgggtatccccgatgttaaatcgactacgatctaacgctgggggctcgctctgtctttttctgtataaatcatgcttgtttacggtttacataatgccctgacatttacatctgctcgttatatcctgataatactagaagatccatgcagtttttgagtacatactcgatattatctgctatatgtcttgtcttctagaaaatatttttcaggaacaattgagcactcgagtaggttgtggtcaagtacaccgcattatcgagaacgatctcaacaaatgcagagttgtcgcgcccaacctaccaacgaagaccgacgacctatctcatagcaccggccatggctggactactcgagaaaaggttgttaacggataattcctcgcgaacaccgtcggcttggtcacccgacatgattgcgaacggacatccagatatgctacaagttgggtgtgtgagtcatgctggccacatgagatgcacataacccaactctagcgcctccattggtgttcgagagataattctacatgttcgctggttctcgaaccagcacgtagcaatctcttgcaccgccaacctctattggtgtccgagagataactctactcgctcgctggttctccaaccagtacatgacatccctcgcaccgcaacctccattggtgctcgagagataactctacatgttcgctggtcctcgaaccagtacgtagatttctctcgcaccgcaacctccattggtgtccgagagataactctactcgctcgctggttctccaaccagcacgtagcaatctctcgcaccgcaacctccattggtgtccgagagataactctactcgctcgctggttctccaaccagcacgtagcaatctctcgcaccgcaacctccattggtgtccgagagataactctacacgttcgctggttctcgaaccagtacgtagcaatctctcgcaccgccaacctccattggtgttcgagagataattctactcgctcgctggtcctcgaaccagtacgtagcaatctctcacgccgcaacctccattggtgctcgagagataactctacacgttcgctggttctcgaactaatacgtagcattctctcgcaccgccaacctcattggtgtccgagagataactctactcgctcgctggttctccaaccagtacgttgcaatctctcacaccgccaacctccattggtgttcgagagataattctactcgctcgctggtcctcgaacctctcgcaccgcaacctcagatggtcgaggtatgactacagcaataacgtagcagtcctcgcaccacgacttcaaatgatcgagagacacctactcactggttctcaaccagtcaatcgtagcaatctctcgtacatttacttctagtggtcgagtttagactacatctagttctcgaccagcggtgtagcgattctcccactatttctacttctagtggtagagttgcgactaccacctggtcctcgaccagaggtgtggcgattcttccattacctctactccaacaaagttgacatcagatacacaatatcgccaagtgttttacccagagatcccttaccacaaaagacacatagcgttgaaacctatcctactgttcctttacgccgtcttgacaaggcctccgaggaacctaagggaactttggctggggacgcccagagccgataaggccttgtcggattcttcagagacgaaagaccatgtaagatctggtcgtgtaagagttctcgccgtgcgtattaaccaagccgtgtaatcggaaatggattttccaacttcatggctgggggctaggatcagtgcttgttcaaccgaggcaggtcaaaggtccaagagccttgtcatccgagaacgattctccgacgacaatgctgggggctagggagagtgtatgactctacaaactgactgatcggagtcggtaagagataagacactcatatacaaaacactggtctgtacattcaattcactagtctgtcatattataacatgttaccctttgagcgttcgctcgggggctatttctatctaatattcttttcttagtattgattttaggaaaattctattcgacattatcgaagatcgcatgtctctatggttctacaccaagatcaactaaggcgaatacgacaaatgttgacaaggctctgtcgcagactctacgcctactcgattactcgagaacggttcgtggatctcgacgaggaatacggaatgaagagatggtgtacccgccgagataaaatttcttgacttcaatccaaattctcgattgcagcaagacgggagacttagtcatacgctctgtactttctcggtcgacatcagagattgacttagacaaaccctttcggtgcccgcacgaggctgataaaggaagtctaacattatctctaaactcaccgagaacggtcacgtgagctcgataatagttcctccaaagtctgcggttgagaatatgaactcgttcatttgcatcgaagtcgggggctactgtcagggttatggataccacatacctaatagtagttgactaaatctcggcaggatccaccacataccatgttttatacggaaactgacctcgagggagttccggataaggaaagacaaccagagttctacatggaaacgacaatgactactcatattgtatccatattggttttcctagttctacttggacaaggggacacctatgggtataaatacaagcccccctaggaggagaggggacatgagagaatcaacacccaccatggaggatcaacacccaacacaatcgacatagaagccacaacatagaagcctacatacgccaagacacgccgccggatattgacttcagggataagcacggctagtaccctacggtgtctccggatactgtcaggagagacgaaagcgccatctctgatctcgccgggcacgaattcgaggaggaaggctaccctgttgtcgactacgagttagatcgtcagaccgtcatgtcgacaacagttagataggctaccccaaatattgtactagtgtgattatcatgaataagagcaataccggcttcggccaacaggatgtagggttattacctgacaattcaaggcccgaacctgtataaaaattctcgtctccatctattttacctcagtctcgcatatatcctagcaccgatgatccccataccatgtaaatactagaattgcaacatcaaacgtcgacacttttcctgttcttggaattattcatagctcgagcaattctgttagcaaccaaagccaaatcctcctcctcgatttgttcgagttgatcatcggatgtggcattaaaaacagcaagaaaagaaggcttagatgaagaagcatcaacatccgaagaggaagacgaagaaaccaaagcactcgacttagaatcaacttttcgagaaagaacattcatctcatgtgttttcaattttgtgtaaagtgaatccaaagtcaaagtagacatgttaacagactcctgaatagatgtaactttcatcttccaaatagacatgtcaagatcattcaaaaagtgacgagaaatctcagattatggataattagcatcataagaagaatcaacagatctaagatcactcaaaattttattaaacctagaaagatagtcatctaaagcttctccaggtttcatctcaaatttaatgtactcctttttgaaaagatctcgacgaagttctttaatgttattagttccttgatgaaaattactcaaaacattccaaatctcatgagcagtttgaagatgagcaacacgatcataatctgaacgagaaatcccactcaaaagaatattgcgagctttgcatttttgttcaaacttagtttttaaagcagcagtattaatctcttcaggaatcacataaggacgagaaacttttctccaaatatcataaccttcagccataatataagattgcatcctactacaccaatgagaaaaatccgttccatcgaaaacatgaggcttagttgaaaacctagcgggagtagccatgacaaaaactctagatcgataaaaatccaaagaagaaaacaaggctctaataccacttgtaggatcgaaacacaagaactaagccaaccagagggggggtgaatggttggtatacccaaaaaccgaaaacttttagcggaaataaaagttaccctcgaaattgacggaagtcagtctgaccggtgttgatcttctggttggaccgccctggaatccctgtcgcgcctgttgtcgccgccggtctgaccgcaggtcacccgccggtctgaccgccgtaatgccgccggtctgaccaccgtgtgtcgccgattagaccgcaaaaacccagtgaaacacaaatcgaagaactctaaaagtggatgacgactttattgattctctctgtgtttacaaagtgcaccaacagcactccttatgaaaattttgactaaactcgaaatcctaactcaaaactcaactcaattgctctcaaaagcgataccgggaagcctcacgctccccctctatttatacatgaggtaggcagcctaaagccatgaaccaaactcatactaagagtcctaaacaccttaggaaaccctctagtacaagaaacaaactttacataaccaatcgtaccaaatttggactccttccaaattcgtctccgcatcccatacgcacacaatacctccatcgtatgtcatatggaatctccatcaaccacgtgcatcaactctagcctaagtatcccgcatgatctctaaccaccacggacgtcgtcttatccccaagccgactcccgatccatcaccgcaaatactctcccgaggcatcaagtcacctacacatgaaataaacaatgaaaccatattccgagaccaagctatctccaacttgactcattagtagcaaacaacagtattacatacgtatagtatccatctagaagtcataattatgaaataatcacggatatccaaacaaacaacccgaaactgaaaccgacacagcgtcggccggtcagaccgcgggctggcaggtctaaccgcgcgcataccgccggtctgaccggctatcagagcccgatctaaccaatcacataaaataatataatcctgcgatcacctgtgaatccaatcgtctccaaaaccacttcgtgaataaattccaaataacaaaaccaataatctccaatgtccaattgttcatcacagaataataatcaaaaacacctttgattttacaatatatcgtgttcttttctcctgaaaatgaagatgaagattaagattaagttttttacgcaaaatgatgtgatattaacatatcattgattgtgttttagttattacaaacttgataaatagattaatataatattttagagtaactttcatatagaaaatttttgcacgaaacacaccgtttagtagtttaaaaaagcgtgccacaagaatcttaatcttcatctaacttttgttggagaaaagaataggactactgcatgagctcgggctacttttaactattgctataagttccaaccatgatcaagaattcaagatatgtgcctatgagcatggaagaaatacgctagagaggataaggttacaatcaaagtaggagagaagctctcaggcgtggaagaaaatatctcattaatgtggggaggagaagtgcttgctgatgggaggtaacatggctctaagagcaagttgctgagatggaggagataagagaggagagagagaagaaacggactgtaaacttagaggcggtttagacacaagaaccaagaaactctgtaagagagacaagtgggtctatattaattgtaaataaccttatagccaacaaatcggctgtattactagccttgctttaatagttcagcgattctagaacgacttacgagaaataaggctacctagtctaataattacccccctccattttaaaatataaacataatattaaggttagaggaaagaattcagtggatgtgcacactccttaagaaataatttggctaaagaacaaaagcaagaaacttagctacaaaactaaaatcatctataccgaaaccttgcttttgatgtccctattggaaccttgatgctttgttatgctaaacttatatttaatactaattacataattacttactcttcgttccctaattgttttgggtaccgatgaccactctgaacaccctagctaggtccgccccaaaagaaaaaaaagatctcactttactcacctcaatggttaaaatttaaattttgaattacttgtactttcgtcctaagcacttgattgactaaatatttacggattttatgccctagaatcaacgcctcaaaaatatttatgttgtattatttattttcaaattaaaaaaataccatatcacgcgacttaaagtaataaaacctaccctaaaatgccattagaagaacaaagggccatcgacccatcgtagggagagaaaaaaaacagtttgctactcataatttgatactaacaaggatactttggccgagattagtttcaaaatttttcttcaaacttctaatttttttatcacatcaaaactttcttacacatataaacttttaaatttttcatcgcatcgtttcaatttcaaccgaactttcagttttagttttagtgtaaattaaacacaccctttttacttacgtgcggcctctattccctcccgctttatcgcacgtcctgtttcccggcctgcttcctcgcgcgcgcgcggtcggtgagcgaccagaagaggttttgatgccatggctgaaactgaaagcgtgacctgacctcccaccaactccccccaaggcggggctagtcgatcgagccatccgattcattcccatgacccacgcgcggcgacaagtcggccggtgatttcaccgtaccagctgcccccccttgtagtatcacgttcgaacggtgcgcccgccgatcgagcttgcgctcggtgcgccagcgcgcaagaaaatcgccgcgcgacgaggcggcacgcacgggatactgcgccgcgcgcggcttccgctcttccgcggtgggatccccaggcgtccgccgcccacaacgacaagttggcacggctgcgcgaaggaacgaccagcccagccggcaggcagcatagcagcagacacgggcggatttcgtctcggcccgcgtcagggcccggctgttcggcggatgtcgctggctggctcggtccatgcaaacaagtggaaagtggcctatatctggattgagcctggccttgtcaacaagataggccttgtcgctggctcggtccatattgggctttcgggtgtgacatggaagttcgattcttttcttcaagtagaactggtggcactgttaaaaagacaacatgtttttttattgatcatttgcttctacccctggggacagtgtatagcataggttgttcataccatacggttatatgggaaaatatataagtgtaaaccatatatataatgtaaacccgaaaactatcgtacaataaaaaaaatggacgtctgaaattgtccacgttaccctgagtgaaaaaattattttcagatttaaccatagtaaaagttttaccatgacatggataagcattagatgcccatatttttatcctactatagtttttttttgtaacatatatgtgatttacaatacatattttccctcaattatataatgctatgaagaaatggtcatatgtctaaggatagcatcttcacggtggaaactgaactagagaaaatgaccgtttacgttctttatgaagaatataacatggcatgttcaagacaatatgtacattgtgtgaaccagcagtttactgtttatttttttagtgcaacgaaaaagggctataatcttttcagggtagggcaaatagagaataaataacatttttttccttgtgaattactcctatcaattactttacttcgttaaattcagaggaaacataaagttgataacattgagtatttaatacaaacacttcataaaccagagaaaagatcaaaattatggcatgaaggaatgaactttcagaagtcagaaactgtgagctatagatagactgatagagacattaaacaacaattaatttcatgccatctaaatttgagagactgttgccattacattacaactaagtgatagatatactcaagacaggacttggcatttgaaagtcaagagactggcatgcaaattagcaatgctcaagacagcatgtacatttgaaagtccaagaaactgaacatcactacatgctacttctagagacttttgcagattagcaatgagtaaatggagacaataactcagaccaaactgcaatattgagacctacaatgaaacaaacataacatgtattttacacgattgttacaaattcgttcgccccatgcttggcccagaaagtcttcaagtcaattggaatagcaaggttatacccctcaccacttcaccagtcaccggctagcttcctccttccagcaatacatgcaccccatgtttagttccaaagtttttttttccaaacttttaactttccatcacatcaaacttttcatacacacacaacttttctatcatcgtaccgattttaaccagacttccaaacttcagtgtgaactaaacacacttcagtgtgagtcattggtagtggatatgtcgaaatagaagttgtgcaacatgcaaactgccagccacctgcaccccaacgataccattgctggggggatcagtgcaagagctgctagcacacaggtgttgctatccttgaaagatccaaatcaataaccattaattaccatccccacagtcttctcgtggatgcatgcatgttatgtttgaagctttaccaaattttggtgtggtttttaaagagtgaaagtttctacaagattccaaaatttaggatgtattgatggttgaaatattttttgttcgctgataacgttgatttgggcaacaaattaaataggcacagtaaatactggagtatttgaacaactttgtggtaatccttgcacacaagtcataattcgtaatactccccttttctcaaaaaatagcaacttagaccgaagaagacatcacttagtagtataaatctgaacaaactatcagttatctactcacgtaaaggtgattatccagatttatagtattagataatgaaattgctatatatttatcgacaaattttctcttataaatttattaaatgtaaatacaatataattgtaattatattgtaacttttatgcaactatattctatcttttatgtaactgcaatgtaaattgaatgtaacttttatataattttaaacttgtatgtaagatatgtgtaagttagaaagaaaaaaattcgtagcgcgcgtgggagaggagattcggtctcgcaacctcctcttcatgaaaacagcgtgttaccataggagttttgaaagctgaatagaaattgtattatagtacaatataattgacaatattattatattataattatactgtatttatatctgataattttttatcgataaatgtcctagtctccattccaaaacaaattaacttctaaagattaatttgaataagcatttattcatttaagtttgtctcaaaagataaacaaagggcgtatattcagtaggtggagtacgccgatgttacggcagttcgggaatgtacccgcagcttctagaaccctccattctccccacgtataaggccgcgccccgcgatccaagcagcagcagccatagcccccgccagctcgccgccgccgccatgttcggcgtcgtcttcccggaccacagcttcccgctcgacgtcaccgccttcgcgcaggtggcgcccaactcctgggcgctcgacctctccacgctctccctcgccgccgccccgcgctccgccgtcgtcttcctgctcccggccgccgccgccgcgctcccgccggggaaggccgtcgccgtctacttccagcccgccgccaaccgccccttcgcgttcctcggcgcgctcggcccgggccgcccctccgcgagcctcccgctcccggaggccggcgacgaaccggagccccccctcggccccgccaagctcggcgtcgccgtggaggacgcggcggcgctccctccgccccccgacgggcagcgcgccgagcgtgtcgcgctccgcgtcggcgagaacctgttcaacttcatgcagtcgttctgcggcgccgacggcggcaagctggtggtgcccacggacatcctcgaccggtggttccgcaagttccaggagcgggccaagaaggatccctcgtatctcaagacattcgacttttgagagcgaaggtacagaacagccttcccggtttgcatcgattcttcctgtaatcctgttttttttttctctttttgttcccctttggtaccaaatcgtcaattgctaatgtaattagtagttagtgttacgatgctacagtacaatgcttgtaactaatgctagtcttagtgcagtaggactaaaattagttttag

SEQ ID NO: 50257 - DNA, 4623 bp, Oryza sativa
ccttgtgtaaccgaacaaggccttagggggtgtttatacaaatgaagctgcattgaaccttatcttgttggtttttgaattgcctgtacatcttacatttctttactcatcatcgtgtgctatctgaattttaatcctgaaaatagcgacatcgctgttttgagaatggcaaggacacgttagaattgcagttgttaatataggacttcagctgtaatgctttatatgatgggagaatccattcagtccataattgaacatgaatgtttttttgggttaagttctagatactctgtgtttatcatattatactgtttgtttatgtgctggtgattctgatttaatgtttacatatcagtttggcaatatcattttcacctttgaaactaccagcttctgctcgtattttgattcatctgttcatgatcttttcctacgtttttggatacagatatcagatgcaaactaagttcttaggtgtgatttttgtttcagttcttgtttgtgtcagaccaaagaatcaatgagtcaaaactaaattttgttttaactgtctttttttttttttggtggagccaatagatcagtagacattgaaaggtttagccttcgctggtgtgctgttgctccccttttcttgggtatgttttgcctgcctttagtttttgtaatagcttattatgggtttatgtagtcttttttgttgcaagaaatttgtcttctttgttgccaaaacatacccaagcatgaagtactgtcaaggaaacaattttatgcggcgtttcgatttttacgttgtgatcaccgatcaagcattctcttattagttattacatcttcctgcgttgtaagaggcaagccagtaattgagtactaaaaaaatcagtagcatggctgaaattcccagctggagttctagtttataaactgtttgttattgttgtctgaaagtagatggctttgaaagaactgtgtttgtgtttcggacagccatttcctagtataaatatgaagatgtgcaccactaaacacaaattacgaaccttaacagagatcgaaatattagtaccactgttctgcagaactattgcgacgagcaactagcctatgtcttctattttcttttgttaatggtctacttttgtgcataatgcacacgctaattaatttcgcatgggcatatctttttcaggttattttgcagttcattgcaaactgcatgtcggcagaaagggttggttagtagagttttgtatttgtagaccatctatcagttctgtatttctagacagaaattaacttgtcattcagggactggattcaatcatggttgccagttttttttttctttttttttctgtacttctagtactcctagagaagtggtaccaaaagccagaaccacaagaaggtacttgcgtcaaaagatgaaatcgtgttgccaaactgtacagtaatacaattgaactttgctactgcgtgtcaactttatcttggagttgccgtttcatgctaagaaaggggtaattctcaagttgtttactgttctgctgttcactggcgttttagctactacacaggcttgttctttacacatgtcaggcctccctatatctttggaagaccaaaatgcagcaagggtgttgtaaaatgtactccctccgtcagcaaaaggtaatttgcttctttctggtccaaaataggggtgctggccaaatatttcctcagttgaagactatcagagcttctatcgcaatgaaagattatcagagcttctatctcctctgctttttggaggatttggaatcacaaaaacaacgttatcttcaataatcaaccaccatcaggtgcgtgaattttacatcaaagaagcagatggaccggccctagatgggtggaaggctgtcttctcaattgctatttcttcgggctcctcccatgtttaattctgtttctttctctttattatgtactagtatgctccctccttgttttcttctttcctgtattttaattacccgttgtaagcgacttggttactccattaggaggagcttatatcaatataattcaatattcgcccaaatcttcagtccttgaccaacagttttgatcccacaattgcagcagcaattggtaacaagtccacttgcttctactgcattgcttagcccacttgttaggtttgtaacatatagttttatttcttaccgataatcaagtactccatccgtttcacaatgtaagactttctaacattatccacatacatatagataataaatctaaacacacatatgtctagattcattaacatctaaatgtatgtgggcaatattagaaagtcttacattgtgaaacgaagggagtagataagtatgaagtatgaactaaatggtagtaaaacatatgcgacctttgagttaccttcctgaatgaagtatgaactacgatttccatagcagtacagcacacaaatcaaaggcctcaggttgagtctgcaggatgaaattacacagcacctttggattgcaaatcaacaccaactccttttcacatgcaaaacaatgactaaatacaaaactcaaagaataccaagaaaacgaatataatgcacaacttaggcatgcttcctaaccaacccactgatcaatcgacgtaatttaggtacaacagcaccgcagatgttaggtcatatatctacaggcaaatcttatctaaatcctgtcacaacctgtcgtcactcattagcaatgtcaaccagttaacacacaatggcccaatgtcgtggatagtcttcactaccatccttcttgctgagaagtctctcatccctaaccagaaatgcagcatttggaaatcaggattatcagaacctcaaaagatcaactgtgacattctcgaaaatgtccaatcgaacgatgggatctcagtgcaaaaccaaaggagaatcaggttctgagccgctgatggaggcaaaggatgacatactatcctccttcgaaaccgttgagaagttcagtggtgcagcagccagcctcctgttctctttgaagtaattattgtaccgtccagaatatgagcgtggagttagaagctcaggagtggcactgcctgcagaaactctacggggcaccggggtcatgaacccagctccatttccattcgggtgatggctgctcgtcctcctattaaagctgcttgtcttttttggactaggtttggagccgaaaatcaactctttctccttaagcaataagctttgcagtttcttctggtcctgtagtaagaattatcaacacatccaaatagtgaggagtcaactcttgtggtcgtaatgccaaaaggaacacatgatgcggtacaattcatacccggtgtcgtctcttgtcttcttccttttgtacccttctgagtttttgctcctccaaaatggcaacaagacgggccttcacatgcaaattcaatttatgtaattcaatggaacatagtgtactgtaatgatgataaatatggtagaccagctctacgacttactccatcatataaaaatggcacacttctttcatcctcccacgcaaatgttttagctataagttgtcatcattgctgcaagaaagtatagcttctaatcattttatgtatcaaatatgcgagtgactatagatggatctatatcagaagcagcaagtagaccgagcttgtgaatcaggaaatgcttagtgattactgttaggagtacatcattgtctaataaggttatacctatatcagaaccattagcccagttcaaccaatattttagcagaatgcaacacagtgttcaactgacataccagcagacatggaaacaaaactcacatggtattttttgaacaagtatccttgccttctctgcacgcttgagatttatatgggcacccctaccagcactatacctgctactatcctgcacaaggacacacaaaaaaaaaacccttaaagatcttaactaaatcatagaagagatgtgaaatatatgttgtcaaccaaggcctatatgaatattcagaataattaaaacaaaaatgaatcgtacttggttatattcctcaagccaagtttcttcatcacaagctgatagccatctgtctactttctccatgatatctttcctggttagggactcctccctcgcttttgctatttgtgtttcaatgctggaaagaagttcacaaggatccactagacctgaatatgaaattattttagaacatttaagatattcctcagcagcaattttcaattgtaagcaagagagaatatcagtagtataccagaatcaatcaatgcggttatcttctcaggtgctgtgctcatatcaggctccatatgcgcattactgcagatatcttctagctctaaccttttcttaagaacaagctccttcattctacttgccttttgtttagttagtctctcaacttcctcttctgtctgtattcaaataattatgttaataagtccaaatacagcttgtaaagaaacaagtatctcacagatagtagccgaacctcctgaattgtctccagcgacaggacactagatgaagtgatctcttcctcactagatccaagaacagca

SEQ ID NO: 50258 - DNA, 2190 bp, Oryza sativa
  unsure (1)..(2190): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatggcgtccggtgattcctggtagaaaaattcagttaacccaatgtttgagaacacctctcccacgcctatcaggaagtactggggtccctgccacaggatgctcattggaacagccaccttcctgtgcaccaaaccttcatcctgcgcaatccgcaaccgattactctccaccaatgctgctgataccatggagagcatggaaaagaacaggccgatccccattcgctgcagtggagtaatgccatttgctctgccagtgaattttctgaacactggaacaaggactctttcatagactggaactagtataaggacagcaatgacatcaatggattggaaggacgccgcaggtatttcgaaagagccgatgtgtttctccatcaccatcccctgttctatgaatgtcgaaaacatgttgtccagaactgcagcaaataatatcatcgttgcccaaacggggaacatcctgatcaaaatcttcagttcctccacttgagtgactgtgcaaatcttccatgtgtttagtaggccatcagattcaaaatcagatggtgtcaccattgcagctctatcaaagaacctgagagaaataaaataaatagatggctaacttgatagagctgagatggaatggacagctccttgccgactttgcattgacaaacaaaggttcatgaacaatgaaggtttgcttctagtatgtataaatgaacagcagaaataagtgtattacgggagactttgtttcaaaagcgatatcacaagagacatttctttagagaatattataaacaatgtgctgaaactcttgtaatgttaactggttttccatatttgtattgtgtgatgtgtcccacagaagaattttcaaagagtgaaagaatgaaatgctttactggaattaagtatctctactccctaaaaagaggagtttcccaaaatattaaaattattattcaaagtgttactgtaggatttttttaaaaaaatatttgcatattgtacacaagtatatggctggttgatataatttaatttagttttatatttcaagccatcattttgaaattttaaaattaagctatatgatattcatgtactaccagtgttttgtaatatacgacgctgttaatttttggatctaatgtttgaccattcatcttatttgaaaaaactatgtgagtaccatttttttttgttgtgagttgttttatcattgaagatagtttaagcatgacctatatttttgaatgtttgcactaaattttctaataagacgaatggtcagacatcatgtccaaaagtcaatagcatcatatacttaaaatagaggtagtatataaaaaccagtgcatcgcatgggcactacactagaatgagttaaagacaagcttacaaaatcatattactagaaatgaaataaattatagttcaacagaaatgcaagcataaataaaagcatagaatataggcatcaaagttgtaatgtcaacatagtgtattacttaagtccagttgtatgctccaattttcggctgccttcgattgctgaactctgccccagaaactcataaagaactgaggaatcacatggcaaatctttatcgcgtttgtgaatagcagcaacaacaacctggcatattctcgcaagagggcttcctccaggtttctgaaatctatacatagaggagccaaagataaaagtaccaaaacctaaatacacaaatagtgcagaaatggtaaaaccccagatccaacctttgtgatcttgcacccacacaataacagtccccgagatcaatgagcccgcattggctacgaaataggtccaattgaaaaaagaactcttttttgttctctcattttcatcagtgtcatcaaattgatcagcaccaaatgatgatatgcaggggcactgtgcaccataccctaaagcaaccatgtacaaaccgacaaagaatatgatgttctgagaagagactggatctgtccatatgatccatgagtgaggaccagtagagattaatggaactgctgctgacagaagcaacatcatcaatccctaaataaaaggat

SEQ ID NO: 50259 - DNA, 5266 bp, Oryza sativa
ctgaccaagttgcaacatctcttgcagcggccacgtttgtttcatgtagaacttttgtgagataactgactaggttttttacaattgaagtaaaggccagataagagcagaatgaaaaaactgcaataaaaaatgaaccataaaaggtccagtataaaattaaacagaacccaaacacaggaggaaagaatattcataaatcataataatactgtaatatatataaatgctgggaaatgaaatcagtttcagatgttcgagtatttagcatcaaatatcctactatatcttcaagcagaagcttgacaatgcaacatcatttttcagcactaaccgatggctaatgaggaacccttccagttccctgtatgtttccttaaagcaggatgcccacggatgcaaacagatccatcacctgtatattcaagggtctgcatttccaagtaaaaaacacaaatagcctttaatgccagtgtcatccatcactggtatagatgtttcaatagagaattgtgcattttcctaatgtagatggaattattctatatatttccaggaaaatttatcctaagaacaaaattatattatatacattggaagcaaattaactgatcatccaaaaaaactgcaaagtatcactaactaaaaacattattagtatgcaagggcctagccattcttatggtcacattagtaatatattgctaccactttatgtccttattgtaaggatgatatatttagacagaacatttgaaagtttatcttggattgcatgccccagtcggccatgccccatactagtgcaaccatataaaataattttaagtaagagaaaattttccgactgaacttcactctatatttcttttttactttcgcaacactctagaactagagcattaaacagaaacaaaacatcagctgaaagcagtattttcacaccatttgatgaaagcagaaaaggcacctcaaatttggccaaatatttttttctctttaagagaaaaaaatcagacaaatctcgctatgagagtgagagagagagagaacaaaccacttgcgaggagttctcttcatccagcagaggcttgtcatgctggtatgaggagtccatggctttactttcttacaagtaaaccaggttaatgtcctgaggaagaggaaagaaagtagcctgagattttgagcagatagtggaagtgcagattagaggttttaatggaaaataatggaaaacatattgccctacaataaaaaaatgccagagttataatttataaataataatagaccacccaacaactgggcatactgtgagtgatgtcaggtttcagtttagacaagcagcacgttgggcatatggctatcatttaatcagaaaaatctgtcgtacagagttttaatgtgataatcaatagtagcctgtagcccttttttgtccattatcttagactgacgcatcagtactagctctcacctaaaattactagtagttctagaaagcaagcggcgtcatggcatcaatcatctatttcagaaatgatgggccaactacttcgaataaaaaaacagtatttatatatttcttccatcctaaaatatatcaatattgtactaaacgagtcacatcatattactattaatttagacatgctgcctatctagattagtagtaacatgctacatccgatcctaggttactatattttaggacggaggtagcaaaactaaagccgtactcggtagtaagtgaagtatactactatctccgtctcaaaatgtatctatttttagtacagtaacttgtcccaaaatgaagctatttattcacctactctctcctcttaaccaatcacaaccatttttttcacctactttctcttccccatcaatcacaactctcctccaatcatctctacctacttttttaatatctgtgtctaactcaaaaatacttacattctgagacgaaggaagtactcatcagttgcaacggattgagatctcaccctactctcttgataaacgaagagtgatcatcttggtagccaatatgatgaaacactcacacggactgagaagacagaacctgctacgaacaataaatgggcagcgcatcaaccatcaagtaatccatctaacgctacgacctatccatcttctaattggcgagacggattagccatcctgacgaacgccgtaacagctagagctcagccgagaggcaagcacgcgaacctaacatggatattcttctgctccccccattttccccttcgctagctcgcttgttgggggaaaagagagaagatgagaccgtagcatccaccctcccaagaacttctctctacaactaactttgcaaaattcaacgaaggaacatgcatgcgactaatctgacgagatagtttgcaccgaaaagggggcaattaaatttgcctcgcttcaggtactagatggagacgaaaatcggagaaatcacgcaccgagagaatgaagcatgaaccggccggattggccggactccggcgagcccgacactgagcccgccactctctgctgctccgcgtgggccgtcctcactctcctccacgccgaggcgaaggcccttgatgattttgcgctttgtagagtggggatgacacgcgggtccacctgcttggaataatgctaccggtgctctctccgactccccttttcttttcttttttacttcttttcccgattacacggaagtggagagtcacaactcacacgcaccactgcacccgcatgtaactctcactaaaatagaaaatgagcaacggcaaattataatgtctctcttttttccagcttcagtttccttttatttttcctgcacgtaagcgcctcatgcaccaggcgatttgtcttttccatgtatgttgttcctaaatttggatggtactgcaaatcctttatatttttgagctgtcaagcaaatatactgctagacattcctcgagagggaaaaaaataagtagtattgtaagtttaaatctgattaatgcactagcagtcaaactgccattcaacctttttaagtcttcagttcagtttgacacactcgattcattttttcctggaaaaagtatactttaactccctcaactatggccagagtacgattcatgacctccaaccacaaaaccggatatatcgactcctctaactaccaaaaccggtgcaaactatatcctaggtggttttggttgacgtggcacctacgtggcggtgttgacccggtcttcgtcccacgtgtcgtcaacgtgtcgcttaggtggcattagagtaaatcaaaaatttgtaggaccgccgtgtcattaacaaaaaaaaaatagtgggacccaccgacatatggccccacgtgtcattctcacccctctcccctctctctcatcttttcctctcctctcaccttcaatcactagagcgcggggcggcggcgacaacgcacagggaaggaggtcgctggccgtccacgcgcgggggaggagctcgtcggccgttcacccgcagagaggagctcgccagcgccccatcccttcttcttcctcatcctcctctctctctctctctcccttctctctctttctctcccctttctcttcgtctgcaggcggcggtgggtgtttgagggccgtagcggcgacagccagcgggagggcgggcgctgcctcgagacggagcggcgacgaggcgccctcgaggcggagctacggctcgtcgtcctcaaggcgtcgcgacggctcccgccgcgcccacgcacgtcgcgatgcctttgccgccgccgccgcctacctcgactacatcgtcgacaacgcggacgagtttggcggcacctgctgggccatcaccaagttcagctgggacgtcaagtatgccggcgtccagatccttgccgccaggatacgtcgtgatagcaacaaacaccttgcattgacgtgatatgatgtcagtgagagtgagctatgtaggcgatgagtgtgaatgtattttgcgtgtgcagctagccaactactgatgagaggggagcacgaggagaggcacagggagacactggagaggtacatgagagaaggcagagcaccatgtgtgcgcgtgcatgggccggcggcgccgacgccaacgtggagcagagccccggcgccggaggcggcgacggcggcacaggcgtcacgacatgcatgggcggcgggagccatcggaacgccttgaggacgacgagccatagctccgcctcgagggcgcctcgtcgccgctccgtctctaggcagcgcccgccctcccgctggctgccgccgctacggccctcgaacacccgccgccgcctgcagacgaagagaaaggggagagaaagagagagaaaggagagagagaggggaggaagaagggatggggcgtcggtgagaatgacatgtgggcccacatgtcggtgggtcccactattttttctcgtgtgaatgacatgttggtcctacaaatttttgtttttactctaatgcccgacacgtctacgacacgtggaacgaagaccgagtcaacaccaccatgtaggcgtcacgtcagccaaaaccatttctaaaaccacccagggatatagtttgcaccggttttggtagttggaggagtcgatatacccggttttgtagttggagccttggaggtcatgaatcatactcgggccggagttgagggagtaaaagtttactttttccttttttccttgagtgggccccaaccgcataacgagcagagcacgcaccgtgggacgggccctgcaaaaatccgtcgagagaggcccgtgttatcgacgcgatgtgggcatacggcatgacggcccatgtccaaccgcgccagtccctagttccctacgccgcccttcgacgctttgccgaacgaagcccattcggtggcctagtttcatcccttcgcgctatccagcaccgcggctcgcgctcaagtcggcctgtgtggtgtgctcggctgctcgcgtcgcggtgtgtcgtgtgcgtgacgggggtgggggtgggtcgcgcccccgcatcacagcgtccgttcaaggcttcacgcacatgccgcgccccgtgattggttggtactcctatctctagtagctggtgtactccgcgttgccgggtcgtcataggattttttttttcctttggctccctgcttggctgcttgtttttctttctagcagttaagtaaagggtatgtttattcctgcaccagaagtagt

SEQ ID NO: 50260 - DNA, 2376 bp, Oryza sativa
ccccggagcacccccttcgattttttcaccataaatgctaaattaaatgtttctaaatggctagaggttgaagaaaccatgtaattgaggccctcctcccctaattttctgtttctggatccgcccctaattgtgtcttagagtccgtgctataatggctacaaatctgtagcccgctactcttctctctctccttatttatcttcttaaaatatatttacagctagcttatagtctactattgtacctgctctaaagaagtcctcgatccttgctccttggcacgaagcaagcaccagcgcagaaattcaacacgatacatatccgatctcacctggggaaggctaaaaatgggcgtacacacgcacgccgtcacgtggatgtttcttcccggcgaccgactgaccaaaacatgcacaagccggggcagcggagacaagtacacgtggtcgactggtggtagctcgcacctcccccggttttggccttctggttctactagccttctaggcgtccagtagccgcgtcccttcctttttcctttgcctttgcggctttgcctctgatcccaagtcccgacgacagtgtagcgtacgtagacgcagcgcgatttctcagcgcggacggccggacgggtggtgtggtgtttggggggattttcacaaagaacggctgaaattttctgcatgccatgtacgatcgatgcctgcttttgctacccgctgcacaggctgcctgccctaccaacctaccagcgctttgacagtttgtaatgggaaagtacagttaattagtaacgtgcatggactgcttgaatctttctgctacgtctttgccccggtccgagcggaggtcaccaggtacgtatcgatgttagctttttatacgtctttgctccgtattgtgtggagtcatgaccgtagaaatgtcaagttttgatctcatgcaagctagtcaacacgatctaagccggaaatttacctttcgttgtctgctcaaacggtaaggcctgattgccagggaaattaatttgacgcaacgaaaatccggcaaaatccatgtgtttcatttgagtttattgatattttagaaagagtttttctttaccattcttgagacctctttgtacctactacctatgttccaaaataaatgtattcctaggatttaaaatatgttccaaaatagttaccattttagaatactaattatcccaccaatcacatttccattcaaatttcttcctattttaccctcagccatcctccaactctcatctatacaccgtttgatgagggacaccataatcattcgttttaaatcttaatatatgctaaataatctagagttacaattattttaaaataaaggtagtactaggagtacattacctaatgattcgtctaggttggtgcctcacactatgtacatgctaaacggtgtgttctttttaaatatctctaaaaaaaggttttaaaatcatatcaatatattattcctgtttaaaataattaagtaatcatgtgttaatggttcatcttattttacatatcttcttaatatttttatttcctttaatgcctaaccattgaaaaaggtattaagaagatatatgggtaagtaatttctggtttcaaataactcccccctatcccaactagcccgtgagatccaagctcatttggcaatctacattgggtggccattcctccttaggtcgagttcgtttcctttctttcccaacctatctctattgttttccgccattcccccttagagcaagtttaatagtatagctcactactagctccaattcatctatagctaatataatagccaattcatacaatagttgtttactatactattaatacctggtcccacctgtcatatacacattacatcttggagtctgtgctacagctggctacatatctgtagcccgctgctattctctctttccctttatctctttaaaatatgtttatagctggcttatagcctgctattgtacctgctctattaggctaagtctgttttttttcctttcccaacacatctctatcgttgtcggtgatatgggcccgggggtatcacgtctagagggaggaggccgcccccaaactcgcgtggctccccccgaggggggtcgaggccggggtgttgcggcggctgccccctcccagcttggggttgagcccggggtgttgcggcggctgcccctcccagcttgaggccgggccgcccctaagcccacgtggctccccccgaggggggtcgagcccggggtggcgcggcggcagccccctcccagctagagggaggaggccgccctcaaacccacgtggctccccccgaggggggtccagcccaggg

SEQ ID NO: 50261 - DNA, 16213 bp, Oryza sativa
  unsure (1)..(16213): unsure at all n locations
ggacggcgactgtgtacccccgccctgtcagtgtgtcaggcggcgagcggcgtgctccgtcccgtcccatcataatgatggggggcttcatagcctcttacccggtcggagctagttcaaccactctgaactgacccgggttcccgtttctagtgtgaacgagaacccggaagtcctcatccattaaatggcgaatgacaagggggccctgcatgatttgatgggccccgcgcagcaaccgacgtgcagatagcttccgggctaaggctcaagacatgtaattaatatagagaatattttcccttctccctaggtaggactcgcagcacatgtggtatccccttagagtataaaaggaggaccatgtctagcgaggatgggggatcggactgaggatccctgagccaaagcttgtctaaccctagcttgcataccagggattcagggactttctaagctcagaagaatcatacacacaggagtagggtattacgcttcatagcggcccgaacatgtataaatctcttttgtctcgtcgtcttggaggagcttccgagatcaagatcacacacagttttgctcaccaaattctcgaatctcacccgctgcccccggccgaactcacgaaaggggggggggggtctcacgatctcccgctagaaagagtcacccctcgacaatcgttttccgtgcacacgcttttcaaactgctagatgatatgttttttttaaaaaaaatctatacgaaagttgtttttaaaaacatagtaatttattttttaaaaaaaaatattagctaatacttaattaatcatgcgctaaccatcgcttcgttttgcgtgctgggattgaaggttcccaacctcactcacgtgcatgaccccctccccccgaactctgggcttgttcggaatggagggattacacatgatttttgtaagattggcaaatcctttggatttgatgcattcggttcataagaatcacgtgtaggaattttgtaggaatactatagcaaccctgtgaaaacgtaggaatttcataggattctgaacatccactcacatctctttttttttcattagctaccacagggtacatgctaatcacgttggattgactagatggaaactaatattttattgtttaattatactataatatatgagatcaatattaattggaaaattcctacggtttatatattcctgtattccgaatgcttcttaccatcaaattccttcgtttttcaatcctacatcttacataagcaatcctatattattcctgtgttttttttattcctatatttttcctattatgtgatccgaacaagccctcacaggtgacttcaacctcttgggcaacccggccttccccacaagtttgctagctagcgaccatcgtctcctgtttgatgagcacgaagcacattgaatgagcataggatgcaatttttgttcttgccttatccctgttgatggattgattagattttgttcagtacctgattgtaagggactataaaatccagcatatatggttaagaagaaagagatcacaatagaaaagcatgctcagccccatattcaatggcggagcaattatcaggttatatggtcaggcaaccgcttgatcttcgccacaataataaacattattaaaaaaacaatcggccaccaaaaacgttattcgtgaagtgagcttgacggcattgttggctccaacattgcctatagagcaccgatatggataacggttcgaacttatcaaacaccaaaacacagtcacatacacgagtacactacactgatcgtataagaatgtgagtggacatcgatatcaatcaaatttactgacttaaaagcctttctagagggcatacaagttgaaacctaatgtgctaacacccacgccaggcacaaagccagcttccactaccaccgaacgtggcgtgaaacaaaacctgcattaagtttttgcggctattctacgggctagcactctgtttcgcgtcataaagatcgataaactataaataaaaccaaggagcaaggcaagagcttttctgcacgaaatggccatccccgcgaattctccgaaacaaaaagaaatggccaacccccccccccccccccctcttcaccacacgcttcttccgatgaaatggaatgacgaacggcgcctttcgcagagacatcagtgctcgcatgtgcggtacagcgtcacgtccccgctctctagaaataaatcgtctgccgagaaacgcaaagggcgggcagggcagggcagggcagggcagccgcgagtcggtgggcagccggggtgtgggtggggtggtgtggccgtgtggggagccacgcgcggaagaaaacaaaagcaattaagcgacgctggtttttcgatcttggacggcaggtaagccgtgggccggctgcgcacgcgggattcccccgcggcccgcagggaggcgcgaccaggggacggcggtttcgacttcgcgccggcagagggggcgctgggtgttgggagtggacgacgcggtctctctctctcgctcgcgcgtcggcgtcggtctttcccagcgcgcgcggaaccgcccgcgcgccgcgtgcggcctgactcggacgccacgaggcccgcgccgcggtggtggtgggttcggcgcagcagccggttcggcgccttggcggtaacaggccggtggtggtttggggctttgggcatctcgcctagcgatgcacatattccttggcttaaaccccacgatttgggctactgactaatcgcgtgctgtatttccttgccttttgcactttgttttttgcaattcgtttgcttccgtgggagaagactttgccccttcgtcctgcgtgtacagtctatatattaatacagagggtgtttgtagtcagacacccggactatgtcaattcccacggcgtgcgagctcgcgtcatttgataactgagttcgtgtaattaacccggaaagctatcgaattctacggctctcctctaacatgcatgaacttcaaagtttagtttatttctacggttattaatgacttaaaaagctttgtccactacttaaagaaaacaacataaatcattttcttacgtgccaaattaaacggcacctccaccctaaggtgagtcctccttaccgtattctttgggtcttcctcccttgtactagttcactagttatagtgaggtgccttcagctcacttgtatcggtttgctctttcccaacaagtgcactttcacctcccgcaacctatagctattaaattattgagcaatgctacacgtactaaatttttcttactaaacttttactaacaatcatctcaaccgtttgatttaagtagatggaagtttataaaaaaaaatctagatgcacgcgtagcatgacacatcagtgttagtaagaatctagtaagaaaaagttagtatgtatagccttttcctaaattattttacccttgtttttctcttttccttttactaaaataatgtatatttttaaagtctctaataaaagttagtcctattgtttaatatatcataaaacgatgaaaaatttcataatagagtatccgattaacttttttttaggtactacttatgtgaaaatgaaaatgtgaagtcttctcttacttttgacgagtaacacatgatagtttggggtgggggtgatagcattgatatatactatcccctagcctagaacaggggcggatctacagaattaaggtcgacaccgacgactttcggtaaaatctataataaaactgcttatctatatgttataacaatatgacctaaggataattaccatgctatgacaccgatagtcacgttatgacaccaacgaatctattttctagatctgccactgcctagaacccttcccttctcttttcctacttttttttttctgtccaaactccaaaccctcaaatgaattataattttgatgtcagggcgaatatggcatatgtcttgacgaaggttgaatggtaagtggtcaaaattttcgtccttttcaaccccgtttcaagaatttacagctaagattctcttacgttcaagacatgtaccattgttagggttattatctgaaaaacgtaacaatgttaggtctccctgtatcaacaaattaacaaaaattagcgttagtggacgaaagtatacaggtcttatttctttgtaagaaaaatatgcaagaacgctactgggtttcatcaagagtaggagtactttttgtgcagcttgctgacgtcatgagtttctcagctgccgttctctgtcacgagtcacgaccacctcagatcaaatgtcaaaaggggcgagtgacgtatttgatacaagatgaacgaatggaacctgaaaaaagcagttaaatataagtacaatatatgtcgaacgtgtgtcgatcttacataagactaaccattttgcttttcgttgggaaaatgatttaaaactctcgagggaatgctttcttttcatgtcatttatgtagttgtattttttttaaaaaaatagattaatatgtggtatatcactacataaatatataagatcaaatatgatatctacaagttaaaaaaaactctagttagtttacatatattgacagttaaatttgtttgctttgtaaacttgtagaaatcatagacatatcatacatcaatctaccttttttttaacttttgagtaaagtgaattgttggtctctaaacttgttcacctgtgtaatttaggttctctaactctcgaaaatttatttttcaaattcctggacaagtgtttcattctgattccaaattgcctagacccctctataaaatgagggcctgtttagttggtgaaatgagaattttttgtgtcacatcggacgtttgaccggatatcggaaggggttttcgggcacgaatgaaaaaactaatttcataactcacctggaaaccgcgagacggatcttttgagcctaattaatccgtcattagtacatgtgggttactgtagcacttatggctaatcatagactaattagactcaaaagattcatctcgcgatttacatgtaaactgtgcagttagtttttctttttatctatatttaatgctccatatatatgtttaaagattcgatgtgatgtttttgggaaaagtttcgtgggaactaaacagcccctgagtcaatgcctcatgtggcatgtcaggtgaacaacacataggatcccggatgggtcatgaccgaaataacatactttaacaagtttaggatctaaaaatgtattttgagagttagaatacttatatgacacaggagaccggcagtgtactttactcttaattttgtataagtatttaaataagagtataagaggacaaaaatcatttttatttctggtgtatataatatttcgtcttatctcttactagctggtacaagtaaccagtactccctctggtaaaacaaaaatacatcatttgattttctttcaatcatactagaattttgatcatcaataaatttcaaaatacttaagtctaaatcataaaaaatgatatatgtagctttgtcttgataaaaatactacctccatcttaaaagaagtacacttttatccatgaatttaaactttattttggcaccaaagtagtacgctaataatccataaactaattaaactttttgtaactaatatgggtagaccagtacttagccacttctttatattttgtccgaaaattgctagattgacaagtaatacgaaacggatggaggggttgtgattaaagtatcatcattgtgacctaaaaatgtatgcgtatattttggttacagatcaacgatgcttttatttatttgaccatttatggtcagaatagactttcataaatttatcttaataaataatcacggtccaattcacaccagaacgacctaaaaatatcttcatattatttgatcagaggagcatgtgttttacagatcaacagttcctttgtttatttgactattcatggtcagatttttctttttggttttaagaagactgtgcaccgtctctctctctctctctctctctctctctctctctcacgagtactgagtactgacaggttagtttgtttccctattcattggacaattacgcagttacacaccagtgcccattttttgaccaactagtgaaaacggaaccaaatcaaaagtgtccatttaccgaatcaagtaacgacagcacacggcgatttgtctgcgcgacgaaggctcgcggcctcgcgcctggcagctcgctcgctcgctcgctcagtcgaccgtcgctgcttgacttttcccccttttcaaagtcgcttcctctagacccagcgagagcgggcaatgacggagcggccactgcttccgtccgtccctctctccttccgtccctttcggcgtttgttgtgctccgtctccgccgcgtcactattttttgcggtataaaacccggcgctgccccctgcctccaaccacaccaaaacaactcgcatccgtttcgttcaagtccccccccgaaaagagcttagtagaagcgcgccacagagccttctcgacctggctctcctctagccacctctgcttcttcttcttcttcttcttcttcttcgtctgatcgccaccgaggctaaagccaccaggaggagcaggttgatagctcggcaggcaagatggtgctctccaaggccgtctccgagagtgacatgtccgtgcactccaccttcgcctcccgctacgtccgcgcctccctcccaaggtacgtgctctcgatctgctctctctctgttcttgctgttcttggcccaatgcagagcttcttccaatatttcatggctgactcgatgggattgatcgattggtgttattaggtaccggatgccggagaactcgatcccgaaggaggcggcgtaccagatcatcaacgacgagctgatgctggacggcaacccgcggctgaacctggcgtcgttcgtcaccacgtggatggagcccgagtgcgacaagctcatcatggccgccatcaacaagaactacgtcgacatggacgagtaccccgtcaccaccgagctccaggtacagcaccctgcaggcatctctgcttcgttgaattttctcctatcacctcgcgttttctcgccgccgcgcgcggctcgaatgcacactggaaatccccggatttttggtcgataaaaccggcttggccagttggcctggcctggcagattggtgataagaatctcaggctagaaactttatttccgagtttatcatttgcgtcattcacgggaggcagaatgggggaagaacatggcacagtttccgagatgatcaccaattcgcattagaaaaaatatataggaagtccaataaataaagtaaggggatgggaagaatgatcaccatatctcttcatttttcgcattaaaatatggaaggtgcatgaatgaagggaaatgggaaagaataatgcttggtttggtcaaaacagggcaagagaccaaagttccatctactgaaacggcgtggacaacagtcaaaacctggaacacagaaaacaccactgcaactttcccctttttgtgaatgagacacattattagtccttttttcagccagacatgctttgggccagatgatgtcctagcatgaaatgtacaacattttttttgggccgggccgttctacagctaattaacgaacgctttggatgtgtgacgctgtgcagaaccggtgcgtgaacatgatcgcgcacctgttccacgcgccgctcggggaggacgagacggcggtgggcgtgggcacggtgggttcgtcggaggccatcatgctggccgggctggccttcaagcggcggtggcagaacaagcgcaaggccgaggggaagccgttcgacaagcccaacatcatcaccggcgccaacgtgcaggtgtgctggagaagttcgccccaggtggagcttcnnnnnnnnnnnnnnnnnnnnnnnnnnnnnntcaaggaggtgaagctccgcgacggctactacgtcatggaccccgagaaggccgtcgacatggtcaacgagaacaccatctgcgtcgccgccatcctcggctccaccctcaacggcgagttcgaggacgtcaagctactcaacgacctcctcgacaagaagaacaaggagactgggtaactaaaattactatttctactacactaaattatctatctatgaaagtgagattaatcgatgtcattgcggccgtggtgtgcaggtgggagacgccgatccacgtggacgcggcgagcggcgggttcatcgcgccgttcctgtacccggagctggagtgggacttccggctgccgtgggtgaagagcatcaacgtgagcggtcacaagtacgggctcgtctacgccggcatcggctggtgcatctggcgcaacaaggaggacctgcccgaggagctcatcttccacatcaactacctcggcaccgaccagccaaccttcaccctcaacttctccaagggctccagccaggtcatcgcccagtactaccagctcatccgccacggcttcgaggtataatcaatggaacacaattaactctcttgatcagatgaattttttttagctgatctgacacacccatcgatccgatgttatttgcaggggtacaggaacatcatggagaactgccacgagaacgcgatggtgctgaaggaagggctggtgaagacggggaggttcgacatcgtgtccaaggacgaaggggtgccgctggtggcgttctcgctcaaggaccggagccggcacgacgagttcgagatctccgacatgctgcgccgcttcggctggatcgtgccggcgtacaccatgccgcccgacgcccagcacgtcacggtgctccgcgtggtcatccgggaggagttcagccgcaccctcgccgagcgcctcgtcctcgacatcgagaaggtgatgtaccagctcgacgcgctcccctccaggctcatgccccccgtgccgccggcgccgctgctggtggtcgccaagaagtcggagctcgagacgcagcggtcggtgacggaggcgtggaagaagttcgtgctcgccaagaggaccaacggcgtctgctagtctcaattagcgacagcgccacggcctacaaatccacaaatcaagacgctgctgattgatatgattaattacattcatggtgtgagctaccattactgtattttttttttaccgtgctaatttgagtggagccttcgattctaggtccaaggtactagtagagttcataaccaaaagccatgctcttgcttttgtttctccttctgataatctgtgcagctgcgctgcagcctgcactcatctcccgagagttgtaagttgaaactgtacgattttgatgttccctgttctagtgtaagtgccaattattgagtggtatggaaaatatttcttcaagaaaccaatcagagcgtaatttccgtgcttgatgttgtgcttgcttcttgccgttatatgttccccgtagtaccctctctacctgcacttgccttaaacttttttctcaaccttatcagtagtactagtaattttcccctgatttgccttaacagtaggagtagtactaatagtatcaagtagtttgttctaaagaggacttctaaaaatgtaaattgggcccaattgagcccgactcggactcgacgcaacggcgatagccctataaaagcaacggttagccgcaacgctcagccatcgaacgactcattgatcaaagaggagagaaaaggaaacgactcgttgatcaagaaactgactcgatggcgttggagggagccgcgggcggcggcggcgtcggcggcggtggcggaccaccggggcaggaggcggggaagaaggtggggtggagcaaggaggaggacaagctgctgcgggagctggtgcggaagcaaggcgggaagactggggcgtcatcgccaccgcgttccccggccgcaccgacaagtcgtgccgcctccggtggaggcagcacctggaccccagcgtcgacgtcgcgctgcccttctccgccggcgaggacaggaagatcgtggagctgcaccgcgtccacggcaaccgctgggccaccatcgcggccttcctccccggccgcagcgacaacgccatcaagaaccgctggaacacccacctccgcaagcgccacgcccaggacgtgcagcagcgcccgtcaggtggcctcgccctcggcctcggcggcggtggcggcgctgggcaggctgcgggcgggaaactgacgccggtgtgcctccaattgttccctccgacgcaggcaccgccgatcggggagaacttaccggggccggcaagaagcgctgtgccggagctcctcaagctcttccccctggctcccggtgatctcaaggacaatgcgagcgcgccggcggcgatggatgtgggtaacgaggccgtccgcgcgctccccgagttgaggctttccccggcggcggtggtgttcgacgcaatgccgctgcaggctatccggatgtagattcttgcctcgtcttcaattttttcttgtttcttctattttgttgtttctgagatgaacagctcttcaatcaacgcagggtatttcctagaggaacttagttttgatcgaagagctgtagattttgatcttcttggtttcttgcaacaatcttgctagttagtggtgatcaagaagccgtcttgtgattctagttcttgttagtagtagtcaaaaaattgaggtatcaccttcctgtaattacttgattgcaatagtaatcaaggtctgaccatcctgtaattacgtgatgtcgatgaatcttttgttgtggtattcagttcgaaacttgcaattggtttcatcaatgtctggtctagattacgctgacagaatgacagtatcaatcttcagccgtgcttgtgtgggactttaaaacatcctggtatgggtctgggccagttcttcagaatttgtttgatggatcaatctgcatccctccagtccacttgttgtttcttcctgtcctgtgttggtaatgtgatctggaacgactgcccgccgtggcagttaactgtaaagatgttatctcgttgatgttgtttgtctttcgttacagacggactctgcttctcctgaacagtcagactctgttttctcttgcctgtacatattcagttacatttacattttggagatggtttgagttcagccaacaacggccaaggagttcgacctgaaggcaaacaatcttaaagtgatttttgagcaaaaaagttcgattttttaaaagaatgattctttttttttgaatgcctaaaagaatgattctaagtagtttttatatatataaaaaaaattcttcctagcaattatgggatagagttgtaaacgaaaatgacaaagaaaaccctacaatcaaattctaaagcactgataaatcgaaactcctagtgggcgggcgatcgttcccctctcctccaccacttagttttcttttttggcaccgtattacttttctgttttagtaaatttatgcacctatagtttacacatctaaagtttagagatccaaagtttataaatcaaaggtttatatatccaattcaaatttgaatttgaattcaaatattttttatatatagtatttctatacatctaaagtttatacacctaaaatttatagacccaaagtttataagtcaaaagtttatatacccgattcaaatttgaatttgacttatatctaattcaaatttaaatttgaattcaaatattttttaatatattatttctatacatttaaagtttatacacctaaagtttatagacctaaagtttataggtcaaaagtttacataccaatttaaatttgaatttgaatttgaattcaaatattttttttatttatagtatttctatatataaatttttctaactcttgttttttcttattttttaaaaaatttatggtatagtaggaaggtaagaaggggaggaggaagggggagaggagtgtgtctaaggggaggatggggatcgatcacttcgcggcttcgcccgttagcatgccccctgataaattgtgtttaagaataactgaagtcccgcatatagcgtctccgtgaacgaagcagttgtcccatacactgggactccgattaaagcggagccaaaacaagtgtctgaagacaatatttccatattggttagctctatgatcagatattccgatcaccacaacgacggaaaaaaaaggcaattatagttgtctatttggtaatttgtatattcttgtagataaaagaattttcctatgaggtactagatgcatagtattactagatgataccccgcgcgttgcgacgggatatttgtaatgcatgtttgtttattattgtaaataactttaagtgattagtatatttgcaaggaagttgtaagttatatatagtctttcagaaacactacatactaaaaagagaacgcaagtaatgattatttaagaactgatttagctaaggaacactcttgttaccgctcatggtaaggaatgcgattgtgaaatactatgatagaagtatttgatcacacatgggtataacatgcaaagagccatagcatatacatttcgttacttatattgggatagtagcttcagttgtgctatgtaaaagtgccaatggactgagggttccgtagctggtacggctgaggtaggcagggcgatccgacaaaagcggatcacgcctggccaccgccggtggccggcggctgccggagccacgctcgtatgagcgctaggcgggggaggctcctcactatcgctcctctggccggtggtctcgctagaagccgaggtcagagcggcgcagatgccggccgtggtgtcggtggtcagcgcgcggctgtgggtggcgtttcagaggagagcggtggagcgctgtgtgagcaaagggcacggcgtcaattgtccaaggaggtggcgtgggcagcggccatgaccggccgccccaagccggtgcatgctgtgaccccttcgccagcatcgccgatccgctcaaagttttgggcaacgccggacgacgatgactcggaggatgatgatgaggcaccgacaccgcccccgttcacaggctcatcggcgacatcttctccgtcgacggaggaattcgtcaacgaggcaagcgcagcgggattctcacgtgcacagctcgtcatggcggagcagcaactccaagcaggtaagaacagcgaccaacggttgccggaggtaatcttgtccacgctgctacggcggaagctggtgggtccgccatggcgtggccctttaccagcggaacgcgtttctccgccgagaacgctgggcgactgcctggcgtcggcatctcggtgtccgcggcgtaggcggcgcgatggtcgacggtgcggcgttcctcgttcatcgtcatcgccggaggccgggacggttggttcaaaattcgtaattccgaaatcgttgggcgtttcaaacgactccgatcaattactacggcagggttcacggcctgatttccctcctctctgcggtgcgcactcgtcggtctctaccgcgattgccagcgcaggaggggaggtacgaaggccggcgccatctgcatctcagtcggatcggattcgtttggggcccgggaagtggtttcggcccaccaaaggattgatctccctctttgctcgctctggactcaaacctagatcgcgaaaactgcagccgccatcacgccccactgcgacgatctcgtacgctgcggtcgtacggagaggaaaagccatggcggcacacggaggcagagggtttggcggtcaagggggagggagaggctggggcttcgcgcaaggtttccaccctggcttcgacggcggccgcggccgtggccgtgatcagcgcggtcgcccacatggccacaacggtggcggattcggaggagggtacggaggcggatatggcggcggaggctatggtggtaacagtcacggtggatacggaggcaaccggaaccgccgcggttggcagggtgggcgccgcttcgcgccggctgctggccacgcggccggtcagttccacgccggaggtggcgttcctggacaccaggccggtggccaggcggtggtcggccaactgcagcagcaggccgctgctggtcagttccagccggctggcttccagacagcggggctggctgaccaacagcccgcccaggcgcccttccaggcacctctggctggccagcagcctacccagccggctgcggctggcaaccagaccagggaggctggggctgtgctcttccagcaggtcagccaaagccagaaggcccaggtggctgcaccggccaacggtggcggcctcggtacgtctcaggtcgggacgtcggcgctgctggcctccagccaagcagcaccggcggctgctccagctggctccacaagaggggccatcattggaggatcggcacaggatcccgcggcgacacatctggaaggcttcatggcaaccaagcccgaacctgcacaagccggaaagcagaagagcaagggtaaaccctactgtttccgctgctatacaaaggggcacactttagatgattgcactgtcttgctttgctgtgatttgtgctttgaaaatcatgttctaaagaattgcccaaatgtgaagaaaacaaatgcgattgcggctccatgtggttatgcagtagagggcatgggcttttactatatccctatgaatgacaacccaaagagtaatgtggaggagcacacggtcttggtacgtgtcttagacggttcctttactgttgatcaactgacagtggaacttgatagactactgccagctaaaatcacttgggagattggtttgaaggggtctgatgccttcatcattactaattttccatccgagctccgagaatatgcggtgaattggggtccaatggacaccaagacaattaagggaaagatccgcttcgagaaaggtgtcgagaatgatgtgaacagatatgagattgacaaagtttgggttcagtttcggggtctacctagcgactcagagaatttcctattatatgggctatagggtccatattaggggtctctaaagcggtggatatgcgctttaccaagacgtttggcaggtccagactgaaggtggctgttctagacccgaacaggatcccagattacgttgatgtggtcattggtgacttcgtttatgagctgcagttccgcatggagatagatatgcctgttggagagccttcagtcattgacatggactctaccacagacaatgatggtgacaatgatgggaaaggcgaggacccaatggaggaggatgccaacaaaaataatggcacccctgatgacttaccaaaggatgctgcccctgaaaatgcccctgcagaccagctacccaagcatggcgcgggtgctgagacaggcaagctgaaggagaaaacagtggctaagtctgatccgggaaaaaataaaaggcccgtggctgtactatctcaggggatctctctggagggttccattcagtggcaggcaaacatgttgggtaaccatggctcttctagcaaaccggtggtgcacaagggagagactgtatctcctctgaggtccagcaagcgcaatgtgtcctccctggagcaggactccatggaaaaggccaccaaactgaaagctcgcaaaaacttggattccactgctgcaaaaggtaacaaacccctcccctcctcttttcataatttagatgattctgttatactggctacaactgactctttaggaattaatttgggggacgatgttagttcggttctagattctgtacattctttaaaacaaattgagttacaaagatttaacgacttttgctcatctagtaaagaggagaaacgtagctgcgaggaaaactcatcagtttgttcggaggataatgttgatattgatgctttaaatactatctgttcggaaattgcggaaagccttggtgatgggggctatgacccgctgtgtctacatacccccttatcacaaataaagaggaggcagcctaagggtaagcagaataaaaataaaagcgaacgtagtaaa

SEQ ID NO: 50262 - DNA, 2746 bp, Oryza sativa
aatagttagaaaagctataaaatgaaattgagacacctctgtactctgtagtttcctaagaggaatcaccttcgaaactctagtcctcttttctgctttgagcttaaggatggtctcagtaagaccttcaagagtgctatcactgatattcgttgaattttctgagttggccccatgtaaacttggatgcacatctttaactgtctttgcaaaatccatcccaagcacagagcataggcagtgcacttcatcgacgtatatgaagaccttctgaaggcgatcagactgaacaaggagggaatgaaaaagattattgctttcactaatacaacaatatggcatggcaaagttaggattttagataacaaaaatgaaataacctatcctttgaaatatataactaatcttgttctcagcatgttgaaagtgacagtttatggttgaaacaataggtaaacaaaaaaatggttgtagcacgtaaatgcttaaggcatacacatattttgatatccaccattcactttatcatcaatatctagtcatatgcgactttgtgtgaaaatatgtacattttgacaagatacatttgatttattttttattattattattttggtgcaactcatatccacatgatggctgaatgggttgaagcaagttgagcaaagaaccattttaagtcaagatcatagttaccttctctttctgtaaattgcgaagctccgcttgaagatcagaaagccttctggttgacaaatcatgattgtccttggaatgattgaccggaccattgtcatgctgattattgtgatccgaaatttgtgcttttatcttctcgatttgagattggacaagtgagaattgttttattctttcttctttctttgacctgagatcttccagtagaggcgtcactttggcaagttgctctttcaatgattgcttttcatccacctgtagacgaatatctcaaattactcagaaatggaatatacttatacagtgatgtcaaatatgtgacagagaacctttacgatataacaaagcataataattcacctttttttacttaactaatgtgaccctaaacatgccaaaagcaattaactgtggccaatgcatgtagaagttgggagtcaaaagaccaacacctttgctttttttttctttctaaatgccattaccaaatggaatttcaaacaaagttcaccgtacagcaaaccatgttgcatagtcaacctcatgtgtaaaagaaaagctaggcatcatccaggtatgcttaacttacaggaatcatatccagcgattcttcaaccaagtagatggtccacaattataattctggccaggaaagaaaatggtcctttgaaccaagttctacactaaactagtttctcaaatgtgcccatcagacatgactatgtaccaaccgagtgacccagctgtgcatgttgcagtgatatgatccccatcattatttgaacaaagatggccaacctgctgaatatggtatattctacgaggtgtagcatgacactaacaattatttcatacttgttgtacaagctacaagataacctaccaatatctgtagctacagacaaatcaaaccttatacgcataagacacacgataacataatcaaggtccctaggcacaaggcttggaacaagaggcaaaaatagaagtatgggctgagtataccttaaattttggggtaatttcacctattgaagccactaaaactttaagctctgcttctttggccatcaatgactgacggagctgggatctctcagcattggcactatcaacctttcgacggtacacacgcatgcactctgtttcaagttctaagaacatgcgatctttatcttcttcgcgctccccaatctcagtccatatttgctaaaatagaagttatgttagaatggaaacaattgcaagaattacatataagttcgtaatattcagagaaaataaaaatgtgcagccacctgagcagcattaatggtagctacatgtgacatttttatttatttatttatttattttgcatatttgatgtttttattcatctaattgacacattggcaaaccggcaaatgataaattgttatagaccatgtaatttcatgccacaaggaacaaaaatctaatacgcaggcttttgatgaagcaagctgactgctcaaccacagacaacagagagagtaaatgaaactcaaaataggggtatagagcatacaaaatgtaatgttcataagagagctactaacttcccaaaatgtatataaatgtgtctttgcataccctaaccaggccccacttctctggacagcattagttagtggaaatttaatttgtttttattttctttctgcagagtttttttttggtaaaaataaggggcatagcatttcttttgaaacagcagaggattgcactctcacttacaattcccaatttcgagtacgcctgatgctattaaacttatatcattatgctcactgacacattagctgagataaatactactcctaccaaacgtaatatttctgacccgtggtacatcaacagtggtataataagagcgctcctaactgaatttacacaagcagtactactccaagttcttcagctccaaattcagactttagtaaaaagaaaaagtaaagtaaatcgtcgcatctgctttgcttcccgagaaacatagtagagacccggaatttgatgaactacttgc

SEQ ID NO: 50263 - DNA, 739 bp, Oryza sativa
acagtagttcatcaacaagaactaagccaaccagagggggggtgaatggttggtatacccaaaaaccgaaaacttttagcggaaataaaagttaccctcgaaattgacggaagtcagtctgaccgagatgatcttccggtctgaccgaagcgtagccgccggtctgaccggtgttgatcttctggttggaccgccctggaatccctgtcgcgcctgttgtcgccgccggtctgaccgcaggtcacccgccggtctgaccgccgtaatgccgccggtctgaccaccggtgtgtcgccgattagaccgcaaaaacccagtgaaacacaaatcgaagaactctaaaagtggatgacgactttattgattctctctgtgtttacaaagtgcaccaacagcactccttatgaaaattttgactaaactcgaaatcctaactcaaaactcaactcaattgctctcaaaagcgataccgggaagcctcacgctccccctctatttatacatgaggtaggcagcctaaagccatgaaccaaactcatactaagagtcctaaacaccttaggaaaccctctagtacaagaaacaaactttacataaccaatcgtaccaaatttggactccttccaaattcgtctccgcatcccatacgcacacaatacctccatcgtatgtcatatggaatctccatcaaccacgtgcatcaactctagcctaagtatcccgcatgatctctaaccac

SEQ ID NO: 50264 - DNA, 1682 bp, Oryza sativa
caccgtgtcgtcatgctaagatggttgcttcttcacatgctcctattatttcagggggaggatggtcgtatttttgaagacgagagcgacgaaaacgacgacgacgaggtcggctcggccggttagaccgggcgccaagccggtcagaccgccagcacacctccggtcagactggcataggaggtgcggtcagactggccaggatcgtcggctgaaggttctgttgatgctattcgagatggtcctccggaaactacaacttcgaccagtactgatacataacgtggatcaacttcagaagtcgtggctcctttgcacattcaacgatgacatccgccagaacaaattattggtaatataggtgagcggactacaaggtctaaggtaacgattcatgatgtttgtgcaaattctgcattgttgcttcttttgaaaccaaagatgtgtcacgtgcattaactgatgaatcatggattaacgccatgcatgaagaacttgaaaattttgagagaaacaaagtttggactttagttgaaccaccttctggacataatattattggaaccaaagtggttttcaaaaataaacaaaatgaggatggtttgattgtgagaaataaagctagacttggggctcaaggttttactcaaattgagggtttggattttgatgaaacttttgctcctgttgctagaattgaagcaattagacttttgttagcttttgctgcttcaaaaggttttaaattgtatcaaatggatgtgaaaagtgcttttctaaatggttttatacaagaggaagtttatgtcaaataaccatcaggttttgaaaatcctgatttttcccaaccatgtttttaaattgtctaaagctttgtatggtttgaaataagctcctacggcatggtatgataggcttaagaactttttgcttgcgaaaggttttacaatgcgaaaggttgacaaaactctttttgttcttaagcatggttataatcaacttttcgttcagatttatgtggatgatatcatttttgtttgttcgactcacgccttggttgtagattttgctgagactatgcgcagggaatttgagatgagcatgatgggtgagttatcgtactttttgggattgcaaattaagcaaacacctcaaggtgcttttgtgcatcaaacgaagtatacgaaggatcttttgagacggttcaaggtagagaattgcaagccaatttcaacaccaattggttctacagctgtgttggatcctgatgaagatggtgaagctgttgatcaaaaggaatatagaagtatgattggatcgttattgtatctaactgcttctaggccagacatacagtttgctctgtgtttgtgtgcacgttttcaagcttctcctcgtgcttcacgtcgtcaagcggtcaagcaaataatgaggtatttgaatcatacacttgagtttggaatttggtattctacttcatcttctatatgcttaagtggatattccgatgctgatttcggtggttgtagaattgatagaaaaagtactagtggaacatgtcattttcttggtacgtcattgattgcatggtcttctaggaaacaatctagtgttgctcaatcaactgctgaatctgaatatgttgctgctgctagttgttgttcacagattctttgactttt

SEQ ID NO: 50265 - DNA, 3973 bp, Oryza sativa
cttttcttatggtgaattgggcataattcatccttttggcatggtttgagggggagtttgtacctcatggttttatcaagcaataatatgacaatgagaaaattgagaaaagagagctttgtttatgcatatggtattttcttgtgcatgctagcaatactttgaaggtttatttgtctctaacatagcttgtatgcattctagtcttttcatgagatttagattttgcttttaagggagatgatgcatgacacttaaattctataattgaattaagaaaatatgcaacgttgatgctagcatatggtttgatctataaatgctctatatatatgctttgttgaattgttattcctcaaatagctttaattgctcattgtgaaaaggagaataaaaaatatgaaaaaatgaataccgaatccttggaatagtcttgacgacaaggacgtattcgatgtgagcaaaataatgggtgccgaatccctggaaacaatcttgacgacagggacgtacccggaataaaagagaaaaatatgagcaaaaaggctcaagaaaaagaaaagttataaaaagttctcttggttattttgtgctaaaggttatttgagaaagagtgataaatgcaataggatatgtctttagtggttattattcaacctatgtgcttgttaagatgtggcattacaaatcgtatgaaatcatgaattttgatcgttgattcaagcttaattgtaaaatctttggttcatggttatactttaatgcatgcttgttctggtatagatgggttatcttcttatttattgccacacatgacttgatatgctatatgtatgctaagctcttgaacattaatgaacataattcctatgcttgatgaaatcattgtcaaaaggggcagaagtaatgtcagatttatttttggaattttggagaagcaaggtgtattttcggagttgttgagaagagcatgtttttggttcatgaggaatttctttcttttaataagggggataagttttctttttgatttttgagcacgatgtgtacatttgtacgaagtgtgctttttaccacttttgtttttatttttccaaacaccaaaacatttttgatgagtttgccaatgtgttcatcaagggggagattgtaaaatcaaaggtgtttttgattattattctgtgatgaacaattggacattggagattattggttttgttatttggaatttattcacgaagtggttttggagatgattggattcacaggtgatcgcaggattctatcattttatgtgaccggtcagaccggcggtatgcgcgtggtcagaccggccagcccgcggtctgaccggccgacgctgtgtcggtttcgggttgtttgtttggatatccgtgattatttcatgattatgacttctagatggatactatacgtatataatactgttgtttgctactaatgagtcaagttggagatagcttggtctcggaatatggtttatttgtttatttcatatgtaggtgactcgatgcctcgggagagtatttgcggtgatggaccgggagtcggcttggggataagacaacgtccgtggtggtcagagatcatgcgggatatttaggctagagttgatgcacgtggttgatggagatttcatatggcatacgatgaaggtattgtgtgcgtatgggatgcagagtcgaatttggaaggagtccaaatttggtatgattggttatgtaaagtttgtttcttgtactagatggtttcctaaggtgtttaggactcttagtatgagtttggttcgtggctttaggctgcctacctcatgtataaatagagggggagcatgaggcttcccggtatcgcttttgagagcaattgagttgagttttgagttagggtttcgagtttagtcgaaatttttgtaaggagtgctgttggtgcactttgtaaacacagagagaatcaataaagtcgtcatccacttttagagttttttgatttgtgtttcaccgggtttcggcggtctaactggcgacacaccgacggtcagaccggcggcatcacggcggtcaaaccggcgggtaacctgcggtcagaccagcggcgacaacaggcgcggcagggattccagggcggtccaaccggaagatcaacaccggtcagaccggcggctacgcttcggtcagaccggaagatcaatctcggtcagactgacttccatcgatttcgagggtaacttttatttccgctaaaagttttcggttttttggtataccaaccatttaccctctctcctctggttggcttagttcttatgtttcaatcctacatatatagtagagatgatgaggaagtgttaatgaggaaatggtatagcagcgatgaataaaggaggaggtggctggtccgcaagtgtggtaaggatagatctacctggttgaaagtgcaataaaatgaaataaaactcgtccaattaaactaaatgatggaaagagataagatatacgctgatatatatttaaagaaggaactaagatataatgcaattatattaatgtgcaaacttaggtaacaaattctgacccaaagtacaatataatgtgcagacttaggtaacaaattctgacccaaagtacaataatgatttttccttttttcttttcgccctctcttaattgtcaggcttgatctccaggccagctagctagctgatctggttctgataagagacactgatgtttgatcaccccttgaaagcgacaacccacgacagggagacaacaatgagaatgttcccttttccacaattaattaaggattgcaaaatatgcagtgatcgatcacttgcaagttgcggttgaaggctggcattttgtacgctcaagagaatatataatgcttggtgtttgtcaaattcctttctgctattgtcagtgtattgttaggtgtgaggtcatataattaaaggcgtagtacgttgataaatttgtcatcgacacattcgtaacggaaaataaccttggaacattacaacgcctatatttggaggaaaaagagccacgttccgtgtgctctgcgcacgtgtacttagggtttagaaacttccacgttaatcgttctttatttatttttttattgaatcggcgaaccgccaatttcattaaatatagaaggagaaaactgtacagtgtaaagggaaagaaaaaaaatcaggacctttggccctagtcaactaaggaacaagccaatttctcagatgatgcgcgtctgctaaggcccatatcttggcctcgtccttgatttttgtcagaagaccactcgatgggagcacgttaatcgttctcgatcgtgatgtaggctaataactgcatgtaaatacaattgtaagaagtgcatctacgggttttttaccatttttttctaacacattactaaatctactagcgctatttgtttatagaaaacaaaagtatgaattattaacaatataactctatttataggggagttcactttgattcctaaatcaacttgatcaaatattgatattggcaaattttagcattaccaatatttagtaattaattaaggttgagatgtgtaagttgtatttggtttgccacatttgtcaagattttgtgagaagacgatcctagaattatcaaactttggtagcttgccaaattttgataaagctaaaacctggtaggttaataaagtgatcatcaccttcaaatcttgctaagttaaaaaattaaaatatattatatgtgttggggaagggctccgaccctcgcgcccctttctaggtaatcagagggagggcctccgttgggaaggtcatccgtcggaggttgagttgtccttcaggcaacaagcacgtcgaccctaaggaggcgatggctcaggaggaatagagcggtttcccccttagcgtgaggaggagctcgtggctccgataatc

SEQ ID NO: 50266 - DNA, 6212 bp, Oryza sativa
cagtaggtcatcataaggtaattcgctcgatggctctgttgagcagcagggctacctcaatgatttggattacccatgtccaaagattggagggcaaagataaggcgatggcatctgggggctcccgggaaagagttggcggtacaaactctagtttgtccctttcacccttgtctcatggctctttgctgctacgtgacaagccccttgatccaaatccttctccaattgggtgtgacttgtgctgttctcccccccttgacgctttttgtttgtacacctttggtctctcgtgtgcaatgatgcgcaacgctgtgccacgacagcgaccactgaattctgctatccctagcagtgttcataagtgtagtagtgtagtaccacactactgagagcttaattatccaggggagacgtacacgtacctagctataggctgtgccctgccttgcttggtcatatgtgcatggactcgaacgtgtgtaacgaagcaaaagaaatgtaatccctccgtccaaaaaaaactcaaccgagaattgggatgtgacataggttgtgtttagtttcacaccaaaattaaaagtttgactaaaattaaaagtttaaagaaaaacgttggaagtttatgtgtgtaggaaagtttggatgtgatggaaaagttgaaagtttgaaaaaaaaagttgggaactaaacaagcacataatctagtataacttatgtccatatttgttgtactagattatctcatatttcagtcttaggttgagtttttttttacggagagagtatatgctcctaccaaaatattaatgaacccactagcttatcctgttaatttcttcttccaaaactgacgacacgcactatggcacagtactctgcaatctgcatgcagattgtacactagtaccggaataatttttctggacgggactaattttagattgcagacgggaccgtaaccggtcgcgtctgtaaaaaatcgtgctctatttttacgtgcagctctttaaaatgactgtacggtaaaattaatttttgcagacggaccacttaacatgtccgcacgtgaaaataagcttattttcgcgtgcggacctgttaaataacccgcacacggaaatagcccacctacatttttaatcccgcagttgccgcccatcccactcactcccatatcactctcaactcctcccactcctcccatctccctctcctcctcaccctcctcccatctcctgatcccggagacgacaatggaggcgacggcaacggctaggttggcggcggtggagcggatccatcgctggccaccgcagggaggccggattcgtcgccagcgatcgcgaggaggccggacccgtcgccaaccaccatggggaggcctgattcgtcgccggccatcgcggggaggctggattcatcgccagcaaccgcggggatgacagcatcgggcctcgggcaaggcggtgacaacaacggtggtggcagcgacgatgacagtggtgacggcggcggcggcagccgctggattagggttccgcttttgatttgtttttttaattttttttatttttccatgcgggcggcttaagtgcctgcacccgtacgaaaaaaaatcagattttcgcagacatctcgttccagacgggtggaagatccgcacgcgaaaaccgattctgactgcacggaaaaattgttattgtaccagtggtagctaatgtgttgataactaaatgcactatataatcatacttgcatatatgcagattatataaagcgtacatgtgcatatatagacatatataatttcgctggcttggctctagaggatgctatctatgctatgcatcatcgatcgaggccaagcaaggccattccctgtccacaaaaaaggcacaggacgacgacgacggcgacgacggcaagtacgtactgtcgcgatcgttctctgtcccctttcaatcccattgtacacatgtcgagctagcgtcgaacagtgaccaaagtgctgggaatcaacggctttaatcagtaggacatgaacaggcagctgcactgttcattcctctcgcccgcgagcgatcgtgctctgcattgggccagctctagctagccatgcatgcacggccggctgcagcacagtggcgactcgctgggtggccggccaatcgaccatgcacggctaattaagctaattgaagctagccatagctacatgtgtactggctagctacaaccctttgctttcgccacagggctctcggtcgatcgatcgatcgatcgagagagcagccgccgcgcgcggctggtcgcatccccttgtcgccgcgcacccggagggtcctttgccacggcgatctcgcggtgccttgcgtttgtacccgacctgccaccgttttattccctccgctcctcctccaattccacctgctgatagcttagctgctagatcgatcgatcagatgagatcgatgagatgagatcggtgcgtgcatgcacggcgtacacagtggtgatcgatctcgatcgatcggcctcttgatgatcaatcacatgccgtgctttaatttgcatggactgtgattaattgcatcgtccaagaagtgactggtgcgtgttcgtgtttttgtgtgtacgtacgcccgacagtggcacagcatgagcattgcgactgtaccccgtgctacttgctagctgccgatcggtgacggacgcagctagctatctgtgattaatcgggtgcatggatgcatgcattgtatatatgcatgtgatgcaacgcaactatgcaactaggcatgcgctagctacctagttgactagttgtacgtttcgggcatcgatcggatggtgatcgaggggaatatatattagcatcgtttattagtgatcaggttctttggagatatcgagatcgaagtggctgtagcctacatgtaattgtgtatgcaactagctgcagatagacagactgatagtttctattacacaacgcaatcggataaacctatatcaggggtgggaagaaaagaaaaaacaaaagctacaactaggtaaaagaaagagaaactattacggataaaagctacttcaatcaacgagatggtgaagatggagccacactacactaaaaaaaaccccaaaaacaactacgccagcgaaagatcacacatgactctccgagagaatagactccaaaaccatagagaccgagaagagcgccgagtcaagattaattattgttcgaattacatatttacatgtatggattaattaagagcttgaagggaccctcgatctgtcgatggatggatcgatggatcgtcggtcgacgggacgatgagccgacctggctgaggacgactagagctcaggcaaggagaatatatatatcagaacaagagctagctagtgggtgtgtgtactacgtggtttttggctcgtccacgtgcgtaggcacacgcaccggccggcatttcaacaccaagcgtttggctttaactgacttggcgatctctcgaaactttcaggcagcagtgacaagtgacaatgaacacatcaaagctatctgcaggatcgataatataatattaggtaagatcgttttcttctaacaatattgaatcgtagaatcggacgtaggatcatgatcctgtcatattttcataaagtgcatagttttatataaatgttataatacattgtaaaaaaattaatacaataatatcagttttgttaaattgtgtaaacttgagtagagttattcattttttttaaaaaaaatccaccttagttttgaacaatagcataattaatcatattatcgggatcccaggtaagatcgtccaccgatcttatggaatcaattaatactcttatgtgggaacatgatactataacatatttatggtaggatcaagatcatcgtgccgtttgataggaccatggtatcgtaactcgtaagatattactatgactaggtgttttgaacatttatgctgggcaacagaacttccgagatttcagatgttttggagttcgtttagcgatttttgtttttaaattctgcccggttatggctaaatttaaatagattttaaccaaattcacaaaaaataaaaaatcgccataatttcatactatgtggtagagggagggggggaggggacattgcaaacattgtcaagggcctatttagaaaaacttttgacaacggtaacttctcctataattaaaggctttattaaattcagtttttattcagattttatgaacatatggttacagaatctaaaaaataaactagaattcttcttaacttctctagattcttagaaagtggttagggcaagtactataagcctctacatattgcgcccctaaatttaccacataagattagataatgaggtggaagagagaagttaggagagagagaatgagccatccctcatgcaaggggcaacatctacacaatctccaagaaaagtgaaagatgatgtgagagtagactaatattggggtttgtgtattagatgtgatattttgtatgtgttacctcttaattaatgagaagatgacatggttcaaattagatgtgacatccacctctactataaaacttgcccttaccaaccatagccagctacttctcaaattttttaagctctccaaaaccgtaccagattataagctctccaaaaccgtaccatattataacttggatcgatcaggatcataacaacttgaacactactgtacagcatgtccttgtcgttgcattggccaccgtactccatccgtatatatctgcgtacgtcgtcggcagattagttcaatcgaaggataccaaaactagttctgttgcatgcctacctttttcaagtgcaactagctaactagcaaaatcgtaggagtaccctaaacctcgttaccaagccggaaatcattaggttggtatatcagttcttcagagattagcctgcacaatttaaccttaattaccacaattgatatatatttcgttgcactaatgtattgttaattctctgaactctttcagttaggcatatatcgattcctgctagctaagcataatgattaaactacaacatcagagttttcccccttaattagaaccaacccggccggtacactagatctagcttagttagttagaagctgctagcccaatcattcataatttcatactgatcagattaagttgaagttattaattattaagcagcaataagaggtctgaaagccacccccgacagatggagacatgggcgcgctgaaaaactaagctcaagtgcttgtcatgccctgtgttgcatgtaagttatgatgagttgtgactgttgggttaacatgagtttacaccaaggccagctaattaatgggaatagctgttcttgatgcctatcaacacagagccacttgggtgcttcttccctgtgcctaacatgctgccttttgtcaatttatcacccggctattcatcagttacagtatacgctgcagtcttctctcccttttattctacagaagatttaacacattttatccctatctcactgtcatcctaaaattaagctaagctcgtctactacatttgaacacatatatgtagttgagattacgaaatgtgcaagtacaattagagagagacacaatgatggttagctctttagctgggccaagtatcctgcttgcctcgtagtcatcattgatggttaagcaagaatgggtgggtccaggggggaggccagtctacgtgtgcaaggaagcacagggtgggcccgccttgccgtctcagatctcaaccatcggattcgtgggccaccttgctaagttcaaacgggccgagaggacagacttggggaccaggcccaatagtgacacccccttctcttggcaaagctcccccttcatcttcttcagctctccagtgttttttattttattttctgttgatattccacttgaaaggtttcatcgattgatatgctcagcccttttttaaaaaaagtaaaatgtaaggtttcctaattcctgtagaaattaaaccaattagttaccacgccattgcatagactctatttattatatatattaaaaattaattcatatatgctactatcctttttttagacagagtaaatttcacacaactacagttattttgcacaatctatcacaaaact

SEQ ID NO: 50267 - DNA, 3404 bp, Oryza sativa
gttgatattccacttgaaaggtttcatcgattgatatgctcagcccttttttaaaaaaagtaaaatgtaaggtttcctaattcctgtagaaattaaaccaattagttaccacgccattgcatagactctatttattatatatattaaaaattaatcatatatgctactatactttttttagaaagagtaaatttcacaaaactacagttattttgcacaatctatcacaaaactacatatttaagagcttgttttacaaaactacagatttagtgtctacttttatcacaaaactacaggtactttgtataatttatcacaaaactacatatttaagaacttgtttcacaaaactatagatttagtgtattcgtttatcccagaactacacatttagtgtcttcttttatcacaaaactacaggtttagtgtctccattattacaaaactacaagttttaacaatgctaaaacatgtagttttgtgataatgaagacactaaacttgtagttttatgataaatgaagatattaaatctgtaattttgtgaaacaagtttctaaatctgtagttgtgtgatgtattgtgcaaagtacctgtagttttgtgataaacatagacactaaatctgtagttttgtaaaataaattcttaaatatgtagttttgtgatagaatgtgcaaagtatatgtagttttatgaaatttactcttttagaaacagagtacaaacgtaggcgtccacaacgtgcacatactcatccctatgaacacgcacacacaccctaccaatatgagcaccctcaaggactggatcgacatgtcttgagattgacgaagttattacatatgtctcgctgttgacaaatatgccgtttaccgctgaaagaatatttagccgtaaatacgagcactcctgtcaatcataggacttgaacccaggtgaactggttccaccacaaaaaacttaacaagttgagttacgcttactttgcaatcatgtaataatatattggcatagttttcaattgtacccttagattaacagaaaagttatgccgattacaacttgttagaaattgctatttttttctagaaaatgtaattaataatttatattttagaattaaattaataataattataataataaattaagttgcaagatcgctacaatttcataattattaattgtgaatttaagaaatatttattttactaaaacaaacgagtcaatggtattttcaatgacatattttatttaacacatattttaatatgttccacgacaatgataatacgatgattgattcttaaattttattaacgttgcagctcatttgtaatgacaaattagcatactgatacacagatagaccgacatacatattctatataaaaacctcgttcaacagtcatatacagtgataatctttctatttttatgaataaccggccaacatatattgcttctccctgaatatatgcatacatactaattaattaactactgcactaatgggcattacccccacctcagagtgcccaattgcccatggatatgcaaaatactgaaaaggacaaaagggtattcttggaacttgccaaatccacacaagtgcaccatgcaggcatgtgcccaaacacatcatgctacagtcctcttctgcagagacaaattacctaagaacagtgacacagtatagctgaaaaaaagggccctttgaccatgacttcacaccttagagaaaaatattactatggggtataggatcgaatcacaagaattaagccaaccagaggggggtgaatggttggtatatccaaaaaccgaaaacttttagcggaaataaaagttaccctcgaaatcgacgcaagtcggtctaaccgagattaatctaccggtctgaccgagtggatgccgccggtctaaccggtgttgaatctccggtctaaccgccgaagttgcctgccgcgcctgtcgccgccgccggtctgaccgcccgtatgccgccggtctgaccgccggtagatcgccggttagaccgccgaaacccggtaaacacaaatcaaagaactcttaaagtggatgacgactttattgattctctctgtgttaacaaagtgcaccaacagcactccttacgaaaatttcgactaaactagaaatcctaactcaaaactcaactcaattgctctctaaagcgataccgggaagcctcacgctccccctctatttatacccgaggtaggcagcctaaagccacgaaccaaactcatactagaagtcctaaacactttaggaaaccctctagtacaagaaagaaactttacataaccaatcgtaccaaatttggactccttccaaatttgactccgcatcccatacgcacacaatacctccatcgtatgccatatgaaatctccatcaacaacgtgcatcaactctagcataagtatcccgcatgatctctgaccaccacggacgtcgtcttattcccaagccgactcccggtccatcaccgcaaatactgtcccgaggcatcgagtcacatacacatgaaataaacaaagaaaccatattccgataccaagctatctccaacttaactcattagtagcaaacaacagtattacatacgtatagtatccatctagaagtcataatcatgaaataatcacggatatccaaacaaacaacccgaaaccgaaaccgacacagtgtcggccggtcaaaccgcgggctggccggttcgaccgctcgatcaccgccggtctgaccggcatacacagcccggtctgaccggtcacataaaatgacgaatcctgcgatcacatgtgaaatccaatcatctccaaaaccacttcgtgaatagattccaaataacaaaaccaataatctacgatgcccaattgttcatcacagaataataatcaaaaacacctttgattttacaaggggggccatcagcaaattttatttccccatcacatcgaacgtttgaacacatttacggagtattaaatattaaaaaaaactaattacataatttacgtgtaaattacgagacgaatcttttaagtctaattatgctatgatcggacaatgtgggactacagtaaacatttgttaatgacggattaattacgtttaataaatttgtctcgcaacttacatacatattatgtaatttgttttgttattagtctacgtttaatacttcaaatgtgtgtccgtatatctgatgcgacccggcaaattttttgccggtgaaactaaacacagcctaacagccaacaggagggtagtagtaacagctactgtagcacgaaatggagcaaagattgtgagtgaaaaaagatccgaaaggcagaatgatgcggcgcagaaacgggcgccgattc

SEQ ID NO: 50268 - DNA, 1570 bp, Oryza sativa
ccccccccccccccccccctctccttgctgctgcagcatccctgcgtgcgcttagctttccttttcccttctttttttaccgcgttgcagaaaagctcaattagtcggcaattccttggacacacgcatctctctctctctctcttccttcctttctctctcactctttcctgcgtattgccaggaattgcagatcatgccgcagcgagcagccaggcacagccttacctggtactactactcctacgctagctctcgctctcggttgctgcatgcagctgcagctgcagcggcagcataggactgattgcattccatgcttcggccaggtgcctttttctttcttcttttcgccatggtcttgcaaactttgcgttgcgtcgcacagtggccgtttcttcgctcgagaaatggtagcttgggattgggaatgtgtttttttaccgacactgatagtgatcgagctgggtgagtgtggactgtggagtgtgaggggggggggggggagcaggagcagggtgtcgttgatgcttctctcccagcgaagaattgcgcgccgcgccggattgataggtcatttcagggggagctgcatgattgcatcggccagagagaaaggcgagctacgcgctcaggtgcggctgcctgtgcggggttggacaccggactggagagagacgacggccctggaatacacagagaaagagagaggggaaagaaagaaagttattgcgacagctatgcatgcatggcctaattgtaaatcggtggctacggctactagcactgcatgggaatgggatgatgcatggaggagtgatcaaaagaggttccaaatttctcttttggggagaggaatttgggggtgatttgatttggtctaaatgattttgtctagcgatggtagtgctccggaattcgtaaccagggaattcctacggctagctgctgctgcggctgctgtttacaaaaccgtgtagttatcgcgatgatcacgtgcgataaccttttcagtttttgaaaccacgttataccttagggtaaccacacggttttcacgatgctaagaactttgcatttaggcccttccactacaatatactctcaaattgactcgcgacactcttaacaaaacatacctatgaccccgcaaaaaaaaacatacctatgaaagaggaggtgaagagacggagatagaaggtagggtgaggatgatcccacgaacccgatgcgacgtgattgtcgtcgtgaaggcagatggtggacctagaatgcgtgaggatcatggtgacataacgctacaccggatttgcatgatcaccttattctcccgatcgtgtcatctatttcaattcgtctccctagaccttcaattgccgatgatcacaactatcctaatcgttgttcttcccctcgtctcccatgggcatggtgagagtcggtttggaagtggtaggagtcaattttagggcatactctaattgaggatgtaaatgtaaaattctcacaactatggtctatggatggatacgtcagtgcccgagttgcatcatatgcactttggacctcg

SEQ ID NO: 50269 - DNA, 11119 bp, Oryza sativa
tactttttacaaaggtacccgatatatcggtgatcaccagtgtctttagctgaaaagaaactctaaaatgcaagatgtgtttagctgatgacatgacaaacacactgttgctgaactgaaatttatgtttgaaagcgagctccccagtatacttgcacagtgaaaatttatctttctgaaggatggcggcatggactctgaagcctgaaagtctgaaaaagcacgagaataattatagatcgacacacatggccgtaggcactagttcatgttggtaacctggttggattcgagagcacgaggacatcctattgatctactactactacgcatatacatgtacacacattggcattggcattggcattggcaatatatattggcatgcacgaacttgcaaatgctatagcatgatgattgcgataactgagagcaacccagagataaaagcagctctctacctttgcaaactttggcgagcatgttgcatagcatggagacctaaatgatgaaacaggcgaacgaggagggagaaaggtactgctcgaaacgatatgttcttgataacctcttattaataacaccttctttttgctatataaaatcaataaacgtacgacgacacaaagtcgcatgttaatatacggtagtctacttgttgatgatgatgcttagtgctaaccagccagagagagagaacaagatggcactcatcatcgaattaacacttcagaatatagtacagtttcttcagtcctgtttgcatgcatgcgtatgtatgaggaaaggaatgccagacacctatagtttatgacattttgtcattttccccttaaatttatatatgcaatgaatacactattttcatacaggagatcaaaacaaatactaccaaacaatctggccatgcgttctattaattttatatgacgttttctagcattgagatcaataacaaagatagaagaattcagtagggccagtcctctgttcgtcatgaaaatcagctgctactagtctactatactagcagctattgtgcaaagtacagtactagtatttgttagtttcaatcaaagtccaaaagtaattgccaaaattctgttcaaaagaagatggattgttcgccggcccatcgtttagtttcctccaaaaaaagatgccatctttttctcctcctcctcatcgaatctatgcgtactactgcatgcagcttcgccaaaaggacaacttctgaatattgtaaagatcgagtagcagtagccggatgatgcatggtagtattaaaaaagacatgtgtgtgcaacttacttctaaaattttgttaatgagctacacatgcggccatcttagcagaaagtcgaaagggaggaaaagccaagagacaaataaactttagttgtttgaggagagaaagatgtcaatgccatctcattgcgaggctagtttatttagcgagagagagaaaagggagatcctagataggatcaaggcaagggccgggggcacttgtgggagaaaaatgatcgcctgcatgtgtgaagaatcttctcccccatcaccacccccattgctgatcactaacagttggggcgttttttcagcaaagcaatcacttcggtgacaaggatgagctgttcgtctgcatagtttatcattggcaaaaacactagctttaatttcatctccggtcagctatctaccacggcatcaacaactatatatatatatatatatatatatatatatatatatatatatatatatatatatttgcattcgtatatacgtggcgttttggagtagattttttttagtgtgtatatatatgtatttctagataaataaagaagaatgcgtgaactgaatttccatctagctgccaaactcctgtcaggacaacagaaaagaaggcaaagaggggggtcgagaggaaattaaaacgtacgcagagactaatcaaagagggtcatcagcttgctaatcaagttatgatgaaggtaatggacagtgctccattaattgcgttggcgagatcgatttggcagagactagccccctcatgatcccatcttaataaacccccaaaacaaacaaacaaagccttgataaaagctgcccatccaatgagtatatgagacacattcccccttcaaaaaaagggggccaacacccacacaccgatgcaggcacaaaagcaaagagatattgacaaagccctttttttcatctcaccttgcacacacacacacacacacacacacacaacccctctctctccctggcttaagctatatatgatcccctcatgccccagccctttctacaacacaaacacatacacacacaatgcaccttcacctttccaccccataaagcctcccttggcacccctatcccactaaggagcaaaaagagaaccaaaccaaggcagctgctgcagaggcagtagtagtagtagtagaagtagctgctgtgatctagcctcttgtggtggtagctctagctctagaagtggtattgtggtgataagcttaagcttaagcttattagtgatcctctcccttaaaaagaagaaaagctccttgcagttatggcactggtcaagagccaccaccaaatgttggcctcttcttccacctcgtcctcctcaccctcctcccagcagcagcagcctccaccgccggcgtcgaactcctccagcctcgccgccgccgccgccgaccagccctcccccgccaagcgcaagaggcgccctcccggcacgccaggtacgtatatacgtatgtgttggagacattgataccatcatgcatgcatggtgttcgatcatggagcccgtgtgtacgtagacccagatgcggacgtggtggcgctgtccccgaggacgctgctggagtcggacaggtacgtgtgcgagatctgcgggcaggggttccagcgggagcagaacctgcagatgcaccggcgccggcacaaggtgccgtggcggctggtcaagcgccccgcggcggcgacggcggcggaggacgtcggccccccgggtggcggcgacggagcctgcgacggcgggcggcggagggcgcaaaagcgcgtgttcgtgtgcccggagccgagctgcctccaccacgacccggcacacgcgctgggcgacctcgtcggcatcaagaagcacttccggcgcaagcacggcggccggcggcagtgggtgtgtgcccgctgcgccaagggctacgccgtccagtccgactacaaggcccacctcaagacctgcggcacccgcggccactcctgcgactgcggccgcgtcttctcccggtacgtacaccaccccctctcctcctcctcaaacctacgtagcgttcatggcggccggcgacgcatgcactactactactacgtacgaacgctaaccatccatgattagcgattgatacgatgacgtttgggtggttggatatatatcatgattatgtgcatacgtaattagatcttggagtatttagatttaaagagatgaatttcgaattgtttttggtgggagacagggttgcatggagataagacaaaagctatggtacgtttcagggtttaaaacctgccactgggctgtagatatgatatcgccactcggagagagaaaaaagaaaaaaagaaaattaaaaggatgtgtgtttttgtagccgacaccaattgactagctatagtttgatctgatcgatccgttgtttaactggctagctagctgaccaaagaaagagcatatttatgtacggactaattggatcgggactattactactacttcaggttcttgctgttgatgcatgctgatcacttacatacatacatcctgctaggtagctagggtccagtagtacgcatatatccatcgagattaatcgaaaactattttctagctagactgaaaaagggagagaaaaaattaaatcagaggagatcgatgagatcatggaagagatgaaaaagcagggcagacgcctggcatatgatcgtttcggtggcgggttgcggtaggaccgaaaattcctacaggaaagcgaccgcatatcgaccaaaaactgtctctgcgcatttcacccaacagctaagctaagtgtagtagtagcagcgatagctccagcttccggccagttacgctgataagatggctggttgttgtagtcctaactcaaagtaagtaaaacatgagcgccactgtttgttcatgtgcaaacataatgcctgccagagctaatcagccattaatagcttgtaggagtagcattttagcatgcgagttactagcagctatttatggatcttaattctgtgaaaacttatcaggtggctgtagtaactgctatcgtcacgtaactttaaccacaaattacttttaaataattacttcctccaatccatattatcagttgttttgtcaaagtcaaacttcttcaaatctaaccaagtttataggaaaaagtagtaacattttcaacccaaaacaaatttgttacgaaaatatattcaattattgatttgatgaaactaatttggtgttgtaaatattactatatttatctataaacttagtcaaatttaaagcagtttgattttgatcaaagtcaaaacgatttataacctgaaacggagggagaacattataattaagaaaacttgtgtggttatattaatgatgatgtacacttcggtaatataacatatttttaagtagtatttatttttttccagaaaaattaccagaagtttaaacctgtatagtgacatagccaattatttaagaatgaagtatataatatctctatcaaatatagcaatcaagtacgtgataggataatcctgacctgcctagatttacagtaatagaattagaatgtgtgtttgatcccgtaatagaacggacactagtactacatgtagatgtcctagggagtgagatgatgtggacgaggcaaggtgcaaggtgacgaagcagaggtcgctaggtaggtaaagacaagctgctccattcctcggacccctggatccaccaccaaagtacaaccacgcgcggacggggcacatcaccagatcgcccggagctaagctatacacaggccaccatgtgcacccatccatcatccatgcacacacaacagcatcatctcctcctctgtttttttctctccaggacaagagcttcccactaggcgatcgctttaataattggcagtagctaagccacactctcttgtcactgaccagcccataaatataccggacgagcagcagcatcagcagcatatgcagcatgttttcccctgcagataccgatatgatcgttgcttcttccatatgtcgtcgtcgtcgtcgacgactggttttctagctcgatcaataatggcgtaagtgcaggcgccatcactagctagctgtgtgtgtagtatatgtgtacagtgctgctgttggttggtcccttggacggactggtcgcgcgtggccatttagtcagcaatggaacgtagctagcttccttgatgggtttaacgatggcatatggtggtccatcccatgggtttcatctggttgtctcatgctctcatcgatctgtcagtgtgtgtcttgttcgagatcgatgcgttgctttcgatcgatctacatgtacagatgatcaatcagtcgatcagatcgatcgccgtgtttttgttgtgtttggtgataagatggtggttaagtggtatgattagtgtgtgctaatggcggtggttgtgtgtgttggttgcagagtggagagcttcatagagcaccaggatgcgtgtaactctggacgtgtgtccggtgaggtcgtgcccgtggccacgacgctgccggtcatccgtcccgcggcgctgcggcatcatcaccatcatccgccgccgccgccgcctgagctgcagctcctcccggcgtccaccacggcgccgttggccgccgcgttctcgtccaactccacgaccaccggctctcctcccacgagcaacacgcgacgacgatgacaacgacgaagctgcagctctcaatcggccccgccgccgtcgtcgccgcggcgtccggcggcggcggcgcctgcgccgcggcggcaggaggggaggaggagcagcagcgggaagaggtgaggcgcgcgctggaggagaagaccgcggcggacgcggcgcgggagcgggcgcgcgaggaggccgcggcggcggagcgcgcgctggaggacgcccgccgcgcgcgccaccgggcgcgcggggagctcgagaaggcgctcgcgctgcgggaccacgcggcgcgcctgatcgcgcaggtgacctgccacgcgtgccggcagcgctcgctcgccgtgatgtccatggccgccatcgacggccacggcgcgtcggcggtggcgcgcgagcacctgaggggcggcggcgtcggcgccggcatctagctgatatgtacatgcatgcacatgtacaacttgtacgttcacgtgtgtacgtgcacgcgtatgtatgtaaagcaaggggggttgggtgacgacggtgtaattcatctttttttttagccgcaaattgatgaagtgtacgtagtttcgtaggtcgtttcgagcttcggtcgatcgatgtcattgttgggaaaattatcaaaggtggtatttgcaacttttgcatgaatgcaccctggcaccattatactccctccgtatcgaaatatttaacaccgttgactttttagcatatgtttgaccgttcgccttattcaaaaacttttgtgaaatatgtaaaattatatgcctacataaaaatatatttaacaatgaatcaaatgataggaaaagaattaataattatttaaattttttgaataagacgaatggtcaaacatgtgctaaaaagtcaacggcgtcaaacatttcgaaacaaagggagtagtttttagggtgctaaaaagttgctcttttttttttactggaaaagttgctcctttaatctggactggtaatggttctaggttactacttaatggtgtatcgctgcatcaatctgtaaatgatacttcaatcactataaaataaattaatggtgtatcgcggcatcaatctgtaaatgatacttcaatcactataaaataaattaatggtgtatcgcggcatcaatctgtaaatgatacttcaatcactataaaataaattaatggtgtatcgcggcatcaataaaccgctgttttgaaacggaaatgtctgacttacactgaacttttggcctagtccggtttaccccataaaccgcaaaattagacatttttaactctaaacttttcaatccgaatgaagtactctctcactcaatccaatgcggttttggtttcacgtaacatgtgtaggcaataatttaactgatgtgataatccaattaacaaaataaaataaaaaaaattggtgaggccgacctattagtgttgctgttgctgcttgtttacctctctagcatcctctcttcttgatctctccatcctgaagcatctctatggttgggttagcctgaagatgtcctcccattcctcctccctccgtactctctctctctctctctctcatagagctgtaggatgccatgatgccttggcttccctttccttcccctttcttccatcctctcccatggcgactggcagctaaaggcacgtggattgcaccccaaattcacagtgccacagagaatggagggggcgataggggcaaatctcaggaagggaagaagaggcgtagtttgccatcttggggcgagaaggaatatgccccctcatcaccgggaagaagtaattgtggaagggaatttaagcggccacaaggtggtggcgttgacaagttcctacctgttgccacgtctacctggttgccccttttgttaatttggtagcgtcagaccttgcctatgttggttcagttgtgtacatcacccccatcaccattgcgggtcagcctgcaaatggggcgggtcggcccgttggaccgctggcccgaccctcaaaattcggctccagaaggtttatgggtcgacccatataattttagggtcaaacgagtccaggaaccagtgcaccctgggtcgacccgtaatcggcttatcacagcactgcgtaggggcgacgcactcctcagctagatcgaggcggcggcggcggcttcaggttggggcgacgcgccccaggctggatcgagggctcgaggcggcagcggcggcggcggcaacggcgacgacgacttcaggttggggcgacgcgtcccggctggagcggcggcggcggcggcttcgggttcggggcgacgcagtcccgggctccggcccggctggatcgagacggtagcagcggctccaagcttacaagctaggcggcgatgcgctcccgctgtccattattgatttagcccaaccttgcttcaggctgcagcttcagcagcgacgacgccggcgatcatcaggattatgagcatggagtgtgagtgttctttgttattgcgtcttgggcagaagagcatgttgttagattgggtgtcatttgcttgatgaagtactactggttgctagtagtgatgtttgtgttttagaatgcgaagatttgtgcaaaggaatcacaaattctgaatggaacatctaggaaagttaatggagttatatctgtttctttaaaatttctagattgaattttctgaatccaattcaatttgtttttcttttgcttctattctgaattgtttaaccatgatttgtcaatttatattatcatcttgtccggctgcattttatttgatgcttatcaactactgaactctgctatctttgcatgtcgctgcttggacaagtgcactgttatgttgtctggagtaggaacctaacggggcgaccagtgccaccagagaggggcgggccaatgtttgtctctggtttcaactggtgcccaaaagcaaatgggtcagagggtatagggaacgggcctacctgccccgccccatttgcaggctgaattgcgggctccacctttagcttctccgtcaccggctttcatcctctctgctcccctccttcctccggcacctgtgcatactcctctcttccctccttggcacgggtggcgtagatatataggttgaccctagagaggagcgcaagtagaaaagaatatgaagcaaacgacatataggtatagatatttctttctttatatatatataagttgattatcccacctggatgattgagtgccacctgatacaacgttgccacgagagtcaggggggattaggggaagcatgctacaccaaacgtttaggggggcaagtcaaacattttcttttcttaaaatgattatgcattttttttatatctccatcccaaaatgtaccaattttttactattcgggaacatagccaacaattattttaagatagtgtgagcacactcaaatatgtatatatgggatccgttactcattgctgaaaacaaaatatattatagtattaccgtggataaaaaaatagtaggatatttctaatagtcacatgcggattgatttaatttcgttgtattttctctatactaaaatatattaatttctatttccctacctacgtacctttgcttcatgaattgagaaatcccaattgctagaagtgaacatatttattgacggacgaagtagcattgtatctcaaaataaaaggatttctggctacatatatatctggataaacacgaataaaaaatatttatatcatgggatgagggagtaatgtctcttggatttacttaagaaatatatagccatatttgtgttgcgattgtattagagctctaacacacacacacacacacacacacacaaaatatcaaattacagcgtttggacaaagccgctatcaaagacgtagtagtacaatattctaggtacgtagatgaaacgatctctttaaccatacctcaatgcatatacagtactcatcttagactcttattagtgagcaaacaaatacagtagttgtggcaacagggatgccattgcatgatgcacatcgttcgagtattcgactcgtttacatcgagctggactcagcctggagtaataatcaatctgagccagtagtttacagcatcagtgcgtcactgaaaagaggctgcagcggcgtcaggaggaggattcagaggatgccgttcctttcgcaaaaggaaccaaaaaacgcctttactcatcctgcttttaaccgcacgatccaggcgcagagcccccccttcccggtcggcgcagctgcgagcaactgcagcgcgcaatccatttcgtcacccagtgcgctctgaattccccgtgaactctgccgcagtaaaaacgctcgattaccttcgcttttttcctttcttttttttcgcccagtcctcctgcacagcgagatgagggaatatgccctgattttatacatggctgggccggtctgtggggacgtgtgttcttgggcttcaccacatggcctgttcggtagtaaaaactttgcctcatctgaaacaaacctggcgacgtcgcggtgacttttaccagaagggtactcgagtcgttttgccagttgcattcgatctcttcgatggcgttgtcagtcaaatgtgtcgtgccactgtgtgcctgtgacttggccacatcgtacgaccatccggcgaggtacagtgctagtacagtatacaagttttgcaaggattttgtttgtacggtcgaaatgttcagaattgttttgcaagggggcaatgccaatgtgtcagagcacgctcttgggtaaataatcatcgatggagtactacagactacagagtgctccaacgttggagctcccggtcgaatagattgtgacaatgtagtttgacctactctagccgcttgcaaagcatttgcaaagcaaatgctcctccgatgactactactggttccttagctagacaccgccctacctagtactcctagcttagctatggtggcaacttgacaagcttgcattggcgaccaacatgtgattccataaaagctgtgaggtgaggtgagatgccatgagatgatcgatatatgtaatacact

SEQ ID NO: 50270 - DNA, 4932 bp, Oryza sativa
  unsure (1)..(4932): unsure at all n locations
cgctcgtcgtcgtcgccttggacaacgggcgccgacgaggaggggagatgagatttggcactagcaagctgaggggagaggggagatccgacgagccgctgccatcgcccaaggccagatctagcgagcccagatcggatatggccgccccgcctagcgccatcactgctcggaccaccgcttctcctgacgctattgccgcttaggctgctgctccgcccggccgccccgccacagtggaaggagaagaggagagcgtgcaagtcgccgctcgagcgtgagagggaaagagagagagaaagagagagagagagagagtggaaggcatgatagaggggaaaaaagaggagagaagggacttctgtatttttgtagaccccacttaaggctacagtattgtgacacgagtgtctaatactggtcttgagccaactgacatgtgagacttggcatgcgagtaagaagcactgtaaatgctctaatggaagcttttccttggctcggctcggcctcgtctataacaattttgatcgatttgacacgctcgatgtacctatatctctctctctcgcacgtgctagcgtgtgcactccggaattatgcaatcagagccgatgaaatcgtcacactttgctttattcaacacgatcgtcaagagccgcagtttttgttgttacgttcctcagagcagcacgcacgtcggccggcgcctggaaacacgaagcggtcgccggcgagtgctcatatctcgccgtcccagaggtcgtcgagcgacttgtagggcccgtggtcggagacgaagcggagggcacggttgatcttccgctgcgggatgccggcgatcctctgcctctcctcctccgtcagctcccatccgacgatgtccaggttctcccgcatccgcgcctcgtcgaagctcttcacgatcaggcagtccccttgctcgtacacccacctcaggcacacctgccaaatcaacacacacacgtcagttgctgctgagacgacggcgcgacacgaacacacgcgtgcaaatgtagacgtgacgtgcctgggctacggtcttgcccttggattgggcgatgtcgcggagcacggcggaggccatgacggagtcgctgccccagtgcgtgccgctggcgcccagcggcgagtaggcgcagatctggacgcccttctccctgcacagctccctcagcttcctctgctgccacaccgggttcacctccacctgcacgtacgtacgtaccgtgacaaaccaaacgcaacgcaaacccaacacaataagcaaatcaaccattaaaaaaaggttataacatttttggttgttgcagcattgtgaattgtgcaaaccaacctggttgacggcgggagggatggtggcgaaggagagcagggtgtcgagctttttgcaggagaagttgcagacgccgatggccttggcgaggcccaggcggtggcactcctccatggcctcccagacggcccgcatgtcgaacggcacgaagtcgtcggcggtgaagggggccttgtaccggcccggcttcatggacacaggccagtgcaccaggtacaagtccacgtactccatctgaaggttcctgcatatatacgtgtgggatgagcatgtgctttctgttaattaaggtgagtcttaacctttcataatcagttgattagtcgcatggtgcctcagatagaaattaaatgcactgcagttaatgagggactaatatctgtttggaggtggcagccaagatggtaatgaaagaatttgtctcgtggctaatgcagtatcttccaaaattaaaagcactcaaacagtttggtttttcaactacattcaaaattcaaaaaataaactagaaattagaaattaggttttctagcttttttaaattattagaaactagttaccaactagatactcaaggcatccctatactcaaggcataggagtggtcggcacgtgatatactcaaggcattcctatactcaaagatgagcatcagcacgacaaccaaagagtaagactttttataatttgtcttgttaagattaaagaataatatcacatacaattttgctatatatttgtcgataaattttcccccaaaaatttgacagatgtaattacagtacaatcatagtgtaattacactgtaacatgcatgtaattacactgtaactataatgtaacttctatgtaacttttaaaaatctctccgtaacatgttattttggtaaaatagaggttgtgggaacaaactatttcacatgtgtgtgtgctgtgattttttttcttcctcatcaaaacaaatcttataatagatctaacaattcaaaattacgtgaaacttacgtacaagttacactatagttatatagttatatgcaagttacagtgtaattacactacaattgtattataattacatctatcaaatttttaggagaaaatttgtcgacaaatgtataggtggtccctatcacatatcctaattccacaataaattttcctttatttaagataatgcctttgtttttcttataggcctggcccaaccgattactccaaacaactcgtaataatccactactaaaatcacaattcttcacttgattccgccggaatcttatacgggggcaaagagaaggggggggggggggggggggcatacatacaatagcngttgcctgagcgcggggagcaccctggcgcggtgcgcgtcgctgcaccagagcttggacgtgatgaagaggtcagcgcgggaggcgatggcgccggaccgcacggcctcggcggcggcctcgccgatgggcgcctcggtcttttagtgcgccgcggtgtcaaagtggcggtacccggcctcgatggccttgagcacggcgcgccggatgggctccggcctcggcccctgcaccgccgtgcccatgccgacgcgcggcatgccgaagcccgcgcccttggcgcctgcgccgccgtcgctcatggctggaggcagagtgtccccctctcttggacggactgcggcaatggattggaggatttcgtgggggtttttatggcaaattggcaaagcatatataaacacgacgacttgggtgcggtgttgacggaattcgccgtgacaccggttggttatttggttgtcgtcggtgaccagtacaaaactattcgatgctttcgcagaattttctcaaaaaagaggaggaaaaggtggatattttgaggcgcgcatcgcgcctgatcgttctcgttttcctctcggatttgtttttggatcgtaacggaagttcatttgcgatttgacgggaaaaggagagccgttactcaagcctatgctgatctaaggagaaggggaggcggcccatatcacgccatcctggttttgtagcatagcgagaccggccaagctcatgcagtcataggcttggttctttgcgttacatcacagattaatcttaacggtcaccgctagtagtgacttctcggagtgtcgatgcgatgtggatcagagcaagtgataatccaagtggcgttctaatacatccatatcgatggctatcatgctagtcattttctacaattaagagagggttgaaacttcttcgtactatctaaattataccccgaagcttaattatagtacaattttaagaattattttatgtacttacatctgtcccaaaataacttcaggcataagggctcaaaataacttcagacataagggttcaaattagcacagaaaaaagtggcactaattaatagaaatgttatattaatggatgggtagataagagatactgaaatgataaaaacttaattttagactgaatgataggtaagagcatagaatttgttttgggacaaatgttagatgttaaaataaagttatcttagtacagatggaataggtttttctgtctcattagcaatagaaaagatgtaacttttcagaaaatgcagtccaaaagcagaacaagcttcgctggattatgaagaacgaatcacatcaacaaatataacgtgtcaagcctagttgcacattggaagctgcttcgcactatcaatcaaaatgatcatgattctcaaaagtgaaaaaaaaagaatggttcagtatttcaatatttgacaatacataaccagcggtgggtacacgtataaatagacaagccgctctagaggcatcatctctacacttcagttattctgctataggaaataagacatgacatgatcttccagagatgctcaggtaggtcatgcatcaacaacgtgaaaatgtctagacatcacagggagaattacatgaccaaagaaaagacgatttatcacagcagtcgcacaaaaggagaacaaatttataggttcattacctgttcctatgaataatggcctaacctgaaacatggcaatctctagctgctcctgttgtgcgagagctaaccttttctatactgggacttcttagtggcaccaaaaaggagtacaactccgctgctctccagcctttgacaacagtattactcacacttgatggatttgtatatgtgacggacaaagaacaatgcggcacggaaaccgatcatgcccagcatcaggaagaaagcatagcagatgcaagccatgtagccgaagaagaatgatgtctgcataaatccagacatatctgatcgtgcataatagtagtacagacaatacccatagacaaaaaatccagttgatcctccacataagaatgacctgtataagagaaagggcagaaaaaaaatcatattgttgttcagcatttagtacaaaagaacagcattaactggaggttcttagttaataaatagatggatgagagaccttaagcatgggtagaatatccataaatgggtggtgctcactgctcagcattgtataccttgctcatgacaaaa

SEQ ID NO: 50271 - DNA, 7791 bp, Oryza sativa
atgatacataattggttattgcattgtactcaaaatttcactacgataatactttgctaatcagcaactccaattgtaactatgggaatacaacagaagggtgcccaggaaatacatatgaataagatgtcaaacaaacgaaaaaataactgcagaaaattgacagccacctgattgatctcagagctcaataaataaaagcaaatacccaaaatatcagtttcagtgtataaaatgaaatatatgatgcattcccatgccagtacttgtttaaaaaacataaagggaaatgaatgtacctccaccaccattcatggtcttcagcagcaagctgaaagtacgtcagtgcaacagtaatgaaggcagtaacaataaggaggatgatgaagactatgaagagaatgctgtaaattgtgtaaatcctgtggccccaaacactagcaaagatgtagtagagctcaatatagatggcactgaaaggtaaaaacccagccatagccatctgcgggattgtttgccggtaccacggaagtggaggaatctccctaggatatttggtggtacggcagggagcttggaattcagtcttgctgtttttaccagcaatgcctcccaaaactagaaggggaaatgtaactaaggtccagatgagcacaatgacacagatagtgccgaagggcaaagctgctgttgcactataagcaatagcaacagtgtttaggaagcagaaagtcaggaataggggtccacagaacaggcatcctgtcaacagcaagttcctcacctgagaagtataaaacgatagcattagtaataaaagaattataatcgatgcttttaaatttgcagtcttagcattgtagaagtgtctagggatgtattatgtatacatgtaacacatacccagtttgttccctctagctgacagtagaaagaggttgcaatatacccagcaattcctgaagtgagagcatagatgacaaccaatgcagtaaaaagagcaccacgattgtacgggtagaatactccaacaagtgcaagaaggaatataaaggttgtgctgcaatgtgccaaataaagattgttagctatctgcatgtctaaaaaggaacaacaggaggaagaattccagttaagcaaaataaaaccataatatatgtggcaagaaaaggcccatcaaaacttacagggcaaacagttgagttccggtgccgagagcagccgaaaaaaaggacttgttcttggggaaccggaaaacatccccatggatatacttccatccagactcttcttggtcatcagctgcttcctcatcatgggcataccttcaaatgaaaaagggttaacctaaaaactacgagatgaaatgtagtcaagtcatcaagctcataaatcaaagagaagatcaaccttcaagtaataaattcataagcattacactacaaaggacatataatctgaacaccgttgacatagtagatctgctttatgcgcttcctttagcaagttaataatttaatatccatttcagaccaaaatatttgctctatgcatcatgcattagtttactctcaactgaagaacatggcaagaggaagaatagatgctcgtttagtagaatagaaaccactgtttggagtgagtttcgacagtcatgtcaattgtcaaaatgcatctccataggaaataaaaataatttatatgctgcaattttccatgttctatgggctggcatctgtctttactgtcactgctcattacatttcttttcttttagtgcttaactagcacatgtgcatagtgggctcaggcaaatatcgtgacatgcatggagtatcttccaaaatatctttaatacttaatgtaaatacgtaatgtatagatccttacttgacaaaatcgttcttcagtactcgcatgaggatggtcgccaagaatccagtcaaaaggaggactgtaacacaagagtttatgatagagaaccaatggacctccaaatggtgtgggaggttggaggaactggaatacttctccatcctcttctcaaatggtgtgggtgtctccttccacttgactgagtaaaggaattgaacatcagcttccttgtcctcagtcaggtcaactagtgcactctggtcagtgtgcacattgatctcaataacccggtcattgttgtagaggatgtcaagatgatgtgcctgtacaggtaatacttccactctttcggatctgtcttgcctcccttctccaccttaccaatgaatccccacagtgggaggtcatcgtagtacatctggaagtagtagtcctttgctaccgcattccgaaacttggccacctcctccttggtgagcttcttcgagcaaaccggcttggagtcataatccacacggaaatcaagcttgtaaggtgcatcaaccaaccggtccccattgaggacctcaccgatgcctcgctcttctccttcactttctctgtaattaacaccatttattagcaaacaactaactgggattcttcagcaatgaagaggaagcatgaatctgtgactaactaacctggagagcagaaaggcaggtcaaagtaccgatacgtctcactgcaaggaaaaaggaaaatatcatgacaacggcattcgcgtgacattatcgcctttaagaataaaaaatctactttacaaatagatccgattcccagcaagtctagaatccgctctccgaacacctatacttgctaaaactgaaacgaaaacagagcccgacgcgaagatctgggcagtcaacagtgcagtgatcgatcgttatcccgtccaaatcactacgaacgtcatctctcggatctccgaaactagcctctctgcgtttgaccagacaaacctaaacccacgacgactcagcccacacacacctcgaggcgagatcgggggcgggaacaactaacccaacccacacccacgaatctaacggatccgacgatgggatctgagcgggggaggagagagagagagcctcacctggggttgtggaaggggccgaccttgttggcgtagagcgggacgagctcgttggccttgtagcggtggtcggagccgtcggcgacgacgccggtcgccgcgagggccgcggcgagaaggacgagcagcgcccggggggccggcgctgccggcgaggccatcgctctcgtcggggcgggggcgggggcgcgcgcgttgactaggagagagagcgcgcgcgcgagggtttgggggtggtgggatgcacgcgcggagatctgagccggagtggccgctttgcttgctccttaatagagagagagaccgagacgagacgagacgaggcggaggggagatctggagagggtggcgttttcagggttgggtgggggggaggaaggtggaggcgtactgtggccctaatattgtagtactagtataatggggtcagctaagctaaaggctagtagtagcccacattttggtgcgtcggtcggtttgacacgatccaaatcagagcgctctctcgctccccgggggtcggggttgagtccagcgcaagttttctttccactttttggcctagtcacattctgatttttttttgtcaaatattatcggttagctccagtagtgaatagtgaaagtagtacggaaaactaataagatgaagattaagtaatggtacggaaaacgggaaagtcattagcgtatgattgattaggttttaacttattataaagttgaaaatggatttatttgatagtttatagtaacttttatgtataaatttttcacatgaaacatattgtttaacggtttaaaaagcgtgataatgaaaactgaagtagactacatacattttaatccaaaaagaacgggcagtagggcttccctgctctcaagaaaatcaaagtttagtgtatagcatatgtccatgtaacaatgttgtagaaacttgaacaagggaggaatgagggcaggaatttggtacaacattgctggatggacatatgcttcagccaaactttgttcaagtttggtacaacattgctggatggacatatgcttcagccaaacttgaactcagaaacgaatcgggctggatggagtacattgctggaagagaagcattactgcataagctcactggccatccctggaaggatggaagcgaagcacatgcttgattttttttaaggtagaaaaaattgctaggtcattcaaagaatctacaatagtgactactgcaggagtgtaatattcagttttatgctgctaagaaggtcactgcctatagagatgaaaatcacaaacatcatgagagttgacagtaccgcaagaatggcaacgggccatgtactaccaaagtgagcttatgcagtaataccatctgcagcagttaccaacttagcagggctatgcaaatgctgaaagaaaagaataccacaacgcaacctttgcttttcacctgccctcactagcgccatgcaaatgccaccaattcagtgagcttcacttcccctagtttcataatcctttcctgcagttacgctgtcatcaggtttcctctacatacgcatgctgacttcaagtgctggtaggaactaactctgtcggtcgacaatgacacctcttagctctctgcatgtgatgtatggagtatgcagctcatttccctgacaatttctcatgaataaatgggaaccgttgagagaactgataagtttcagtcaaaaaagaaccatccgcaggcggcagccacagcgaggtggttctcatttctactccctccatcaaaagaaaaaaaaaacaaacctaatattagatataatatttcctaatacaataaaattggacaggagtatgttcggatttgttgtataaaaatatatcatttaataatagatttttttcgattttgctatatctcactcgaaagatttttttcttatctctcactcgattttctcactcaaatttacagtgcattttcttgtaagttacagtgtaatttatgaaacttacacggtaacttttgtaagttacactgtaatttttgaatcttcgcatgtaaattttaaattttgtattggatttggtctttttcttgaggatatggtaatttagtgtccattatggtgtttcttaattactttttgctttttattatatctatcggattttaatccaaagattaaaaatctgtgcgataccatcataaaaatctttcgaaagatgtataggtacttccgatttttttttgaacagacggagcaacacactagttatcgggaaaaaaaaaaacccttccaagacactgcaataagctaattgctagcgttattttcttccctaaaaatcttaccttttccgaaggcatcggcttaatgctttacttatttggaggggccatgcctctttccagatgattgctgaagaattcttaatgtttactccatgaatgattgtatccccggcgtgattttctgcgtgatggaaattttgcacaaactttggaatcactacggttttgtactcatgtatctaagtaaaataatctctcattcaacaaacttaaattagcttaaaacacaagttagcattaaattcaactgaggcaacctttgcttcctccatacagtcaagtcaattcggcagttgaatttggtgaggccacgagaaatggatatgctccatcgatttgggggataaccgcgagaaatcgtgtggaaccaacagacgacagataacgagttctgggcaactaattgctcagataagaaagagagcgtacaacattgcacatattactttcatctatttaatagtatttaagaataataatcgaatgaaaccgctagaaaaaaaaaaagaaatccacaaatcttaggagtcaggcatagacacttcgtaagaaaaggatcaagattccattcaaatttacagcaaatacctcagttatcataagaatgtaataaaactacctcacaattgcggctgaccttaacctttctaaacatgcagaataatcttgggcatcattagtcgtgatgacaaggaatggacggtatttacatcagtacgaaggtaacaaaatcttgatgatacggcgaatgagcttgagcaattatatattaaacactaactttacaagactggctacagatgatccgaattgatacaacactcctaagatacaacatcacctgttgcagtttgcgaacagcgattgcacctatgctatcttgtccgagcagtgatttgacagctggactcgagggctaacgttagcatgtctgtggagaattgatcgtctggtttcaaccataaagcctgaccaaaatagcgagaaaatattagtaactaaccctgcgctacatgaaaacaacgaacaaactgaatagaaaggcattggtctccactgttatatctcttcagttttaaacttcaaaaacttaattgcatatatacacggtgaagatacattacgcacaagaaagtccctatgctgaactattggcagctccaagcggcttgtttggtaactggagggaagaggattgggagtttacacgagggaattgatgatgagattaagatggaaatttgatttttaatcccaatatcttgtttggtagaggtgatggaaattgatagggagtttagttggagattaggtcattaataaaaacggatggctgagatttgcttagacaaagtaaaggaggaattccctcccaattacctgcccctacccaggtattgaaaaggagggagttccttcctcaattccccatccccatcccaccaaaattcccatatctcccaaccaaacaaaacacttaatagcctcatccctctaaactcccaatcccttctaaaaactccctccaaccaaacaggccgaaggtgtttgattagaaagatgtattctaaacatgacagctaagtacaaatgatcatagagcgtcaccttgtggtagtaagttatcgcagcctcgaatttatcctgtgttatgaaaagatgatattagtaaaattcagatatactcagaaagtaactgtggaagtgtcaaactgaaacaatgaatcaagcatatcaggtctcattcttaaaactaaaaaatattgcttctacaaatgcaacttaagcttaaaggtcaattgtccttcgtgattttcatgtaaattagcaaggaatctctgaccgaaattttttttcctgaaaacactactactagaacttaaatcaccctctcattactctgttctcgattcttccaatggcatctctatgccttgtctagttgtttctcacttatgcctatgggaactaacaaataccaagtatcccgatgtttcaacggtaaacgctcagcacacatatatgaattgatgttgtaattgaagtagcaggttacataaaacttagttttgaacttctgatcatatagatatccaatagataattaaatataagtctatgtggaaagaccatgatctaacacgtatcatcttccaggttcttttgtcagaatttgcagaacttctgccctatgcacatgatacatcgcctttacagcatgccagtgcagcataacagagatagtaccattcaaagcagtggataagaaaggaacacaagagtaccataaggtggtaagtataagcaagaccagcaaacgcgctcaaacttttggtttgaaaggtgagtgccttttcataatatgatattgccttttgatatttcctgttgcaacaaaaaaaaaaggttagctcaagaatgatattttaac

SEQ ID NO: 50272 - DNA, 21561 bp, Oryza sativa
  unsure (1)..(21561): unsure at all n locations
caatgtgatgcgatggttcccttacttgagtttccgcaatgcatgcccaagattcaccaatgttggttcccacatttcattcaaggaggatgaagtatgctccagtgttagctcaaaccactgaactgctttttgatacctaaacattttttttaaaaaaaacagaatatcaaattctcaactactttaatagcagcacaaacagttctttttactgaaaccactagaactggatgtgtcaaacatttttttcagcagagaaccaaatctaatgggatgaaattttataagttgaagagaatttgaaaagcaaataaaaaccaaacttgtatatggatcatggacatcaatcacacgtttcaaactctaatgatcatactataaatgcataaaacacacttgttatcgtgattgcgttaatgcagggcccagctggtgcagcattagttggaaactaaggggaaaaaaattagttgctctcttacttgggtttacttcactgaatactatgtgaagatcttgtcgatacaaagggaacagcaaagcatccgttacaaatcaatcaagaaagatgaaacattttttctccccaaagttcatcataatagcctatcctttcttatttatcctggagccattccccttcttttattcttcttttatcccaaagttcctccggtgtagccagtttctacatgctaaccttaacatgaactagggttcacatcatcccacttcaaaaagctttccatacaatactatgcatactacatccatattctattcaaaatttcagaaccaccaaatcaaccttgtatatcatggacatctttcaaaacatccatgttagcataacatttttcctataggaatatcagatatagaacttataggaatgctttccctttcatgagagcaaagcatcttacaagggaaagtggagcatcactggttccaataataataggataagcagacaaaagaaacctttagaacagagaaactcttactctttcatattataagctacaacccccatctcgttatatataagcggatcagatgggcagatagattttgcttgcgtgaagaactgcatcacagcagaaagaaaagggggtttaaaaaaatgatgacaaaactattatgccttgccaaataaaactttgcaaataacatactctccatgataggctctcattgtgagctacaacaaacagtattcactaagtaaaaggaagttgtgcatgataatatctcattttctataacccatccaatattacaaatacaggatgtattttcagcatctgaccaactactattaccacattaaacctccttttttgccaaaaacaaaatatggaatgagaaaatatagggaaaaaagtcagctctaagtatagtttctttatcagagtggaagcctcataagaaaattagtctcggtaggatttctcaagttattacctgctctgcaagtttgaaattgtgcattcgcaaatattgcatgcccatgtataaagttggcagatgacatctgaaatagaaaacaatttcaacaaatagtgagccgaaggacagacaacaacagaggtgaagtaattgaagtgcaacaagaatctacactccaaaacaaagagaggaactcaatccacaatgctcataatcagtaatgtgtagtagatacaaaagcttgccagtgtcccaaaaaacacgaatagcagtttccagaacagaaggccaaaaaatgaaagaaagtagaaaggatccacaatgctcataatcggtaatgcatagcagatacaaaagcttgtcacacccaaaaaaaatacgaatatcaatttccagaataaaaggccaaaacaattgaaagatagtacaaaggaaaattaatgcaactaattgtgttaagataattgctccttagacaaacaagtacaagtatgctctggtgttaatattgagttgacttaagtgtaaaaagaatcaaattaatttaattaatattttgctaaactgtacacagcataataacataacaaataaagaagtttttttacacaaacaattacttcgaaaggaattactgacccaggaaatagccgagctgctgtccgaaatgcagccattgcttgatcaccctcctcctgtgcagcataagcaataccagtaccaatccaagcaggaggaaatgtcccatctaaccctgtagctttgctgataggaaatatattagtgcaaaacatattacagctacttaaaattgaacaagaatacaaggtataagaagttgtaagagggttaaacccatccatgattaaattcaatgaacaatgagcattgaacaaataagaaacaaaataacctgcaacctttggactggtataactgagacacatgtcttaagaaaatatatattgtttatttgaacttggactctggagaattattggacagatatgtttcaccttacaaaccatctgacagactgatactacatgagtagaacctactcatttctgtctttttatcacattgttctatcattccagacaactaaaaatatttaacaaagaaatatattgtttgttataagaaatcaatcagtcagttggatatgcgtagatttcaggaggcaatggcacctatggacactgttctctccatcagatggtaacactattgtagcacacatgttataccatgtctgccatgttttcatgacaaaagtgttgccttacgcaggaacatggttgtgatttgcagtgcagaggatattcactaatcacaccctattttattttacatcccaacatcgaaggcacagcaggattatcttctaagctatcctaaggcaaaaatgcatagtgaaggttcaaataaaaataatacagtagaaattaagagaagaatatgcttacccaaagtatctgcgtgcttgatcatacttcttaatacagtagtaataacacccaacagcaaaccaggaaagagctctacagatggaaccacagctgacattaaaataatatactttgtttgctcatgtctgactacaaacaatcaagtgtactttagtattatgtccctccaactattggagtctatataaccaacatgaagggggggggggggggtcaatctcttcttgttcatcacataaataaaggtcagttaacatattttaccccaatcccgatgctattaaaggctagattttacaagttgcattaaagtttgcagaaagatgaataatgtgcacaacactgtcattatatctaagattgttacatgcaaatgaaagggggaaaagcccatctagcaggataacaaatattatgtgggtctgaatgtgggcaggccagtgggaatactcacttctgaggatagtccttcactagattgcaggccaaaatataaaggtcatttgaatggccaagctccattgcagctgccaaatgaactaacgtgcatttcaaatgaaaagggtccctttcaagtaacctgaggcacatatagcatcacaagaatgataaaccaatattgatcaaggaaacatatgtaccgacaatgaatcatttaccaacttacgcagatgtgagttcgaaacatttttggtactctccactctgatgatagtattcagctttgcaagccaacacgtcaatattatttttcagtgtcagtcctgaactcaaagatgaaatactacaagattctcgttcaaattccttgaactttgcttccactatatattctttttcatgctaaagccataaaacaaaacaaaccatgatcaaaagaaatataagtgaatgcagatacacatattgtttattaaattgcaaagcaatgcagttaataagtcgtgtaccttccttatcaaacaagagtagaatgctgagagccacccatcttcttttccaaattttagagaggacaatagctcagattctgatatcattgcataacaataagtaccaagaacaaagagaggattgaaggtccaacattaagcatatcttcttaaaactagtccagtaataacaataaacattgtattatttaaaagaaatatcctaagaggatggacatgacagatgggaagattgattttgtaaaacttaccttcctcgcatgtcaacatgtagttatcaacaaggcattcaagggcctgccatgtacagacataagaagttaggaatgaactaactggggttaccacagaggcccaattccatgttagcatctggatgccaaattccatatttagtagaaccaaaaatacaaaataatggtggttcatgtaattgaaaaggtattgtactaaagagtcacatgattcttctcacctcatagcacaaaggatcagccttcactgcagctttgtacctgagataacagcagaacaaagccataaaaccatcttaaccaagctatttggccagatatgcccaaaaaaaaacactgattagacaatcctgcttaaatcttaatttcaaacaaagaaaattagcagtacttccaggtagcaacagttatttcaactattagcagtgtgtcctcgttttacaagaaaaactcattttctttatatcttctaaagagtatcgaataacccaacattctcagtgaagatattgagtaaaaggtgtaagagaagaaagacttcaaaataactgcatcgtcattcaccagaaccactgaatacactcaattagacaaaaaatgaaatgatgctttaccattgtcgagcaaggtcacagttgtccagtgcttcgtatgccttgccacgtaaaaaacatattgccgctttgatctggcaagcaaatattactatcaatcaccatactaagagagagagagagaggcatggggaagagaaagaagagtcaacacacattgatctcatggtcttcagcatccttatcaaagtaaatgtcactgccatcatcctgatcaacaacgtttccatgctcatctatttttgcatctccaagtatgatcaaacactgatgccattctttcaactcctcctaacaaaccaaaacaaaacgatgaaacagtagctaagataaaaggaaagacggtagataaaataaaggactacacaggactgtacaccagagcacaaatcagaaaaatctatactgaatcataatattttctggtatggttcaattttctaaagtaaaatcttagaagtacattaaaaaaatcactaatcctatacagttcttttgatctttcctataagaaaccagatttttgtttcgagtgtcatggatattgattgaataagcagtcaaaatcatatgtgcagtttatatatctgacatatatagaacttaaacaaaattctcatttatctaaaagtccgaagcaggaagcacatattataatcaaccaaactcccagatcagaccagctattaagaaccaagctaagcacccgttcattgatggaatgcccaagtaaaaatattctggtcgagaaaatgcaggtgtatcatgttaattattttgaagcatcagcagagcattggacttgaagccaaaaaaatgaaatcccccagtgcaagccattgggcgcaccttgtgtgaagtaaacgaccctatctcaactcatacagctaaagctaaaagctgatcaagcaaaattttatcgagtgcttgcaaacacacagaatcaaatcgtcaaaaaaactgccaaacaatgcccagagtgaaagaacattgaggccaccatacaaccacaagctgttcataaggaagctcaagcgcagccacgcactggaacattaacaggggcagtgaaactaaaccttctatctacacacagcatgcacccaacatgttcgacaaaatggcagactaaacaagggcgtgggtggggaagctcacgaggcacttggctgcgaggaagcggaagcggaggtcgcggaggagcttggaggagttgaggatgtggagcgcgcggcggaagtggcggcccaggaagagcgcctgcgcgagcatgtagacgtcggcggggtcccccgtggccgcggccaccttgtcggcgaggaagatggcggacgcgtacaggtgcttcccgacgctgtcccgcaccaccccgcgcagcctccaccgcctcctccctcatctccgccgccacctccccctccgcctccgcctctctcctccgcttgggatttttctgcgctgcggcggcggtggtgggcggcgctgctggagggaaaccgaattttgtatcccacattcgccactagggttcgcggcggagagtggtggtttttggaaatttctcacggggaaaaaaaaatggagtcccgacgcgccgcggatcgcagcaagtgatcgatggatggaacgtgcaagcagtatggcttatgggccacgggcccacggcccacaacatatgcaaacgaaccagaaagcctgtataggagaggacacacgggccaggcccatcatctggccggattcggaatctacctctgtgaaattgcgatcaaaacctacggaaatgtatagatttcgtggtatacaaatgttgattttgccagcttacattgacgttcttcaccttagtcgtccctgtttgaatttacttttctattattattaacacgggagaaacgataatttgaaatgattcctttggaattcctgcaaattcttatgtctatcttacaattgctgcactgttctttttttttttatcatgtgaagacgaattaatgtgcacgaacgtcgtccatcggagccgaaagcggtcgctacacgccgccggtgatggccctcgttgccggagtagcggtcatcgcctgtgagccgcaccgctggaaatcggcgacgcggggcggcggcatgccgcggggagccgtcgctctcaccggcggcgagacgccgacggcgccggccgggtgcgccgccgccagggcttcttcgccgtcggctgcgaggtcgccgccgccgcaggagaggaggcacgaggcggtctgggagcagcccagcgtggtcacgatgacgtagctgccgttctcgtacagcttcatgacgtagcactcctcgtcctcgagggtctcgcgcgggacgccgcccacccgtcgcgcaggcgccgccggcgaggccacgggaacggcggcgacgtcgtcggcggcggcggcggtggagggcgcgtcgtcaaagcagttgaggtggcagtagtcccagtagatggggcacctcctgatcaggatcgggttgcgcccggtgcagaggtagcagatgtacatctccgtgtcgtcgccgccagtcgtcgccgtggcggtggcattgccgggcgccgtgttgccgtcgccgcccgtggtggacacggcggcggcggcgaggaggaggagaacttggtaggatgcacggttgatggaagctgctgagagaggcatatcacaaattgatgagagatgatgcgtgcagcctgtctcatttataagggttttttttatggcggggatatttataggtcattttggctgcagctgcattttgacgtcaggagcgtagtagtatgaaattatgattatgttgggagaccaacaaaatctcagtcaatgaatggatactacaatttgactatacgagaataagtgcttacctgtttctgcgtaagagtgctatctgaattctgaagggtggtatcaaatttcaatcgagcaatctgctaattatctcttcccatgtagaggttacatgtttttcttcatcaagataaaccagaaaaatcggttgcatacatatgttattttgtaattaagattcggattgtatctctgtttcgttagcacgcttttaaactattaaacggtatatttcatgcaaaaactttctatatataggttgctttaaaatattaaagatacccatttataaaggctgtaataattatattttaattaatcatgcactaatagttttctcgtttcacgcgcatcaacttaatatttcatcctcatctgaaaaatagctttctagctgtactcattttccagatcaaacgtctagggtatacatttcctattttcctctgtacaaattttctaacaaggttcatactcatgaatacccggtacatatccctttcaaaaaaaaaacatagtacatgcacgtagactacgcatatcgctatgaacagcaaacaaatgtagtgcaaatcagtagtggaatagtgatttactaattcagctgttcagcaactacgcgctccggcggtggatggtactatttgtcagcggtggacacggttaattagcaagcccaggaagcaatggattctgtttgaaagtggtgagcaacaagcaaagtgtgttgtgctgccgcagccatttaccaaaaaacaaaccaccgaaacggcaggttgggacgtttttagccatagaacgaggagacttctcgtgttgctgccgcaagccgcaagatcgatccgatcagtaagaaattaaacggctgtgaatttatcccaagaacacacactcgtaatttggttaacagagacagatcgtagtttgcaaatatgagctggttgattcttccacattaactactacttcctgaaaaaaaattgtgaaacctaaagtgttactcgtattattatttttatttgttttgcttgcttgaatttcttttggttttctctctaccatactgcctatatatttatgcacagattgacacgaggtttagtgctatgtccaacgttacattcgtcggatcggatcatcaaacggcacgtacgcgttgtcgacatgggctcgcggacggcggcacccgggcacggctagcgctggtcgccgcaccgctcgaactcggtcaggccgcgcggcagcgggctaccgatggcggccggggtgatctcgccggaagcggcgcccgacgacgacgacgacggcagcgcgtcgccgtagctgcacacgaggtagcatcccgcggacgcctggcagctgaccacgtcgacgacgacccagctgccgtcagggtacaccttcatgacgtagcagtcgtcgtggcccccgccccggccgttgtcgccgccatcgtcgtcggcggcggaaaaaggcagcgcgcgcggcggagacgaggaggaggagcgcgacgccgacgacggcgacgagaggcaggcgatgtggcactcgtccttgtcgagggggcaccagctgatcatcagcgtgttgcgcccgcggcagaggtagcagatgtactgctgctcctcctccgtcgtcgccgtcgatagcggcgaggagcggccgcggcgcgccatcacggttgcgttggcggcggccgccgtggcattggtgccacgagccacgacggcggacgtggctggcctggcggccgccgtgcctaccaagaggacggcggcgacggcgaaggagtaaaaggagaagatggaagccgagaaagccattggcaaataataattgaaggcgtgtgcgcggtgacactgacacacgcagcgcgtggcttatataggatggtatttaggtggagagattagtactatggtcatgtttggaaaataggtttgggatatgatttcccacacctcaaaggataagtcttaatcttagctatccatcattctcaccatatttcatcctatcgcttcattcatttccgtttcctaattccacctctcctaacctattttccaaacaccctatagtactaaattagcgagaagattggatgtccttgagctttactgcagaggagtatatgcaaagaagttatcatgggttttaaaatttaatcatttcctcccaataaaactttgtcagtgatatgggcccggggttatcatgtttagagggaggaggctgccccccccccaaaatgccacatggccctcccccaaggggagtcaggcccgaggtggggtggcggccactccttcccaaatactagtcggaggaggccgccccccaatgccacgtggccctcccccaaggagagtcaggcccgaggtgggatggcggccactccctggccgagactagagggaaaaggctgccccaggcgccacgtggccctcccccgaggggggatcgagcccgaggtcgggcggcggcggccacctcccgtgactaggggtcgggctcccccgaccacctctctaggtcaccacgtacaggtgcccacctacccgcatttatggcgacccgagcggtcgcgccacgccggcgtgcagtgtactcaaccggtctgtgaccggtcgaataaccgatggaactggctagtgcacctgtgcgctgctcgtgtgttaggcggcgtgcagcctgacatgtcccatcaaataatgatggtgagaggttctcatcctcttatcccagccggagtcggtcctcccgctctggtcaaagctaggctcccgttccccgatgtaataggagcccagaagtcttcacccattaaatggtgaatgacatgggcgtccctcgtgtcaggcggcatggtgtggtaggccccacgaccgaggcgacgtggatgcggcttccaagttaaggaacaagacatgcatttaatgcaaagatggtaatacttctcgaggaagttagttgttgggcctatgtggtatccccttgaactataaaaggaggaccttgcccactgagaaaagggacgatgacgacgacgacgacactcagtaggcctgaactctaggagaagaagagcgagaatgctctccggagtttaggaacccttgtaacactcaaccataattccaaacacaggagtagggtattacgcttcttagcggagcgaacctgtataaatctcttttgtctcatcgtctttggggattgaacgccctcaagatcacacagcttcgctcaccaagccctgaatctcacccgctgcccccggccgaactcacaaaggggggcctcacggttccctgatggaggagttcattctccgacatctggcgcgccaggtagggggcgcgttcgtgatttttgaggttctttcgagcgccggcgcgataagtgttgcgccgccaatgcgggggaaggcgcagcttcctcaggagtgccgcaccaccccaggcagggggccaggcccccctcatcttcaccggataaggctggcggccaggtctttatggcgagtcttcggaatgaccgatgacccccaaagtttcggcccagcctcaccgaaaggtaccacggtagcatcaacccctccgagtccctccagatccacacgacgatcatagaggcggcgtggggtgacgaccgggtcaaggcgagtttcttccccatggcccttcatggccaagcgcggggatcgctcatgaacctgccacctgccttcgtctactcctgagaggactcttgcagttgagctccgggtgccgtcgaagcccgggaccccctgtgctggctcttccatagcggctagcttgggtcccaccggttggctacggtgcccggcctggctcaactgtggacggggatcgctggctctagagtttttcggctctcacacacgggcgaaagtagtcgtccgtgtagaaggaagagatattgaaaggaggccaccgaaaggaaagatcaaacagaatgtgtagcgtggggacacaggcttgtgggaacctaacctcgtttgctaagtggtcgcaggcttcccaaagtggttagggacccatggagggaggccctcttcaagctaaaggtttgaaaggtcgcgacatgcaagcaaggtttgtgtttgcttcattcatacaaacgattctttgctaaaagtatgggggctacgattcctagctctatcctagccctgcgtcgagctttgggcgccgtcgacgtctgggtccccctgtgctggctcttccgtagcggctggttttggccccgtcggctggctacagcgcccagcttggcttgatcgtgggtgaagattgttggctatggaaaatttagtcctcgcactcgcgcaaagatgatcatttgcatagaattattattgcttatgtttatctctcgcccatctcttcctcgcggtcccgcggtacccacgtgtcgcgcgctggcttgcctcccttggtaacaaaaagtttgtattcacctcatccattcaaacgattctttgctagaagtgtgggagctatgattccttaagcttcttatttncccnctagccctgcgtcgagctctggtcgccgtcgacgcctggggtcccctgtgctggctcttccatagcagctagttttggccccaccagctggctacggcgcccagcctggcttgatcgcgggtaaagattgttgactatggaaagttcagtccccacgctcacgcaaaaataatcgttttgaatagatgaagtataacacgaacagaggttaacaagaggcaggggcaagcaaggtacgcggcgtaaggtcacgggcccgagagagtctaacaacatttgctgagtatatacaggaaataagttcacgacctaaggtatgggctaaactcccgagcccgcagtgcctcggagaccgggaggaaagtgggaagttaaggcgacgtatgaacgtgactaaactcccaccgcccaactcccagaatgataggacagaagatcgggcccgcatgtcaactgactagcagattggtgtcaaccctgatcacctgggaaaggttttggccagggctaacgccgggggctactgtcggtgatatgagcccgggggtatcatgtttagagggaggaggctggggtggtggccactccttcccaaacactagtcggaggaggccgccccccaatgccacatggccctcccccaaggggagtcaggcctgaggtggggtggcggccactccctggccaagactagagggagaaggctgccccaggcgccatgtggccctcccccgaggggggatcgagcccgaggtcgggcggcggcggccccttcccgtgactagggatcgggctcccccgaccccctctctaggtcaccacgtacaggtgcccacctactcgcatttatggtgacccgagcggtcgtgcggcgtgcagtgtactcaaccggtctgtgaccggtcgaataaccgatgggactggctagtgcgcctgtgcgctgcttttgtgtcaggcggcgtgcagcctgacatgtcccatcaaataatgatggtgagaagttctcaccctcttatcccagtgtcatgaccggcaatggtgacactgaaaaagttgtaatcaataaagctgtgagagctgccagaatccaccaaaagtaacaagactttactgtgaaccaatgctctcaaacgaatagcagtaggaaggtgaggtcctgtcaactgcagaccttatcggtattctccgtttcaaaaagacgagattgagaaacaggtgaaagaaatgattgatgctggtttaattacacntagtatgagtccctatgcatcacctgttttacttgtcaagaaaaaggatggtagttggcgtttttgtgtggattacagaagattaaatgctctcaccattaaaagtaagtttcctatgccggttgttgatgaattattggatgagctctcaggcactaaattcttctctaaactggacttgaaagctgggtatcatcaaattcgaatggtggaaactgatgaagccaagacagcctttaagacacatcatgggcaatttcagtttagggttatgccatttggtctcacgaatgcaccctccacctttcagtgccttatgaactcagtccttgcaccatttatcaggaagtttgtgttggtgtttatggatgatatcttagtttatagccctgaccttgatagtcatttgcatcatcttcagcaagtttttgttattttgaggcagcaccagttgtttgctaggaggtctaaatgctcttttgcttgcactcaactggaatacttaggacatatcatttctgacaaagagttagtactgatcctgagaagacagcagcaatgctggcttggcctgtgcctacttctgttactgaattgaggggatttttgggactgacaggctattacagaaaatttgttcagggttatagtatcatagcacgaccattgacactcttgttgaagaagaaggcctttctttggactgatgctgctcagcttgcttttgatcagttgaagacagctatgagtaacactccaatgttagctttgcccaattttcagcttccttttactttggagactgatgcatgtgcttatggtcttggtgctgttttaagtcagcagggtcaccctattgcttattatagcaaaactttgggccctgttaatcagaaattgtccatttacgaaaaagagtttctagctattatgatggctgtggataagtggagatgttatctgcagagaggtccatttatcattaaaacatatcacaaaatcttgtgtcatttggatgatcaaatattggggactgaattacagcaaaaggcaatgactaaattgatgggtttgcaatattcttttcaatacaagagaggggttaataatattgttgctgatgctttatctagaatgccttcctcctctcaattttgtgctttttctgtggtccaaccgatctggattcaggagatgatcaattcttatacagtggatcctcaagctcagcagctactagctgagttggctgtgcattctcctaattctcaagggtattcattgacacaagggattattagattccagaataagatttggattggatccaatgcaggactgcatactaagttgattcaagcttttcatgcttctgcacttggtggccattctgggattgctgctacttatcatcggattaagaaattatttgcttggcctggtctcaagttggatgttgaaaattttgtgaagcaatgtcaggtttgccaacaggccaaacatgaacactgtcggcttcctggactgttagctcctctcccaattccaaaagaggcctggcaggacatctccatggattttattgaaggtttaccgcgctctgatggctataatgcaattttggtggtggtggatcgttttactaagtatgcgaatttcattcctttgcgtcatccattcactgcatcacaagtggctcatctggtggacaaaactgtatttaaaactcatggcatccctcgttctattgtgtctgatcgtgatcgtctctttactagcaagttctggacaactctttttgctacttgggacactcaattacagatgagcacagcatatcacccgcaaacagatggccaaatagagcgtgtcaatcagtgtttggaaatgtatttacgatgcatgactcaggctaaccctaagaagtggagccattggattcatttggcagaattttggtacaatacaaattatcatacatatcttggctgttctcctcataaggctctttttggggtggatcctcattattctcaagttcctgatctgacattggctactctgcctgatgtggtggatgttcagactgaaaggcagcacttgtctgaatttttacagcagcagttaactcgagcccagctgcgcatgaagaacaaggttgataaaggtcgttctgaccgtgtttttgctgtgggtgatgctgttttcttgaagttacagccttatgctcagtcctcatagttaatagaccatatcctaagttggcttataagttctttggcccttttactgttttggagcgcattggagtggcggcttatcgtttggatctacctgccagcagcactgtgcatccggtgtttcatgtttctcaactcaaagctcaggtgccagatcatactcctgtttatacttctttgccatcccaagtggttcttgatgctgctgacgttgttcctgaggcgattttggagcgtcgactagtgaagcgcagcaatgcagctcatgtccaggtgttgctgaaatggtcttcattaccagcagatcatgctacttgggaggactatcatgttgtgaagactcgctttccagatgctccagcttggggacaagctgaaactcctgcgggcggcactgtcatgaccggcaatggtgacactgagaaagaggtttaactgtgaatgatagtgtgtgtgttttgggctagactttatcaaatagaatgcggcctgtgtgccttaaatcgtttgggccaacagcccatgtaatcaggagataaatactcgagagagagaatggctgtggccaacctggcaaaagaaatcgaatctatctctctccaaactctgtctctcctctgcctcagctctgtttctcttcgtccccaactccgatctcgtctaaatatatatatctctctctctcgtcggcggcgagtttcgcggtggcgtagtgttacacccagccggagtcggtcctcccactctggtcaaatctaggctcccgttccccgatgtaataggagcccagaagtcttcacccattaaatggtgaatgacatgggcgccccccgtgtcaggtggcatggtgtggtaggccccatgaccgaggcgacgtgtatgcggcttccaagttaaggaacaagacatgcatttaatgtaaagatggtaatacttctcgaggaagttagttgttgggcatatgtggtatccccttgaactataaaaggaggaccttgcccaccaagaaaagggacgacgacgacgacgtcgacactcggtaggcctgaactctaggagaagaagagcgagaatgctctccggagtttaggaacccttgtaacactcaaccataatcccaaacacaggagtagggtattacgcttcttagcggcccgaacctgtataaaccccttttgtctcatcgtctttgggggattgaacgccctcaagatcacacagcttcgctcaccaaaccctcgaatctcacccgctgcccccggccgaactcacaaagggggtctcacggttccctgatggaggagtttattctccgacaaacttcatggacatatatctatatttaaactacaataaactatatccaaatacactgagaaaaataaaagcatataaagttcctatgaagaaaaaaaaatcaaaaccttaaattggcggatccaaatttcaaacatttatttttcaccgttggatacttggatggtactagttaactcacgcaaagacctacttttccgataaccaattcctgttacgggtaggtggtgcatacccttggttaaatattcatgcatatgaccttttttttttcaattatacggtagagtacgtgcacacaacactatacacatatttttatgggagtatccacaggtttgtccatgatgcacactaaaaagagcgagaccagcgacacatctttggtgtcactaaatttttgttgaaattatacttgtattattgagcacatcaaattttaatcctagtgggtgaaatcatacatttacaactacaccaccatactgttagtgcttacttacatgcatatgaaattcccaaatggatttatcaggtaatttgggaaatatccgtatagttaaaatatcttatattataggacggggtagtacctaaccttcaaatgtacacaagttaccgatccaatttctaatatatttttattgttgtatcccttattaaataaaaatatgtgtattgcattttcttaaatctgttaaagttccccgcaaaaaaaaatctgttaaagttaattaaaaaggaatctccatgaatttctaagagaaaaataaaaaaaatacaatccttgcatagttggctcatactacgtattaattattaaccctcgcagggttttatcgaagggagaaattttctttcaggtattatcaccttacgtgcagctattatagcgtgttaaagttcatggtgtcatcattgttggaaaagacatcaaaactagttacagaagtactcagagttatgagaaaaatcgtatggttttagtgcaaaattgtttcattttgtgtcaagtttagacttgcagtagatggttcattcgaagagtcgtatgagccttactgaagtggaagccgagctttcccccaacggcaagagtccaactgtccaagagcaatcaggaaactgcaccggcagattagtaccatccgattccgattctgatccgagcttacttctccttattggaatcggatacggatccattcctggcccaggagccattgcccggtctataaatatacagtactactccggaagaccccgcaagagcagcaaactcaaggaagccgacgcgacgcgacccgaccgatcaaggagattgcggagatgggcaaacgacggtcgcgatcggaatcggatgctgaccaccgcagcggtgcgtgcgccggcggagaggccaagcggccgcggccggagcagaagcatctctacctggcgctggacgactgggagaaagggtacaatctctacaaggttgacgtccacgcgatcggctccgcggacacggaggccgagtcgcaactgcccgagcctcccgtgctccagctcgaggccgccaagggcgcacgcgacgtgctgttcgccgccgtcggcaccgacatcctcgccctgtggcagccgaggtacgagacgacgcgcaccgccgtgtacgacacggccacggggcggctggacgccgccggccctcgccacccgagggcgctgcagcccatgcgcttcgtcgtcgcgtcgtccgccggcgcccgcgggctgtacgcgctgcacgggggcggcatgcacttcctggagcgccgcggcggcggcgaggcgacgaccgagccgcggtggacgtggagcacggcctgctcgtcgctgcgcctgccgttcgacggcatgcagcccggctcgccgcgccgcaccatgcaaataacctcgtacgccatgcatcccgacgggcgcaccgtcttcgtgtccgccacgagtggcaagcaccacggcacgttctcctcctccctcgacgacgacgacgacaacgagtggacgcgccgcggcgactggctgctgccgttccatggccagggccactacgacgccaagctgcgcgcatgggtcggcctccactcgccagggcacgtgtgcacctgcgacgtcccgtccaccaccttcagtagtgtggcggcggcgacgtcgcagccgccggcgtggcagctggtgaacgcggagcacctcttccaggaggatcatccggagcgcggcggcacgtcgctggtgtccacgggcgacgccgagttctgcatcgtggagtccgtgacgccgaaatggatggatccggtgtgggatcgcgacgagatcgacgagtacgtgctccgtgtcaccaggtttcgtctcaagcacgaccggcacggacagctccgtgcttcgtccaggtgtcgccgcgcttcctacagggtgcgcaagcatgactctgtctttgcgccgcaagcgttctggatgtaatcgtgttacactagttactaaacttactactacttgtaaattgtaagaagtccaaactttctcaatcacgaaaaaaaaaagaagaaaagaaaatgtctcgttcgtgaaaaaaccttgaacgacaccacatccgggatcagggagatgaacagcaggtggaaaattgcttgcctgcctcgcttacgagccgtgagttgtgacttgtgacttgtgaccgtgcgtgacgacgacagaggctgacaggcaatttgtggacgagcactgctacacgtgctttttttttaaaaaaaaagaactcttataaacaatgatgtttgatttaagtatataaaaattatagcaaatgcagatatactcatagtgttagtaatagataataagagtttagtaagacgaaattgtatagacttttccttcatggacctaaaccgccaggcccatgggcctcagcttctggagtctggaccagcgtaacacattgaacaaaacggaaagacagaaaataaacaaacaaacttgaaaagaacgaaaaaaataaaaataattgaacaaggaagatgaaaattatacgagaaaaaagagtagaagttttggagcattcccttgtcataaaatttagagacttttaggagaaaaaaaaattccatccaatctaccaaaccccatctcataccatccaaaatggtcgtatccaactaacaaaaacaaatttacatatcctatatacttatgcaattcatccccactaagttattttcctgcttcctggtgcagccacgtcacttcagaaggagaaccgccagatcagttttctacgccacgcacgcttgatccttgaacagacgcatatgctctccttcctgccggtgaacccaatcagccgactccttccatctccatgttgtcccctgagcttcctactgccgctgtcgttcgacctcccagcagttgcttgacgttctttctcctttgtaatggccgacttatatatcttctaccggctttccatcttattgagtctgtttattgctcaccttaattctatatatatatatatgatcctttgaagtctgaacaagccaattgccaatgcagcatatcgggcattctcgtggtctcatggcaactatacattgaccagttctttcaccttgcaagtgaactcctagcccattattccagcaagtctgacttggaagtcattggaaacaaaacaaggttcctccgatttatcttgctcgatattagtacataaattggccttttttttaaccactcgcacgagacggtgtgaacttctattgatagagcaggtaaaaattacaagattacaaccttggaaggtctaaccaggaaaaaggaaaaaaatataccaccacccacacaccgacagcgccaacacacaagcccgggagaaggcaagcaccggaccgatcgccgctagaccaacaaaggaacatagacgagatcaccccctaggggatgccaaaacgacgtctccaagaagagaagtgacgggagaaccaccgccgccgccgtccgtcaaggttcaaaggagccaagactaggctttcgcctggcaaccacctttgaggggtgagacagcacgacaacaccctcaggagggggaacatcgttgccggtccggccaaggccgggctaggttttcacccgctgctcaccacatgcaaatctacagctggtgtcccgatgctccaccactgctcaagctctgccgacatgtggcacacctgcaccgccgccccccgccgaccagccttcgtgcgcggaagaccgcgccacacccaccggcagctcctcctcataccgaggtcgcctcctccaccgccggccacgcctctcgcgccaagccggcctccatctccgccgctcgcgccgagccggcctccactgccatcggctacgcctctctgcgccaagccggtctccgacccctcctccaaacgatgtcgcgccggctagaagtagccgtctgccacgccctcggctagccgaccgaagccgtcatgcctccggtgaccgcagacacgatcaccaccaccgctgctgccaaacacccgttgccatccacacctc

SEQ ID NO: 50273 - DNA, 4810 bp, Oryza sativa
cggcacggatctgaggtacaccgccgacgtcgtcaccgagcaccatgccaccgtcccctccttcgctcccgccaccagcgccaccatgccggcctccgcctgccgtgcaccaccgccaccacgcacgcaccgctgccaccatgccatgccgggttttgccgtcgctggccgagccgccccgccagtgctgcgtcagtcgaagctgccgccgtcgcacgggctccgcgcgcctccgtcggccgcggacttagcctcgcccgccgccgcaccaccgggcgccgcccacgccgttgccaccgaagccggccgctcctccttccccgtcgtcggacgcctccgccgcgcggggagcgcaggggagctagatccggcgtcgccgcacgccggcgagcccgctgccgcggcctctaccccgccgccaacctcgcctcctacgcccacgccgccactacaacctctgccgcaccgccgcctccttcaccccgccaccgactcctccaccccgctgccttcttcacctcgccagccggtcgggcaggccggtgtcgccgtcttcgcgccccagaccgtgtcggtgcccccaccgccgacgggagggagagacgaagccccgccgccgccgtccttgtggccgtgcggctttgccggcggccgctcgggcggcggcgaggcggcagaggcaggagtgggggagcgggcgacggcggcggtggtttctgcctcccgtgtcgcccgtgagggagacgatgcgggggctctctttcgatacgaatgctcaggttacagattaaattggccttaaggccccctttgaatcacaggaatgaaaaaacgggggaataggaaaaacataggattctgataggaatacaagtgtaaaacagaggattgcaaaacacaggaaaaacataggaatgaccgtttgattgagccgcaggaaaaacacaggaatttgaggagagagaaagactcaaaggattcttaacatgaggtagaacctcatgttaaatttccttcaaaatttgcatgggaagaggcattccataggaattttataggattccataggattcattcctttgattcaaagggctatataggaaaaattcctataggaattaaatcctttaaaattcctatgaatttcctttgaatcaaagggggcctaagttttgtcgtttcagctcatgccttttctccgtgcttttctgactccatgggcaagatttactatgtccctcactacgtgggaactctgtcatgtggtgtatctgtatttttgttctgtctatcctctacagggttttgatctattacgtgtactctgtttttcactaaaaaatatttcacttacccatgtttaatccccccccctattgtttttctacggatgggcctaataaatgatggtagcagatcttaatttctgggcgtaatatcattttaattaattccaatcaaaggttgttgcacttagaaacccagacttcatctgaagattcgctgctaagctgtttatagaatggagcaactgaaaacgaagaattaaaagggttgttccaagtagttcatcttttaaccttgcaggcacttcatacctcatatacattatttttgtttggtttctaagcccccagtgcatttgttgcttgaatcacagaaaactgatttcttagttcataaaagcactgggtcttcctaggaatatataatctagaatttcaagaggttcagcttccttttttttttgcataacacaattaattcattccttcgagttttacctcgcattaacatttatgttgtactgagaatgcgaattttgttctgtttgcatgctcattgttgctgacttgctgtggacagagtagactgttacatggaaaatggaacacacatactcacttgggcagtagctacaagcaagttaatcgatgtacaattttttctatcctcaatcaggatacattgattggtgataataactacttagctgtagcttcagtagtctccgtagaaaggattggcacttttacatttttagataatggatattttatacccggcttcatctatcaaaagatagactcatgccaattataacaaacgttcttacagagtaacacttggaaacaaaaccgagataaaagttcagacgactaaagaccgatgtgtctagctgataaccatccattggaactaaaaaattgcaaagctgatgactcaagatgttgcgatgccgcgatcaactgtgaacgcagatcctcatgccgttgcagcttcgcccattggcgtaaccaatgcgtacccctgaatagtacctgcaaaaaagatttcggtccgtaattgtcaaacactaactcgtttcttgttaaccaaactgtccagaaaagcgctgctgctgcagttaacagtaaagtattttgttttttattaccccccttagaccactgttggaataactcaactaagtttgatggggtacttataccaaacaaaatatgaaccgctcgccacaagaacttggcaatatagcaatcaaaaaacaggtgttgaattgactcaggctgatgacagaaagcgcattttaaatcaccatgccaattcctcctagctaaattatctttagtaagaatgacacctttctttaagtaccacaaaaaaatttttatttttgaagggaccttaatttgccaaatatcctgtgaaactctaataccattactgattagtgcagcatacatcgatttgacagtaaaatttcctgaggcctgcaaagaccacacaaacgagtcacccccatcctgtaataatacttcctgtatggaagcaagcactctattccatctactaagattcgctcccaccaaattccgcctaaacgaaatattcagaggggacgaactaagtactttggccacagagtcatttttccttctaacaatattaaacaatgatggaaatctgtcctttaaaggtttattacccagccacgtatcgcaccaaaatctcgtttgcgatccatctttgattttgaacgatcccaagcccaggaaagtgtcttttatgctcattaaacctttccagaagtgtgaatccgtagcccttttctggcaacaacctaggggcttttccttcaagtatttgttcctaatcagttcctgccaaagtccgtcctcatttaacagtttgaaaagccatttgctcagtaagcatttattttgaatctctaaattggggatacctagccccccttgtatctttggttggcacatgactgtccatttagctagtctgtattttttcttgtgctgatcattctgccaatagaaccttgatctatagcagtcaattttttctagcacaccttttggaatttcgaagaaagacagcataaacatcggtaagctggaaagcacagagttaattagtacgagtctccctccggccgttagtaattttcctttccaaccccccaacttcttttcgatcctatttttgatttcttgccaatctttattgttaagttttctggtatgcatgggaagaccaaggtatctaaacggaaatgacccaatcttacaccaatagtggaataaaaggcttcgttctcttttgctctaccaaaacaaaagatttcgctcttatggaaatttatcttgaggcctgatagttgttcaaaggttgtaagaattaacttcatattaatcgctttggcgacatcatggctcatgaaaattccgtatcatccgcatattggagtatcgacaggccatcctgaatcaggttgggataacaccctctacgcggtcagcgtttttggctctagcaatgagaatcgctaacatgtcgacaactatattaaatagtactggcgacatcggatccccctgcctcaagccctttttggattggaaataattaccaacttgatcattcacctttatactgacattacccccttgagtaaacttctccacccaactgcaccatttatgtgaaaaccctttcattctgagagtttgttggagaaaagaccatctaactttgtcatatgcttttcaaaatctatcttaaaaatgaccccatcttgcttctttgtgtggagttcatgtaaagtttcatgaagaataatggccccttccattatatttctacccggtaaaaaagccgtttgagtaggtttaatcactttctgagctactgatgtaagcctgttagtagccactttggtaaagattttaaaggagacgttcaggagacagattggtctgtattgctgaatagtcctaacatccttctgcttgggcagtagaataatcgtaccaaagtttaggctattaagaggcaacgatccctgctgaaatccgaaaacagagctaacaggtcgtcctttataattgtccagaaggcctgataaaactctggtgggaaaccatccggaccaggtgcagtattatgtttcatttggaatatagcacattttatctcttcttctgtaaaatctgccgttaaagactcattttcttctgcagagacttgtcgtatgtcgtcgacctgagactcatctaaaaaaatagatgaagtctgtgatgggccgaacagggtcttaaagtacttggtgatgtgctccttaagttgagcatcaccagtaatgacctcgttcccgtcctgcaattggaaaatacgagttttcctgtgacggccatttgccagaagatgatagtattttgtgttagcatctccttccaataggtgcttgaccttagcacgttggtaccatttaatttcttcctccctcaataactca

SEQ ID NO: 50274 - DNA, 1001 bp, Oryza sativa
gggatgtgacccctcctaagattatgaatctggactaccctttgtccagattcgttgttctaggaggggtcacgtcccctcttagattgaggttttttgtagaaggagggagtagaagtcagaagcaggaaaacttaattttttttccagattctcagaagttgttaccaaccagctgtttctcagaaatttaaactcccctaaataagccctaagcttcttagctggtagggagccgctgggaggaaggcaccgatctcggttcaaacctagccaataactttttttttacttagttctggatgtaacacaacaacattttaggacagatgtgtgcacagtacgcccttccgagaacatcacccacgcccttctaaaaaacgcatatgctcctgttacaacagaaaactagcagaactatcgccccgacgtactacacagctacccgactcacgacgactcccaaacagaagccccccactgatcgacttgacggactgactgagggtctgtttagttactaaaaagtttttcctaaaaatatcacattaaatctttgaagatatgtatgaagcattaaatgtagataaaaaaactaattgcataattatgatggaaatcgcgagacgaatcttttgagtctaattagtctataattagccacaagtgctacagtaacttatatatgctaatggcggattaattaggctcaaaagtttcgtctcgcggttttcaggcaagttatgaaattaattttttgattcgtgtccgaaaaacctttccgacatccgatcaaacgtctgatatgacaactaaaaatttttatttcaccaaactaaactggcccagactaatcctatttgcagggacgatcgacatgtcgtgaactcgtgatcctccggtttcccggccgtatacatgctaccgctagcaagcatcaaaactttctctccacagtggtgccatggcaggtgtacgtgcgatccctactttgattggct

SEQ ID NO: 50275 - DNA, 1012 bp, Oryza sativa
cccgccgacggagaagcggcggtggaggtggcggaaccggaggcggcagctggtgggcgtgaggcccgggcgcgcggcgagggggctccgcgtctgcacctccatggcgacggagtcccagctccccgtgccgtgcctgctcacggcgcaggccaagagcagctcctccaacgtcccccagatctcacctccccctcctcctcccgccgccgccgccgccgccggagacacgtcggggccgtccgatccgtccgccatgtgctctcgtcgtcggcggctgcttcccccctttttcttctctctcgctcgcgcacgcttctttgttcgatttttatctcggagagatggatgggatggatagatagcctctgcctctgtgattcgagcgcgcggcggcctcgcgcacccaaaagacaatttcgcgtttctcaggggggtgttttggagaaggcgagcgtgctgttttcaaactggggcccaccttctgcctttctttttattgtacgatccccatattgcccctgattgcgcatactattatcccgtactatatatgagacgcaaatgtcgcaacaaaccgtgtttatttgttaggccttgttccattaatccctataagtaagggattagaggagatttatttcacatctattgtggcgtgaaattattctccctcaatctcctacaatcctattcaatcccctctaaattgaacaaggccttataggagaaaattcttgctctaattccaaaccgcaaatttgatacgcagtactctctctataaaaaaaaactcagcatatccagatttgatgtactataattccatcccaaaataaactcgttatgtacaaattcgttatactaggatatatctctatatccaattcgttgtaatatgtccaattctagtacgaggtttattattattttttttacagagggagtaagttttttttagaaaaaaattgattccagtaaacgtgtaaacgatctaagcaaagtcagaccg

SEQ ID NO: 50276 - DNA, 1510 bp, Oryza sativa
  unsure (1)..(1510): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgcttaacgcatcagtggttttagcttgcgcaaaaacaagatccttcaaggagagctggttagaaaagttaccgttgttgttacctccttgataatatgggcatggttggttccacccctcacctccttgtggacgatacctgttgttgttgttgccaatgtacatcgcctcctcacgggtttccgggcagtcattcccagaatgacccgtgttgccgtagacctcacatgtgatgtgagagtccaaggccttgacggtgccttgtggtcgtttcttgtggtcgtccaatcgcttcatgagaaggtccagcttggcagcaagtaactccgtctccttattggtgtgcatgcctcgctgacgggtctggagtcgttcctcactccaacccatattggagaccatcttctctattaaatcagcggctccttgaaccgttttagagaagaaagcccctccagctgccgcgtccaggtgatcgtgggacatcgagtgagtccattataaaagttctgcaggatcagccagttgtccatcccatgatgaggacaggcgggcacgtactcctgcagacgctcccatgcttctagaatagactcatctcttgtctgttggaaactagaaatccttcgactaagggcattggttttgcctatcgggaagaatttcgagaggaatgccgtagagcatttatcctaggtgttgacagcagcacgattggcatagaaccactgcttcgctctcccaagaagggagaacggaaacaatcgcagcctaacggctttgggactgacgcccttgatggtgtacgtgctacatatctccaggaactgtttttttttactgaaagtactgccagggctttgcccagcagtttaaattttataaaatataaatatgtacaaagttacaaagggaaggcaaaacaaatatgctacaaagtttgtatccaatcagaaagagattgcttgagtggatctttcattctacacatatgtagaagaacttctttaacaaacatagatttccatgattgaagtgatggctgaacagtttgaaagattaatccattcctttgcttccaaatatgtcatgctgccatgaaaaaaacatcaaggaaaccctttcgagcaaatctgattctcgccaagacaagcatttggaaaaactccaagttataattctaggaaatgcccatctgctgctaacaagccacactgaagggacatgtaaaaaacagatggagcctagtctctctttgatgtgtgttgcataaggcacatgtgaggtcatcgtcctcttttgcacaatgtcttctgtcaaagcatgtcccttgtgttgagtctatcacaaaacaagagccatgcaaagacctttatcttcatgacacattt

SEQ ID NO: 50277 - DNA, 1760 bp, Oryza sativa
aattcctgcagccctgtctctccaccagaaagaacctttgttcaggaccagatgtggcactctggattcataataggtttgagagatgagcctgaccgatggcaggtcagctccattataaaacttgaccaaatgctttaaaagcaaagcagtgttctgaactctcaagctgatcacacccattcctcccttgtctttgggcatacatactctatcccatgaagctagagattttctagttgaggatggattgttacctctccagagtcaattctttcttgctgtatcaattgccttgatgacagtgactggaagttgcagacagcgcatataatatgttgggatggaggaaagaactgagttgatcaaagttaatcttcccccttgaggcaaaaacatagaacttgctgtcagcctcctttccactctatccaccaatggagcaaaatcaaccactctgggtctagtagtaccaaggggcaatcccaaataagtaaaaggcagggaaccaatggggcatcccaaaataccagccaataatgatgctttgtcctgagatagattcaaaggatataaacttgacttgctaaaatttacctttaggcatgtggactgagcaaacatatttatgatggctttcaaacataagacttccttttgagaggctttaagcagaatgagtgtgtcatcagcatattgaattattgggaacccactaccatcattctcatttattggcttagagatcaaacccaactaaaaagctttattcacaactctttgtaacagctcagctccaagaacaaaaagaagtggtgagagaggatctccttgtcttaccccccctcttgcatttaaaagattttcctggaacactatttagcaagacagcagaagaagcagaagagaacaccattttcacccattctatccatttttcaggaaagcccatgtgttgaagaactgcaagaatagctgagtgctcaatagtatcaaaagctttctgaaaatccagtttcaaaaagaacaatttccctcttagattgctgacattgatggatgtactcaaaagaccaagcaaggcaatctagtattgtctttcctttgataaaaccatactgattctcacttactagcttaaggattatgccttgaagtctgtctgccaatagcttagttaagaacttcagagaaagccccattagagatataggtctataatcattgacagtctctggtgaattcttctttggaaccaaggttatataagagctattcaagattttcaagttagtgcactctgcatgaaaatatgctgctagtctgtaatagtcctgagctattatatgccaacattttttcataaaaaaaccattaaaaccatctgtaccaggggctttatctgtcgggataacagaaacaagactgtcaatttcctgtgtggaaaatatgtccaccaaacattctaggtctgtatgtcttgggaagagtgtactcaagtcaaaaaccattttagggtcccttgcaactcccattctattcttaaaacactgaagaaaaagagaggccttttgctcatgtaaatgcacaaactgcccattttgatcaagaacctgagacgttgtgttgattctatatctctctgttgcaatagactagaaaaatttgtattttcctcaccaagtaacatccatctattagtacacccctttttccaatatatctttctgaattccaataacttgaggatttgcattttc

SEQ ID NO: 50278 - DNA, 2452 bp, Oryza sativa
attaccagttatagcatcaataattactgtgagaggtgtgagactaatcacgaaaaacattgctcaacccgcccatgaccgcgggcacggctattcgaatagttttactctggccagaggtgtaccactgtacccacaagacacaacctcaacatcatgtctaccatgcatcgcgatactggaaagtacccgaatagaggctgtgacaataccctctacacaacacaactcaccacagtgcaccgttcctggatcataatcaccccctctacaaccagaggcatggactccccagcgacacccatggacttctcgccgcttctcagtctgggaccccataatgaaccgtgctatacaaaaggtaaagccgttgcccacgctggcttgtggttggtacggttaatgtctgacaacagtagctcgcgaaccggtccttaattgtcatgagcacgaccttcaaaaccatgtgctcacaacccaccattgacaagttttaattatcaattaattatcataacatgattaaccatcgtgagctaccattaaatataatcataaataataatgtagtaagattcatcccattaatgagctaatgtttctaagcatggctaagcaattatatatatagcatttaactgaaccaaaccaatatataaggttcaagctaatcaatttattacccaaggtatcaaggaatagggtattcaatgcaaattggccataacaaaggaataggttcacaccacccggtgacattcgaaaataaatgcacagttgaaataaatagagaatttaaatatatgatcaatatgcacaaaggattgtgtttaggatctgtgtgacttgccttgcaagaatcggacttcaattagtcttcttgaacacttccgatgcactcatgaaccttcgcaacgacggaaatgacaagctaacacgcaaaacaaaaaaaaagactaataaaaaccaaataaacagtacataaaagtaaacaaacatgtagatcatgattttagatgaatttagagacttgaaccacttaattccgacttcatatgaattagttatgtactttacaagataaatctgattttagacttatacagaaagggattaacgatgtcatgacgacatcactgccggcgttggagggtttgggcggccaaaccgagggcaccagaagaaagaacatgacgaggggaactcactgaggggcggcacgacgaagaacgacgacgggagacggccagcgacgagctccgaagggcggcgaggtactggtcgacggcgacagcggctttctggcgatctttagcggaggaaaattagcggacgggcttcaccttggcgctgcgatgccgaagaaggcgacgacgacgtccagcaaccactgagtcgacggcgaggctcggccggaggtgaagtagatcggattcacgccgacgaggagcttccagcgggttacggcaaaaaggaaccggtggccgggcttcttctcctccttgcgaacccggtggtgacggcggcgtccagaggcgacgatggacggtgacgagcggcacggctggagcggctgccggcgacggagagagaagatggctagggcacgggagctcgagcaaggggtttaaaacgaaagaggagagcctggggtttctatttataggcaaaggtggaggagattagctcggacccgagaggagagaatggcgccggatcgggaagaacagtggctctggtggtagaagatgacactgttgtgacagggaggaagtagagtttttgcttggcggaaaagaaaagaagagagggactagaattagacttttctgggaaagaaggagacaggaaacagagacaggcaaagaggaaggatgggctgaggatgagtagacttttccagtttcagcccgaaaaggaaaaggggaatttcaattacttttccaattaaattaatcactgaaatgatctttgaattgttaaaaatatttccaatgctcaaataatttcaagaaaaatcctgaaagtacttgaacactataagtatttaacaaaattataatcagaccatttaatgattaatttaatatgtggataattactgaaatgttgtttgtattattaaaattaggagttgagcttcgaaaaatccaagaaaatttcagagagtatgattaaccatggagaatttaataaaaattaaatccagccatgctttatatttaggaaattttatttcccacatttaacttcacttgtaaattaatgaacatttaatataaattactaataataatttattaaataatttataaatcctgaaacgaaaatcaggttgtgacatctcttgacccaccaaaggagcaaaatcaaacattgtcgttttgggaaggacaagtgtggtaaaaggattggttgcatgtatggcagcaggaacagggggatccactag

SEQ ID NO: 50279 - DNA, 2010 bp, Oryza sativa
gaacaattttgcgcggtacataatcgttgtctttaaacttaggccttatcagaactctccatttcatctcatccctttcaagctaaaaggaaagctgaccaaaagtgattgtagctaggtttagatgatcccaatcaacaaagtcaaggggaaaatccaagaaaagaaaccagccctccctattgtactgcgaggctctccaatttgttccctgatcatgctttacgaaagaaaccgagtgcacaccatcatagataaatggctcactatggaccagagcatctctatgcatagcagagcgaagttgatacatacccaccgcagaagcatgacgaaagctatttctgacctcaaaaagatgctcatcaagaatgtgatgcaggataagcatatggtggtgatcccaatcttactccggcactggcggctccaccaaagcaaggcagaactcctcatggcgatgaacaggcctttcagggaatgtgagatcaactcttgggacacgcaaatttcctcccaaatgcacaatgtgaccttgatggaggaaacgaagggggttagggttaagattcgccattggcaagggaatcggggtccggggaggcttgaacagtagtatcaacagtagattggaggagatgagggggttgcgtgataaccggcactatctctttaggtctccaaataaaattgccattaccccgggagtttaggactgcagtagaattaatgcggggggaaaaaaagactttgacaatttaaccatggagacaggcctagagctgcatgacccatattcatgcaggtgcggcaccggaaaggcccaacacaggcagacaaagaatgccccttctctaagcaacgtccacaaattaaatttgaatttaaaacttgcttaggaaacggatcccgattacctcgctcattttgaaatttgagactagccgccggctggatcaccggagctttggtcaccagaatggtggtcgctggagaaaccacgccatgcaccttcaagggctcctttaatctatcaaaaacactcttcaaaggaatatcactgtgaacagcttgagcgtaagaacgacccggttgtcccagagaaccagagatacgtttcttaggagccaccgaaatccattctttttcttgatcacgggtccaagcatcaaattcccattgccaattaggtccaccatttctccaaaggaagaagcgtagaacaaaatcatcacaagagaaagacctcaaacgataaatccataaacccactggcttggagcagaccaagaaagaataagaacgatctttaagaagggtaacagagagatccacaggagaaccaccaatcacagccctgagggctagagcaacagaagacgttgtcaaacgaaaatttgaacggggaatatccaccgctaaccggaaaggaggcgagctgaacttagcagagaaataaaccggcgatcgaaaacgatgccaagcttcatccctaattgcatcaccgggagagaaattccaccctcccagcggtgccggagtcaccatggaggatcactggaaatcgcccatcagagcacctccgtgaaaaccggatcgactagcttactcgtagcctcaactgctggtttatatgatactcctatctgatagatcatctgaggcgtttcaattgggggagtgcagatgagtattggcatcctcgttaggcttgccacagaacgggctagcatgcgccatcgtgatgagcctagacttcaagtcgaaatccacgtcccctatgttgacctacggcccaatggccacattgtcagcagagggagcagcgaactcacggagagtcttgttagccatagtcttgaaggttggtggcgctggtacggctggtttctctgtcggtagagttttctgcggagcagcgacttgcggcctgacgctccggaagaaagcttctggattttctttgaagttttccggcaagttgataccagtcatgcactaccctatttt

SEQ ID NO: 50280 - DNA, 9524 bp, Oryza sativa
  unsure (1)..(9524): unsure at all n locations
ccaaccgtcattggggcttcatctcaaccgtccagccaagacctggatccaacggaggcgagggagtttcggccgaaccccctagttcggctgaacctggggccggcccaactagcccatgctttggctggcggcctcctctgttgttcttctccgcagacagtgaattttggcccagtttgtcatgtcaattctgagttcttggcccattcatacataagtctggttctcgatatcgtccgattgatttatcgtctgagttgatgtcgattctcctccactttattgttattctctacaaaaggttagtagacctaatattagtgaaatattattattctaacatatttatgcattgcaagcatcactagttctcctctattttggtaatattaacggtcgaaactgatcgataatgaccgtcaacacctgccgttcttgtgagtagcgtcgtgattgttcgcgcacgtgagagagaacaacaaattagatcggtttgtttttttttggccactgtacgtttcacatcaaggcacatagaagagtccatctccaccttgaccagccactacacaagcccacctctctcaaacttgaccgaggctgttaccaccctccacctcatcacgaccatactgacctctccacttccgggtagcgggtatcgagtccgtagttttctctatatcatataattgttaagtagcggatttgagatatttttataaaaacgaaacctacgcgatgtgagcatttcatttttgagatgatctaattttagttttgcactttgcatttaagtccctgtaatattcatatttacatttgagtccctgctcgaggtcggtggttagttcttgttggaaaaaatagtaaaataatataaaaaagaaaaggcagaaaggtgcaaagaaaaagaaagaaaaagccacaccaaaaaaaagaagaaaaggcagaaaggtgcttaaaaaaggccgcaccaagaaagaaaaagataaaatattcatcctttgagtatgttttcagagtgtagagttgtgcaatgattcatatctagctcttagtgttgtcgggtgcctacttgagctagagttgagcctaggctaggccagcacattgactagtactttgaactattattcaactttgcattttctgattagcacaattgcgttcctttgctactatatattatgcctcccaagctccacatatatacttctggtcagcaccactttgatccttgcaatcgccacatcacgtccttgaaggtgtcacgaactagccaccggttgtaccgtccttagcattgctgataagacacttgtaagagcttgataaagtgctccattttcctgagttgttgagagacaccactacaccgtgtagctgattattagtgataaccttcactgtttgttgctgtttttgtgtttgcaatgacaggtatgggtggcgctcaaaatcagcgataccaacaaggtaacaataatcgcgtgcccgatgatccttgtgctaaggttatgtttaaaataccatctttttcgggttattatgatgctgagaaatattttgattgggagatgatagtagagcaaaaatttagtacccaccttgtgcctgagcaacatcgagttcgacaagctacttgtgagtttaaagattatgcttatatttggttggctgggttagttgcagagggagctttacctactagttgggaagaactgaatgtatctatgcgcaatagatttgttccaccatcttatcttagagaattaagcaagaaactgatgcatttagaacaagggataaaactgtacaggttactatggtgaactacaaaatggattgatgcgatgtagcatagtggagggaactgaggattctatttgtcgtttttactcgggattgaggcgcgaaatttaggacatagttgataataaggaatttaacactatcaaccagttatttcagtttgctatgcatgcagagaaggaattgtaggggcgtgatcaacaggttaagaacaaggcgagcacgtacacgccgcaggcgaagccatcatcaaggttgcccaagcctatctatttctgggcgtctccaccaaagagcaagcgaccggttacatctggagtttgtacagtgccgaaaccaccttccccacgacccgcagattcaggtaaaggttcttcgcacgtatccaccaagagtgccttgtctgtcgcttcgacgggatgcacgcataggattcagtgccaccgctaccatggatttggccatgtccagaaggtttgccctagtcaactggtatacgttgctacggatgatgactacatcagcacttccgatgttgaagatgatgaggaggaagagaagaaagacaaagagcaaaaagacctatctatagctccatgcatgcttgaggaatgtttaattgaccaagcgcctgtaatttctgaagatgagaaaaaaggtaatgataatggtgctacaactactcaaggtatgcatatttatgatgtgccaactatgtccactacttatgctacattatagcaacccgtagtggaaacaattgctgaaatacctttgtcacaaaacaatttgcttgatgtttcttgtgataaagaagagttgtgcgatgcttcacttatatccttgccacaactagtgaatgaacatgttagttccatagtagagctaccatgtgttgagtttaaacatgttattcacattgctagcgagaattatgagcttaaattgctatcttctttaaatacttggggttacattcaatttgatgatgtttgtccactcaactatttagagaagaaattatttgctagatttttattgccatgaccttcagatgtgattttttatgttattggcaattatggtagtaaaggagaatataatgtgcattgagtatatatttgtttgaatttgaccatacctccttttcatgatgaaatgaattgtctaggggactgcatgtgtagaagtaattctctatctagttgctttagttgtttaaatgagttacaggttggtttgcaagaaggggagtgttgtgattttgaccatcaaaaattttcctcaccagatgttgagatagataaagataagttcaatacactccatgacaagatgaaacgaggacggtttccaatcaagaaggggaggataatgaggacacaactagctcggatataaccatgactatcttatatattaatcaaccaaaggtgcatatgttctatatgagattcactcgtcatatattcgaacaaacgttgctacacaatgatcaaagcggtgctgaccagaagtatatttgtggagctcgggaggcacaatatatagcagcaaagagacacaattgtgctaatcagaaaatgcaaagttgaataatagttcaaagtactagtcaatgtgttggcctagcctagactcaattctagctcaagcaagcacccgacaacactaaggactagatattaataattgcacaactctgcactctcaaaacatattcaaaggatgaatgattttttttctttctcggtgtggcttttatttaaacacctttctgccttgtttttttcttttttaggtgcggctttttctttcttttttctttgcacctttcttccttttctttctttctttagtttttttttacttttttttcaacaagagctgaccactaacctcgaacagggactcatatgtaaatataaatattgcagggactcaaacacaaagtgcaaaactaaaattggataacctcaaaaatgtattgctcatatcatgtaggtttcgtttttacaaaaatatctcaaatccgcataaatatttgatatatggatgactacgaactcatacccaggttcggaggtggaaggtgggagtcgctcggttttctttctcacagcacacgcgcacatacgccacacatgaaaacctaacaaccaggcaactccaaaaccgctcgattaaaacttctccaaaccacaaaaacggaaacctgacaatgattagattcgatttttcaaggtcccggcaacaaccgacaatttacaaaattggacacaaaattgacgtacaactcacaccttgataaaccctagacccaaagtgttgaacagatgcattactcaaaactaaaaattaaatctaaaactaaaccatcactcgatacgacgatgcaatctagaattcaacaatgcaaaatctaatagaacaatgcaacaactaaaattgtctaggtaaagaataaatatttttgtgttgcaattttctggttatgggaagacaaattacctaataggcaaccgcgctctgataccaactgatgagaaagttaggtcccgatcttctgataagtattgataaacaatcaatttgggtggattcgctggacaactcgatccggcttctaaacgaacacgctactgagccccgcaatcgcagcaccacgtctcctctggttatcaaccatgccgaaacccggttgacctcaccgagaaggctaatccctgcatgcgaatcgaagaacacaagcaagaacaagatagattgcaacacaattgcatatgaatgattaagcactcgaatttggggttctacaaaccgatttagcagcaaaactgttcttaacagaataatctaagcaaaacccgactctaaacgatgacggctactgattaagtatgattagggatgtcctagggttaccctaagcctataagctttccaaatccatcttaaagtagactccataagctttccaacaagtactcatgggccccgaaattctttctagatcagcggctaggttcgtttgaagttgatgctatcaggaggcccaaatccgaattcaaaacgtgtagaactttatgtcttgtcttctatggaccaaaagtgacgtggtgagatggaagtgaacttggagaaggttttggtttggtccccaatcaacttctttaattatccatgaattccttacgctcgcctcttttctttcacccaagcaagtacctctgcaaacgaaaacacacaaaactcattgtgtagcaacgtttgttcaaatatataactagtaaatctaatatggaacatatgcacctttggttgattaatatataaggtagtaatggttatatccgagctagttgtgtcctcgtcaggaagattccaaaagcatattgtgatgccgaaagaatattcggaaccggtggggttctgattgaaggctagacaaacaacatgactgaaatatgtaaatcaaactagtgaaatagctttataatattatatagatatagaataccaaaagcctgatggctttgtcatcaatcaccaaaaagggggagatagaaagttcaagtgctaataatttggttttgatgatgactgataaattcaattatgtgagactaatttggatatgaaagtgctaggcaaagccctggcagttttcaaggtcaaaaaaatgtggatatgaaagtggagtgtgtgagagctgattcctagacttcatatgagttgagttgagatagaaacgttcattggtgatgcacctaaattacaaggatgaaatacatggagataaagctatatctatcactctctctccatgtacatattgatatgttcatatataatatttcgatgtgaataacattatacacatgagactaatgttttgtttgagcattttttgcttgtttagtctctttacattgagaacatgaagatgatgaaggtatacatttcttttaatgcgtatgtttgataaatgcattctattcttgtataggataagctcctaatgtttcattctttttaggaaaaagtacgaattacccccctcaacaattacggttgttcgatttttaaccctgaactccaataccagttatttttaaccctgaacattacaaaccggacgaattactcccctagatcgatccagggtggtttcggtcctacgtggacacacacgtggcagtccggtcagccaaaacaaaagaaacatatatgggacccacttgtcagccacaacaaataaagatggtggggcccactgtcagcccgagcctccacttctccccttcctctttgccccttcccttcgatctctacatctctagcgcatcaaggcaggtagcggagctcgccgttgatctcgccgcctccatggcgagctcgcagcggcggccaaccagcgcacatgctcgccacggaggaggaacacgagcatgcccagaatggaggcagagacgagagaggcgtcactgcgcacgcgctcatcgacggaggacatcgccgtgctggagacaggggtgggggagaagcgcggggccgaggacagagacggagcgagctcgggtgaccgacagtggcttccctatccccaacctcctcgccgttgaccgtggcgccacttgacctccaggtggtcggcggtagctcgggtggccggcggtggaggtggaggcagagcaagcctgggggcaggaggctgcggcggggcacgcaacgattagttgtggatggcgacgtgctagggcggatgcggcgagcgcagcgggcgggcgagaggctgcagcggggcgcgcagcgacgagcggtggacgacggcgcgcgggggtgggtgaggcgcgcgcctcatcctcggcctccgccacgaggaggctcacgagctcgccgaaggtcgtgatgttgacttgggcgtagggcctcatggcagcgacgcctgcacctgactgtcgtaggcgcggcgtgcgccactgccgttcatagcgccgacagggagagtcacggagggacctcaagacggcggcaggcagaactgcctcgcctcctctgccgtggcgctcacctccgccgccgcctcgcctcctccactaccagttaggatccgccgcctcatccttcctcagctctcccgacggcaccagacgagagagagagaacgaggaggagagagaacctcgccgccgcctcgcctcctccacgccgcgcgctgcccgccgtgccacatctcccgccggcccccgcacgccgaccgcccgtccacgcgccgccgatgccgcccactgctcgttcacgcacacccgagagagagaggagaggagagagggaagagtggtaatggcaggtgggcccaatattttattttatttcattttgttgattagatttccacgtcggcgccacgtgtatgccacataggagaaaaaccgctcaggattgagtcaggtggtaattcatccggtatcaatagttcgaggtgtaatatgtttggttttgtggttcaagggggtaattcatactgtcgcaataattcaggggggtaattcgtactttttccttctttttatgcatactattgcttcacacaaatattttgtatgcatacatttaggggaagcaaatcctataccttagttatgcatgtatttgatccaagttattcacttttatttaattcggatctttacagttgagcatatatttgagtatatgacacttatggtgttgattaatactcatgatttattcctatccttttatatgcgcgatcggtaaatcaacatgtagaggttgacaaccggatcattgagactaataatttcattgagttcaatgagaaaaataggtcccaaggattgaaaagatgttgatgctcaagtgatatgattacacctaaaataccaagaataacacagtagagatattgaagatgttggatatgaggtggctactatggcaagacggtgaaggggtcgcgatacaccatgcggcggtgaagggcaagcaaggggcatagcaccgaagaaccaaatccggtggtaaaggggaagtgacggtgttatcatgatggaccgtgcgagaccatttgaagctacaagtaaccgcataaatcatttgaagaatatatggtgaaacggttttggcgttgcggtcccttaagacaaaggaaggaagatggaaagaaggtattcctattagtataattctcttcctatttaaatttgagtacaggaatgtcgtactatcaagagtgatgcaacgtcgatgtgtttgtgtatgtgtcggtgctcaaagtgatctgtcatagtgctaccttgagagaaacccaagatttaacaaatcctttgagtgtttttagacgttttttggttgagttgggtagtcctctgagtcggctttccatagagtccaagattatcaaaaacagactcccaagcgaaatgttatggtcgtattactatgtgcttttcggaaattctgaaaaaactccgaaagtccgaaaaatatttcggaaagcccaaaattttttggaaattccaaaaatgactgcgaaattcatatagacttctgttaattttcgggcttgtccgaacaggcctttcggaaattccgaaagtcatagtcttgtccttcaatggctagttctgagaggctcgtgtatataaactcctccacccctgttgacggtcgttatcgaccaattttgaccatcaatattactcaattaatgaagactagctatgcctgcaatgcataatttccaaataaaatatctacctccactatatactatgctactaacatgtatataggagaagcacatataaatgcaggagaatcaatagaaaataaaagatcaatcaatcaaacattgtcgagatctagacttatggatgaatgggccaagaacacaagattgacacattcctctaggccatttggataagggaggagttaaggggggcacctgccgaaaatggaccagaatggcccaactcatggttcggccaaaccccccatctgcgccgttgattcttggttttggcgtggacgctccagatgatgtcctgatggcggttacggggcacaaaggacatgtcgcacacttataaccgtcataactgccctatataaggacttcactccctccacttcaacacacactcaagaagaagagctctctccctctctcaagtttagtagtatcttagtgctagtggagtaggaattagaatagtattctgaatcctcgggtcttcaggagaagtcgggtatggctctagtagctttccactcttcttttgtaagacttattgaattaacagaatattcttttttatacatttatggtattttattccatttatattatctaagtaccaactttcatttatacttatatcaatatagttctgtagctagcctaccagataggtgcaatggtgtgggtttagtgtccgattactcggttgctctatgtcatctcgggggatatagagtagtatttaataatatagacgtggtgtctagattattaagtatcattatctgggcatatatgctgcgggacagtagaggtgagccactgatagtgacaactcagtacgggtattcctccacgttagtataaattcataagacaaattcctggggagggtactactccatattanaccccgttggaaggccatgacagg

SEQ ID NO: 50281 - DNA, 1831 bp, Oryza sativa
ggaagagtgaaatcgaggagagcatttgcgcaacctcgtaaggaaaaggttgaaatagacccacctttgtggcccccccaacggagacgtaggatccgcagatccgaacttcggaaaataaatcaacgtgtctgttctcttggttgctcattcttgccattctcatattgtgcttgagcttgtttttacccaatctacttgtatgcttaattaatatagttggtgaccttatatcttgcttagataccttgtttgtcaccttttgattcatatacattttgtttgttcgagctacaaattcatagatagtgttttattctattaccactgaacttttcggttgagaccggaacttccaatcccataccggaaattccgatttgaaccgaaagttatcatcattataatatgctaatgaagttgtgataacttttaggaatacctattcactccccttctaagcaacatcaaggtcctttcaaacctgaatgacattcgatagtaagcatacattccattggatacgtgaacgttgtcatgctttgatcgtaggaatatatgggaattatatgataaccagaatacccatcaagaaaacaaaagaaggaatgatttgtctgccgctctaacatctcatcaatgtagggcagcagaaaatggtccttttttatagccttgttgagttttctataatcaatgcacatcctccatctaatgacagctcattccgggattaactcgttcttcaagttttcaactactgtcatgcctcccttcttaggcacaacctgaactgggttaacccattcgctatacgacataggatagacctctttttcacaacttctctcatcgtattgtttagcctctgttgtggctcccaagagagtgcgcaagaagggtctagggggatatgatgtgtgtagagagccggactaatccctttgagaacttgaagaaagtagcctagaatagagcaatgctttgctagcatggctatgagtcgggaggtcagatcatcactcagtttgtcacttatgtcgacgggcgactctgagtcaccatgtagaaaagcatgacgaaggcctgaaggaagaggtttgagcacaactatagaggtcgtgaatacggatcggttttgggtaactcaatcacctctccaagatcgtcctctttctcaacaaatgcagtggaaatcatcttcgaggagggattcaggggactcaaaaggagagacagccaacacttccacaattgtctcgaatttgggaatggggttccatcaaagagtttttttatcgtgagatctggacaaaaaacaccattttcccaagcttgatgtcgagaactccggttcttgcacattgaagaagaacttttctatgggatggccgacgtggagtttgaactcatagacttcgaacttgtggaaattaagaattttgttgtgctgaattggcactctggggataaccccgtacccttcgatgataggactagattaatcctgaaaggttttgtccgttggtgtcgtaggctctccggacctctcattatatttgagggatgaagtgaataattcaagccatcaaacaaacataatgaaacatccgacgcctcgagagaaggatattagagacattgatgggcctttagcctgccagtcaacttcagcctgagatgtgcccgtcaaaccacacgaaggcggcgaccagatgtatcacacattcaggagacttgacaaaatggctaaagatctacgatatctcaaatatccttaactcatactcatgtgaatctagttccaggatgtgtactagattcacacttt

SEQ ID NO: 50282 - DNA, 8314 bp, Oryza sativa
tttttgccttttatatgaatcagattttttttcccgtcggatctacagtttttttggccactcaggggaaaaaacttttgttgttgttgtttttctttattttctttttttacggtttttctttttatgcacctttctgtctttgttctctttctcttttatttttttttaacaaaaacgacctcaagtaccttgttgcaagattatagggactcaaatataaatataaaaattacagggactcaaatataaaagtacaaaccaaaaaattaaaatcatataaaaatggaatgttgtcgacctgtagattccgtttttgcaaacagatctttaatccggcacatcaatttttttcaaagtcaaattttttttccgtttctaagaccgaatctgatataggagtcaggacctttttttttgctatttcggatataggagtcggacattttaattttttttcattatttttttatggacgaaggaagcacctcttattttttaagtactagagatgtgatcttgggagttgaattttattgaatcttgtacatgaactttgtttaaaacataattagcaagtgccaacctagtttgctatataatttaatttagaattttggaattaataaatatcgagttatacttaatgttagagtcacaaatataccttttcatgatttacttaaatagcaagagctactgctattgacttttcaaaatgtgagtttataatttgttgctacctggataaatttgaaatttgaaattcgtaaatagaaatttttaatggttgaaagagtgcaatctatttgaataatgatacaaataatatacccactgatctttttaatggttgtggacgttactattatgacacgtcctagtgaaccgacatcaattaattttaccttttcactctaaccttctcatctttgcaattgttgagagtcaaaataattgcagctaatacatgcataaattaattgagtttaaatagatacactcggaactccttttatctgacgacttgtttttgtttcttcaacgtctgttacataagatgctaaagccaatgatatccgcggaagggagaaggtggtgtcaatatgaattatttaacacgtggtcctctttcaataagaattttgtgggggaaaggatttcagcatagttatctcatggaaaattgaaatttccttgttctcagaaatttaggaatttttgggaatgatatctttttgaaagttgaacaaagattgatttaactcataaaaaaatttaacttggaagtttaaattttgaaacgcatcttgatttagtgcttgctatattagggtggttggtgactctactatcactgcaaagccttggaggtgactagagatcggtcggccgatcgaaatcttcaaaactcgagcgctgacgtcacgctgatatcagcgcccgacttacgtgcaaaactactttaaaatgattttttcttaaattacttatccaaatcatgatccgattgcaccattaaattcgttgtaattaaatcttcaaaataagaccatacatagatatattctgatgaaatttttttagcttattattgaattttttttaaatgttgcacgatgttccatcagatatatcggaattgtttcactaagtagatcgaaaatgtttcactcgtttaaatcgggtattatttcaccttatataaaaacaatgtttcagcaaatagcgaaagaatatttcagttcactacgacatttgatctatacacactaaaacattataagaatagtaggtgaaacattttttcggtggaacaaaaaataaaacaaattcccttaataggggtttctaaaatatgtgggttttttttgttgcaatggagtatttcagttcactgcaacattagatctatacatagtgaaacatagtgagtacactaggtaaaacattttttgtagaaaaaaataaaataaattctcttaacagggggttttcaaaaaatatgagttttttttttcaatgacgggtggtagcatagaacgctggtggggccagagcatgcatgcacgggggaggggcgtggggggagcgcacgatccggctcccccgcgtcgggcgaccggatcacatcattatcgcaaagctttaggcgctgcgatcgtggttgtcaacttgtcataaaaagttaccaacagcttgtaatggttgcttattagcagaaattaacaaaggattaaaactttgcaacacaacataaatagtaagcgacatagtacgcgtactatttgtttgaagatactaaatgatagaacaaaattgtgtggcatatagattagtccggcaatatatagattacattatgttccaattgatgctatgggcagtcaactttcttgcgatggtgcagatcattgcaatgccggcggcggcggctgcaccaagtggatagtcagcggcgtgctcgcgtcttctaaactgcttgtagatggtgacacaaccgatcaatctggcgatcaagtcagtcaagtaactgctcgatagatggtgatggatttcttgatgttcgtgcaggatctggagaacggcggccaaatcgtggtgttggcgtacttcatctcaaggtatcgatggcttcttcgtgtacacaggcgggttttccctcgtcgtcagggagctcggcagttgtgatctcgcgtgacgtgtgctgagtcctgaccagatacatgatatccacgtaggccaactggtgcaccacaactgtatggattagatgaaggcctgtacaaagattggtaggctttaaaacgcaagattagatgggcacattaaaattaaaagccacatgttgtcatgatattatgttgtatcaaatcaatgatcagatatttctggatatccacataggccaaccaccgagatatccgtactttcatatgtggtaactgcatggattagatgaagaatcgaagacccgtacaaagattggtgggctttaaaatacaagattagatgggcattagaattaaaagccacatgttgtattaatatgttgtcatgatattatgttgcatcaaatcaacgatcagaaatttttggttaacgggagagctcataaaaaatgcctgattagtatgtgtataaatgtatagatatatagatagatgtatagatatatatagatgtatagatgtatagacagataatgataatgtaaacaagtattatttggttcatacgacattatctttactactttaaaaagtacatttttttcaccaccgcagttgttctccttttcccttccaaccgtatgaggtccacagatccagtaatttatttttagtcctcccacccaattgaagataatttgaacttaaattggagatattttggtctgtatacgttgcttgatcagtaaggtttggtaatccgagctgacccaaatcaggagctgcaaatttaaattccccggttcatcgccggccgccgggacaagatgtgatcaagcaataattatgatccgcacggagaaggataataagttaatcacacaatcagggggatcatgcatcatggcaacaacagctaacccgctaatatataggtgcgaaatgtttgcttgataattagtggcaccccaccgtgtaaattaactttctctctgtttttcttcctttccatggcaggaagtcatatgactagcggttaacatcgagaacctaccttttgggtagccactcattgcctgttccacctccaccgtgcatccgtgatttcatacgtttgaaaagatcaaaagggatgcacctcacctcctccaaaagatcaggcagcaggaaaaagcaacgctcgagtagtctcaccggcaatggcatcgccttacgcatcatgccattcgttatgcccgactgcccataatttcatacatcgggaaaatggcaatgctggcctttcttttgtatgcgcgcgtgtaattttgaaacagacagcaacatgttagagtaggggtcaaatatagcagtcctattaagagctggacttataattgaaataggtataggataaagttagagtcggacactatcttatactctctcttaaatatagagtgggacaacacgatataatcattatgactacaatatagcgtatacaagtagggatacgatggcgactaggccatgtactcatagcggctagatgctatgttgattggggaggagcgcctataatcaaaagcccgaagatatattcttgtgctaaacttcattaacaaatgtcatgtgttcgtatgttgtcatctaacatatcttggtaatcaattactaaagtgatcgagaagactacttgtcgttccgttatatcaaacaacttttataacaagtgatatatactaaagctatacgtgtcatgcaattgtgtatgtttagggaacacacttactatttattataggcacacataatgtactccttgtcttggtaggaccaaaaggtgtcgtagatgtagttgaccaatccttaatggttattctcgagatttgtgacagtgaccacttgtggatcaaagaaggcaagttccggtgcattctcctgacaccactgccaacttaacctatacgcaagaaaaacgatcttataagcgggttaaatggattgttattactaaattgagttgagcgacaatacttacaaggagtagcacttaagtaggtttgtgtccaccgctcggagcctgtcgaggtcgaatagatccttaaagttgaccacgatataatttgttggaccaaggaatggctttcgatcgtggtctccaaggatattgctagctatattctgtctcctggcgttagatttctccatttagtatacgtgaaggtccttgcaagaggtgcccattgtggctagcacgtcgtctccaatcaatggcatacctagttggaactcttgtggagcgacgtacttcttctggacctccttccccttagtctcttcatgccccttgcccagatctagcttcttcggagccaaaaatgaggcctgcacctttcctcctcttcctctcccccttgaagtaggtttatcgagagtaattctctgaggagaagagtgcgcctttctgctcttcttcatcgattggggttgaggaatcgccatgctgtcggcctccatatggtcgtccccaaaatccatgtcatactgcaactccacatcataagatcttcttcatcgtcgtcttgattacgtcgccaccgattggtatcttcgccttcaccgctagcttattatgtcaccgctaatgggcatcttcatcttctgcctcatttgtcaccgactgattatttcgccaccatggctacacaactgtgtcgctatcgctgggcgccttcatcttcactaatgacagaccatattactgctgactggtttcttcgcctccacggctgtgcgacttcatcacctttgattggtgccactgtctttaccaccaccaatatctttgtcacctttgatgggcgatgtcatccccttgttagtcatctcgtttccatgccgactacataagctaccatcaatggacaactaaaactacaacagaagtacatgttacatgcttagggggctcatgaactcaagcgcgatgatcataccttcaatttggacttgttccagatgcatgcaacataaattcatgatcatgagtcaatttcttatgctcaacgagtgaactattcgttatttcccacgagggctatcatctgagtatttgtaagagtcaggatttaatttttacatctactgaggtacactctatgaggataaccactcggatcagaagccactaaaatgagatgcactcgatctacatcacccaggaattttatcacctgggagcatattaataggtgttctaggggtatcggtaggcatattttggccctaggcctaatatgtctgcagcccatattttcaagtgtggccaatcacgttcttttagggactaaggcattttttgcttaggcaaaagtgtgcatgatcaagtgcctaataccttaaaatccctttatatcgctgtcacttaactttttaggaggtggtaaaatgcattttaaaaggtgtcaaatagtgaagctttatatagttaccccactgacttgtttttatttatttaaggcgttgtttgggtttacaaagtaatcgattggatacaatatcgttgctttttgccacataagtgtgcatttttattgacaaatattatgggcttagactgattatatattttggtcattttccaggcggttggtaaatcctttatgagtttatttagtcggattttacaccacatatgccatatatttccaggtgtgatgaaaccatgtgtcttttagggactcaagcacatttgttaaagcagtgtgcgcatagtgtatgcccaatactttgaaaatttctttattcacagcatacaagcttcttgattgttgttttgctctgtgaattttccatgatgtatacaactttaggttgctcacatcatattttgcaaagcagtcggtatatcactcggatcatgttgatcggggattcacaccgcatatactatatattaatattaagtcacttggttggctacaattatcgaaatcactcggttgtttggtgttgacggtccttaaatcataatatctgaccatcaatacctgcatataacgaaataaaacatggtatccaacgtagtggtaggtattattactaatcatttccactagtgttggtgaaatatgtgtatgcgagtattttgagaagaaaacacatccgtcaagcgacaaactgcacctccgcgcattcaggacacatttacacggattggaggccccataagtcaattaaacaactccaaatgggcccaactatcatgccaatgggctgagggcctcaaaattagtgtccacaacgaaaaatgggccgaatggagccgtcccgggttcggccgaacctccagtttggccgaacgattttggtagccgttgatcgccaaatttcacgtggacggtcctgatcacatcctaatggcggttctggggtagtttggtcatttcgcataggttgtaaccgtcatacctgcctataaaagaagcagctcactctcatttccaacacacaactttgacctgaattacaagaggctttattgtatcttttgtacattagaataaggtagagagtaaggggaagttctggaggagtgcccggaagtttggcgctcatccgacttctacctcaaggagtgtagcttcctaggaggaattctggaggagtaccggagccgtcggtacactctgcttcgggttcggagaacttcttctataaagtaagcattcgtgtttctttcttatgttatttaattactttgtctaagtaagatagatatccatctttgcgggttcattgtttagtatttatactaagtgctctagtactaggactccagatagagaaggaagctcttgcgcaagtattagagtagtaattaataacttagacgtggtgtctagtttagagattacctttgttagttgtgtatcccacggatttgttagaggtagttggcaggtggtgatagccctgaatcccgtcctagtaatcctccacgttcggatacatcatagagctatagccggaaccacgctggcagacaagcaggggtcggtgcctgaagcaacagatagggaattacctttacttagcttaaataattaaaaatacatagagagtcctctctagcctgcctaccatcagttgctgtccttggatagtctcagccttaggtagattacacacattccctgagttcgatatctttttggggtcacctgaaggtgaagtgctacaacggtattccgtgcgcttgcggatttatctgtggtcgtaagaaataccaacaagcatttttggcgctgttgccggggaacggttgctaatttatccgagtctaggtcatcctcatatctttatttttacttcttcttgttttattcctttccttgatggagcaacccacaattcaaaacatttctgctcctcgggctaatctttgtgagtcatcctattcttcaaaaccaatcctttcaaatggctatgaaatcggtcctggctttatagccatggtttgagagcaaaccttctctggtggtattagtgaaaacccatacctccatcttcaggactttgagctagtgtgttcttgcctatccatcataggcatgacacatgaaactcttaagtggaaattgtttcctttttctctt

SEQ ID NO: 50283 - DNA, 11528 bp, Oryza sativa
cacaagacggaatgtatgcataccaaagaatgtcgtttgggttgtgcaatgcacccgcgtcatttcaaagacgcatgatgtctattttctctaacatgatcaaggatatcgtggaagtcttcatggatgttccacgaaattatcttcccttgttttggaactccgcggatggtgataagtgacggagggtctcatttcatcgataagaccttccgaaactttttacaagaacttggggctcagcataacattgccactccgtatcatccccagacaagtggacaagcagaaacaagcaacaaacaaatcaagaatattctacagaaaactgtcgatgagatggggaagtcatggaagaacaagctacctgatgcactttgggcatataggactgcttataagacgcccatcggcatgtcaccataccaacttgtctacaggaagacttgtcaccttccggtagagttagaacacatggcacactgggctatccagacttggaacatggatctaaaggaagccagacagcacaggaagatgcagctctttgagctagaggaatggagggacaaggcctaccacaatgccaagatttataaggacagaaccaaaaaatggcatgagaagcggattaagcccaaggagttcaaagcaggggacaaggtcttgcagttcaactcacgagtaaagcttttcggacatggaaaacttcgaagtaaatggatgggtccatgtaccgtcatcgacgcttcatcacatggagccgttacactgtgcaacaacgaaggtaacatctttaaggtaaatggccatcgtttaaaagttttccttgatccgttagaagttgatcgtgacttagatgttgtgaatctagtctcttttagcttctacccggagtctttaggtcccccttgatccgttagttttcaatgccatgagtccttaggcctccctctagttatcttaggtctagctttcatggataaaataaaataaaataaaataaagttggctccttggtcttccaaccaagtgagtccttttttgcgtcactctggtctttgtttttgttttttgtgtccaataaagcttcccagatacaaagacaagtgtggggtggtcttgcaagatcaccccagaagtgatgagccatgacaaactatacaaggaaaattgatgcagtcagacccaatgaggggtcagccaaacctccagttcggctgaaccacctctaccatgaatcgtcctctgttttatacagagcgcaggtttgcacaatttttcctttggacatccattctatcttgagcttaatttcattatcaattctaaaatatcgaacataattaaactcaagctagggatggtacaattagagttcatggtctacttgaaaataatatgcatgcctattattcttagctcattacttgttgctggtggtgatatatccaatagggaccccatgttatctaggtaattgatgaatgagatatagtctgatgatagaaatcctactcttcatgttgcacacttgggaattttataaaaagaaaaaaatatatataacgatgataaactcctcattgatatttctattcctactagagccataggttgatcagtcatgattagcttgctacatacgctgcttgtcattacattgagcattgtcaagttttgtgacccttgtgaaatgcgtttcatactttcatggtcaagatcacatgcattccacatacacgcacatatgcttgacttctacactggaagttagcatttctcatttaccgttcatttcatccatagttcacaaaataaatactccttgttatttatgcctcttcttccaaagttctttcaaaaaaaaaagagagatggcatggctatgcaaaaaagaaagaaaaaaaagtgctcatacaagtatggagcatgatgatgaaaaaaatagaaagaaagaaaaagaaaaaaagagatagccatgcactctccaaaatttcaaaagagaaaagaaatagaggaggaggtatacaaaaggagttatttttattttcctttttccactcacaaattcatcatacacatacacatgcacattcttgaccagaaagtatgtcttgcatttccgtggatcctttatttgactttgcaatatatgtgatacaagtaatgctctactcttttccataccctaagctctacataaaccttattagatggtaggaaaagaaaaggcacagtcatatgcctttgtaaggaatcatacactttgagtgatcaagagaatctattgaggagcaaagtaaagttataattttatgttacttgaaaaaacccaagttgttcttcatgaaaagttagggtgacttgagtcaagatgattccatttctcgattgtccaagattgcatggtcgacactacaaagatccacaagtacaaattgactccccgcaaaaaaaatgatccacaagtacaggtatgactttgaataatttgtttgcatgattattagtaaggaagtcataactttgttgtagagtccatagccttcactcgggacgagcaaatgttaagtgtggggatgttgttgacggtccttaaatcataatatctgactgtcaatacctacatataatgaaataaaacatggtatccaacgtagtggtaggtattattactaatcatttccactagtattggtgaaatatgtgtatgcgagtattttgagaagaaaacacatccgtcaagcgacaaactgcaccaccgtgcatttaggacacatttacacggattggaggccccataagtcaattaaataactccaaataggcacaactatcatgccaatgggctgagggcctcaaaattagtgtccatgatgaaaaacgggccgaacggagccgtcccgggttcggccgaacctccagttcggccgaaccattttggtggccgttgatcgccaaatttcacgtggacggtcctgatcacatcttaatggtggttctggggtagtttggtcatttcgcataggctgtaaccgtcatacctgcctataaaaggagcagctcactctcatttccaacacacaactttgagctgaattacaagaggctctattgtatcttttgtacattagaataaggtagagagtgaggggaagctctggaggagtgcccggaagcttggcgctcatccgacttctacctcaacgagtttagcttcctaggaggaattctagaggagtaccggagctgtcggtatactctgcttcgggttcggagaacttcttttataaagtaagcattcgtgtttctttcttctgttatttaattactttgtctaagtaagatagatttctatctttgcaggtttattgtttagtatttatactaagtgctctagtaccaggactccggataaagaaggaagttcctgtgcaagtattagagtagtaattaataacttagacgtggtgtctaggttagagattacctttgtttgttgtgtatcgcatggatttgtcagaggtaggtggcatgtggtgacagccttgaatcccttcctagtaatcctccacgttcggatacatcatagagctatagccggaaccacgctggcagaccagcaggggtcggtgctagaagcaatagataggaaattacctttacttagcaaaggtaattaaaaacacatagagagtcttctctagcctgcctaccatcagttgttgtccttggatagtctcagccttaggtagattacacacgttccctaagttcgatatccttttggggtcacccgaatgtgaagtgctacagcggtattccgtgcgcttgcagatttatctgtggtcgtaagaaatatctacatttggtttatttactccttgactatatgtttagtttgttcaactaaccacatagttaggggctacacctattaggtgcatttagtcgatgcacctaagtttacatttaattatttttcagccctctacactcttcagatctggtaaaagtactcgggagaccatagcgaagatgattgaaacacttagctttggagtaatctagttcgagagaagattatctttttgactgtgaaggtctcaggggctactgtgtatattgtgggtaactcctacccacacggcaaggttatctgactaattataagggatagcttagatctatggaatatgtaacggatcataacttgaatattacgtttccttgtatattacggaacggcctaaagtcctggtttgataatagatttaggaaacccttaccgtatttgttaaggtttttgtcgtgtaatcctatccccccaccccggtgctatataaggcaggcaggaggccctctacggcatgatttcacaaccagatcgtcagatcaatactacaccaggtggattcaaatccccaaacaggagtagggtattacctctcattgagagggccagaacctgtctaaatctgttgtctctgcattcatccagttttaggtctcatgcgctaccccctttatattgctgaaatcttgtttcgacactaaagatactgcaattctgagtccgtgaagtagtgcttcatactcagccacattatgggaagctaaaaaatgaatctacaaaacatagctaagtcgttctccagtcggggaaatcaatacaaccccagcacctgtgcctaatattctcttcgacccatcaaaatgcatagtctagtactccaattttcgaaggcgtgtcttactagcacttggtccactcggcaacaaaatctggcaaggcttgaggcttgattgaagtgggtggcttgaatgatatgtccaaagacatcaactccaaagcgcactttgcaatacgactagtcgcctcacgattgtgaagatatctccgagtggaaaagatgtgaacaccatgactaagtgactttgaaagtaaagggccaacttcctaatggtattagaacaccatataacaacttttgtacctgaggatatcttgtcttggaatcggccaaaacttcactaacgaagtagattggtcgttaaactttttgaacatggccctcttcctctcgctcaatgacaagcaccgaactcactacctaagatgttgccgacacgtattgaacgcgctgatgaagcctgaaggggggaggggtgaataggctgtccctgaaaacttaaaaacaaatcgcagcggtaaaattcaaatagacccggaacttcctggtaaggaactccagaacttccggcctaccaggcccggaacttccggtgttcttaggacaggaactttcgggttacagaaggaagatgaaattcaaattttgaaactggagactaagttaatcttcacaagatggtgaacatgtattctaagcagaggatagatcacagaatcatccacagaaacatcatagaaagagacaagagcgatttttttcccgaagttcggatcttgcgatcctactctcctttgaggagctccaaagagctgggtctcgattaaccccttgcctcacttgtgcaaaaaccccagagaaaatccacagccttcaaccccaaatacccctaggcaaatttctagaattgaatgaccaccaagatataactcaacctatttctagaaatccgccacaagtgtgggttgctctagttggaaagcctctagaatctcagcacaagaacttaattaacttacctcgttccctttcggaggagaggagatccttcacaaacttatccgggacatcgacaatatgcaatggattctcacgggcgacacctaactgtcacgcccagaaattcccgagtaggattccaagcagaatgtgcattaaaacccccgtccaggaccggccagggtacacaaacgacaaagttgacatatagatccacgtcttacaaacatcataaagtcttacataaatgcagcggaaaattaaaagataactggagctaagccttgacttggaccgcagcgggatcaccactccacaggcatcctcgacggcacggctaagcctactcctcggagaagccaccatctgacgcatactcaaactctggggtttggggaaaatagagcaagactgagtactacccactgtactcagcaagtcataccggaataggggtatgatgcagggaattatcaagggatagctacagaggttcgtttgcataaagcgagcatttataaacagtagttggaagcagtaaaacaattgtaacaattaatcaatattaatcttccactgtccaacgctacaccatgttgcaacaggcccaaccatccacctagactactcaaattcaatagactagactagggtgaaactaatcatggtgaatctggttgaccgcccataaccgcgggcacggctattcgaatagttttactctgatcagaggtgtacaactgtacccacaagacacagccccacgacacgcttccgtgcaacgacatgccaccacgacataccggatagaggccgtgacaggacccttcgcataaccccctctaaccaagcacaccacacctcaggtttcacccccactcctcgcaaggcagcggacagtcccctctcgtgcctaggtgaatccggaagccgcataggccgtcgcagggcctggatgcgtcagctagaggaaagctacactacaagcccagccgttgcccacgttggcttgtggtaagtacgaggaattcttccagggtttcccacaaaccggtccttaagtgccatgggcgcgactagcaaaaccatccacccacaacccaccatttaacatattttaatgaagcgacaccaggatggtggctctaatccaacatcaacactagaacctgaagtctatacattaatatgatttcccccattgtgtgctagttgaactaagcatggctaagcaatccctagtccaatatctagtcatgttatatcccaagctaacaaaggaacatggaacaaaatagcatggctataatagtaggtaaacatcccacggtaacagtataaaataatgtagtatttgaaagaaaacaatagagcatttgcaatataggatcaacatgttcaagtgacaagcatgacttgccttgctctgctgctggaggaacctcggcgactatttcaaagtacaccggagcgtcgggagagccggaatctaagcggcatacaaagcaaacaatataaactggctataagactactgaaacaaagaacaaaaccctttttaatggattctatgcatttttcttgatttactgagacttgaatgggcttaaagggagctcggatgaatcagatatgaattttagaagattcactgtgtttttactataacagaaaaaatccttaattgatttattgagcaataaataaatcccgggagagagaggggcggtgccgacatgcgggccccacatggcagtggctgcgagcgctggtccaggggaaaaggggcgacgcaccacgtggtgacatgtggcgccgacgtggcacgcacgtggcggcctcgtggcagccacgcgggcggcgggatcggatggccccgatctaccgcctggtagatcggacggcggatgcagctcgcggccggcgcgcacgggcacggctcaagccggcccggcggccatggcgcgcggcggcgaacggccggcggcggaggacggcggtgtcgtggcgacgcgggcggcgatagcgacggctaagcggctaggcggtggcgcggcggctaagcggcacgggagagagggagaaaggggaggaggggcctcaccgacgacgatcgacgatggcgagcgatggagggcgatggcgacggcgagacgagctccgggaccacctaagggatcaaaagggatgagttagagagggagagggaaaccatggatggctagggcggtgaccgaaggcgccggccatggcgaagctcaccggcgcacggcgcgtgcggggttccggcggcggattactacggaggaggggtggatgggacggcccgcacgacggcgaacgcgacgacgtcgacgacgcggctcggcacggcggctagcggcggcggcggcggcggcggcggcggagaggaggtcgatgacggtagggtggtggagtgcacgggagcgggcgattgcaaaacgaaaaagagagaggaaggaacgggggtgctttatatagacacacgagggttgatcgtggccgggagaccgcgatttcgccggaggagtggggagaggtggggaggagaaagaggcgggattcaaaaattgaatcctggccgtgtcgagcgctggcgcgggttggagagagggggagtgggcgcggggacgtgggcgcgagggcgacatgggcgacgtggcccggaagacgtggttgcagggcgcggcggtgccggctggaggtgggagacgggcccgacaggtgggccccacctgttggcgacccggggagagaggaggggggctcgggcggctggctggtccgtgtcctgcggccggcccagcagggaggggagagaagagagaatgggcctgtggcccattcgaaagagaaaaagggaaaaagaaaaagaaaaagaaggaaatgaatttttcccgggattaaatattgcttgtgctcaattttaattggttaaaattatttctggagctctaaaaattccactaaaaatcttgttagcgtatttcgacatgtagaactcaagaaaaaaaattccacatgccaattctgattattatttgcattgatttattagggtttactcttgcttttacaccggtattttcttgagaccatttataacttgaatttaggcttgggaaagaacttcagggtgtgacaaacctacccccccttaaacggaatctcgaccccgagattcggaagagctggtgaagaggtgcagatgggcggcctttaactcatcttccctttcccaggttgcttcttcttctgagtggtggctccactgaaccctgcagaacctagtgaccttgtttctagtccttctttcactagtctcaaggatacaaactggcttctccacataagttagatcttcttggatgtcaatatgctccgaatcggcttgttcttcgggtaccctcaagcacttctttaactgggacatatggaacatgtcatggatgccgatcatgttggatggaagttctagctgataggcgacttctcctcttcgttccaagattttgtatggtcccacgaagcgtggtgtcaacttgcctttcgtctggaaacggtgcactccccggagtggagtaacatggaggtacacataatcccctgcttcaaaagtcgtccttgtgcttggtcttgattacaacattgtccatgtaagcttccacgttgcagctaatatggcttgaaaaacatctctgaatcatgcattgataagttgccccatcgttcttcaaaccaaacggcatagtgatatagaaataagcaccaaatggtgtgataaatgaagtcttcaagcagtcagactctttcaggctatctggtgatatcccgagtagtaaaccaaaaagctgagtagctcgcagccggctattgaatcaactacctagtcaatgtgaggcagcccaaaaggatctttagggcatgacttgttgagatccgtgaaatcaacacacatacgccattttcctgttttcttcagaactagaactgggttggccaaccagtcgggatgaaagacttctttcatgaagcctgctgctaatagcttggtcaattcttccttgattgcatccttcatgtcctgtgcgaattggcggagtcgttgcttggtatgattaccgtattatttaacatttaaggagtgctcaatcacctttctaggaataccaagcatatcagatggtttccacgtaaagaaatctttattagcttgtagaaaggtgatgagtatgctttcatatttacaatcaatctctgtgcctattacagcagttttggtaggatcagatggatcaagggggattttcattgtctttgcatcgccttctccagtcttgggtagcttggtagcaggttcttcaccctcagctgatgttgatgcaactagtcggatctcctaaggagcgagtgctgtctcacaggtttgggccatctcacagctctccttatcgaaggtgatggcttgcttgttgtcgcttcgcagagatatgactccgcgttgtactggcatcttcatcatcatgtaggtgtagtgtgggacagccataaatttagctaacgccgggtgtccaagtatagcgtgataagccgtttcgaaatcagcaacttcaaaactgacgttctctgtacggaagttttcccgagtgctgaaggtaaccggcaaagtaatctggccaagaggtgtggatgacaaccccgggatgactccatgaaagggcgcaatactcggcttcaactcagttcttgggatttgcatctcgtctagagtcttggcgaagaggatgttcagtgcatcgccaccatcaatgagagaacgcttgagcttgattgtcggcccctagttttacaacacaggaaatcggatgcattttgttgaaaccaactccctggatcggtaggttggtacacacatcatacatcacatggtacaacagagtctgcacgattaagtcttacaatacttattgatacacgggttgcccaagtgggtcccgaataggccttatatggccgagtacaataccaaaaagtagagaaggggaaaaaggtgagcgtaagagaagctgcggcggtcctacgtctccacaagcatcgactggggatcactcctatggcgcctcctggggttcactgtcttctgggatgctctcaaacagttccgcagcgtcggtcaggtctaggagggttttcagaaagcaagagtgagtaccaaccgtactcagcaagccactaccacaacatgcatttagtgcactcaggaatacaaggaaggctaggttcatttgcataaagttaatttgcacaactcttttcacaaacctatgacttagcatttttaactaaaaacaacattaggttggagttatcattcaatctacgagggttcatcccctttccccaaagcctcgcttggtccggctttaccctcgcatgcagttttccctattcccatcattatcatgaccttcccgcccatcgggcaaggtcacaccactttccttatctaagcaagattaaaaactatgaggctagtcaagcatagtacaagtcccgatgctcattaaccgcaagcacgtctattcgaatagatttgatttactcacactgtagtggatgtatgcttttaatcctgcactccgcggcttgccaaacacataagtctagtcccaacacatgagacttgccacggcccagtttttcagtcatcctagcgtttcggcacccgctccaaggactattcacccccattgcacccccggcacaaaacaacacctcgagccggcggtgaggagagtcctggcgctcccg

SEQ ID NO: 50284 - DNA, 1783 bp, Oryza sativa
acatacttcagaaccaccatgacaggggtgccgccccacgaggatttcttagtccaccaggtctatacccactcgagaagtgcagtcatactcttattgtttcctgcccaacttcttgactcagtctttaattgaccagggacggcggctagccatttctaggaccaccaatattctatccatgccgccccagtcgaaaacattttgttccattaggtttttggtttttgcaaagctttttgtgctgcgggtggtgcacatgtctccacccgccttctggcaatcactctcgatgagtgaccaccaccaacacatccatatccaactactatggagtgtataatcgtctatgaataagcaatattaagcaatgtcaataattgaccacgcataaataatagactcaggcaacaaggatataataaaggtaacaatatcaaggatggttcatacacaaatttaggtacgcattttataattagcatgcaactttatttataaacaaaacatttataaaatgggttcaacatgctcaaggaggggagcgtagtgacttgccttgttcagtcagtagttcggcttcgacaaactcgtatccgtcctcacacacgtagcctgatttgatcgggaaacggagaatcacagtctattctaagactagcggaaaaaagaggaaaaacaaataaaatagcagaaaaagaaaatgctaacccaagctcattccgaagggtttgggataagaagaattttagcgaaaggtcttcaaaattcgacttgagatgaacaagtggtggcccctaaaagatttggaaaggaattacaaaccacaggagagacagaggacccacatgtcagcccatgtggtcttttaacagccctaggcccatctgtcagccttgctttagtggcgcagctaaaccggagtgaggtggtgcatgtgggtcccatggattagtattaaatcggtaattagggatgaaaggaatgggtggtccccacctatcggccgctcaggcacctcccccttcttcctccttcctcctcggccttgcgcacgcatgagcggcatcgccactagggctgaaccatgccggcaacgaggggtttggaagatagggcggacagtcagggcgggtcctatgtgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatgattaattatactctctggaattttctcggatttttcggagctcaattcctaattttaatcatacaaagagcatttcagtaattacccacatattaaattaatcattaaatggtctaattataattttgttaagtactttgagtgtccaagtattttcaggatttttcttggaattatttgagcattggaagtatttttaacaattgaaaggtcatctcattggttaatttatttggaaaagtaaataaaagtcctcttcatcagcttgggccgaattcagcccattccctcccttcctctcagccggctgaaaagtctagtttgcctcccttgcactacagtgctccttcttccagctctggacagagccagagccgtgccgtgcctgttgccgccgatccccttccaaaatccaacctctccgttgctcttatttccgaattggttgcgggaatggaatcctctcaatctcctcttc

SEQ ID NO: 50285 - DNA, 1412 bp, Oryza sativa
tcgccctcttcgccgtcgactccattgggttcgcaggagcaaggtgaagcccggccatcggttatttcttcgccgaagattgctgaaacgtcgccgccatcgctgacccgaccccgtcgccgcctctacctcgctgccggccgtctgccgtcatcttccatcgtcgcgccacccctcagtgagctttcctctctccgatgtcgttcaccggtgtagtttatccatagggtcttgatctaatctaatctatttcgcaggttgctttaatcttttatctcggttataaattatttgtaaattgtttaattaatttagaatagtcttttctttaataggtttaattggaattaaattttgtaaaattcgtaactaattcatatgaagtcagaatgaggctgttcaagtctcataattcatctaaaatcatgatttacatgtttgtttactttatatgtattgtttatttggtttttattagtctttttcctcgttttgcgtgttagcttgtcgtttccgtcgtttcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttcttatggccaatttgcattgcttaccctatttcttgattacctcgggttataatttgactagttggatttatatattggttcaactagatgttagatataattgcttagccatgcttagaaacattagcacactattgggataacttatgactcactattatttaatgatggcttaatgatagttcacgagggtcaatcgtgattggttaattaattaaattggtaattaaaatatgattaatggtgggttatgaggacatggttttgaaggtcgtgctcatagcaattaaggaccggttcgcgagctactgttgtgaaacattaaccatgccaaccacaagccagcgtgggcaacggctttaccttttgtatagcatggttcattgcggagcaccagactgagaagtggcggagataagcccacgggggtcgctgggtaatccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgccgcggttatgggcgggttgagcaatgtttttcgtgattagtctcacacctgggctgcaggaatt

SEQ ID NO: 50286 - DNA, 769 bp, Oryza sativa
gatggttatcccggggtcgggatgaccggtaatgaagagcaggtgactagccacgacagcgcgcatggccgaccggcggcatggcgagggtgccggcgaggggttacattaggtgccaaatgctgaggggtttatcgacgacgcgtggtaagtgtcctctggcacgcttacgtggttcgggacagcttggacggcggtagccgtttggtccgggccacgcatgtcacgaacagagccatggagcgcggcgcgtgcacatgcgtgtcccagtggcacggtcgaaccgacgaccagggaaacgccatgggctcagagggtaaggcgctggggacctaatgtccagccgctacggccagcaaaatggcagccattgagagttgcgggggtggcgtttcacccactagtggcgccacgccgcggcagcagcgacatcacaggaaaaaacgcggttgagcaagggaagggaagggaagggtgctcaccgcgcgacaaccaggaagcggcacaccgacgaggtaccggtcggtgtaggtcgagcgcgcatttcgtcctcgcgccccaaatgttcgaccggtgctagtcggtgttcgtcctggttcaagagaggttcgagggtgttcgagcaattagattgcaagttttaggtgattaattagcgttcaatcgttcgtccagttcatagcgcagctccctaccccccccatcttgctcaacctaagcttcggccggaggcgagctgaggcgaagcaagcggagcggcggtagccca

SEQ ID NO: 50287 - DNA, 9119 bp, Oryza sativa
ttcctgcagccccacgtgacgccgtcgcccggggtagatgagccgccgtcgccaccaacctacaccggccggttgcgttgcattgatggtcgcggttgccccctctctccgtgccgttgagtggagcaccgagccgggcggtgtctttgccagagctgggtgtcacggcggcggcaagccaagaagagcttggggaagggcaagggcgagcccgccggcgagatgggcgtggtaggcgtcggaagggatggtggggctgggagcgtggcgccatgtgtgaccgcgtggcaaggcgttgcgcggagaaggggatcgagccccgtcctcttgtggtgtcggctcggctcggctgagctagggcttccaagccagcctcaaaaagaggggaaagaaaaggagagaaaagaagagagggaggagggaaactagactttttctgtgcagggagggctgagggaccagaaacagacttcactgatggtccttagatgaattgggtcagtaacagggggaggaaaggtagaggatggtggaaggtgaggggaaagtttaagcttcccaagagaggggagtggagggagcaagaatagactttctcgggcaatacagggcagaggacttgacaggagaagggaaggaataagattactaagcttttctttttaagaagaccataaaaaaaagaaactcaagtttaagaattttggtataaaagaaacttcaaataaaaagaaaattggctgaagaatcggcacgatgctgagattgagatcgatctccgaccttaactatggcaaaaacccaagttgttacattgatattgcgaaccactgggtctagtaccagggggtactaccccgggtggaccactcggtcgggatgatccgagcggtcaaacttgattccaacttcagaccatcgaagatattgaggtgtttctggctggacggcgttgatttccctatcaatcagcttctatttcctcttggattcataatcttgtggcccaccgaagatgtgattgagctcttttcggggatcttgaaaacctggttgtccctgatcggtatcatctttcttttgagttgaagtactatgctctgtgtcagtcggcttcttcaattgtgtggcatattgctcggcaaattacttgtaaataaaacaatcctttgcaaattagtgtgatgtgactaggggccgttcatgatcttgttgtaggtgctgacacgcggtcgttgatatgatgaatgcttgtgaaagcggcgactccttcatcgttcccatcgttgcgatccggtttgtgatgacgttgtcggtcgtctctgtctgcaccacgacgtttgagggtgtcaagtaagtggacgggctaccgataggggtgaaaacgataacggtaattaccgaccgaccggtgttccttttcgactttctaccggccaagccatatggaaatggtaatcgaccgaaacaaatggaaattgtaaaaaatatggaaatgaaaacggaaatggttttgctgttataccgatcgtttccgtatttaccgtattcttgcggaaattaccgtttcttataatatggtaattaccgtattctaaatatgtcgatattatagggcatgtctatacttgacccacagcttacagattgaatgactcttcaataaaatctctaacttttgtacatggctaaaatgaagttaatttataatttatatagtataagcttgaatttatctatatatataacatacttatgtaaagtttaatatatgtttttatagtttaatgtttccatatttgttaccagttttcgatctgtaccgacatgtttccgtccgtattgttccgttttcggtttttcgataatttcgatatcatttttgttttcgactttactgtttccgatttcgtttccgagaaaaatatggttacggaaatggttgaggctgttttccgatcgtttctgaccgttttcatccctagctgccgatgatgagggagcgatgctcttgatgtctatcggggggagagtggacggagttttcccgacaagccatgccatcatgacgtgatcttgaattagcggcgctaaggcttggtttgtgatagtcttgagatcggagaggtggagaccctgactgccaaatggtgtatgaaccgaggcagagggctgccgagtgcttccctagttgactggactgaagcgggaaggaagacggagtcgtcgatgcccgaaacgaatcctattgcagtagtcggcgaaaaacttgatgtaacccctacttggcgcgccaactatcgaaacaagatttcggcaatactaaaaggggtagcaatcaagctggaaaagtggatgggtcagtagagaaaggtttatacaggttcaggccttgtcgatgagaagtaatactctactcctgtctggggaattattccgccgagtgtattattgatctaacgatctgggagaaaagttctgccgccctaggagtactcggacccctccttatatagggggaggaaccgagatttacaatgtacagcccatattacttacggactaggctaacagatatattacaattgtaactaactaggactacgggatatttccttgatatacaaattaatataattcccgagtccttttctaaacatattctacctgtataagctatcccctatacacagtcggatatacttgccatgtgggtatgtggtacccataatctccacaatttgtgtgcttaaattcctaaaaaaaatattggcaaagaagctgatccttactgttcgtatacgagcagttcctttgttgcaaagcaatgagcagtaaaactttaaatggaatttgaaatcatatgactttcctgcaaaaagttcaatccaaaggaggcttaaaaaatatcgtgaattgagatcacctacagttgctagtatcatcacgtacgaccatcgttggatctctcacatcacacaacagtattgtccattactctctctatcccataaagaagcaacacctagctacgcaatgcaaaattaaataagaggataaaggaccaaaataccccttattaatagcaaactagtattggcggatattgttgacgagaaatccatgctcagccgatggtgccagaactgtgttggtgcgaactaaatcgacgaacacaacggcttggtagatctgcttagctccagtgccggtccaaatcttggtgagatgcgggcgtgccagtcagtttgatcctacaactgacaagatatacaaagagctgatcggctatgttaacgaccaaatttggtaattcaagtatcggagatggaaccgaagcggaatccaagatagagatcgttccggaaacagagcaagagtcagctaaagtctaaatcagccgcgacaagaatcggcagagttcgagtcggataaggttagccgattgagccgattccaacaatgtgactcggtacacgttgtcaggttgagttaatgtgcttcatatggattgccacgcacggattaagtcctgaaaaggcaattgtatctattagttcggatattttatgtaatttccttatagataagtttgggtaaaagtctgccgcaaagacttatggtatcttagagtttgttagagataagagtcatgtccgataaggacattttgtatctcgggtataaatatgacccgaacccatgtaatcaaataacacacgttcaatacaatctcggcgcatcgccacccttttactttcgtttactttcgacgagtcctcgctttcgggttgagctgcatcggtttcgatcttcagctagaggtaaaacttgttatggcagcttgcgttctcgggattagtgcttccatctttatgatactctaattttgtttatgtaattcatcgagttatcatatatcttatataatctttgacaatattgttatttaactttcaatcggctaacatctatcattggaaggcagccgattaagttaaataccaacgttgacctagattatataagatatccaccaccctatgaaacactcaacggcttgattgtctagatattgtccttcttttcatacttatagctgtattagtttagtttgaccttataagtcgtgattaaaatctcaatctctagcatgcttttttgttgctgattagggtttcatcggggtttcagctgatcttacctgatttaactactttatatcttatatgcttgattgatatgttaaatctgccctttatgttaagatcttgttgtatttaggtatattaagttcttgttgcacttaggtatattaagcttcctgtttgatatattttgcttgctttaatatcttaatatagagtggtatcggagtactagccgatacatgctagatttatctgatcggctatgctgtgaatgcttataatctccttgttaatatatatttcgatctaagtgatttatactgtctcggcatggcgaccgatctatcctaatcacttgatttaagtatatattgacggaagtattatataccattaatagctatagctgatcgaatagatttagttatttcttgcttatttatgactgccgatcaattcaaatatgacattggctcaaagataaatgatacgtcattggcgactggccgatcggctattgttcatagatttaaccgctattttcctatctttatttcttgttggttgcaggatcaaatcaattggcacactcacgaacctaaaggcaagattttttggacctgcactgaagttaagcagatcttccaggcctcgtgtttttcgcattaacacgcttttggcacgcccggtgggacacgacaaacatgtcagcagataagccacctccgccatcaatgggcaagtcgttagaccctcaaaccaagattccaaaactgactgggtccgatgttaataatgggaacattgttccagtcactgtcgacaagctgtcactagaacaaaaaaaggattttgaattcatgatgaagagcgctcaggagcaattcatgaaatcgttcgcagaaacccgcaggaaagtttaccaaaagtacaaagtaaaagtagttgctgccgacgaagttggctcaagctcatcccaaggtgataaaggcattgcagatggctcaggcaataaagttgacggccttcaggatggagtggttgaggatcttggtgaagataacaatgaagtgcaaccgcagtttaacaacttccaagatcagattaactatgcagcgcaacatgctttgatcaactaatcaggagacctagtcaataccttaacaaacatggtaaagtctgtggttgatggtacaatagctgagcatcaagttgcgggaccagtttatctttcaggaggcatcttcccatattacaaaaacttggtaactggtaaccagaagtttgctaccaatgcaccaccaattcagccgatggcatcagcttcgactccagcaccacctgcgccatcatcggcaccaaggcaaataattaataatcctcgcctcttgtctagcgaacaaccgcaacatgctggtcagaatatcaatcggctgtcccgggagcaaattgcttgaatgtttttgccaactcagccaactggtggaccaattcagcagacgccgccaaggcagcagacagttcagtcgattcaacagcagacaactcagccgatacagcaacagatggtccagctgatgccgactgggttgaggacgcctgataatcggctgacgcatcaaaatgtgactcaggttgtccctgagcatctggtacacattgtacaactagatcaatcggttgcagcctaagttatccctgagcacttagtgcgtaatattcagccgaatttccataattgtcaagggggtaacttcaattatcaatatcagcctccttcgcctcatgctcagtatcaacaagggggatcacctcagcctcagtatactcctcagttcaaccagtttgagccgatacagcaacaaaagcaagggtgcctcaacagagacaatgggacgatatgattgcagatgtgatgagggagcagtttgggcttaagccgaaggatactggaaacttgtatcggcatccataccttgagtggtttgagagggttccattacctaaccgatacaaagttccagatttttcaaaattcttaggacaagacaatgtctcaacttatgaacatgtcagccgattcttggctcaatgtggtgaggcatcggctattgacgctttaagggttaggttgtttcctttgtccttgtccggatcggcatttacttggttttcttctttgccctacaaatctgtcaatagctgggccgatttggagaaacagtttcacagttatttttacagtggaatccatgagatgaaactatctgacttgacagcaatcagacaaaggcatgataaacctatgcaggattacattcagagattcagacagataaggaataggtgctacagtttggctttgaccgattcttagctagccgatctggcttttcagggtctgatagctccgatcaaggagaaattttcatctcaggagttcgaaagcttatctcatcttgcacagaaggtaaccctgcatgaacaaatgtttgcagaggctaagaagaatatcaaaaagatcaaccacgtgtacccttacatgtatggttccgatgaagaggatgattccgaagtagcagtagtcgagtgggtcaggagcaagaaggttgtgccattgtcacgactggaattaacccaataggcattccatacatgcgtgtattattccttgtcccaggaggcaaggtacaccaaatgttgatacaattcagagtttaacaagcggaagcgtaaatagttaatttattacatgggcgacgaaggcccagcacacacgaagataaacgaaaaacagctgaagactagggcgacgaccacagacacttgacggcaggcacgagctagacactaaagccttcatcctccaggaactcctcttctgggttggggaaaaaattgagcaagattgagtacaaccaccgtactcagcaagacacacccacgaatgcagaataaatgcaaaggagtacaaggcggttataataaaggggttagggtttgcagtaaacagcattaacaagacttttagttgctcagggtcattttgtaaagacgatcctagagctacacagtgttattaatcaaggccgtgaacccgcacaaacctgccttaacccaagacctacgatgattcagactaaactggcaaccagacctgggtcccagctcatcccaagccaaccctggccaaccattccacattttagttgttaaccatgttttaagaaataaaccactaacttgggtacattgctaggctttgatgtgcactagggttcccgatcttccgaaaggttctgataaacaaatatttgggcggagtcgcgacacaaatcgatccggcttcatgaacgcgcacgctcttgagccccgcaatcgcagcaccacgtctcctctggttatcacccgtgtcgaaacgcggatgacctcgccgagaaggctaatccctgtttgccaattgaagaatacaaacaagaatgagatagaaaacaaccaaaattgcagatgaatgattaagctcacaagttggggtcttacaaaccgatctagcggcgaaactgttctcgatagaataatctaagaaaaacccaaaaacctaaagatggcggcgggtactgatacatagagtttagggtcgtgcaaaccgctctcgatgcaaccctaatggagaacccaacacgatacacggcccaaaggcccaaatacggtgacgcaacaccgggatagattctagacatcaacttgttctgtcgattcccattgactcggaaagaatttggacgtgggaccaaaaccattggaaatgcgatcttcttagctttccatccatataaagaatgccccaatccgagcacgtatgcgacctgggcgcccattttagtgtagactggttctagactccgaattgcacccgaggtcgacttggtttgggcctccaccttgacttggacatcctcgaggatcctccatggctctaagtccttctccaagtgtctccttgtcccctccattgtacctaatcacaatataatcattaggtagcaatctattctcgaattcatacaaagaagaacataggaatgagctcacctctaaattcaattgtcgcgcacgagctcttgttatcggtccttgaatgaccgttggaggattgttgtttgtatccgaagtagtgatgtccgcattaggcttgcccataaccgagggcgcggctattcggatagattatactctgatcagagatgtacatctttaccgacaagacacgtcttcctcatgtgtaaccgtgcgccacataccaccacggcatgcggacggaagacgtgacatagttcccaacccatcctagccataaacaagagtaccgacccaaccctggctacggccggaattcctgagacaggtaacctaggttgagcccctagcagcaggacaccggccctgtgccatgacatctcgactaccgggccacggctcgtgtagccttcatttgtcctagaggtgtccatcgagccccgacttcgtccatccctatccgtgtacttttgcccatgaccagactgagccacaaactaagccttacccactagacatgtggaagtatggtagtgctttgcaacagaggcccaaagaccggtccttatagtggccgaggtgctactatcaaaaccatgcacctcgagcccagtctaaaactattttgggggttttgaatggaggagaaggggtatgtccattttcacataagccaaccattccataatatccaaatgatatgtgcatttccaaagtctaaagtaataaaaccacctaatattgcctaatttatcagcgaagcatctacctaaattcatactagtggaaccatgaatagagtacccactagttggggttttgtttatcctagggtgaacaaggtaataataacaatagcaataataatgaggtcataacaaaggtaaataa

SEQ ID NO: 50288 - DNA, 2351 bp, Oryza sativa
cagccggcgccgtgggccccactcgtcagccgcacctaagggcacgggtggctgacggctgggccccatgcggcggccacacggcgcgcccggaggcagccacgtcggcgtggccggcgggaggcggcggtccacggctcacctcggtcgacgacggcgacggaggaggcggtcggtggcggagggagacggtggcgcggctcgggttgacgaggacggaggtgttccggcggtcggcgagctcggctaggcggtggacggggtcggcggcggtgcggtgaagccggaggagacgacgtcgaggcgggggacggtcctggcgagcggctaggcccggccgaaggtcgacggcgacggcagagagagaggacaacggcgtgggcgttaatccgacggggaggaggggcggcaaatggcggaaacggactagggaggtacggggagggtttatatagggttgggagtgagagagggcagctagagggtaaggaaaccagcgtgggggtcccggtaggcatcaatggcaccggcgagatttgcgggagcaaatctggccgtttgaatgcgggagggggaggggaaaatgggggggaaagggagagggaatcacgggggacatttcccccctcttgattgcacgcgggaacagtcggggcggcggatttggcggcggtggcgctaggcgcaggcggagagagcggcgggaggaagggatgacgggtgggccccacccgttagcgagggtggcgggcaggcggaatttggccgagagagagagggaggggatttttagggttttctttttatgaaaccttttcgactttgtttatttattgataattattatttgtgctgtgaaaattctactaaaatttatttacacattttaggcttttaggaaatgtacaaaaatcctccaagccttatttgacttttaactttgcacattttaattttggaggctttcacttggattttaattattctaggcataattttaatgatatatttttagggttgtattgggacgtgataaacctaccccccttaaaaggaatctcgaccccgagattcggaagaactggcaaagaggttgggatgggctgccttcagcttgtcttcatgctcccaagtagattcttcctcggcgtggttgctccactggagcttgcaaaaacggattacccgattccttgtcctgcgctccattgtgtccagaatcttcactagcttgtccacgtaggtcaagtcttcacgaacatcaatctgctctgaatcggcctgctcggacggcactcgaagacatttcttgagctgcgacacgtggaacacatcgtgcacattgcccaaggatgcgggcagctccaactggtaagcaacttcttcgcgtcgagcgatgatacggaaaggtcccacatacctaggtgcaagcttcccttttgtctgaaacctgtgcactccccgtagcggcgtgacccgaagatacacaaaatcgtccactgtgaactccagatcgcggcgtcggttatctgcataacttttctgccgagactgtgccaactttaggttatcccgaatggttctgactttagcttcagcttctcttaggatatcagtcccgaatacttggctttccccaacttggtcccacaacagtggagtccggcatttgcgtccatacaacgcttcatagggtgccatttgtatgtaggagaactcagcataggggacacttttatcccaggtcttcccaaaatcccgaacacaagtgtggagcatgtcttctaggacctgattcagacgctcggtctgtccatccatctgcgggtgataagcggtgctaaaattcaatcgggtgcccagctcttcttggagcttcttccagaagtgaggtgaattggcttcccctatcagacataattttcttaggaacgccatggagactcacgatcctggcgaagtaaagttgagctaacttgttccctccataggtggtcttcacagggatgaatcgagccaccttggttagtcgatccacgactacccatatagaatcatatccaccttgggtttttggaagtccggtgaagaaatccatcccaatttcatcctatttccattatggtatctgtagaggttggaggagtccggccggtcgttggtgctcagctttgacacgccgacacacatcacaaagggccacgaactctgcgatttccagcttcatactgacccatcaatatttctctttcaagtctaagtacatcttcgtactgccagggtggctggaataaggactttcatgagcttcctgaagtatcaactgtttaagttccttgtcgtccagaatg

SEQ ID NO: 50289 - DNA, 7413 bp, Oryza sativa
cagtgcagccaagaatccatggctaatgacacttaggttcagggcttccaactgttgattaagttctggtggaatgccgcggacgcaaagagaactgcaatagcctttttgactcagcgcgtcggccaccacgttggccttaccagggtgataatggattcccacatcataatctttgatgagctctaaccatcttctctgctgaagattcagatccgactgggtgaagatgtatttcaaactcttatgattggtgtatatttcgcagcgatttccaaagagataatgccgccagatcttcagagaatggaccatagcggccaattccaagtcatgggaaggatagttgccttcatggggtcgtagctggagtgaagcataagctaccacatgaccttcttgcattaacacacaccccaatccttggcccgaagcgtcatagtacaccaggaaatccttgcgattatcaggtaagattaacactggcgaggaaaccaacttttccttgagagtttgaaatgctctctcacactgcggactccacacaaatttttcttccttctttagcaactacgtcatgggcctggcaattttggagaaattctcgatgaacctctgatagtacctaccaaacccaagaaactgcggacctgggtgaccgtcttgggttgcttccaattggttatggctgttactgtttcgggatccacagtaactcctttagcagatatcacatgccctaagaacttgacttcggacaatcagaattcacacttgctgagcttggcatacaactgatgttcccggagctttcccaacaccagacggagatgctgcttatgttcttcctctgactgtgagtacaccagtatgtcgtcaataaagaccacaacgaacttttccaaatactccatgaacaccttgttcattaaattcatgaagaaggtaggagcgttggtcagaccgaacgacatcaccgtgaattcatacagcccgtactgcatggtgaatgcggtcttagggatatcttctgcacagatacgcaactggtgatatccggaacgaagatcaatcttggaaaagacagtggcaccttcaagctgatcgaacaaatcatcaatccggggaagagggtacttgtttttgatagtgacttcattaagagctcggtagtcaacgcacatcctctttgtcttgtctttcttttctacaaaaatcatgggagcacctcagggggaagtgctcggccatatataccccttctctttcaactcttccaactgcttcttgactgcggccaattcatttgttgccacacggtagggtcgcttgtacatgggagcggttcctagagcaagatctatcctgaactcaatctcccgctttgggcggcataccgggttgctcttccggaaacacatcaccgaactcgttggctacgggtatttctgatagtcctagctaatgaagtactgagttgccggtgggagttgggtgcgcaaagaagacagccggttgatcaggcttccggtacacagtgacagtacgtcttgtgcaatccactactacttggaattgggtcaaccaattgatcccgaggatcacatccaagtccttggtgtcaagaaggatcagatccgaggggaaaggaattccctggatctctatagatacggccggactataatactttgttgtcatagcccctccaggggtggtgatgagcagagagctcctaagctttgctacccccagttgatttctccccatgaattgcacagatataaatgagtgggaagctccagagtcaaacaaaatgatagtggggatggaatgaatgaagaacgtaccggcgatgacatctggagttgtcagcacatcttctgtagtaatgtggttcacacgaccccgagtggcatcctttccatcattgttggggtggggaggcgcttggccttgctgacgcctcggcttcgggcatttatccgtgaagtgcctaggctcaaaacagtagaagcacagacgcggctgaccttgaacatccctgcgtccttgactaggctgcacggccggtgcagggggacggggtggaaggttccctttctagttctgctgctgctgcggctgtgggacgcaaaccacaaattaaggtcgtggcgcggggcgaggctgctgttgctgctgctgctgtgaggaggatccccctggatagggattggtgtagcggatcctttggttagccccatgttgattacggaaattcgccaagcgacgcttgtgtgactccagttccttgtgcttggtctccaggcggatgctcttgtccaccaggcgctggaaatcagtgtaatccccggtgaccagacgcaccgaaaagttcagggtccattcctaccagaaacttctcctgcttttcttcatcttcacgaacatcctcctgggcgtaccgggccaggttattgaactcatgcaaatactccgtaacagaacggttgccttgcttcaactcccgaaattccctcttcttgagggccatgactccagctggcacgtgggtcctccggaaagcggcggtgaagcaggcctaggtgattggctgcccttctggttgtgtagcctggaagtggtcccaccatagtgatgcgggcccctgcaactgatgggttgcgaagataactttctcctcatcattgcactggacggtgtccaactttttccccacggcatgcaaccaatccaaggcatccacggggttattggagctagacaaggtaggcgggcggatgcggaggaactcggcaagcttggagtgctgtgggggtggtggtggtggtggagcattgtgttgcagcggattctggatgtggtggaggaaagcagccatcatgttggcctgctgggcaaggatttgggtgaggatggggttggtgtcagttggcggtggtggcggcagagggggaggtggaggtgggctgccatggttgttgtggttgctgctttcggggtgacagccctcaccggtagcagcgcttctcctggttgtcaccatctaaagattccacatagaaccagaaaacagaaagagttgacgattaaaactaaccacccacgactaccataattcttgaatttatttctgctattaaattggttcattaaggttcaagtcgcttatgcgaaataaataaagacaggctccgacacagttataccacacaccggtataaccatgccccacacgactctgcaagaagacaaacgaaaagaacacacgcgcgggcctactagctgctcgtctacttctgcgacgggccggggcggaaggtgagcaacagcacatcctctgtgctgccaacgccaaaggctccctcctcctgaggaaccaagggtgcgggctcggcgcaaggagtctccacgaagcaggtccacgccaaggactgacgaacaagctcaggcctggaggtactcttgcgggcggtgatcttctgactgcaacagacacggcggtgcttggggtggcagacctgtccttaagcaatcttaagctgacacagctgcgcttccacggcgtccaactccttcttcagctagaaattctcctgacgcagctccaggatcttcatgttgttctcgaccaaaccacggcgcaccatatcgatggaaatcgatacgggccgtgtcatacgcctccactatgcacgccaaatgcatgatggtagcgtcatcctccgcgctagcatccctgaaggcggcgtagtcgcgggttcctccatgacgagggtggtagtggtagggcgagtgctgcaactcgtccggatagactggtgaagagtgccgatggcgaggagcacggcgttctgccaagcggcggggaaggagtctccacccgcggtgactgccagcgaattgctctcgggggagctggtgaggatcacagtagtgacctcccaagcggcacggggctgtgcatcgtcaccatcctgctgtgaaagcttcttgccctggtagtccactccatgcggatatccctggacaacgcacatgccccgcagctccaaagcgaagccagtcagatcaagaccacaccggttgaggttgttggccatctataaacaaaggcaaaagaaaaattttagagatcagcttttgatgagaaataaagcagcaagacagagaaagactaaaggattttcgcaaataaggggtggttttttatttcaaaatacgaataaggcttggggtctaaggctcgtcctagggtcaaggaggctctgataccaacttgcacgatcagaattaacccaacaggcattccatacatgcgggtattatccttgtcccaggaggcaaggtacaccaaaagttgatacaattcagagtttaacaagcggaagcgtaaatagttaatttattacatgggcgacgaaggcctagcacacatgaagagaaacgaaaaacaatggaagactagggcgacgaccacaggcacttcacggtaggcacgagctagacaccaaagccttcatcctccaggaactcctcttctggattggggaaaaaaatgagcaagattgagtacaaccaccgtactcaacaagacacccacgaatgcagaataaatgcaaaggagtacaagggggttataataaaggggttagggtttgcagtaaacagcattaacaagacttttagttgcttagggtcattttgtaaagacgatcctagagctacacagtgttattaatcaaggccatgaacacgcacgaatctgccttaacccacggcctacgatgattcagaccgaactggcaacccgacctgggtcccaactcgtcctaggccaacccaggccaaccattccacatttttgttgttaagcaagttttaagaattaaaccactaacatgggtacgttgctaggcttgcccataaccgagggcgcggctattcgaatagattatactctaatcagaggtgtacatctatacccacaagacacgtcttcctcatatgtaaccacgcgccacataccaccacggcatacggacggaagacgtgacatagttcctaacccatcctagccattaacaagagtaccaacccaaccctagctacggctgggattcccgagacaggtaaccaaggttgagaccctagcagtaagacaccggccatgtgccatgacatctcgactacctgggcgcggctcgtgtagccttcatttgtcctagagatgtccatcgagccccgacttcaaccatccctatccgtgtacttttgcccatgacaagactgagacacaaactaagccttacccactagacatgtggaagtacggtagtgctttgcaatagaggcccgaagaccggtccttatagtggccgaggtgctactatcaaaacaatacacctcgagcccagcctaaaaccatttttggggttttgaatggaggagaaggggtgtgtccatttccacataagccaaccattccatattgtccaaatgatatgtgcatttcaaaagtctaaagtaataaaaccacctaatgttgcctaatttatcagcgaagcatctacctaaattcatactagtggaaccatgaatagagtacctattagttggggttttgtttatcctagggtgaacaaggtaataataacattagcaataatgaggaggtcataacaaaggtaaataggcatggctaaataaacagtgataacgcgggaatttaaataaagcaataatgcaataatttaaacctaaataattttataaactgggattcaatatgctcaaggatgatgtgacttgccttgctcgctttcccaaaagtcggcttcaacctccacgtagagcggatcttctgaagctgcagcgtctacacgaccaatgaaatggaaaaaggcttttactctaataaactccatataacaaacaaaaacaaagcacaaaaatgggtccttgacttcttaaggaaaaattagagacttgaacagtccaattccgagtacaaacgaccaagttatggccacttgaagtttattgctctttaagtcaatatttgtgaatttcttcatttaattttttagttaaaacgatttattgcgtcagccgaggggagggggcgcgcaggctgggttcacaggagtggtgggccccacgcggcagcccctcggttcacggtgaaccgggtgcacccgcgggctcaccagccggcgccgtgggccccacgcgtcagccgcacccgagggcacgggcggctgacggcggggccccacgcagtagccacacggcgtgcagggaggcggcgcccgcgtccctatggtcgccggcggcagccataggcatggcggagcggcggccgagagagaggaagggaagggtgaaaggaggcagcggtccacggctcaccccgggcgacgacagcgacggaggaggcgatcggagtggagggagacggtggcgcggctcgggttcgcggggacggcggcgttccggcggtcggcgagctcggcgaggcgatggacggggttggtggtggtgcggcgaagctggaggagatgacgccgaggcgggggacggtcccgggaagcgactaggcccggccgaaagtcgaaggcgacggcggagagagaggacaacggcgcgggcgcgaatccgacaaggaggaggggcggcaaacggcggaaatggacgagggaggtacgaggagggtttatatagggttgggagtgaaagagggcgaccggaggggaaggaaaccggcgcgggggttatggtcggcatcaatggcgccggtgtgatttgcaggagcaaatccggccgtttgaatgtgggagggggaggggaaaatagggggaaagggagagggaatcacggggaacatttcccccctcttaattgcacgccagaacagtcgggggcggcggatttggtggcggcggcgctaggcgcgggcggaaagagcggcgggagcggcgggaggagggggatgacgggtgggccccactcatcagtgagggtggcgggcgggcccgtccgtcagcggcgcgcttgtggggaggaggctttttagggttttctttttataaaaccttttcgactttgtttatttcttgataattattatttgtgctctgaaaattccactaaaatttatttacaccttttcggcttttaggaaatatacaaaaatcctccaagccttatttgacttttaagtttgcacattttaattttggaggctttcacttggattttaattattctaggcataattttaaggatatagttttagcgtcgttttgggacgtgacagccatgcccatgggtgagaagttctgggaaagaggaaagatttgattttgatatcaccatggctgataagattttcgatttaaagctaagaaa

SEQ ID NO: 50290 - DNA, 9994 bp, Oryza sativa
ctgcaccccattaaaagaagagtttttatgaaatatacattgttaaatattgattcctatcaatagaatacttaaaacgataaaattcatattttttaattcattttgagtatgacttccaatggcatattttcttaatacaatgtcccaatatactattattagattaataataaataaaacaattttagtcatgtttatccctcaacattgattaaaagaaaagtacttcatctgaatttgttggaggaatgatgtatttttctgaagtaatgaatatcaatgaaaacataaattgttcaactggatgaagcatgcaacagattatagtgatataggatgatacacatatatatacttatttatcgtgagaacatggcataataaaggatcaaaatcaaataacatatagtattaacatatagtaagaggaaaccatgtactacgtataaatattaatggattagttctaggagccaaatcaagaactctgctgtactatcctaccataatgttaatatggattggttccgtgtccaataatttttcattgtgtgccatgttaggataaagtaggatcagcaaaatgcatgggattattcttttttccatggttttggaaaatagggacgaaaataaaccatgtttcactgcacaccatttgtctttttcatgcatgcatgtatattactgaagcaacgcatgcatatctattgcttttttccacccatgcattattatcgaaaaaaactgcacatgcatatctattgtttttttccatgccctttgcctttgcatgaccacctgtataacacaaaatttatgatgaatcaactaaataatataattatgcatctatttgccaatatcgggtggaggttctctaatagatttcggtagttagaggatctttttcttctgttggtgtctattagtttgtgtttgcttagctttgtttctgctatcgtaaactttctgtgtgagttctgtaataattggctgtagctctttgagtaaaggccggaatgttacattccattataaaaaaaatcaactaaataatatacggagagtttttttttttgcggggatagtttaggaaagtccgaacatatttttgaacataaatatgaaaaaagttttttacaatataataataagggtagcaaattcttatcacataggaaaaaaaatacattttaaaacaaatatactcccttcatccacaaatatttttgatcctagacttcaaattctatccacaaatataagggatttaagagtagaactttgtaaagccacctctcatttaatatttttcgatcaatcttatccctaaccatcgttctactgccccttcaccccgttttaaactttatcttcatttttccttcattcctaatctcttgaaatcgcttatatttaaggagagagtgaatatatgaagaatggtaaaagtagatcaaatacagataaaaagtcagactatgcaaattgatggaatacttacatgtagtacatgtggcgaccactatggatcttcctaaatgccagcgaatttgtcaaagcaaatagatggaagacttctatgaattattatggtacgatgaccatggattggcttgtcaggtgctatcgaacttgttgatgctgaatcaacatctcaacatcaaaaatatatacagtatggtgatgacgtagattagttcctattggacgctgtgacagatgagaagtatgcatgtaaagagaattgaactggaaattagaagtagaatcaaaccttaacaatggagaaaacaacaattagcattcggctgacgttgtgtgcttttccggcgctcaccggctgcacgtcaacctcgccttagtgattgtgtgttgctagatccgataacgttgatatattcgcctttgccgcggccgagcgagcagaacataaatggcgtacgatgtgcttgtatgtactgtttcctcctgcctttctccgtcgtttgccgctgccggccggcgcgatggccatgccgtgccctcccgtatcttccattgcatctgatcagatcgatctcagtaaatatggatggactcatcggtttagaaaaagaaacaaatacccacgttcgaaagaaaaaggaaaaagaatgcgtgcgtgaaaggatcatatcgatgggcttgacaatataggttacatgggctttaaaagacccaccacgtggaacttggattagattgtaatcaacggttgacatattatggtttgtttaatcaatggcttgatcttcctgattaacgtgagagctccaaaaaagtgcccgattagtatggatacatatttaaagtattaagcgtagtctaataacaaaacagattaaagattccaccagaaaactacgagacgaatttattaagtctaattaatccgttatcagtaaatgtttactgtagcaccacatggttaaattatagcgcaattaggcttaaaagatttgtctcgcaatttcttagtgaactgtgtagttgattatttttgtctacatctagtacttcgtgtatatatctaaatattaaatattaaatgtgatagctatgaaaaattttgtccgggcctaactctgctaggcatcaacgagtccatgattcaatcaccggctttgagagtggagtaaatttttcactcgtcagacaagctctagtgcggtaacccctgcggtggattggacacacagctgcatgcatggcatacaatccgtggagcatggcttttgcttttttttttcgcaggcctcgacagccagtcacgaagttccgctgagccgctgacaatgggtcgcgtcaagctttacaattgatgttactgcttctgcttgctgctagctcccttagagtagaatataacatgtcctatataatccctctattttataatataaatcattctaacatttctcatattcatattaatattaatgaatctagatatatatctatctatattcattaccatcaatataaatgtggaaaatgctagaatgatttataatgtgaaacggagagagtaatagttttattcggattaatcattatacgatggttgtgtttagctcacactaaaattggaagtttggttgaaattgaaatgatgtgatggaaaagttagacatttgtgtgtataaaacagttttgatgtgatgaataactttagaactaaagacggtcgataacacggtcgatatgttacgtcctgttcttgattaagtttgtttacacgaaggaagtactgtgctgctatagcgtttacagtacagtgcttcgttaaatgccactggtacggaaacatttttctcgtgtgcccgaaaaattggcatctctcttagcggtaccgtaacggcgcatggagagtgattgagtacagttagtcaagttatgctcgcctccccgtccaaaaaaaaatcacaaatataatgtcgaaacaagatttcagcaatactaaaaaggtggctatcaagctgaaaaagtagatgggtttacagacaagaaattttatacaggttcagaccttcataataagaaataataccctactcctgtccggggattgatccgtcgagtgtattattgatcgtatgatctgggagaaaaatcgtgttctaagaggcacccggacccctctttatataggggaaggggtccgtattacaaagtacaacccatatctctaacggaataggtagttacagataagatacaatcgtaacctactataatcccaggtgcttccttgatatacaagtttagacatttaacccaaaaacttttaaagatattctatctatacatggtacccccatacccagtcggatatacattccgtgtgggtatggggtatccataatctccacagtagcccctaagacctttatggtcaacgaaatagtcctttctcgtaattcaaaacgataatacaagtgattcagcttcttctgccttggtgtcccgagtactgaagtcaaagactgtgaagggctgaaaataaaaagaaaatcaggtgcatcgaccagatgcacctaattaggtgtagcccccgactatgtgatccatccgagtggttcaaggtacattacaaccaccgaatcactttgggaattaaatatttaatcttaagcagcacgtgataaaatatccaaccgactgctttaaccataatacacccagaaaaggcataacgagacccgagtgaaaagcactctaaaagtctataaaccaacatatatgacaagaatctgagtaaaaaactcttaaaggattcatcaactgttgtataaagaatgacaaatgacaagtcaatatggcctaagctgtgacttatgtcaatatcaaaataagcatataacatgctgaggggatagctatctgaaattagccatctcaacaaaacccaagcagctttgcaacctaaaaaggtcaacaaaattagtattacacttttctaccgggcaccttctttatttcgcattacagtaattccaaagaattatctaactgcatcgaaaaggatttcaacggcattgggctatcctgttgtgagcaatttttaccaaggcaaaaatatatgctgaaatccctaaggaacacaaccagccacgccaatattgaagttgggctgaaagcactgtataggcctaggcccattagcacctcccgataccctaacaaaaaacgctaaacaagtgccgcttcgtcttccctgccgagacctccgccactttccccattctccgctacagtacagcgaccactccggcgagaactagggctagcaaatccacaccaatccactcctctcgaagcttcgtaaattcgcaaaaatcttttgcgcaaccaccgcaccaatctccccttcattcatcgccatccttgcttcaaatcccatcatccattctcgcatccatggcgtatgagagagagttttgagagtcaatgggctccctccgatgttacagaggagaacttcaaggagatggtggcgcacaacgttctcctagcgaaggaaattatcgggtggcgtgcggcgtgcggtgaagcatttctgacccctgacacacacgaggtcgtggtattttctcacttcttctatggtggcttttctctcccaacatcgaaattcttcagggggatccttgaattttacgggattagcttgcatcatctgaaccccaattccatagttcacattgccaatttcatccatgcctgcgaagctttcctgggtattaggccgcactttgccttattccgccgcatcttcttcctcaagccccagccaaacaagagcaagccgtgcgttgttgggggagctagttttcagttaaggggaacccttagtcggaaatacttccccatgcccttcaaaacctcaaacaagggctggcatgcaaactggttctatgtgcagaatcctgaaccagcgctccctgagtactcttgccttcccccagtataacaagacacttggaactcgcttccagtgggagatgaagccgctcaaccgcttaccctaatggagcacatgttgaaacttaaagagcaaggcctgcaaggggagcaaatcactcggcactttatcaacagccagctggcacctattaaagagagatcccgcacagtcttcgaatttgatggcaaaactgaccccaatcgtgaagatccaaaatctcttgagttcaagattatgaaggagaagatgtacaaaatcttctctaacgctattgtggtctgctattcacacctgctgccagtggtgccatataacactttcaaccctcctccatcggtatgtatcaaaaatatctcggccttcctgatgacatccttttgtcttttgtaatgttagctgaaaacttgaaatattatgcataggaattttctcttatgaaatctgatcctccaatcgctcaacgccgctcgccccgccggcaggctggtcaggccagtgatgggccgaaaatccaatctgacgctcagcccaacatctcaaagccaactaactagtcgggctctcagaaaaggaaattaattctttgtgacgacgaaggtgacaatgttgggaaagctggcagcaaagaggtgaccggaaaacagccaaggcaggctaacccgaaaaagaaaacatccagtcgtccaataccaaaaatcaggaagtcatccaggtacgagtcatctagcaatttctcctgtattgccaaacatacaccatcaaggtagcaatttctcctttattagcaatttctcaaatctgcaggaagccatttgacatcgattcctctggaaaagaccctgaaccgactgacaaggagactgatcctacgaccaccacagaaaccgggctgactgttgaaaatcgcccgactggtagtcaaccggcgaccgacaatgtagaggccggaaatgaacccccgactggaaaccagtcggccgaagctgaagccggtgctaatcaggagcccccgactggaaacgagtcgggtactgaacaaaataaggacatcccggaaacagaggctcgggcaagcagccctcccccaaaaaataccaacaccgacccggagtccaattcatctgataaggtgcaagggcctgctcgtcctcaaccgaagattataacaggtaatcaattctccgaattcattttgacttgacaaattctcttcgattacttcatcatcatttgtgagtgttcaaaggcccaatgatcggcgacgaagaagatgttcttcggattcagtcagctgaagattctcgcccacccatcttagttaaatggtgggatgatgaaatgcagcctcaagggatcataataaataagcagaaagaagatgaggaagtgtccttgcttgcaaagacgctcaatcaggccactcatctcgtaaatgtatgtttctcacatatagctttactcatcctatcggccacttcactaaattgaaatgaatttgcaatgcagagaattcatcttaggaatgaagcgaaaactacaaccctcgagaaactggttccacatctcgaaaccctggaagcgactagagcccaactccatgaaactagggagcttgctaggaaaaccgaacaagatctcagggaccaaatcaccgagctccaagattccaatttcgagctgagtggttcatccaaaggtaacccctacacctgattaacttattctaggctgctatccgcatccaattaatcagtggaatatattacagtacaagctgccaagatcaccgagctagaaaagcaaatcaaagctctggaaaaagacaagggtgaactaaccaaaaagagggactcggctctaaaagatgtcgaaggtatttgtagttaaaactctaaaatcattcttatcttcgtgcctggacgttgatgtgaaccttttatgcagatcgcaaaattaaatctcaggctcaattcgaagtcctggtcaacaagattaagaagcttgaaggagctagggatgaagttgccaacgccgccacaccactcatccaagccatgttttttaataacaatggtccgagttcgttcgacgctgttgaaatcttcgacaagctgagagctgctccagatacatactttaagaacatcaaagaagctggatgcatgggagcgagcatggcattggcaatgaccaagtccctgtacccgaagattgatattgacgctgtcgacggctttgcaaatgggaccagtgaagaagatgcccttgacctcatcaataatgcatagaaggttgccgacaaaatcgctgctgatgttgttgagagatttcaagacagtaatctcggtccgactgggtctgatgattctgataatgaaaaaactaagtctgattgacattgtgtgatgtgacttatgatgatggaggcacaatttgtacaatactgatgtatttatgctgtgcttgataatttaaactcagctcttgatttcttaaaagtttttgtcaaaccttattgagcctagaacccgcaaaagttgttaaaaacattcagtcctcattgactaagccaaaaaatcaaacaaggcaatgataaaccaagtaagcaaattgaattgataagaatcacactctattattattatagtagcccccgactgttaactcaaggagaaacttgatattagcagtcaaagagggaaagaagatacaaaagtaatgcctaagcataaaaacgacgaagatgctcaatattccaagagttgtcgacgtgagtaccatcttcacgcttgagtcgataataacctggccgagtaacttcagaaattatgaacggtccctcccataatggagataacttgtgccgatctcgtgtagtttgaatcttcctcaagaccatgtctccgactaagaatgcccgcgatcgaacgtttcggttgtgatagcgtcgcaaccattgtaaataccgtgccgactaaatcaatgctgcctcacaagcttcctccagtcggttgagatcatcaactcggtcttctccgtagcgctcctccttgaaattgcgaaatcgcaaggattcgaattctacctcacttgacaacattgcttccacaccatgaaccagaagaaacggtgattgccccgtggcccgactaggcatagtgcgtagagaccaaagtacagatgacagctgatcaacccacttgccggtgtagggatgcagtccgacgaagtcttgtgctttgattccttgaagtaccataccattggcacgttcaacttgtccattgctcataggatgcgctacggaggcataacaaattttgatgctgaagtcttcacaaaaatctttaaacacacaaccagtgaattgagtaccattatcggtgataattcgattgggtaccccaaaccagtgcacgatgttgacgaagaaatctctagccttgtccgctgtgattgtgacgactggcttggcttctatccacttggagaacttgtcaacagctacaaatagatgagtgaaaccaccggtagcccttttgaaagggccaaccatgtcgagcccccaaaccgcgaacggccaggataatgggatagtttgcaactcctgagctggtaaatgagtttgtcgggcaaaaaattgacaaccttcgcatgttcgcacaattttatcggcgtctgatacagcagtgggctagaaaaaaccctgccgataagccttgccgacaatggttgtggggacacccgatatagtcatggtgccccacgaatatgtaactgcccaggatgttcagttaagcatgaaatgatataaaagtataaacttcgattatacaatactcaagtcacttagttcacaacacaacataaatacaaaccattacatatatggcctataaagccttatttctacaaacagataaactgctagactccaccacaggaaatgcctgagcgtagggtgacctagaaaccatagctgtcccactctaacgggtcaacaggatcttcacaagcatcctcctcctcatgatctgaacccatttatgagtacaaaaggtactcagcaagacatgcttatgataataaatacaataattgcaatataaaacatgcagtatcgagagctgcaaggtttaaaccctaaccttaacagttatttcatagagcctaacttaataaacatttgatataaacaacactattgaacatttaatttaaacaataataacgagcataaaaatataaatgttacttataattaacatgcatagaacattaagtaataaataagttaaccatattaattaatagccatttagtttaacttgtgcccataatctggaatcacccatagacacatctccattaaccgggagcacggcgtattcgaatactcaacgactctgcagcgtatgcccagctttacccgcacgatacccacagctggccggcttgaaaagtaacaaggtgtaatattgctccatatatctttccctt

SEQ ID NO: 50291 - DNA, 3315 bp, Oryza sativa
cttgaaagctaatggcgagtacactgaaaggcctgcagaagtttaatcaattggagcaatatacggccaggttcgacaaatcgatcgtgtggatgggcgaaactatgtcattcttattgacacaagggggtttattattatatcaattttaaataagaaataaccataaatatatccatatatccatcacgaccataaacaggtccataaaaccaaacacatgaactctatcatgtgtaccacccgctcacatgcgctgtcaacagttcttagcatatagccataaatagttccataagcatgttttcataagcaataataataatatccatattaaatcgatagcatgctaaataattaacagtttgtttaaatgtttctcaaattttatcctaagtttgttagactctaaggctcattaaggtgtttataacaacaaacagaaaatataatgcaataatagtaatataattaatttaaaagaattcgtgcagtctatcgtactccaaaggacaagtacgctactaaaataactctctatctactcggattaaatttctcaagggagggtgcatgtattgcaaccttcgggctcgatgtagtcgcacaaaccatctcctcctggcacggagatttcactcgcttcgactaccgaaccaaagtcagcattttctatttacgcaacaatcatcaccacaataaataacagaaaaacaaagataaccaaaacaaatagtatcacaaagtgcaacaatgggtgaaaaggatttaaagaaataattttagggattttttggaatttcggtgaacggcgaaccataggcctaaaattagggtcgtgacaacgggtgctcggattgcaacgaaactgacacggatggattcggaataagaaaaaggatttttcttatttatttttcaatagaaaaatcggatttttcttttcttctctcgctctgtacaggaacggccggcaactccctggcgccggtggtggagatggccggttttgagcaagggggcgccggtttcacgatctaggggtcagggcgactccgttcccgtggttggcggcggcacaggcggtggcgcaggcggtggcggcggggctggcgacggcggcctagagcaggaggcggcggcggccatggcggcagtggtgcaaggggagcgcggtggtggcggcggctcggcctatggcggccgggagcggcggcgcgccgtatggctggcggtggccgaacagagcggcgacgccgggaggaggcgctggtgacgttccggcgacggattggaatgggaaagagagggaaaaggtagtactcggcatggagaatccatttttaccttcaatttcagaggatttgcgatgtatgcgacgaatttaggagctttattaatggcgcaaattttgcgttttggggatttttcctccggtaatggcgatttgattcagtggagataggtgcgcatttgagtagtaagagaggtcggaattgcggttcttttacccccggtattgagccttctagttgagggacgaaggagatacggaggcgggaagctggaggtgtcgtccggggattcgtccgtcgatcggcctcatgtgcacgcgtgcgagcgtgtggcatgcgcgggctggcacgagctgggcgcgagcgtgcgcgagcatggtgcgggatcagcgcgtgacaacaccgggcgacacaggccctggctcggccgagcccagtagaggaagaaagaaaaggaaaaacagagaaaggaagaagaaagagaaaaacagagaaagagggaaaaagaaaagaaaagaaaaaataatagagaaaaggaaaactagggtggaaataaagaaaaggaaattttgggcaaaattaaactagatagaatttgaactgatgtgatatttagatggtgcgatatttgggatagatttaaatcggattcaaaggaattatttgagggatgatatgcactttgcgacaaaaaattaaacgagaaaagaaacaccggaaacaaacttggaaaataatattttaaataaatgtctaactcgacggttatatttttagagaatcaaagcaaactaaatcggttttaaaaagttgtcaaattttaaggatgttacaatggttcgtgcggcagcgtgattgtcgctgatgcccgagtgtatatctctgagcaattgccttccctcctccaaagagacacaacgttgcagaattcctgatggacttttcttgtacagctcggtctcatgtatgacataaagcttgctgcgcctggaaatccgctcggcttcgtctttatcctgagggagttcttgcttggtcaaaaacttgatgagggctctctccagtcggcgtcgatcatgcttacttcttgagtgtctacagcctcggttgtttcccttcttggtacggttggttcgtaaagatgctcaacaaacacatcagagggagatgtttctcgtttcgaaccgaaattggctagtctgtcggccgcctcgttattatgtcggaggacatgggttaactcggggccgtcaaacttgtcttctaacttgcgcacctcttgtcgataagcagccatattatcatcgaggcaggaccattcttacatgacttgattaacaaccaactgagaatctcaacggactatcagacgacgaatccctaaagatactgtcgaaacaagatttcggcaatactaaaaatggggaggctatcaagctagaaaagtggatgggtttgaagacaaggaattttacataggttcaggccttcttaatcaagaagtaataccctactcctgtccggggattgatccgccgagtgtattattgatcgtatgatctaggagaaaattgtgtccctagagggacccggacccctccttatataggggaaggggtccatattacaaaatatagcccatatccctaacggaatatgtgattacagataaaatacaatcgtaaccgactaggatcctgggtatttcctagacatacaagtttagaaaactaacctgagtcctcctaaagatattctatctatatctggtaccccgtacccaaccaaactatacatgccgtatagatatggggtatctataatctccacagtagcccccgagacctttacagtcgacgaaataaccttctcttggagcataaagcaataatccgtgtgcttcaatttcttctgctctggcctcccgagtactaaaatcaaagactgtgaagtgcgaaaaaagaaaataaaaactgggtgcatcgagtagatgcacctaattaggtgtagcccccgacta

SEQ ID NO: 50292 - DNA, 4500 bp, Oryza sativa
cattcaataaaacacccagccgactgcttcttggctttaatatatcgagaatagagatatgaaaaggcccgagtgataaacactcaaaaggtccataaatagacatatttgacaagaatccgagtaaaaactcttaagatgatccaccaaatatgataaaaatcatggtaattaacaagtctaatagcctaggctatgaccctcaccataaccaaaacaagcatatgacatgctaagagaatgactattagtaaactagtcatctcgaatcaacccaaacagcttttggagcctaaaaaagcttacaaaaatagtataacacttttctgtcgggcacctttttatttgcatcgtagtaattccaaggaattatctaaccgcgtcaaaaaggattttaacagcatcgggtcacaccattgtgagcacaaattgccaaagcaaaaaatgcctaagtccctagggatcacaacgggccacgctgataataatattgggctgaagtactgtataggcctaggcccattagcactcccgataccctagtgaaataaacactgaagtccaagcgacgtttcgtcttccccgccgagactctcgccattttccccatttctcgctacagtgcaaaaccgcgccgacgaagctagggttcaccaatccgctccaatccatcctcaaaaactccgtgaaatccttctgcacgaccaccgcaccgattccccatccccttcgagccacatctcggaccaaatcaaaccatccagttcacatccatggcggaagagagagaaagctttgagagtcagtgggcgccctccgacgtgaccaaggaaaatctgaaagaaatggtggcgcacgacgttcttctggcgaaagagatcatcgggtggcgaccagcattcggcgaagcgttcccgacccatgatacacatgaagttgtggtattttctcacttcttctatggcggtttttctcttccaacctcaagattcttccggggtattctgaatttctatgggattagcatgcatcacttgaacccaaactccaaagttcacattgccaattttattcatgcctgcgaagcttttttgggcactaggccacacttcgccttgttccgccgctcttcttcctcaagccccaaccgaacaagagcaaaccatgcgtcgttggggggggctagtttccaacttaggggaactttgagccaaaaatacttctccatgcccttcaaaacctcaaacaaaggctggcatgtgaactggttttatgttcaaaaccctgagcctgcactcccggagtacttatgtctccccccagtttatcaggacacttgtaactcattgcctatgggagatgaagctgctcaagcactggaactgatggagcgcatgataaagctgaaggaacaaggtctgcaaggtgaacagatcactcggcactttatcaagagtcggttagctcctattaaggcgagatctcgtacagccttcgaatttgatggcaagcacgacccaaaccgtgaagatccagattctcttgattttgaggtcatgaaggagagaatgtacaagatcttctcaaatgctatcgtagtcagctactcacacttgctgccggtagtgccgtacaatgtattcaatcctcctccaccggtacatattcaaacatctcaacctccctcaaaagcatgatctcatctcttgttaaattgtttgacattcatgctcaggagttcgcgttgatgaagtcggatcctccaatcgctcagcgccgatcacctcgccttcaaactggtcaggaaagtggaggaccaaagattcggtatgaaacccaaccaaacacctctaatccagccggccagtcagattcccacaagaggaagttagttctgagtgacgacgaaggcgatgatgccagaaaacctgaagataaaggggcgaccggaaaactaccgaagcaagccaatccaaagaagaaaacatccagttgtcctatgccgaaaatcaggaagtcttccaggtacaaatcatataacgatcttccttgtattgatgctcacccatcatgaaaatgatactgatagcacaactcaaacttgtaggaaaccatctgatatagatccttctgggaaagactcttatccgactaacatggagacgggctcctcaaaagaaactgggccgactgcaaaagatcatccgagtgacaatcagccggcaaccgacaatgtagaacccagcaacgaacccccgactggaagccagtcggccgaagctggagccgaagttaaccaggagcccccgactagaaaccagtcggacacagggccaagccaagagatctctgaagttgaagctcaagcaggcagccctcccggaaaggatgccagcaatggcccaggatccagatctcctgtaaaggcacaagagtccactcgtccccgtcgagaaatcatcacaggtaaacacattatctgaaatcattttgatccaacagactttattcgattgtttcacctttattcatggatacattagggccaatgattggtgatgaagaagaaattctccggatacgagcggctgaagattcgcgccctcctattctggtcaagtggtgggataacgatgggatcgtaataaataagcaaaaagaagatgaggaggtatgcctgctgaagaaggcactcagccaggctactcgcattgtaaacgtaagtttcttgacgcccgacctcaaccatctgttcgccatttagctcaagcgctaataaaactgttttgcagaggattcatctcaggaacgaagcaaaaaccgcaaccctggagaaattagttcctcatctcggcacccttgaggccaccagaaatcaactgcacgaagccaaagaacttgccaggaaaactaagcatgatctgagggatcggattgctgaggtccaggaatccaattttgaactgagtggctcatcaaaaggtacacataaactctgtccaactaacttgtgctgctatctttgtaatttcgattaaccggagtcaatatagtgcaagccgccaagatatctcaactggagaaacagattcagactctggagaatgacaaggctgaactagcaagacagagggactcggctttgaaagatgttgaaggtaccagtaatcaatacttcaaaagccatcattttctttatgctgacttattaatgtgaatctgttgatgcagaccgcaagatcaagtcacaagctcaatttgacatcttagtcggcaaaatcaaaaggcttgaaagggctagggatgaagttgctaatgctgctaccccactcgagtacattcgatgctcccgaaatcttcgacaagctgagtgttgctccggattcttatttcaagaatatcaaagaggctgggagtatgggagcgagcctggctttagcgatgaccaagtccctatacccgaagatcgatattgacgctgttgatggctttgcagacgggacaagcgaagaagctgctcttgacctcatcaatgacgcacaaaaagccatcgataaggtagcggttgatgtagttgagagattgcaggacaccgatcttcgaccgactggtcctgataactctgatgatgaaaagactgatactaattgatgtaatttgacaacaatgattctgatgatgatgatggaggcacaatttgtacaatactgatgaatttatgctgtgctcagtatttcaaacctagcttctgatttcttaaaagcttttgtcaaaccttattgaacctaaaacccgcaaaagctattaaaaagctttcagtcctcatggactaatccgaaaaatcaagcaaggcaatgataaatcaagtaagcaaattgaattgataaagatcacactccattattattataatagcccccgactgataacttcaagggggagcttgatgttagcagtcaaaatagggaaatacaaaagtaaaacttaagcataaaaacgatgaagatgttcgatattccaggagttgtcgataggtgtaccgtcttcacgcttgagtcgataggaacctggccaagtgacttctaagattataaatggcccttcccataagggggataacttgtgccgatatcgtgtagtttgaatttttcttagaaccaggtcgccgactaagaaggttcatgatcgaatgttacgattatgatagcgacgcaacccttgcaagtatcgggccgactgaattaaggttgcttcgcgggcctcttccagtcggtgtagatcatccactcggtcttctttgtagcgctcctcgcgaaagttacgaaaatgcagagattcaaattccaccttgctaggcaacattgctttggctccataaactaggaagaatggcgactagcccgtagcccgactgggggtggtgcgcaaggaccaaagtacagatggcagctgttccacccatttgccggcatagggattcagtcggtcgggctgcaggaa

SEQ ID NO: 50293 - DNA, 1279 bp, Oryza sativa
gccttgccgacaatggtccgtgcagcagcgtgattgccacaaataccagaatgtatatccttcaataattgtctcccttcctccaaagacacacagcgttgcaggattcctgatggacttttcttgtacagctcggtctcatgaataatataaagcctgctgcgcctggaaatccgctcggcttcatctttatcttgggggagttcttggttggttagaaatcgtataaggggctctctccagtcggcttcaaccatagctatgtcttgagtgtccgtggcctcaactatttctttccttggtacggttggttcgtaaagatgttcgacgaatttgtcggaaggagctgcttcgcgtttggatccaaaatgtgctagtctgtcggctgcttcgttattgtgccgaagaacgtaagtgagttcgagtccatcgaacttatcttccaacttgcgtacctcttgccgataggcggtcatgttatcatcaaggctggaccactctttcataacttgattaacaaccaactgtgaatctccacgaactatcaaacgcctaattcccaaagagattgcaatccgtagtccgtgaataagcgcctcgtattctgccacattgtgagatgcagaaaaatgtatccacaacacgtaacttagtctttctccaatcggggaaattaaaacaaccccaacaccagtgcccgaaaatctcttcgacccgtcaaagtgcatagtccaatactccatcttctcatcgggcgttgttgacagaaaacacgaggccgttaacaggcgtatcctcttggcactcggcgacgaaatcggctaaagcttgggacttgatcgaagttcgcggcttgaacgatatatccaaggacatcagttctaaggcccattttgtgatccgcccgtttgctttgtgattatgaagtatatcgtcgagcggaaacgatgtaaccaccgtgaccgagtgaccctggaagtagtgagataatttcctgacggtaattagaacaccatataacagcttctgaacttgaggatatcttgtcttggagtcggccaaaacctcgctaacgaagtagattggtcgctggactctctgaacatggccttcttcttcacgctcgacaaccaataccgtgctcacaacctgagaagttgccgatacgtacagtactagcggctcttgcggatgtggtgaggccaaaattggtggagtggtgagaagtttcttgaagtcttcaaaggctttctgtgctttgggtccccactggaaattg

SEQ ID NO: 50294 - DNA, 15618 bp, Oryza sativa
acacatgcgccattgcccggtcttcttccgaactaaaactgggttagccagccagtcgggatgaaggacttctttgatgaagcctgctactaatagcttggtcaattcctccttgatcgcgtccttcctgtcttgtgcgaagcggcggagtcgttgtttgatgggtttagcgtcttccttaacatgcaaagagtgctcaatcacctctctgggaataccaggcatatcggatggttttcacgcaaagatatctttattattttgaagaaaggtgatgagcgcgctttcctatttacaatctaactcggggcctattacagcagttttagtaggatcagaaggatctagaggaattttcttggtcttggcttcgctttctccactctttgagatcttggttgaaggcacttctccttcacttgccatggttgcagccagtcggatgtcttctcgggcgatcgcgatctcgcgggtttgggccatctcgcagctttccttgtcgcatgtgacggcttgtttgatgtcgctccgtagggatatgactcctcgaggacaaggcatcttcatcatcatgtaggtgtagtgcggaacggccataaatttggcaaacgccgggcgcccgggtatggcatgatacgctgtctcgaagtcagcaacctcgaagcagacgttctctgtgcggaagttctcccgagtaccaaaggtgaccggaagagtaatctggccgagtcgcgtggcggatagccctgggatgactccgtggaagggcgcattactcggcttcaactcggtgcgagggatctgcatgtgatgtgaccatggctactatggatacaaccattgctcacatcatggatgaacaagatgatatcaagatcaagtcctccaagtgctggaatcagattcagccacctgctacactgctgacttcaaatggccgccgaatctgcatacgacctccgtttttggcccatgagtacttgatggaaagctctcggagtcctctttccaacggatctagcatcatcgccaaattccatccaagtcatccatagatgaagaaacaaggtgctgcgtcacctgtcatgagcctgtgggcttgtaacttcatttgggacccggcccaggtggggcccatgtggggtgcgccccaagctggtggagcacgaccctaggcacccctaggtcgtcctcccacccctatatatagctagttaccccttcagggtttctcgggttttgatagattaaagtttagccattgctacttgcttgcagcgcgcgtgtcggctagaccgtccgtctgcttgttcttcggaaccccaacatatcatttgtattaaattcctatttgcaatatcagattgcttttatcttgttcttgcttgtttcttcaatttgcttgcaggaatagggttgatctgcaccggcaagatcaacaatccacggagaggtgtatcgatcgctaaggcgcaacacaatgtctcgtatggttgtagtcggatcgtcaacgtttctcccaaatcgtagttatcataactcaccgaaagatcgggccaacaacagccttgagtgtcgagaggaactcaaggttcatcaggtggtatcagagctttcattgctcggtgagttttaatctacccataactagaaaattgccatgaaaaaattgtgccattgcattgtttttatcagtttttgctttgttgagttttgtgttacatcgtcgagtcgagttgctggtgttagcgtctagttcgtttacagatacagtcgtcgtcacctccgtgtatctgttgtcgtcgggacctacgaaaacggaatcggctcgctgccacgattctatttttgtagttttcaaaagtttttaccggttggtttttgcagttgttgagttgcatcttgggtttgctgaccgccgtgcttctgttttggccgtgcctgtgtcgtgcacgagaggaggaaggtgaattaccatatctgattttggaagtagtcaagtttgttttggaaagatatagtagattggattgattaaaaatcagtttcctttttatcccatacaccaaattcggctgccatccactccacctcctggccgactcccactcgcccctttggccgagtccgactccctccctccctttcacagttccgagttttgtgaaacaccttggtgaatttttatttggtgtcggtttcgagatctatttggaaaaacagaaccggcataaattcagcattccatttttgtataattttaattttgggtttagacttttacatttgtgtccctataatttttatatttacgtttgagtccctgtagcgttacattgacgtccttgaatctgtttttgtaaaaaaaatcaaaaaaaaagaaagaaaaaaaaaggcagaaaggtgcaaaaaaaaaaagcaaagaaaagccgcaccctaaaaaaaagaaaagaaaaggaaaggaaaaaaagaaagaagaaagaaagaaaagagaaaatattgttatgtttgagctgaacttcatatatgagagttgtgcatgagttgttcctagtgctatcttatcgtattgtttgtgtctaggctcgcgtctctagtacgttctagcctaggaccagcacgatacttgactttgaaccattattcaactttgcattctctgatttgaaccattgctttcctttgctacatattttaagcctacccagagctctacagatttgattgtagccgtacagcaagtgcttgccaaggcatcgatacatccaacctccattggggtgcttggttgagtcggtgtatgtcaccttttcgcttgcattggtaagaacttgtaagagcttggttaaaagcttgagtgtgtttgatatttgagctgccactacttagtagttgataggagcgtgcatatatttgtgtatgtttcttgtttgctactaaccatggcaggattgcgaaaggggaaacgagatggtcatgctcaacatcgacttcttcaccatcaacgagatatattgtcttcttcacgctttgcatacaaggtacatgataacgatcttgcaagtgtagaatctaatttgcctgtttttgatggtaattatgattccgccgctaatgttaattgggagctagcagtagacaaacaatttgatgagtatgatttctctaatgctcaaatgattaaggctgctagtaataagtgtactggttctgcatcttcttggtggtatactgttggcaataagcttgaaacttgggatgaatgcaaaacaatgatgagaaaaaattttgtgttttcatattataaacgtactctccttgagaaattagaacatctaaaacaaggtgacaaaaccgtgcgggagtactttcatgactttaaaatttgtatcacttatagtggtttaaaagaaagcaatgagaacacaatgactagattttttagagggcttaattctgatattcagactgggcttattaatgtgacatataatcatataggccatttgttgacgattgcttgcagtgttgagagcaatattttaaagaacccaagggagaaataagctatgcttgtgcctcctattactgacactttgcagggagctcagaacattcaccatgaggagaagagcaatatgctcgagatgtcatctccatcactcacgaaggaagaagagaagactgatgcacctacattatctgaagagggcataaaaggtaaattaaatggtgctggtattactcaaggtgagtgtgcttctgatgagtcacatttgtccactatccatgctaatctagagcaaattttggtggaaactacttctgatttgcctttgtcacaagttgatttacttgctgttccttgtgataaagaagagttgtgtgataatgcttcacttatatccctaccacaactagtgaatgaacatgctatttctagtgtttctttgtgtgccgattttaagcatgttgttcacattgctaatgatgtacaggaacgtgaattgctatcttctttaaatattttgggctatgttcagtttgatgatttttgtgagctcgataatttgaagaagaaattatttgctaagtctgatttgccttgtccaactagtgctatttttcatatatttggtgaatctgatgatagaggaatatatttggtgcatagagtttacatatgttcagattttgaacctcctatacatatggataaaacatgcaagctagagagaaatgttattgctaacaaaattatcttgagtttgtcttgttttgatttgatgaaacaggttgttttaaatcgaccacgcgttgagcaccatatggaaaaaccgaggacggttttccgtgaagaaggggaggatgatgtgaccatggctactatggatacaaccattgctcacatcatggatgaacaagatgatatcaagatcaagtcctccaagtgctggaatcagattcggccacctgctacactgctgacttcaaatggccgctgaatctgcatacgacctccgttttcggcccatgagtacttgatggaaagctctcggagtcctctttccaacggatctggcatcatcgccaaattccatccaagtcatccacagatgaagaaacaaggtgctgcgtcacctgtcatgagcctgtgggcttgtaacttcatttgggaccccgacccaggtggggcccatgtggggtgcgccctaagctggtggagcacgaccctaggcacccctaggtcatcctcccacccctatatatagctagttaccccttcagggtttctccggttttgatagattaaagtttagccattgctacttgcttgcagcgcgcgtgtcggctagaccgtctgtctgcttgttcttcggaaccccaacttatcatttgtaataaattcctatttgcaatatcatattgcttttatcttgttcttgcttgtttcttcaatttgcttgcaggaatagggttgatctgcaccggcaagatcaacaatccacggagaggtgtatcgatcgctaaggcgcaacacaacggcttgtacagttgtagtcggatcgtcaacgtttctcccaaatcgtagttatcacaactcaccgaaagatcgggccaacaataaccttgagtgttgagaggaactcagggttcatcagcatgtcgtccagggtcttgtcgaagaggatattgagtgcgctgccgccatcgatgagggatctgcgaagcttgacattgcgaaccactgggtctagtaccagggggtacccccccgggtggaccactcggtctggacgatccgagcggtcaaacttgattgttgtctctgaccaccgaagatattggggcgtatcgggctgaacagcgttgatctcccattcagtcagcttttgctttcttttagactcgtaagccagagggccaccaaagatgtgattgagttccttgcgatggtcttgaaaacctgtcgaggcatcatcattatcatccttctttttcgacgtgctttgatctccatcggaggtcttccgtgcattcttggcatattgctccgcaaactgtttgtagacgaagcaatctttagctgtatgattggagttgggatgatgcggacattgggagttcatgatcttgtcaaaagtgttgacgcgcgaacgttgtcgggaggtgtgtgtagtagtcgcaccaagttcctcgggcttactcttgcggtccttgtgattgttacttccaccccctcccatagtcggcgcatctttctttggcttccaggtgggacccgactgcttggatgcgataatggcgtcttcggctttggcatactcgttggctttttcaaacatctgtttgaccgtcttgggaggcttgcgcccgaacttaccgactagatcttcgtgacgaatccccttggtgaaagcagcgatgatgacatcgtcggtaatgtcagagatcttgttgcgttgttcagagaagcgtcagatgtaatctcgaagggattctccagacttctgaatgacgttgtagagatcaaactgtgtgccagggcgttcaaaggtgccctggaagttggcgatgaagtggtcatgaagttccgcccatgatccgattgtgccacagggtaaccaatgaagccaggaccgggcagaatccgctagggccacaggtaagtagtttgccatggccttgctgtctcctcctgctgcgcggattgcgagaccgtagacggtaagccaagactccggattagtggtgccgtcatacttcttgattccagtcggcttgaagccgggctggccaatccactcgacgcaggtcgttagtaaaggcagctactccatccacgtcgtcgtcgtagcgatccggtgaatggcgatgggcatggcctcgtgctgcatggcgctggttgattgtatcacgaagatcgacagggcgcctacaaggtggggagcgaggctgttcaactcggcgctccctgtgtcgcttaggaggcgagtgaaccgatcgctcgttgtggcccctgctcctgcgattggatcctgcgccggcgatgctgaggcttggctggtgataatcttgagatcgaagatgggggacccggctgccagtcggcgtgcggacgcttctggagttaaccgggaccgaggcagcaatcatggtcttggtctggttcaagatgttgacgacgtggtcagcttggttgagtgcgtcttccttgaggatggtgtcgaggagggtgatcgccgcaacagcgttctgttgagggctacagaagaccgccgtcccctcaacgtcttgctgcccgatgagatctcgcgctcgtcgccctgcgtccaaggctcgttgtcgtcggtcctcggcctcctttgtagcccgttcgtgttcctgttgctcacactgcagccgttcttgctcttgtgcttggcgctcctcttccagtcggcgtcgctcggcctcctgttgtacgcgtcgtgcttctgtttctcgggcttggcgttgttcttccgtctcgttatcggccatgaagacgtcgaaatagagaggggtgtagttatcttcaaagctttcgtcgaagtcgtcgaggtcgcggttgtcgtagcggtagccgaattcgtcatactctatgatctctgttggtcgtgagtcgacgccgggggagctgaagtagctttccaattgatccgtcgaaaccgtgccgagtggctggagtatgacgctgacttccttggagctaggctggatcggtgttgaagccgaattctgcctaggcctacggggagaagacgtccttttagtgaaggtccactttgcaatccgtccatttgcttcgcgattatgaagtatgtcactgagtgggaacggtgtgaccaccgtgaccaagtgaccttgaaaatagtgggataatttcctgacggtaattaaaacaccatataacaacttttgcacgtgaggatatcatgtcttggagttggccaaaacctcgctgacgaagtaaattggtcgctggactttttggacatggccatcttcttcacgctcgacaaccaggaccgtgctcacaacttgagaagtcgccgacacatacagcaacagcggctcttgcgggtgtggtgaagctaagatcgggggagttgtgaaagtttcttgaagtcttcgaaggatttctaagcttcgggtccccactagaaattgtcgattttctttagcaacttgaaaaagggcatcccctgctcaccgagtcgtgagacaaaccggctgagcgccgccatgcatccagttagcttttggacgtatttctgagaacttggcggtttcatgttgaggatggcattgatattctccgggttggcttatatgcccctatgggacaccataaagccaagcagcttccctaacggtactccgaagattcattttttaggattcaatttcatcctgaaggcgcagatgcttgcaaaggtctcttctagatctgtaatcaaatcatccttttgcttggtcttgacaactacttcatcaatgtaagtctcaacgttgcgaccaatctgagttgaaaaacacctctggatcatgtgttgataagttgctcctgcgttcttcaatccaaaaggtatggtgatgtagcagtaagccccgaaaggcgtgatgaatgaagtcttcaagcagtcgaactcatttaagcggatctgatgataccctaagtagcaatccagaaaactgagtagctcacagccggccgttgagtcaactacctagtcaatgcgaggtaacccgaagggatctttaggacaatatttgttgaggtcagtgtaatcaacacacatacgacattgtcctgtcttcttccgaaccaggactgggtttaccagccagtcgggatgtaggacttccttgatgaagcctgctgctagcagcttggtcaattcctccttgatggcatccttcctatcctatgcaaaacggcggagtcgctgattaatgggtttagcatcttccttaacatgtaaatagtgctcaatcacctccctaggaataccaggcatatcagatggtttccacgcaaaaatatctttattattttgaagaaaggtgatgagcgctttcctatttacaatctaactcggcgcctattacaacagtcttagtgggacagagggatctagagggattttcttggttttggcatcgctttctccgctctttggtaacttgggtgcaggcacttctccttcggttgctgttgatgcagccagtcggatctcctcttgagcgagcgtgatctcgcgtgtttgggccatctcgtagctttccttatcgcagctgacgacctgcttgatgtcgctccgcagagatatgactcctcgaggtcctagaatcttaatcatcatgtaggtatagtgtgggacggccataaacttggctaacgccggccatccgagtatagcaaggtacgctgtctcgaaatcagcaacttcgaagcaaatgttctctgtgcgaaagttctcccgagtgccgaaggtaaccggcaaagtgatctggccgagcggagtagaagatagcccggggatgactctgtgaaagggcgcagtactcggcttcagctcggtccaagggatctgcatgtcatccagagtcatggcgaaaaggatattgagtgcgctgccaccatcgatgagagatcgttggagcttgacgttgcgaaccactgggtctagtaccagggggtaccaccccggatggaccactcggtcaggatgaaccgagcggtcaaacttgatagctgtctctgaccaccgaagatgttggggcgtatcgggctaaacagcattgatctcccgttcagtcagcttttgctttcgtttggattcgtaagccaggggcccaccaaagatgtggttgagttcgttacgggagtcttaaaaaccagtcggggcatcgtcttcatcatccttcttcttcgacgtgctttgatctccgtcagtcagcttccgtgcgttcttggcatattgctctgcgaactgtttgtagacgaagcaatctttggccgtgtgattttaattcagatgacgtgggcattgggagttcatgatcttgctgaaggtgttgacgcgtgaacgttgtcgggaggatggtgtagtagttgccacaatttcttcgggcttacgcttgcgatccttgcgattggcacttccactcccccctgtagtcggcgcatctttctttggtttccaggtgctgcccgactgcttggatgcagtgacagcgtcttctgctttggcgtactcattggccttttcaaacatttgcttgactgtcttgagaggcttgtgtccaaacttgccgactaagagttcatggcaaatacccttagtgaaggtggcgatgataatgtcgtcggtgatgtctgagatcttgttacgttgttcagagaaacgtcggatgtaatctcggagagattctccggacttctggataacgttgtaaagatcaaactaggtaccagggcattcaaaagtgccctggaagttggcgatgaagtggtcgcgaagcactgcccaagatcgaatcgtgccatggggtaacccgtgaagccaggaccaggcagagtctgctagggccactggtagataattagccatggctttgctatctcctcctactgcgtgaattgcaaaactgtagacggtgacccaagactcgggatttttcatgccttcgtacttctcgattccagtcggtttgaagctggttggccaatccactcgacgcaagtcacttgtgaaggcaacaactccatccacatcgtcgtcgtaacgatctggtgaatgatgggggatgtggcctctcaccgcacgacgctggttgatagtatcgcgaagatcgacgggacgcctgcgacgtggagagcggggctgttcagcctaacgctccctgtgtcggtcggcaggcgagtgaatagatcgttcaccatggtccctgttcctgcgactagatcccgcgccggcaacgctgaggcttggttgatgatagtcttgagatcgaagaggcggaactcggctgccagtcggcgtacggacacttgaggcgttgactgggaccgaggcggcgatcatggtcttggtctggtttaagatgttgacgacgtgattgggtgcgtcttccttaagtagagtgtcaagaagggtgatcgctgctatcgcgttctgctgcggggtgtgaaaaaccgccgtcccttcaacgtcttgttgtctgataagttctcgtgctcgtcgcccagcctccacggcgcactgttgccggtcctcagcctccttcacggctcgttcacgctcctgttgctcacgctgcagccggtctcgctcttgtgcttgacgctcctcctccagtcggcgacgctcggcttcttgtcgcgtgcgcagttcttctgtttctcgggcttgacgctgttcttccgtctcgttgtcagccatgaaaacgccgaagaagagaggcgtgtagctgttttcgtagccttcttcgaagtcgtcgaggttgttctagtcgtagtggtagccgaagtcgtcgtactcgaggatctccgtcggtcgagaatcaacaccaggggagctgaggtagccatccaattcttccgtcgaaactgtcccaagaggttggagtatgacgccgacatccctggagcaagactggattggggccgaggccggatcccgtctaggcctacagggagaagacgcccttgtggtgaagacagcagccaaatcgtcggggaggttcatcaggattgagggataggccccatcgtcttgatcaagtcgtgtcggagtagattgaatctcgtccgagtggtttgaagccgactcggttgagatgatcttggagtagatctcggccgagttcgggataccgaacggggcggagacctggcctctccctgactggttcgaatctgagtcgaggagagaaatcttgccgaagtcgttggtgatgaagtcgaggttgcccaaccggaatgcctgcccgggagggaagacgaagtcattgatatcggagacgaaacccatcgcactagtcagcgatgaacttgacgctacccctacctggtgcgccaactgtcgaaacaagatttcggcaatactaaaagggggtggctatcaagatggaaaagtggatgggtttagagacaaagaattttatacaggttcaggccttcttaataagatgtaataccctactcctgtccggggattgatccgccgagtgtattattgatcgtatgatctgggagaaaaatcgtgtcccaagaggcacccggacccctccttatataggggaaggggtccgtattacaaagtacaacccatatctctaacggaataggtagttacagataagatacaatcgtaacctactagaatcccgggtgcttccttgatatacaagtttagacatttaacccgaaaccttttaaagatattctatctatacatagtacccccatactaagtcgaatatacatgccgtgtgggtatggggtatccataatatccacatataaatcaagaaatccaaaaatagaaactctaactcttatccaccgccgtcttcgctcccgtgcctaggaaccgtcgttgtttctacggtagtgctcggagcacgtgatcaccaccgctccaaaggctgccatggtcgttagtggtcactccctttccgagcggccgcggatccaccacttccgagctggaggaacacggcggctgatatgccattcttgaaactgctgcttactcaaggccgccgtcgtcgtccccgcagttccggtggcaaaccacccctccctagggcagcaatgccggatccgccgctcttgaggatatcgttgtcatcctagttgtcgccattgtcatcacatcttctcgtagcgctagatccgatgcctccactgccattagatcgagccatcgtggagctgccactgccggatcatcacatcggggatccaacgatggcggatccactcgtcaagcagccagcgccggtcctatcaccgccctctcctaccacatgttcctcctgaggcctctggtggctggttgtcgaggagtggtgagataaagggaggagacgaaatgagaggagatgaggaaggagagactaaggagaggaaaataaaggagactgtgagaaaaaaggggaagaacatgagagaaaaggagaggaagagatggatttgtggccacatacgaatgcagtctctggcttcttagcaggaccatatgtgaaaattgattttcctaatatgtcgttactggatactgtatccattatagcctgtttgtaaaaataaatgaggcatctaagaaaaaaatcatttttagtaatgcgcccagcaggttgagcactcttaaacacatgtatccctctatttcaaaataaaggaccagaattccattaattactataaaagttatattggtgggtgatagataagggtatttaagggttaaaatttctcaaactgtggatcgatagtaagtaagaatataggtgttgaagcccgaactcctctagtggagagaaaggacacccctttcggtttcgaccaaggtacttgtgtcatagtaagggcttgtttagttgacaaaaaaaaattacccctgcatgttacatccgttatacggacacacatttgaagtattaaacgtagtctaataacaaaataaattatagattataccaagaaactgcgaggcgaatttattaagcctaattaatccaccattagcaaatgtttactgtagcactacattgtcaaatcatggcgtaattaggcttaaaagattcatctcgcaatttcttggtgaactgtgtaattggttttttctacatttaatactctatacatgtgtccaaacatttcacgtgacattgtgaaaaaatttgtttgggaactagacaaaccctaactgttgatgttgcggacagcagaagcaaagtcgggcatacgatgtactgtatcatagtaactgtatcttggagcggatcaggaatgagaactctatttcttgaagtatgatgagctagaactagggccatcaatgatagtggggccagcagctgatggggccacaacttgcaaatgtacaacggatctcgaaaagtttcgtcccgatagtttaaaaatggataataggtcattcagcgtatcattaacaaaataataataacagcaaaataataataacttatatataaaacttttatatatgtattttagtgacttaaaataccaatactgaaaaataaacttcgatgaacaaacttcaaatattatatttaagttttaaaatttaaattttagcggcgactaatgctgtatggagaaaacgatggggcctttcttctccagaaagttttatttttgttgttgaatggccgaattgttacaaaatagttcggaacagaacaatatatttttgtaggaaaaatacacagggaatgtgcaaaatttactaaacagacaatatgtttccgttgaacaaaggtagtttgttaactttttttctaagagaaacattagtgtgccgtcggtgtgttttgaccacagaaactgaatgaaatatttagttcgataactgcagcgtataatcgattttggtgggacccacaaaaataaatctcaatcccacctctatccactcctctcctctcgcgaccagccggaaaattccgcatgcgcacgttctcgttttccctcgttccccttcctttgccctctccctgcccaaacattccaaagctccaatccggtgataatctctccctgcccaaacattccaaagctccaatccggtgataatctagaaattaacccatggaggagagcagatcaggtcaaccagctatggatccaactagatcggatccttcgcggtgctcgtgtggctcgtgctcgtgctcatgtgggctgttgcacatgatgccatggaatcagtatgccgccgcatacggcgccgctgcaagctggctccagcggttgtgttggcgagtttgcttctcgttggcacggtcgtgcatcaacgaggtcatggagcgcaggtaggaaatggcaccctgggggatgcgtattgagggcctcaacaaacaacaccttgatccactaccaccgtcggttaaaactaattttgagtattataggagataagctcccgagtcccaccagtgctataaatagaagaaccgtagagaggagtgaatgctctaatctctcgccaaaccctaaagccgtgacgctatctcagccaacggcgtgaagaaggaaagcaaagccgaaggaagaagaagaaaaggcaagaagaaaaacagaggaatcaatttcaatggcttctagtgcaggtcagtagattaatttgtaattcgagtaaatgtaattgcttataagctaaagtaataagatcctgtaatttagaactccaacattgtggtatcagagctgatcttttacctaatccatccttcataatctcatcatccctgcctaagccatatttgcctttattttaaaccgagaagtggttcagcttgatgaatctttaagtgatatgagtccaattaaggttttaagctctactgttgttgcattctaattttattttgtcgagcagtagaggaaagatggaaggaggggataaactagattgaaattcctcaaaaccgtgtcactaaatttgtggagactagacacgctatcttcttagaaaataataaagtagggaactcaaaagataaggagagtaatcttgaagaaatccgggctaatgctccaatactggaaatccgagagactaatattccaatttttcaagctgtgccacagaatgtagtgccgccaacaacgggtaattctagaccctcttgctctaaaactactgtcggagggtaaactccttgagcggggcactgtggggacccccttcctcgttcgaaccagggacacgggtgaggctttgagagtcgatgttggaagatgcagaggggtcgggcccctcgggaatgatggagacacaagcgatttagacaggtttggaccgctgtagaagtgtaataccctactcctgtatg

SEQ ID NO: 50295 - DNA, 1254 bp, Oryza sativa
tccaattaataattgcatttattaattagggattcaactctaggttaattagaacaatttctccggacgatttacttaacaaatttttaaagcaaggaaaaggttgaaactttagggcgtgacactctgtctctcaagggccgccccgccctccttccccttggcccaactcccctcccctccccctcccgggccgcctccgcccatccgcccggcccaagccaggccgagtccctcccgcgcacgtgcgctgtgtgcgctgaccgcgtgctagcaggaggggcccacgcgctggcaggaggggcccacgcgcggtagtcttcctcctctagccggccgttccgctctgtccctctcccgaaccatagccacctccccatcaccttcctctctctcctgtgctgacggtcaactccggccgcccctgccgcagtgcctgtgcgccggccggccgcgccgtgttctcgctcggcctcacaggtgcatcatcttccctggcgccgcctccgattcgtggggaaatcgccggagacgcgtccccgccggcttgcagtggcattgccgctactataccatctccaaccatccctgccacctcgcctgagtgcaggccgacgtcgctgccacctctgtcggtgctgcagcgccatcctcttctccggcccggctgcggcgtcgcccgaagttcgctgaaacgccgccgccgcgccaaccgcccgttcctccttgccggctcgtcgccccgctgcaccaccaccttctccaacatcgcaatggcgtgttccacgccgtcccctactccggcattgcagcggtgatgtcgtcctcggcatcgcctccccttcggccgaacccgccggcgtttgtcgtcgcctcctcaccggttcccaccgtcgtcctctcgtcgttcccggtcgtcgtggtgttcgtccctctgtcaagccattctcgttcgtcatcctcgctccatcaagtgccacagccccgtcgtcatcttcgtcctcgcctccgcgtcgtcaagcattgcaccggccgcgtcttgccttcgtgcaaggatcgccgccgaagtcgttccctcgctgttcgcctccgtcgtccctgagccgtctccgccgtgcccgttcgtcatcatcgtgccacacctcgtcgcatggtggtaagggtctctcctctcgctgccccgccctcgtcctttcgatgtcgcccctgcccgttgtgcgggtgtcgatcccgctacccgtgtaccggtgtcgg

SEQ ID NO: 50296 - DNA, 4086 bp, Oryza sativa
  unsure (1)..(4086): unsure at all n locations
ataacagcattaaactaaagaaccatgtgcttcctttttatgtattgttactgcttctttataggcttgtagctttgcttgtgtgcttcgtgtagcttctgtcgttccagaggttcctgaagcgtggttcgtggtcgtcgccgaatgttcggaaggccattctctctgagcaaggcaagtcacatcatccttgagcatattgaatcccagtttataaaattattttgatttaaattaatgcattatctctttatttaaattcctgcgttatcactgttttatttagccatgcctatttacctttgttatgaccttattattatttctattgttattattaccttgttcaccctaggataaacaaaaccccaactagtgggtactctatttatggttccactagtatgaacttaggtagatgcttcgctgattaattaggcaacattaggtggttttataactttagactttgggaattctcatatcatttagacactatggactggttgccttatgttggaattggacacacacctccccctctattcaaaacccccaaaatggttttagcctgggctcgaggtgcgtggttgggttttgttagtcgtacctcgggtactataaggattaagctcaggcctctattgcaaagcactaccatacttccacatgtctagtgggtaaggctaagtttgtggctcagtttggtcataaacaaaggtacacggatggagatggacgaagtcggggctcgatggacatctctaggacaaatgaaggctacacgagctgcggctcggtagttgagatgtcatggcacagggccggtgttctgctgctaggggctcaatcctacctacctgtctcgggggttccagccgtaggcggggttgggtcggtactcttgtctatggctaggatgggttgggaactatgtcacatcgtccgtccgtatgccgtggtggtatgtggcacgtggttacacgtgaggaagacgtgtcttgtgggtaatgatgtacacctctgatcagagtataatctatgcgaatagccgcgccctcggttatgggcaagcctagcaatgtactcaagttagtgttttaattcttaaaaccgcttaacaactaaaatgtgaaatggttgggctgggttggcttgggacgagctgggacctgggtctggtggctagttcggtctgaatcatcgtaggccttgggttaaggcaggttcgtgtgggttcacagccttgattaataacattgtgtagctctagaatcatctttacaaaatagctttgggcaatgaagtaacttttaaatgttgtttactgcaaaacttaacccctattattatccccttgtacccccttgcattaatcatgcatctgccggtgtggcttgctgagtattgtggttgtactcattcttgctctatctttacccccttcagtaagagaagctttggagaagaagtcgtaggtggagtcctggcttataccctagttgagcgcctgtgaagatggaaccgtcggcccgctagtccgctgctgattatttctgtttgtcaggccttaagtgcctttgtaataatgtaaatattatcgatataataaagatgtgccttttgtatcatgtttgtttggtgtaccccagcttttcctgggacggggattaatacactagcgttctggaaaaggtatttttccgggcgcgacagtcaccgaattgggaaggaccgtttcaaatccataaggttgtgtccaaaggagtttatatgttacaaggacttgatggaaaagtttatggacgagcacttaatggcaagtacttgaagagatattacccaagtgtttgggttaatgcatgatcggttgggtgttgccgatgcatgatagccgatgtgtttacatcgccttgagatggccgatatagttatatcgcccttagttgttttactatcataatcggttgtgttttgccaatgtatgacggccgatatagttatatcgcccttagttgttttattatcataatcggttgtgttctgccgatgtatgatggtcgatatttaatatatcgcccttagtccaaattataattttatcgatgccttcatcattgcaaaattaggggggcacatatatacaaaagttgagaattatcggcagaaaggttcagtgataatcaaaaggagtaccaaagtttcttagccgattacaaaaattttctaagtcctattacaaagataatcatctagacaagttacgctggattgccgatacagcccgttggctaatttgatctacttcttcaatagcttggatatcttgggcgtcggttccaggaatgaccttgagagactggtcaatcggcccgttcctgatagccattttagctgacttgttcttcgacgccttgggatantcagttnnaacttctatcnntgctcaagagccatttcggcgttgcattcctctagttgagctatgagatctattctgcgagcctcaagccgatctattttagtttgaattggcccaaccaagagttgatctagcttagctttctcttcatgaacggtttgccgattggtttgaatagtggcttcaatatcccttcgctctcgccgatcggctatcctttgcttggccttttctaccttgaattgatgttgctcgaggtatacagctggagaaatggtatttgccagatcattcgggattagggattgaatctctgcaaatcttgcccggattgtaccgcagtcaaccaccaagttgtctaatgatgtctctagccgatgagatatgtcttcaagagttcttttgacatcgtcatctagagggactagagttttgcttgttattttttcttctacctcttcatcaaagtaatccttgatgtcaaacaagaacagatcggctaaagcctacaaaaggaaaattgaagacagttaaatttcaaagcgaattatatagccgatctaagatttatgacaatgaaagacttactggtatggcaggagcagctcgttgttcttcctcctcaatattgtggctgcctgcagccgatggagtacgatcactgggcgtcgactgcacaggaggcgaaggaggaggagaaggctgaaaaaaagacaagtgttaattaacatcagttatgatcatatttaaaggattttatagaggaaaccttaccggtggagctggtttagatggtgctggtgctattttttcttgacgacagttttttttttctacaaatacaaaattgataaccaatcaactctgcaagttttttcaggagatgatcaagatgggttatttccccttgagaagtgagctggagcagcaggagttggaggagtctatttgcgtgaagccgatgatgttttttctcctaagtcactcagttcggctgcagcttggtcgacatcttccttaatctcttcttcatctagggcttgttctatggatggatctaaggcaggcaagtcatcggttggcttggatttcttcttcttggcctttctctttggagccagagccgatggattagcggctgatgccttagttttcctattcctactggcatcagctagttctcttagctgcccttggagtagacttgaggtcctgggggcatggtagccgatgacgggggagttagtccacctccatttggtaagaggcctgaagcatactcgatgtccttgccgctgttgcttttgcgaggatgggaagattctattgtctgcaagacagaagatgagactagtaaaggtacaaatcggctgacaattattttacaggattgacaaagtaaggatttacctgagggataacatctgggaatagatctgtcatgtacatggaagctgattggtggaacaagtgctgcttccattcaccccaccatctgtcaaagttcctgctcctgaactttgctagttctacatttttgatgctgcccaaagggggtcctgggatgttcaacagccgatccatcatcaatgttgatgagatttcgcctctaaattgaattttatcggcaaagataaaagccgattggcagctgtcccatccca

SEQ ID NO: 50297 - DNA, 1520 bp, Oryza sativa
  unsure (1)..(1520): unsure at all n locations
caacaggaagaatacatggactgatagcagccaagaagacctctctagacttatcatatctttcagaattgatttcttcaaatctaaagtctgatggcagttcaaagctcattgagtcttcatatgcaaaccaaactcgagcatctttctggaagccctcatagaatctgcagaaccagtctttgagcagttcagccgatagctttgctccagaatcggctggtgttgatgcagcttctccatatgacatgcatctgcgatgggttagtacttccccatcgtcacttgtgatcagttctagtcttggaaattgggactctaacagagctggccgattcacagctttcttggcaactaagttaagccatgtttgcagtaaccacgatggtccacctgcacctactactgagcctgcggctatcttggccgatgcgttgttcaacatctgatacagatagccgaggaggattttgcccaaagggatttgcttctttgcttcaagggcttctgctaggaattgccagttggtagtagggccacaacttgatccacagaaaagaaatttctcaagccacattagtagaaaggctgtgtgctcttggggggtgacagatcctatgcccatgtttgcggcgatatagccagaccagccacctattgtttttgttttaaattcaaactggttcttggaatttagggtcatcagattggccgaataggtgacatctaaaccagtgatcatgatgacatcaagcagagtggggggtcatcggcccttgattgaataggaaggcattgagggtgttggaccagaaatatgttgcagaagccatcaggggttcgtccttagctgaatttgctaaagtaagagcaagggcttggctgattccgagttcatcccagtgaccttgcttgctagccaacacacgcttgtaccatacgggctaacttttctcaggagaacttttctcaagcgaaggccaagacttgaaagtatctttccagtgacctagatttgggttggccaatctgatgctcatgtgataggctaggaatcgcaaccagattggaaagatgctacggataaaaatagagaagaagaaaacaagatgagacaaggaaaaaccaatctattgcataaagaagaagatctagccgatggacacgtacctctgcatactcggctgatggcgctgcgaacgggctggcggaagtcgacatcgctgcgggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50298 - DNA, 1937 bp, Oryza sativa
tgtgcttttggcgtatcggctggtcagtttttgggatttcttgttcatgagagggggattgaggtaactcaaaagagtattaattcaatcaagaagattcaacctctggaggacaagaagaagttgcaggagttgatcggcaagataaattttgttagaagctttatctctaacttatctggaagattagagcgttttacacctttcttgagattgaaagccgatcaagaattcacctggggggcagaagagtagaaggctttgaataatattaaagaaatatcttagttctcctccagttttaatccctccacatgaggggattcctttcagattatatctctcggccggtgagaagtcaatcggctaagttttgattcaggagcttgaagggaaggagagggctgtattttatttgagccacaggctcttggacacagaaacaaggtattctcctgtggaaaagttgtgtttgtgtttgtatttttcttacacaaagttaaggcattatctattgtccaatgaatgcattgtgatatgtaaagccgatgtggttaagtacatgctatcggctccgattttgaaaggtaaggttggaaagtggatatttgctttaacggaatttgatcttcggtatgagtcaacaaaggcgattaagggacaagctatagccgattttattgtggatcatcgtgatgactcaatcggctcagtcgatattgtgccttggactttgttttttgatggatcagtgtgcactcatggttgtggtatcggcttagttataatttcccctcgggggaaagtttcgagtttgcctatactattatgccatatgcaactaacaatcaggctgagtatgaagcagttctcaaggggttgcagttgcttaaggaagttgaggccgatgctgtcgaaattatgggtgattcgttattagtgatcagtcaattggcaggagaatatgaatgcaaaaatgatacattaatggtatacaatgagaagtgccgagagttgatggatggatttcggctggtgattttaaagcatgtatctcgggagcaaaatgttgaagctaataatttggctcaaggggcatcagggtacaagccgatgatgagggatatcaaagtagaagttgccacgataacagccgatgattggaggtatgatgtgtatcaatatttgcagaatctatctcaatcggcttctcagaaattgcattataaagctttgaagtacacattattggatgatgagttgtattatcggatgattgatggggtgttgcttaaatgtctgagtgccgatcaagccatggttgtgatgggtgaggtacatgaaggaatttgtggtactcatcaatcggctgataagatgaagtggctgctttggcgttgtcggagatatgggtccggggatttgcgaagtgtggggaatctaccttcctatcctgctgcgtgtccgtacagcctggccctgcccccgagcacgcgaaccgctggagcagccggggggggtcggggcctcggggtgccacgtcatgcccctcgggcccttgcactgcttcgccccgaggccctcgcctagccaccatttggcggggggagcgagcgaggagggggcccaggctgagcttccattaatacgcgcaacgccccaactgccccgtgtcacatttaatgcagtgaggcagacgtgcggcgtgcgaatctgacgcgccataatcaagaatgaccggtctatgaccggtcatgacaccggtcacgtctgactagaccgacaaccgtactcccacgtcgcgtctgctcccggttgagtgggggtaggtatgacccgtcccatcggagggtcattcggacggcggccaccacaagtcttcatccattaatgggggaatgatagggctgtcccccgtgtcaggcgagggacggcgc

SEQ ID NO: 50299 - DNA, 1197 bp, Oryza sativa
catccacaccacgctaagttttcacccccacccgtcaaaaggcagtgggcggtcccctactgcgccgcggtgaatccggcagctggacaacctgacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccgtccagtgtattttaattagctaacaccattgcggtggcaccaatccaaagctatgctcatagttaaagtctatgtaataatgtgatccctatttgtgtgctagttgagctaagcatggctaagcatttcctaaaccaacatctaatcattttgatacccaggttatcaatggcatatggtaaacaataaatggctgagtaataggacccatcccagatgacattgtaaaagaatgcgacatttaatagaaatgcgggacatttgtagattgggtacaatatgatcaattgtaatgcatgacttgccttactctcgcactgatgagaccacagcaacgtcttcgagaaactgcggatcgacgaaacggccgaaatctacgcgacaaacaaagcacacaagcaaaacatgctataagactactgaaacaggaaacaaaaccatttttaatggattctagggatttttatgaatttactgagacttgaatggacttaaacggagctcggatgaattactaataaagaaaaagtccttaattatttattgcgtaataaatcccaagggctgacgtcacccaaggggggggcgccggcaagcggggtccgcatgtcagtggcacaaggggagagggagggggcgccggctggtggctcaaggggaggggtggtccaccagctggtggggcccaccgggcagcagcacaaggcgggaggggagtggatggtggttcggcacggctcaagccggccgaccatggcaaggcggcagcggccgcaggcggcctccgacgacgaccggcggacggcgaggcggcggcggccggcgtgaaggcgacggcgcacggccggaacagcggcgtggctcggcgctcgcgggaaggggaaggaaaggaggaaaggtgtcctcacc

SEQ ID NO: 50300 - DNA, 701 bp, Oryza sativa
tttttgttaaattgaaggctttgaggaaaggtttgaagaagtggagtaaatctctctctaaacttcaattgttgattaaaaattgtaatgctatcatagcttttttggactccattgaaaacttgagagatctcactgttcttgaatggaactttaaaattcttatcagaaacaagctactgttatacctgaagtataaacaaacttattggcaaaagaggtgtactatcagatgggccaagtttgggggtgagaatacaaaatttttccatgctatggctactgagtcttttagaagaaatgcaataccctctttggtagattcttctggtttagtttgtacaagacatgaggaaaaggctcacatagtgtggagtcctttctcttcaagaatgggttgttctcagtttgagttcatgccttttcagctgcaagaacttttccatgcaaatcaatctctagcttctttggatcaaccctttggtatttctgagttagacaaaattatacataatctgcctatagacagagccccttggcctgatgggtttaatgggatgtttgtgaagaaatgttggccaatcatttgtcaggattattatagacttgcagctgagttctactctagtacactggaccttgatcctttaaaccattcttttatcatcttggttccaaagaaatctgtgccagaaggtata

SEQ ID NO: 50301 - DNA, 1283 bp, Oryza sativa
atttttcagaaaattctcaaatcgtttttgcacgtagatatatgcctattggatcttctggtcgtgtgtctcagtactggattcctaaatttttattatcatctaacccccagtactaaggctttggtggcaaggaaggagaacgtgtggatcgtggatcccggttgttcgcggcacatgaccggtgataaaaattggttctcctccctcaaaaagacatccaaaactgaatcgattatctttggtgatgcgtctacaagtgccgttctggctacaggtttggttaaggtaaatgaaaaatttgaattgaagaatgtagctttggttgaggacttaaagtacaatttgctttcagtttcacaaattgttgatgaagattttgaggttcattttaagaaaactggaagtaaagtttttgattcttgtggtgattctgtgctgaatatttctcgatatggaagagtgtttaaagctgattttgataatcctgtttcacctgtgataacttgtttggttgctaagtttgataaagatgtaatgttttggcatcgtagacttagacatgttggttttggtcatgtcactaggttaagtggtttggatcttgttcatggtttgcctaaacttaagaaagatcttgatttggtttgtacactgtgtcgtcatgctaagatggttgcttcctcacatgctcctattatttctgtgatgacggatacaccaggacagctattacatatggacactgttggtctttttttgtagtgcaatctgttggggaaagtggtatgtgttggttattgttgacgatttttctcgatattcttgggtttttttcattgcaactaaggacgaagcttttcaacactttcgtggtttgtttcttcgattggatcttgaatttcctagttctttgaaaataattcgaagtgataatggtggtgagtttaaaaatgcttcgtttgaacaattttgcaacgaaagagatcttgaacatgaattttcttctcctcgtgttccacaacaaaacggtgttgttgaaaggaaaaatcgtgtattggttgagatggctagaacgatgttggatgagtataaaactcctagaaaattttgggctgaggcgattaacactgcatgctatatttcaaatcgcgttttcttgagatcaaaacttggaaaaactttgatttggacgtcaacccaaagtttcacatttgcgtgtttttggttgaaagtgctttgtcttgaaatctgaaaatttggataagtttgaggcacgttct

SEQ ID NO: 50302 - DNA, 962 bp, Oryza sativa
tttcactttttgagggatcatgttgagaagggagatgttgaattgcagtttttggacacaaagttgcaacttactgatattttcactaaacctttggattctaatcgttttgcttttcttcgtggtggattgggaataattcatccttttggcatgttttgagggggagtttgtacctcatggttttatctagcaaaaatatgtcaatgagaaaaattgagaaaagagagctttgtttatacatgtggtattttcttgtgcatactagcaatactttgaaggtttatttgtctctagcatagcttgtatgtattctagtctttgcatgagatttagattttgcttttaagggagatgatgcatgacacttaaattccatacttgaattaagtaaatatgcaatgttgatgctagcatgtggtttgatttctaaatgctctatatatatgctttattgaattgttattcctgaaatcactttaattgctcattgtgaaaagagaataaaaatatgaaaaaaatgaataccgaatgcttggaaacagtcttgacgacaaggacgtattcgatgtgagcaaaataatgggtgccgaatccatagaaacagtcttgacgacagggacgtacccggaataaaagataaaaatatgagcaaaaaggctcaagaaaagaaaaggttaaaaaattttcttggttgttttgtgctaaaggttatttgagaaagagtgataaatgcaataggtatatgtgttatatgtgtttagtgtttattcttcaacctatgtgcttgttaagatgtttcattataaatcatttgaaatcatgaattttgattgttgattcaagcttaattgtaaaatctttggttcatgtttatactttattgcatgcttgctatattatagataggttcatcttctttttatcgcaacacaagacatgatatgctatatgtatgctaa

SEQ ID NO: 50303 - DNA, 1888 bp, Oryza sativa
tgcatcagccttctcctcattcgcgagtgatggaagtgacatctcaaacatatcgttcttctcattttggggactgttctgaacttcctgcaaaatatcagtgataggaggcacaagcatagcttgttgctccattgggttttccaaaattttgcgctcaacattgcaagcaagcatgaacaattggcctatatgattatatgtcacattaacaagcccagcctgaatattggaattaagccctctgaaaaatctagtcattgtgttctcattagattcttgtaaaccactataagtgatacaaattttaaaatcatgaaagtactccctaacagttttgtcaccttgttttagatgttcaaatttttcaaagagagcacgtctatagtatgaaaatacaaatctttttctcatcagtattttgtattcatcccaagtgtcaagcttatttcccacagtatgccacaaaaaagatgcagaaccggtacacttattactagcagccttaatcatttgagcattagaaaaatcatactcatcaaattgtttgtctactgctagctcccaattaacgtaagcggcagaatcatacttaccatcaaaaactggcaaattagattctacccttgcaagatcattatcatgtaccttatatgcgccatgtggatcacctgccatttgttgtcgaagatgaacaagtcgatgatctgttattcccttgcgcaatcctgtcatggttagtagcaaacaagaaatacacaagaatatgcacgctcctatcaactactaggtagtggtagctgaaatatcacacacactcaagcttttcaccaagctcttacaagttcttactaaagcaagcggaatggtgacgtacaccgactcaaccaagcaccccaatggaggttggatgtatcgatgccttggcaaacacttgctgtacagctgcaatcaaatctgtggagctctaggtaggcttaaatatgtagcaaaggaatagcaaatgctcaatgcagagaatgcaaagttgaatgatcgttcaaagtcatgtaccgtgctggtcctaggctagaacgtactagagacgcgagcctagacacaaacgataccacaagatataaacactaaagcacaactctgatatatgaaagcaaactcaaagatacaactgatttttctcttttccttctttcttctttcttttttttctttgttttcgttttcttttcttttttttggtgcggcttttcttttctttgtttctatgcacctttctgcctttttctctttcttttttttgattttttttacaaaaacagacttaaggacctcaacgtaaggttagagggactcaaatgcaaaagagaaaacccataaataaaattaaaactatacaaaaatagagtgctctcgtcccataggctccatttttgcaaacagatttccaatccgatactccaacaattttcacatagctatgtgagaagtcacggtgtagatcaaaaccgagagaaaaaaagagggagggagtcagactcgggagagggggagggaagccacacgcaggggggtgggaatcagctaaaaatctgcaaatcacgcatggaaggaaacaaagtccaaaaaccgatctgctatcatttctttctccttaaccgcgcgcaacagatcttcgtcctcacatgaacagaacaagcacggccgaatgcagacggcaaaccccatatgcaacttcagcaactacaagaccgaccgacaaaaacttctgaaaactagaaaaatgaaaccctgacaacaagacgattccgttttcctaggtcccggcgacaacaaacacacggcggtggcggcgacagtggtacgaaacctgaccagaacttgaaactct

SEQ ID NO: 50304 - DNA, 1296 bp, Oryza sativa
ttcaaacggtcagactggcagatcaatctcggtcagaccgatctccgtcgaatttgagggtaacttttatttccgctaaaagttttcggtttttgggtataccgaccattcaccccccccctcaggttggcttagttcttgtgtttcaatcctacaatatcattgtgatgaaccctgagttcctcttgacactcaaggctgttgttggcccaatctttcagtgagttgtgataactacgatttgggagaaacgttgacgatccgactacaaccatacgagacgttgtgttgcgccttagcgatcaatacacctctccgtgggttgttgatcttgccggtgcagatcaaccctattcctgcaagcaaatcgaagaaacaagcaagaataagataaaagcaatctgatattgcaaataggaatttaatacaaatgataagttggggttccgaagaacaagcagacgggcgatctagccaacacgcgcgctgcaagcaagtagcaatggctaaactttaatctatcaaaacccgactaaccctggaggggttactagctatttaagggatggaggaggtcagaagggcgtcctccctctgtttggggcgcagccccccttgggccccacttgggccagagtctcagacgaagttacaggcccataggcccattacagacaatgcagccccttgtttcttcaattgcggttactgagatggaatatcacaatgaggatggattcgttggaaagaggactccgagagctttccatcaagtactcacgggccgaaaacagagctcggatggagatttggcagccgtttgaagtcagcagtgtagctggtggccgaatcggattccagcacctggaggacttgatcttgatatcttcttgttcatccatgatgtgaacaatggttgtatccgtagtagccatggtcacatcacatcgtcatgacatagagtaattgcatatgcaaacattatacctgcaccaaagcttctcacaaataagctagccggatattcagtataacatgaacataatgtaaagtaggtaatcatatactcggaaagtatttcaataccataaatgtatttagaagagtattctaataaaagtacaaagcttacaaaagagaagagaaatgctactagagccatacccgaactcttccgaaggcttctggactcctgatttctactatattcctattccaccagctagatactactaaactaaacttgagagaaatgagagagctattgcttgaggtgtgtgagtgaagtgagaagag

SEQ ID NO: 50305 - DNA, 1267 bp, Oryza sativa
agctttctggcggtgaacggtggcagatctcggcatgaaaccaaaagagaaaaggaagaggggttctttgcgaagctaatggtagtcttatcgtgatctgtggttaccggaatcaatggcgacggcggcacgagtggcggtgggtctcggggtagtgatgcatgtcacgttagaggccggatctaggtggataaaatgcatgcatgcaactctagaagctccagggtgctcacagtagtattggacgaggttggccaagcttggtcgtcgacgacggcgttcggaacggctcggcgacggcgctccttctccatgaacggcgtcggcttgactcactacaagaactgccatgcatgcgtgtctctcatgttatagtggtcgtaggaaatctatgtgtgcatggaatcgacttggagctcaccggagaaggaggaatcaaagatggagctcggcggccggagttggagaagaatagctcgatatctctcctcggtgctcggatcttggggattcttgagggcatttggagaggacctcgaggggaagattttggcgcgacggctcggccggattcgctccacagcagccgggacagcgacgaggtcgtggcggcggcgctccgggcgcgctctgaagctcccgtgggcacgatggcgttcccgtcgctgcagtggatgaaatgagatggtgtcaaaaggaaacttgttcggcatgaagattagaatacggaacgggaaagagttagagttggcaaagtcttgacgatgtgttgcggcgtccttcttcctggcggccggcaacgaagaggagagggaagacgatagctggagctctccctctcggtttctttggctcacgggtggtgagtgatgtgtggagatgcaactgggaggaggagaaagctagagatgcagaactgggcgtcctcacgtctcggccacgcgtcgaccggcgcccagagcgtgtcccctcttctctctcgtgttcttggtcggttggagaggagagacagaggaagggagcctgccaagtgggtccagggcgaagggaacaagtctggagtgagagaggtgggtaggagattgggtgttaatcgattttggacgattttcaggatttgaatctctctcctctctttgttaatctatagtttaatttttgggcatgataaattcatgtggatttttctagaggtagatgaggatacctagtttccattttcttttgtttctcttaaaaagtttatgtggtttgctctcagaaaatt

SEQ ID NO: 50306 - DNA, 897 bp, Oryza sativa
agcaaggaggaagtacaactacaagtgaatcctataatgggcattggtaagccaaggggaaaatttgcaaataaattgaaagagcttgcaggtatagcaaaaatccttgatgatggtaacattaaagagtctgattttgctgaatatgcccctgatgataatcactctgattcctcaccatctgactgttctatctctttgttgcaaaagatgggagtggatatgtgcagcctagctcctgaggaggtagctgaatccagcctggggggtgcaagaagaaagaaggtgcccaggcctgacatggagggaaaatgattttaatgttctgacagtttttgtcagacctgtgtttctttttagttaattctataagggtctgtgtttggtcaagtggttttgagactttgtcatatattgattcagttgttagcactatgttggctatgacattataggctagttatactagctctgtttggttgttgtttcaatcctattttattcatgagtaattacaagtcttggaatgtgcactggaatattaggggaatgaatgcagagcaaaaattgctctccttaagacaaaaaattgataactgtgcatgttaggttttctgtattcaggagacaaaaaaggaacattttgatatctctgatatcaagaagtttgtcccaaaacggtttgattcgtttgcttttgcaccctctagtggtgcatcaggaggaattctggtggtctggtccttaagaatgtttgttggaactgtggttcaagtaaatttgctctctgtgactgttgatttcacttccagacatactgctcaaacttggtcccttacttgtgtttatggccctcaagtggcccagagcgatctgattttgtcaattggttcagaa

SEQ ID NO: 50307 - DNA, 828 bp, Oryza sativa
tattctgtgatgaacaattggcattggagattattggttttgatatttggaatttattcacgaagtggttttggagatgattggatttcacaggtaaatctataggtactgctggatctggtccggttagaccgggcatgtgttgtcggttaaaccggcgtgtatcacgcggtcagaccggcgcagcccgcggtctgaccggccgactctgtgtcggtttcggttttggtttgtttgtttggatatccgtgattgtttcatgattatggcttctagaaggatactatacgtatgtaatactgttgtttgctactaatgagtcaagttggagatagcttgttctcgaaatatggtttctttgtttatttcatgtgtaggtgactcgatgcctcgggagagtatttgcggtgatggaccaggagtcgacttagggataagacgacgtccgtggtagtcagagatcttgcgggacactaaggctatagttcaatacacgtggtttgtgaagattccatatggcatacgatggaggtattgtgtgcgtatgggatgcggaggcgaatttggaaagtgtctaaatttggtatgagtggttatgtaaagtttgtttcttgtactagagggtttcctaaggtgtttaggacttctagtgtgaatttggttcgtggctttaggctgcctacctcgggtataaatagtgggggagcgtgaggcttcccggtatcgcttttgagagcaattgagctgagagttaagttagggtttcgagtttagtcgaaatttttgtaaggagtgctattggtgcactttgtaaacacgagagaagca

SEQ ID NO: 50308 - DNA, 8120 bp, Oryza sativa
  unsure (1)..(8120): unsure at all n locations
atcaaatcatgccggctgacgcaggccgacacggggaggatccccgtcattcaccatttaatagatgtggatttggggtgtggaagtgccaggaacgctatcccgggtatgttaagggcggtcaagccagccctgaacggttgagaggcactgtacctctcatcatcttgacgagacaaggcatacccaccgcatgccgcctgacacccgggcagagtgcgcgtggcttgccgttgtctcgtctgtcacttcaaccgatcacgcaccggtcacgattaggtcatgcgagcggcacgtcgcattaaatgcggcgtggcacacccgctctgccctcactaaatgcggttaggtgagtgtcaagtggcgtccacctagccacccccgcatgacggccacatggtgactgtcccaaggggtcggggtggcccaacccctcaggctagagaggggcggctacggcccgacccctcggggaaaagccacgtggatgtcgagagcgacctttcccctttaagcatggtacccccggggccatatcatcgacaagtatttaaccccgcatcatatgttaaacctatctactgggaggagggagcagagggttggattctaatcccttgaggaaatgtctccttagtacatatggtatttatagagttgtatgtttaattgcacgaatggtgtcgtattcttttttaacttttcattgctatttagatagtatttgagcaaacgaggaaacattccctcaactcaggaattaaaaagtttaccattccattggtcaatcatgctggacatttggtcctttttatctagaaaaaggtccgaggtatgtttttttttttacaattcttatttgaatgagtttattaaatagaacaacctcgctagtggagcgaggttgcatccaatgttcccctttcattcaaatggtcaaggctgctcttctctctctctcacgaatggagcattgtttggcgtctgaatgatggcacgatgcatgcctaaaaattgctagttcgatagtcatgtgttttgtttactgaatttcagcggcagtggtggattgaaattattgctgtttttctttagattagtggcagataatgagtctgacgaaagaaagaaagggctttttgtctgcagccgaactgaggacatttttgctaggaaagtgcaaagaaagcaggcggcggaaatggcaagaaaagccggatctttatataaaagatactangcactagtgaactttgtgcgtgatgatgattatctgctgaaaattcagtgcaagtagcaacattgtccattctacagtgagtgacagtgaaactgcagagcagaagaggacatgtgatctgttggttggccattggccatatggcctgcatcaggcatactttgaccatccgaactatagatagaggacatctgcaactagtatgggatgtgaatttctgggtccttcggtttaagttactagtagttcgattataggtgaccagccacatcggtagttgcttccttgagctgttcttttactgatgttggctaggatatactccggccgagtttagttgcaaactttttatttaaactttcaacttttccatcgcatcgtttcaatttcaatcaaactttcaattttagtatgaactagacacaccctccgtatgacaattacatggatggaaagaacctccatagagtaaggtttgcatggccttacttagggatggtcgtacatataaatgtgttgcattgacaagcaaaatcaatactgataatgtttctgtacagtgtcaatgcccaaagaaagaaagaaagaaagcatgaagagatagtaacgagtgcagagaaagacagaggaggaggaacagtgagaaagaggaagaaagaatctaaggaggatccaagcgggccaatccaacaacacatccagttccaatcggtgtgcgacaccaccacatacgtacgaaaccatacatgatcggacaaccacatggctgattcagtttgcagataattgacaacctaccggcctagcctagcctttttatttatttattttttaatttatccggcctctatatccaaccggatatataccgccattataatttaggaacttagcctatcaaatagggaacttagtcctaacctatcaaatagggaacttaaccctcaagtaacccaatctgaaattcgctcctatagagatttgaattcaggaccttggggagctactcatgtcactgcaaccactaggcctagcctagcctagcctagctaactactcccttcgtactcataaatgaagtcgttttgacagcgacacggtctccaaaacacaattttgacttattatttctataaaaatatttattaaaaagtgatatatttatacttttatgaaagtatttttcaagacaaatctattcatataatttttatattttcaaactcaacaacttgagagttattcatgatttatattcccaaggtttgacttaaatattatcttaaacgatttcgtttatgagtattaagggagtactatgtaattatgtctaggtccatttctatacggaacgtctcatttaatactataatggtttttggtggtacggatggagtagctacatgaaacaagcatataagcgtgtgtgtgtgtaattgtcaaaaagtgtatatataaatgtgtactctgtataaattgagtgagctctcatatccagatatagctagtagtacattttaatcctctagagaggtagagagaaataacagagacaaccttttgcgtgttgttaaaaattaaaatatatgacagatgcatcaaagacagatgttggtatatgctcgattatattgattctgacatgcaagcattgtaatgtagtactccctccgttccacaatataagggattttcagtttttgctgataacgtttgaccactcgtcttattcaattttttttgcaaatataaaaaacgaaaagttgtgcttaaagtaccgtagataataaagcaagtcacaaataaaataattaataattttaaaaaattttgaataagacgagtagtcaaacgtagcaagcaaaaactcaaaatcccttatattatgggacggagggagtactccattcgtaatctagatgagaatttaatatcatgtagaataataaatctgaacaacgtcatgtcaaaatttgttatcttagaattcaaaactagaagacacaagagaaaaacactgccattacagaaaaaaacaaaagaagaaagggagtgagagagtacaggtattaacacgtgtgcagtagagtatagtgtattaatggatggattcagatttttacctaaaaataattggatggattcggacgcagcctgcagaaacaacaaagagccaagacaagcaagagggctcaggggagtggcagcgcatcgctcagcatccaatcatggagaccgcccgccgcccgcctgcctgcaatctgctgctacgtgtcctgtgctgtatgtcgactgctccctccgtcctaaatgataattttataatcttttgaataaaataaataatcaaatattataacaaaatctcaaaagtcaaaacgatgatggagatagtatcattatctatttcatatttcatactgtaatactaacacttctaaccctatactactctaaaaaaacaaatctaaaatagtagtagataagttttctttttatggaagaagcgctccactgctacttcatttaaacaatgtagtgctccttttagcatcaataaatttgtaaacacgtattctaaatcaacctttcaaaaaagggcgggttttgctaattttttttataaattttctccccaaaatgtatcgaatataaatacgatacagtaatagtaatagtataattatattgtaacttatatataattacgatataacatataattacgatataacttgtacgtaacatttatataatattcaatcgttagatatacttcaatattcatgcaagcgggaagaaaaaggtcacagtgcatgcatgcacaggtgagtagatttggttccccaacctccgcttcacaaaaatagcgtgttacgtcaggatttttgaaagctacatacaaggtataggtataggtatagtgtaattatactacaattttattatatttacatttgatttttttttaaagaaatttatcgacaaacgtattgatagtaaaaaaaaaagagaagtattatgaatctcactattagggtgagttccatgtatactaccctagctctatctcttctgtagcaccgtttcaactctaccaaaagatgagtgttctcaagaaaatgaattatagacgcgaagctgggtgtagacaactccatttctgatccaacccttaacagttagagaaaaagggatatgtgtaactgcaacggcccatgcatgataaatatgaggcagcccaaaccaacctctctctctataatgtatagaagcccaaaagaagagcgaggcccaataataagtccagcagtagtaggcttcgctagtagtgttgtccaaagacacaagtagtaggaggagattagagagagagggaagggaacaccgacccgcatcgcatctgatcggcatcggcatcgtcctcgtcctcggcatcagcagcagcaagggaagggaaggattcgccgcccgcgaggtcgtcgcctccccttccggcttccgtccaggattttccatggacggcgcggccgactccggcacggcgggcgccgcggcggcggcggccaagtggcggaccgatgcctcgcgggcgttccagtactacctggaccgctccaccccgcacgccacggggcgctggatcggcaccctcgccgtcgccgccatctacgccctccgcgtctacctcgtccagggcttctacatcgtcacctacggcctcgggatctacctcctcaacctcctcatcggcttcctctcccccatggtcgaccccgaggcccacgccgctgcctcctccgacggccccgccctccccacccgcggctccgacgagttcaagcccttcatcaggcgcctccccgagttcaagttctggttcgttacccccatccccagatccagattcagatcactcctgaccttttttttttcgtctccttctaattcgcaaatctacctcttcattctattattactattgttattatgttttattcatcgcggttgacataggccaaaccaaaccatgtggcctcaaatttcacatgcttccactattcttctttatattattattattattattacatcatcaatcaatgcttgggtctgctactactacccctatcatcaaccccatttaattccatctcatgctgccatgatgtgttagctatactgtccatgtcacctctaatccaactaccctcagccctcctcaccctttgatcctgtctgctcaattcgtcctccctatcttatggagtatcttgttatattattgtgtgtgctatgtgccataacacttatctgtgcacaaacttcaattgtagtgccacactaccggaccgcgtgaattgtaattggtgtcctatggtaatacacatctttaagtttgttagtgcagcaaatgtgcgcacactgaaaatattgatgctatatagaagaaggaaattgtggtcatatatatcatcctttgcttacctcctaatgcattctatgcctttagtcagtggcatgttaaccagctaaggataagtcctaacagtacctaacagatttatatgaatttgtattccactggacatgtgcccactgccaaccatacaaattggtcttggggtcccgtaatgacctcctcaacaaagtcttgggatctcttctcaatttgcccatatctctccctttggaatttaataaatggtactggttaatgacacaataatatttatacatgcctgtatgcaattatataacctatggttcagacatgtgctatgtttcatcatgagtgaatttagatgcagaactgcgtactgcatactctcgtgaaaataaatgtttcagcctgacatgtccatggcattcattgatctgtcttaaattcagtgcagcatacaactcatgtttaactatagccttagcattccatactgtgactttgtatgcaggaaagcatacctcttatctttgcatgcagtcgctaatacgtatttcactattttctgagctaattcctttgtttcatcaaatctgaacattggttttgtgttttcaacctcagtatccacaccatattattaacattcatttgcttggctttcaggtatgcaatcacaaaagcttttcttatagcttttgtgatgactttcttctctgtatttgatgttcctgtcttctggccgatacttctctgctactgggttgttctttttgtcctcacgatgaagcgccagattgtgcacatgataaaatacaaatatgttcccttcagcgttgggaagcaggttagtttactgctcaatacatggtttatgttatctgatgagtgttggtacttggtaccatgagaattacatgttttaccacatactgaaacttgaaagaagtgccattatatatccatgcttggggccattattaaataccatcaattgtgcctttttatttgtgatcttgaacaaatgcttttacagtatgcgtcatcatgtactggtgtaaaataaatacctgtggtttcagcaattgttttgttcctcaccatttatcccaaattgttctgctagaaatatggcgggaagaagagcgcaggcagcagttcttcgaaagactgattggcagcctacccactctggtaggaaaaatggaaggggcaagaagatacagtcgatgatatttgatgtgctacataccaattgtaatatttcattcatatctagagctagaaggatattcacttgtatttcagactctggttcacggtttaaattgatattgtggtagaatgctttcttggatgggtatatagtgtgactcgttaaaaatatgacaaaacggttcagctactctttacaagtggtacggcaaattgtagacccaattgcacttggcggtgagctgctttgttggagcaacagggcactgtctgcttgcgtggatgaaaagctgagtcatctgaagctagtgaacattttttcgctggctcgctgcgtgtgttttttctctgattgtggcccggttgattatgaaaatgaccagtaagtaaagtcatccgaccctgctgatttgtttgttttgcctaacctagctcatgctcggggtcgtgaatcgtgctacacttgttgcagctttcgttttcttgaagagttggaaggtgtcagcttagcttcctgtgcgtactagtattgcagaagaaaacgtaaaactgtaccagagcaagaagactttgacataaatttgtaacaaggcagataggtggtacaaatcaaggcactcagctgaacagctcaactgaaatgcagaactgaattgaagagtaaaaatgatccatgcatgacagacaaaccagtggacactgactgaagatggagcaatgaacaaaataaaatcaagacttgtttttattggcgcatgcatatttagggtgatatgatgcatgacgaaatgaattagaggagggtgttgagatattcgtcaacggttgtatattggatttccgggtagagctgagtggcctccacgtcctgcggatcatccagcggcgagctcatctcccctctacagtaggccgcgtgcgcgatcgacaccaaaacgttcttcgggtactctaactctgcaattgcaattaattagcaatatattataattgcgtatggtttattgcagtggagtactccatacatgttacgtacctttgattttggtgagcacggcgtctcgggcacgtacactctctccagcttcttccccgtcttcttctcccacatgctcaccagctcgtcgtgcgacatggtgttcgccggcggccgtatgtgcaacgtcttgttctccgcccggggatccaccggcgccagcaccgtgtacgtgccgatgtccc

SEQ ID NO: 50309 - DNA, 6678 bp, Oryza sativa
ccggatgccattgatgaattcgatcgatcggtagcaagacaactagagctaatgcaaatatgcaatcgagcgtgtgtgagagaccattgcgcgcgttgatggccttttaatttggttagtaacgtaacgctatcaccaccaattaagcctcgcctccctcgtttcagttcgcacgtcactagctagctatatagtatcatgcacactactgtttcagtgcttcctagctactcttggtgattctctttcacgtacaataaatcattaattgctgtaactttgtacgggattcgatttacctggagacgactaattgcctcctgtatgttcttgtagacaagaattaaagaaccagctgccaccaattttccgcttggtgctttcccccaaatctaccttggactgcctcttactacggggaagttaaagctggtccatttgcagctggtaatggacaaaatcagagtaaggatggggggctggaaaaacaagctagtttatcaaagcaggtggaaggttcttgtgcaatcagttctcagtgccattccaacctacttgctgaccgttcttaaaccaccaaaaggattcctagatgatgttgacaaagcgcgacgaaaatttctttgggccggagactaagaaagcttgggcaggaaatgtaaagtgaattggcagcaagtatgttctctgacaatacatggtggattgggcataccttgtttggagaagttctcacgatcgctgaggctacgttggctctggtatgagtggacaagcccgaaaaaaccatggataggaaccccgccgccctgtgatgacactgatcgtgctctgtttgctgctgccaccaaagtatcggtcggagatggacgaaaggcgaaattttgggaatccaactggataggagaccagccgctgaaatacttagccccaaacctcttcaagcactccaaaaggaaaaacaggtcggttcttgaggcaataaccaatgatgcttggatcgaagacatccgcggaggggtgacaatacaactccttcaggaatatatatgcgtatgggaagtgctccacaacgcaggagaggtgatccatgaaggggctaaggacacaatcctctagcgatggtcggccagtggctagcaagatcatagatgagcttcatttgtgggaaatggtaggtgccaagggagtgaagtgtattatggagattaggcttttgtttttttagggagtgtaggcaggaagaattcctccgagaacgtctcccctgccttctgttctgtacagtttctctcacttcttctataatataaaaccagcttgctgggttctttcaaaaaaccaattttccgcttaccagataccacccaaggatcatacatcttcatcactagctgcttccgtagaagtgaaccattccactgcatctcattctcagctaagacaccgcatttctagaaatttgatgccccgtaccaaatataaaatgaagccctattttttttaaaaaaaaagaaaaaaatataaccaaagcataatacttcttaattatacaacatccaatacatcattgtacatgctatttctcacaagaaaaaatttgattacatggatgacacatatgaacacgcaacccactcatgagcgcacacctaacagacagagaccaactaacctcatgcattctttcgtaatttcacttcaagttgatgtacattaggccagagcttctttactgaaagtataaaacaatctgagcctacattaatacttcctaaatcgacgatgaggaggcaattttgttttcttagtctttgtatatcgctcgattagtcgtagtcttgactctcgactcttgccacttccttccatcgaccatcgtcacatagcagtgacctactttttggtggaggtttgcacggtcgccgccccgatctaatggttttcttgcaaaccactgaagtatctttagtttactgcataattttcagttttttttggaagtcccgatctaatgtttctttaattttgtgcatcattttcgctgattaggaaggactgatataacaattgccatcgttttacctacagcttattataaatgatcacgcttatcaaccaaaaacataaattcataggtacaacatttatgcaagtattctgaacgacttaaaagtcaatactgaaaaataaactacaataaatggtatcaaaataaactctaaaattagattttaaattttggtacgtaccatagcaatagggtttagcataagcaggtctggtagatataacgcatgatttagtattggttgagacatggtaaataggtagtacaatgttaggttttgatctctggctaacaggccagagaaaacgtagtgggttcggtctaccccgagccacacgcgttcctatgatggcaccaagataataagactcgcgcgcacgtcccctctgaattacacggcgatcggattgtgcaactaatcccattgactcgcattggctcccgtagcgctataagagggagaaaactccctctacatggttcttttcctcaaaacccttaaaagtcaacaaattataatcgtgagttttaaagagagaccgaaggttgaactctacaccaattatcccattcactggcatgtcaaggttgctggtgacaaccatcactaacatttgctgcctcactgttaacgttaaaatttggtaagctccgaaatcgtcatcggcctcagagttctagaaatggcttacggaaattgttagttgccagtcgtcgacatcgactagtatcgctacgatggcatattagctggtcggatctttgaccattaaattatctatcttgcagtatcaaactgactggcacgtccgcacttcattaaaatttaggacctgcacttaaacagatatcctagaccttcgtgtttcaggacgaaatttcacgtcaacactcactgacccaggggcacacacccaggggcacacgtagatcgacgcctacatgtgtacaacaaacaaagcggcgtggtagatcaacgcttacatgtacaacaaacaacgtgattgaccagcggcacatggcttcttcactatctcaattcgtcgtaaaattatttaggtgatcatgtataaccaagatcataccatactaataaaaaaacacggatattagggaatgacttaatatcaaataattagaatgggtgaggctttgaacttagatcatctagcccaccaccttgtgaagctacccggaagatccctggttgtttctccatatcatactaataatgtttaagcaaataaattcattaacatgcaaatcaagccctgaagaagagctgaactgagcacagtgatccatgacagattaaaccaagacactcactctcaccgacggtgtgaaatttgcaggaacatgtacattactaaggaagagacttaattattttattggcacataaaagatgatggatgtatcgatgtatttcagaggagcctgttgaggtagtcatcgacggtggtgtactggacgtccgggaagagctgggtggcctcaacggcggtggctggatccaacggcgtcgtcgtctccccccttatgtaccctgcgtgcgcgatcgacagcacgatgttcaacgggatctccgactctgcaaccaaaccatgcaattagccatggacggataaaaaactaacttaatattggatacgattcgttgtattagaatttaggatggagagagtacatatggaacatagtacgttaccctggatttgcttgagcacggcgtcctcgggcacgtacaccctctccagcttcttccccgtcttcttctcccacagcgccaccagctcctcgtgcgacaccgcgttcttcgccggccgtatgttcaccgtcttgttctccgcccgcggatccaccgccgccagcaccgtgtacgtcccgatgtccccctcctccacgaacaccaccttggtggctccgtccccgaggatcaccacgctatccaccggccgcgccggcggcaggttctgcccgatcgtcggcagcgcgtagccggcgaagtagttggacaccacgtacgtgtacggcactcccgccgcctccacggcgcgccgcacggcggccttccggtgaagatggacctggccggctccaccgcgcccgtgtggtccgggtccagcccgaactccgacggcaggaacctccgcacgttgccaccgccgccctccttgatggcggcgatgagcttggtctggtcggcgatctgcagcgcgcccagcgtggagatgacgacgtcggcgtcgcggacggcgctgagcaggctggcgtggtcgtagaggtcgccgtggaggagggtgacgccggcgtcgcggaagctctggagaagctgcgacttggcggggtcggagggggagaggtccctgacgagggcggtggtgggatgacccagccgcgcgctggccaagacgacgtgccggccgatgtaccccgtgccgcccaccaccaggatcctgctcttcttctcctcgccaccggacgccattgttctagcgatctacctagtacaagtagagtgttagtgtgtcacagcttgcatcgccttcatcgattccggcccccttttatacttttttccaagacggggaaattaagtatttcttattcaaatttctcttcatttttgtcccaatcagaatgttgttctagaacgtctgggccaaccaccacgcccgtgtactagtaattcgtaccgttaatttatttattaatcgacgtcctcccaatcatgatcttgacggcattacacttggttcagtgcacctggacgcgattgtatgcctcctgcggtgcgagcacttggttcagtgcacctggacgcgagcggacaacgaacttcgcctaggtttccagcccagttttggatccaccaaccaaatagtatccaccagtcaggattcagagcaccattttccgctcacacatcttcatcactggcctggattccaactttacccaatgaactctttcatcatttcatttttaaggtgacataaatttattttaactgattaggtaccgtcttttctaagctgtttccggtatggtggaccaaccaaattagggtgcatgacgcacccatcagcgagcggccattatattcagcttaccaacaccgaaatatcacaaatctccatcactgcactctacaggtggactgtcacaccgcacctaagagccttgctatttcattctttgttttaaaatgtagcaaactttctcaaaaacctctatgtatagatgatggctatgccattacaccgcccatatctaccaacagattggccaaatttggcaaccaagtgttgacgaccattaaatttggtcctaattagaaagatgatcaaagcattcacgcaaaggccagtcatatgtaccgatgtttactgagctatgctgaccgatccaaacagaggtacgcctgtctaaccgatggtctaactggcaagcctcgaatcgaagtttaacttgattattgtttcgcctttgcttgcatgagaccaatatttctcgacttctaattgatctctgagtcagtgagtgtgtgtgccaataaaaaaaaatccacaagatagtcccttggcattcattcagacaaggtagataggcagtacagatcaaggtctgaacagctgaacggaactgaaccgagcacaaggatccatgacatattacctgcagacgactcaatgaagatggaagaacacattaataaagatttgagattttattagcacacacacatagtaactcgtttcaatagaaagcacactactgctatctctagaatgttgtttctataacatcaggtgaaacaaccagtactagtggtaatttgtattcgatactgctacttcgtcagtgaaaaaaatatgtgccccaatttcgtatgacacattggatcaagcttgggcaatagtcagctaacagatagtgaatttcctaattagcgcaacatacctatcttacataaccatgcaaccaagcaacccatgtagttttctcagttgcagataagccacaaaagaagggggctggggctctctcccagattcagataaagaggaggaagaagagggtctccagtctttattttataagatgacatagatagagccaccttcgatccattcaatcgataaatcctttggaatgaaggagggggttgtgcagttttaccttttgaagggctgatctactccatttcatcctatctttatatgggtgcatgaatcaagcaacttggcagctgtcgtggttgtacctgatggtggtcagggtaggaccgagcttaggtatggacacaggagtataggatctttgtgcctaaccattttcatatctgatcatctgttcagcaaaatacaagtcagtaacaccaaaagaattaattcataagtgactttctcctcgacttccgtggctgcaaattgtaacatctgaaaacaacagcctggcgtaaaacagacctagtctgtagtaagtgactttctcctcgacttccgtggctgcaaattgtaacatctgaaaacaaaagcctggcgtaaaacagacctagtccgtagtaagagccatgtatttgaaggactccctgctgcaat

SEQ ID NO: 50310 - DNA, 4994 bp, Oryza sativa
atacaaataccaccacaatagactccacaaaagaggtgaatgagagccaagagaaagccaaaaatcttctagtatggcatagtgatatggaatggcaagatgaagttattgcatatagtatcaaattatcatgaatgaatacatgcagattttactaaagccaaaagtacattagcagaaaacagaagccatgacatacattgtttctaacagaataagcaagctctattgcgagggatagacagagattaaaggttcattaagtcactagtgtaaatggcatataaataaatacatggacaatgagcacatattagttaatcctagaggagaagaacacatgagctgcacccatgatcatcaacacgtatagactgcaattgttcagagttagctcatgctccaaactagaatctacagaaattctcaacacctgtgatacatggtacacaatttctcatactacaagagggcagatagacatggttgactcgagatcaagtttatgttttacaagatacaggcaagtaagtacaagacgataaagctgaaataaccacatcaattcatacgtgcaagttttaagcattacatctcttaacaatacattgcagaagtgttgttgtttcaaatggattcagtcgttagaaatgaaaggccaaccaaacattatagaattgaatggtattgaatattctaaaattgaatgcactgttttgtaagaaattctctgaagcactgatataaacagcaaattagcaaccgacggcaccagagtaacagggagtcaagggacaacaacaatgtaaatttcactgttacaaaagcagggcatatggattgatattacaagataaaaccatgaagtccacaacccaaccccagtgacaaaatgaagatagaatacagcagctagaacaacctcaccacaccaccttcaaaaattctggaacagcttcaatcagaatgggctgcactaaacctaaaatcaggaccgattccgcggcttcttccttgtatgctctacttgctctttgtcgttgtcggtatcatcagctctctccctcttcttttttctctttttctcagtggctacagaatcaccagcactaactattatccctttcacaactgtcttcacctcttcctcttccggatgattctttttgttccttttcttctccgggctggcaaatctttgctcgggagcaccaccgttttgtttcacatcccttgcattctcttgctgactctcatgcttcttcttcttcctgttcttcttgctcgtctccttgtccgtttcttcttccgcgacgagatcagcagcgaaggccacttgttgtgcctcctgctcctgcttcacatgagtggctgcttggtgatggtcctctgaacgcttcctcttcttcttgtcggaggcggaggcagtatcccccggtggtagtagttgagtaggtcgaggcggaagcggtggtggtttttggtggcgtcgccgtcggtgtgtaggtaggtgtcggcgtcgtaggacgggaggttgtaggcgccggagtcggcaaaaaggtcgagaatgcggacggccttggcgaacgagcagggcttgaaggagaggacggcgccggtgatcgccctcatcgcctcgccaccggccaaccgccgtctctctctctctctctcttgttgggtttgggttggaggcgagggggattgctctgctctcgattattagggttttaggagcaggggggcgccttctgatgggcctagtgggccacggcccatcatcattctctccgcacggtaaggcccatctcgtgtgaaggaagcaggccgggagattgggtgggaaatacaggttgcaggattcatcggattcaggggatgaatctgattaaagtttcagttcttcgcagttatactacaagtgattccaaacttaccttgtaagttacgttgtcgcaattgcctaagcttgtcatttcacatttggatcatctcaggtttggggactaaaatacatgtatatacaccgcaaatttaattcgattatcattatgatgaggcgaaggcaatcagatcagtacaaagcacatacatacattagtatgtctgcagaatcacttgttagctgcaccggcgggcttgttgcctttggcagcggcggatggcttgttgggtttggcggcgctggtaccagcctccttcttctcctggctgctatcgggcttcttctccttgttgctggtatcggcgacgacattatgctgctgcttctccttgctcttggtcttggacttggacttggagtttgaggagagcttgagcttgaggtgcaccccgaggtcgccgccgctgcaggagctgtggagaagcagcgagttgttgatggactgcacgttgctgttgatcatcgccttcacgccccccttgccatccgcactgcttctcttgtcgtcgccggcgcccttgctgcctggggcgggggaggatatcttcatggatgcgcccttgttgtcgccggccagcgtgatgatgcttgtcccttgctggccgtgggaggcggcgctgagcatgccggcgagccccgccttgaggtccttgcgcaggtcgcccttcttctcctcctgatctttcaccttgtgctgctgatgctgatgatgatgcgtgggtggtggttgtttgtgatgcagtacggtgtcggtggggatgacgacgacgtccttgggcttgggaggaggctcgtgacgaccatctctgcttgctggtggcggcggctgctgatgcaagcggcggttggttggcccgagcggtggtgcggcgcgggcagctgggatggttgggtggggatggcgcgatgagggaggtgacggcggcctgtacctggagctggagggcggtggcggtggcggcggcggaggcggtggagggctggtccagtacgggaaccagtagcgctggggaggctgctcttgctcctcctcatccatggcgttcatcgatgatctagcctaccactagcagtagctgacggacggaatatggattgcttgaaatggcgggaataacccacagaaatctatatatacaagacggaaagaagagaggaggatcctattcgtatctttcgattgctttcagcttgcggaaaatgaagcgaaacgaaacgattctctgccgcatttgcaatccaagtacagtgcaggagcaggagcaggaaaatgggtgggttgtttaggcatctgattcttcttcctcattgccgtggcgtacgtgcaccatggcttgccaatcaaaacatgatacgtacacccacacttccatactggaatatgatctttcatctatttttttcagagctctactgtatatagtctatatatacactactgcagtgatagtattttctatactattgtaacgggcggagttgccatccttccatctcctcccattgcgcgtccactccacttgcataaccaccggtatataaattcaaaatttagtgacaatgtttaacatagcttatggtgtcatcgacagctgtataaaaaaagttaagaataaatttcacaaaactatatatattttgttcaaactatcataaaactatatatttaataatgtgtatcataatatatagatttaacataattttttttacaaaagcatagatttaaagtatcatatcagaaaactacagatataatattggttttattacaaaactacaatgtttctgacctcaatatattatggatataaactctataatgtatagttctttcataacttcatcgtaaaatctgtagttttgtgttatgatactttaaatatgtagttttataataaatttggcattaaatctatcattttttggatacacatttttgaatatatagttttgtgatagtttagttaaagtatactgtacgtagctttttttttgaaaattactcaacagttaatttaaaatacaaacgtatgcaaataggaaacgtaagatgtaatcaaagagtaaaacaagtcttcttatctgtggtgttgtaaaataaagtaatataaaacatacatgccactgctcattatataatgagtgatgttaattgtattatataattttgtattgttgtaacccctctatcccaaaatactggttatatattatcgttatatttttaataacttatgtgccgctgagaaaaaaaatggttatattgattatcgttaatcatacatagaagtttagtaataggtgttatctctttctttagtttgttattctaagtagttttattgcttttataatcaagctatgaatttgtaatcgtgaccgttcgatttgcaatatcggtagtaattggatgtaatttatttaagcaaaaacaacaataaattctattataaaagggtcattgtatgtttagtaaaaaaattggaagttgtacaagaaaagagaatagagaggatagaggcaattgtatatatccctactatagaggtagtagcggtattttatactgatcgaggggtagggctcacgagtcggtcaaatacctatggtgcagaaaagcgatcagcctcgatctcagtctcggttagagatggcagcggggaattcactgtcggggtcacacatctacgtccttgtccacgcggtgttaaaatttcaccatctccacccctgccatccacgatagggctacatttcatccatcaccgtcctctgcgcgcattgatattgtgtcgttggagcttaagcagtcggcatgggacgatgacgccagggagggctggaggccacacttgtggattgatctttgctggtggctcgggatggcgacgctagcgagggctagaggccgcacttgtggattgatctttgatcccatttgcaatatactctgggttcaccatttttgatggtcctactacggccccgtttgatagggctccaaactccaatttctagctctaaactcctactccagtgggagctg

SEQ ID NO: 50311 - DNA, 27956 bp, Oryza sativa
gtgagtacactcccctcccttcctcccttcctagattgaatttggatgttgcctgattggttgattcgccccatggactcgcccgcaggagggggtgaagctgctgggcacctggctgcaaggcgaccgcgccttctccttctgccgcctcctcgcccgcaacaccgccaacctcaagcccgcccatctccccgcctgtctgtctgtctctcccatctactactgctactcctatgtacaatacagtagtatctcatgattctttcgtgtttgttttgcagccgccacatggcccttcctcatcatggcgctcaccaaatgcgtcatcgccgacatctccggcaagaagcgctctcccaagagcgccgctgccaggatgctccgcctcgccgtccagtgcgctcaagacttccgcctctcaggttggttacctttctttccaaacaacattttcctgctctctgccctccttttcatccactttgtatttctatgtatgtcacggtcacggaggttgctctctaactttggtacaaatgacaacctgccctgcgctgctgattttaatcaatcttttgtttatctatctatcttcacaactagttttgatgattctgcattctcactagttttctcacgcaatgcgctgccaccattttatacactgcttgagttcacatcgtttcatgcatggatccccacaaacttgggcagcctgctgcctactccctccgtttcatattataagtttcctagtcaaatttgaccaactttatagaaaaatatattaatattttcaacacaaaacaaacatattatcaaaatatattcaatgttagattttatgaaactagtttggtattttagatgttgctaaatttttctataagctttgtcaaacttgattaggaaaaaactcaaacgacttataatatgaaacggagagagtactcaataatgatgcacaaacacacaacataatcttctatcgtgctcaccagatacacattttgcagctacttgcacattccatgacttatgctatgtgtacaattaccccgactcatcttgcctacctattcctaacccaatttaacgtttattttatccgcatccgttcctttttgtcaaatgtctactccaacatgacagcattaatgttcactcgtaaatttctgcgtggaacttccaataaagaatactgctgagggctgaaaggaggtgctcaggcattctctttcatgcatgcctgctagtaatgctcatacctttggtgttgggatgctcctgattttcatgtactcttgtttatttatgcatcttctcacttgccacttgccagacacccagcagtatgcttcgcgtttaaccagatatgcaaacatccttttcaattgctttgaagtggaatattttacattctgtatgacgataaacaagaggttcattgtctctgcagggcggtcgttacttttgatttccgtcgctaagaaacttttcagtcatatatgggaggttgtaaaagatgctcccagctttctgatagagtacagcataattcttaggcagcttttaactgttaaggagtaccggtatcagatgaaacctcgaacatatagcagtgagttcccttgccagatctcctatcttttcatcccattgacacttttgttcctttattattcttatattttttcaggttttgttgtgctctacatgaagaaagttgcgactggttttgatgaaaaaatcagtaatcaggccagctccaaggaggaatccttccgttgtacactgacccttcacgttctacttgaaaacccaccgggtgattaccctgatatcatgagggaggaggtcctttgtgggttttgtgcaatatgctcaaatattaggcatgtattgtttgctcatgtccttttgacgctcctcttgaacccacttcctcctaagaagaatggtttgcatttttatattttttgtctcccgctgcttttctgagttgcaactgaaataaacttaatttgtggaatcagggaagagggaaagctgacccgcaaacttatagaatgcgttaacacctttctactgaaggatgggccaaacctgggatgcaaatctgttgatatccataatgctgttcaagattttatgttccattcttggcctgtgacccacgacagggctttgaaggttctgatagcctgacttgcactactgcatctttattacataattttgattataccttcattacatcttttgtgttgtattcaagcaacaatttttaccctttttccagagcttgttcatcacctatgcaaaggttcagctggaacttgctagggctattcctgagattttggaaaaacttcttgatgtcatcattaaggaattagaccaaaattttaatactggagccggtttagtatggtagggatactgttattcttttgaaaatgctttatgattttgatttcttttctgatgaaatacaataaatataggtgcgaggcacctcgagacgagaaagctggctccttgaggtgcttccaggaagaattgatggatctatctgctactgccttatatctggtattggatctgcatctatacacagttgcacacacatgtgctcagacttgcacgcgcaacatttcattgttctgttttcgctcgaaaacagcttaaattgttcggaatatttaggcctacaaatgcacaccgaggacatcacataacaagaaaaagttaaagacggagcatgttatgaccgccatcatggatagcctgctgagaggatcccttgtttggtatgcaccatctatccacttcaaaagaaggcattgtttatctctgaaatctcatatgcgtatcctgacaaccttgggtttgttaaaacctgaggtaaacagtcgaaattcaagaatctcttttattaaacatgcctcatcctgtgcattttccatgccttttacttgctgcttccaattcagttctattttgatattatgaaatatgtataaaatcactcgcatttttctaagttagtaccaacacagtgcttatcagtgacaccaccttttcgagcaattagctttcatgctctgtgaagtttcaattttgacatgttgcttcttaaacccttaaactaaatgttcttgtaggcatatggcctaaccatgtgctagaaattgattatttggaggtgtctcccattgttgaatcccaaggctagcatgtactgttctgttccttagttgcctcatgctgtgttatttctcactgcccccttacaagttacaactgataaacttgttgcacgtcggtgtgatatatagtagcacttgccacagatgttccctgtggtgagatgtaatcccttattccttgttaagcacgaggaccactaaatctgttgaacgtgtttgattttgtatacctattattatctttgtcttttcgcaggagtggttctatttgttgtcttattcacaagtatgggtaccgagtggataaatctttgttgatcaattggttcaaggcgacctgtaagggtttgaaaaggttatgcaactgccttattttttgttgatgtaatattttctgtggcaatcggcaactgcaaaattaaagaaaatagcaacctgctttactttctgttatttaatgcttgttggtaagtagatctgtgattatgttctttgagtttttcagtatatgacactcactctagatatgtattatatggagcgtgtctgaaatgcacatgcatgcaagatagtgcaaaatcactcttgtggataacttttactgcacaactttggaatcgacaatcaatcattgatctgaaatatagcaaatatagcaacttctagtgttcaaaatttgtcccagaatatagcaacttctacacctacttcctaatctcaaccaatcacaacaacccccatttagttccacgtacttccttaatcaccgtgtgcaaaacttcagaaacccttatattttgagacagagggagtacatgctattattagtcactagtatagtattatgtcattagtagttattcatgtgctctagggatttctagtaccaaattttattataggtattcacctaccatgagcatgcattgtatagttcattgaatgttctattttttctatggttgcccagtgttttgagcaatgcaaatgccctacggtttcaagattcactgctttggcttatcaggtttgttttgatggtaccttttgtttttgttggtggcttaaatgtcttgttctgtgctgctttatgtaaccagatgattactgaaattgttctgtacattctagctagcaagtggaatatgtcaaactttcacttaccttaacagggttctcaaggagttctctgcgcttctcatgtctagtgctagggatgcaccaccattttggttaacaaatgacgaggtaaatttatttctgttttgctgtgccatttacatttcagttaattagcctgaggctaaagagcttatacgaatctaccactatctcttgtggtccccctatcactactaagtattttctagacttgtgatgttcatagttatacccacatatgacacaaccaatcaccttttttccgcagatgtcaattttggaaggttattggcaagatacctggaattctcttattcacgcacttcctttgtttagcaccacagctctagtcgtgagtatcagaaattgacccttctcttatgatatttcaaaacttataattgttataagttcataacattcttgtttgaaaaaaggtgcctaatcagttttttgtgctgtgcttctgaaacaactgtttactactactaaaattgaattatcaattaaagagtgtatatgactctgatgttatcagtgtttgcgctctttaccatatctccatttattttttagtccttcagggactgaacactaaaaatggaatgataattgtcaatataacctgcatttagagtacccaagtggttgtgaaatatcactgtatgatttctagaacatctaaaaatttgattggtattttattgcacatttataggttgattcagttctgaggttgttgggtgaaatgatcatgcgggtgagcttctcattcccaattatcttaacagaagctctaacatattctgtgcataatttcaggccagttatagttatttcgagatatcattgatattttgtgctttccttcttcaaggaccaagttcatgcatcatttgtgtcagaagatacatgggacctacaaatatttaaacaattaccatcatcgtacgtatgccctctttctgtgagactgaccatttattagttgtaatcttgcctcattttttcagtacaacctccgttaaaaaatataagaatatttgaggctgaccatgggtattaagaaagtaggtggaattaactggggaaatgttgtgataggttaagaggaggaagtaggtggagaaactccagaaatccttatatttttggatggaggagtacctgcatgtagtgagatatgcatgtgtcagtaaaaagctcctaaactaccttcagcacagtgctatctatgtacctgaatacatttaacttgtttttgcatgctattttcatgtcagttattttctattgtcatgtgaccctacctactagtctttcttctcacggtaaatatctcctattctagaatatattgcatacagttaaactgcatcttgatttctagagatgatggacaaataaaaaaaataaactgtgtattcttctcaaataccagtagctttgttgcctgaacttccaacaatgactagtttcagtgcttcctgtttaatcaccattctgcttggatcataaataatcagttgccactatcctaattatctgcggaatgtcccagaaaattggttgaaatttctgttgccaaataagtccaaaatccacttttctgatggtctggtgaataatgtaaaataatatccttcctttcgtgggaaatcgttaagagaaatgagtgagtggtgagcactgttgcttacatagcacatcagtaaacagaggtccatgaaatctgaatatgttgctgctgttatgatgtattgatcccatcttattggtttagctgtgaactatataaatcagtagatgtatgtgtgctcagttggcgttatccttggactaagaattaagagagttaaatcctatcaaatagaagagccatgagcctcttaggctcttagtgcactaggatagtaccaacctgattgtgatttatatttttcttgcatatgaagaaaccacaggttgttatcctgccgctatgaaaagaaataactaatgcagcacacattccttagtccttacaattgctgttagctgaactgtggaagacattgcatggtgtaataaactcatagttatgctgttttgtcattctgttatgtccttgccattgttgcctaacctttccttcaatatccttaactgatgtgaacattttggcctatacttacttacatttcattgtgagctaattcttataattgtttttttgacattgggattatacttacaattcgttttggcccccaattcttactgtaggtctactctgtacttcattgcttgttacttttcaaagataggttttcaggtatgcttgctgtcttgcactattttagttgtttactgcttatggttacagtggagtagtggagttgatcaatcccatacatttaggaaacaaatagactgtccaaaactcttatgcaactcttttgttcaaagtatgacaaggattcatgttcttaactcactaattagggtaaattcaccagatcaagccaaaaagagggcattcatcattgtagtctttcccaatttttaaagtttggttggtgccaaaatgtttgtttaattgttttggatctatccttctcaaatataattctaattgtttcatattcttgctaatttattgttcagcaatctcacaaaatacactgcttgttatttcctgaactgtcatgtaactctttttggatgattaagtatgaaagcacacaaagtaactacagagttggcaaatgctcacgtttgcctgtactttctatggccgaagttgaaaaagagcaaaaccaccccacagtttcgtgtgctttctatggttgctacctttcttcttgatgtttcagtaaacagcctgtctagaaataactgctacaaatttgtgaatgataggctagtatgatgatgtagaaaaaggaacatctgcacaaaatctaatcaccttagctattcaatatactggagctaatcattttaccttcccaactattgtgctttgagcctttgactattattactagttactcctactttctgtatttcagatttttttctttttatatcaaacatgctcaaagcatacttttgttcttcaatatcattatatgcagggcgatgtatccaattccatatttattagaaagaatctgttaagatcaacttttgagttagtgcactccaaggtaattatttatattttaccagacaactgtattttgtttattccatttatgcttttgtttaattttgtgtatcctctccttcacaaagatactatcaacatttgtatcgaccactttttgctaactgagacaatttttcccttgacaaattataaatttatgtttagctgcattagtgttttgaatgtggatgcatagtttcctatggtgatagatcagtaaactttatacaagtatcacacatttaggcaacagtagaacataattatttatcactgtaatcatcacaaggacttatttgacatttgtatgctttatattccttctgattattcctagatatatacagatgcccttcatatttgtgatatatatagagctcatctaagtaatttattgtaacttaaattctgcaatggaagtgtgatgctttcactagttgaatcacataactaattttaatggttcttgaatagttcaacatacaaatgtgagctacaaaagggaaaaaaatccagatagatggtcccattatttggacctttaattatcatttcatcatgcatttatttgtgtttgtggttagtgattatccatttttcaatttacattatgatccatttccaaactacattctggagtgggctgtcaatattttctctattttttccgagatttgtaagttcaattgctgatatttttggcagggtttctctcttttgaatgaacaaagtgttctgatgattcctgaaaccattttttctctctgtgctggtttttcctcgccagtgattaactcagcagatacatcgcaactgtttggtgaatgtaaaaacttatctaaggtatgtttctgtttagctgtcagttaggatgttgcagttgaatcctgaagaatgtttctatctggtgaactttttctaatttggtttgctatatttgtttccgaaggacaagtgctggtctcacgaggaagaactaggttattctgtggaaactctatcggagatcaatctggaaagtcctaccaaggtgctttaatcctggtagctgaatgttttctatgttgctcttcttattgatcttggccagtgaggtgcatctatttatgcgtgtaaaacttgtggcacttcttttcattttttaagtcagtaataaattttcttatccaacagattgtgtggcaaatcttgtaaacttggagacttcataatggaagtcttcaactcatctgacttcacttgcaactgaatgccattttgactgaaatatgtggagaactattcattatgatgcttatgattaacttcaaatctcaattctgaacactaatcattaagagaattggaatcttcctgttagatcatttggaacttcatgaaagccaatatcatgtcttttttgtatgcataattcaatatggcatgttttaatttgtactttgaccacgcggagtaaaaaaatctgtgtgcccacgtgcaacatatgggcctttagatctcaaattctggagcttagatgctaaatgaagttgggaaatcttatgatgtatctgctactacaagcttagtaatgtagcatggaaatctggtatgctctgttggacaaaatttggatttgggggcagaagcaaacttatgaaaatatagtgtttactcatatgatttccctttgggtgttctaattggtggtaactacagaagttaaacttatttgtttaacaggccatgtctgagaaatgcagccgagcgcaccttcctcggcatattcagcaacccttgctcctggagcttctagagttcaccaaaggattcatgtcctcaaataaacagtttgagaaagtggacttacctaatcttgtttatgcctgctctctagtctgcaatctaattcattgttcgctgttgtcaaggtatttgttttataatcatatgtgcttggttccgtcctatttttacagtcagtggccagtacacataatcaaaatctgtgataatttgcactaaaacgagattaagttcaaacttccagatctttctgaactagtttttgtttatgaaaatgtaattatgcccctcctttccttgttctctcccatctgttgagtatttgatcccacaaagttctttattccaatgttgcttttcagggtctttgaagaaaaatcttcttttctgcaagttatgttggattatgtcaccaatgccataaaacatattgtgtcagtggttatgaaggaacatgctgaactttctcatggtcttaccaatctaggatcagtatttgacacaactggctcagccttatcctcatttaagagcttcatgcattctccattatttagtctgtggagagttaataacaaaactagttctgtgcttggtgtcaccgaattacttgatgaactcttagaggcaatttctgagctatttgctcagttctctagtttgatgaacaattttgatggagacaatcctagtaaaatgttgccagtgccttttgtcagtttgtcagaggacctacatcctgacaacagaagtagttttgttgatatggatcttgatatgactggctctggtgaagtagatcctgtcacagcaggtggaagtggaagtatgggtatctcaccacggcctttggagtgcaagctagaactagtctgtattatttcaacttttttctctgttgtgccgcttcatacctgggaagtcttgtacaacttagctgacaaagaggtcaatatcaaggtacgaagttgcagtagtatccactaaaatatccctcttgtcctttgcttcaattgtattcttggtttattatttccatttgcaggttggccaggctatcttgcttgaactttgcacaaatatctctgcctcatcaagtagtttatcttctgtggtactgtcttgacttccattaaatcgtacttcaatctgtggttgtgctggtggtcttgtgagttttatccactcaggcatttatctgattttatccttttgcttcggtcatgcagctcaatcttgtagttgatatgtgggaaagaagtgcttgtacactacttagctctgcagattgtttagcacatgtccatgccttgctaaggaatttgacagctaattgtgatgttgggcataatactgatggaaggtcacaaggatgtaaagtggcatccaatgaggttgctatttgacatatgatacaatttagcatgtttctgttagccttcgctaaatatttctcttaactttataacttttgttctgtgacaacataccttcagttataggttttcatgagtgaacaccagttttactagttttatacagttggtgtctttttttaataactagctaaatacatgtgctttgctacggatgcatgcactcgtccctgtagattttagagattgactagataaccacaatatatagaaatactatcttgtagtaatatggaagtacataaggagtagttggtaagaaaatataaaatagagttggtggggtggcaaattcactgcctctaccaatctaccattgccttcttttagaagagtatagagtatagctatagatataattaaattactcaaaattaagtactatttgcagacctggcaatcacagtcatcatgttattggatggactgctagttcttttgcacttaaatacatgctgaacaagaaatacagttagaagaaatatctaaggtgtaatttaaacaaaatcattttctgctgatgttcacttggtcagtatactccatatattatgatttttcatcatgtagtgatgtattaaagcgccatttcagagcatatacacctttcttgaacaacagcatatttatcaatattttttttttgtgtaactggatcctttctccaatatctagtagtagcacactaccactttcttcagacagtcggtggccttgattgactaaatttggtggttgaaaatcctttagtcctggctatcgttgataaatgttatgtgtcattcagtatttagagatatgttctcattaacaaattcatcctctgcagttccctagaaaacccataaatcggctagaatcattcataaataaaaaaatgaaacttttagtacagtccattgtacagtaggtttactatgggcaactggttcccaaatgttttcttttggtgaacctggttggactagttcataatctatagtcatgctaaaatgatgtcttacatgttttatcttctattttaaagttgtgataactgctagttctttcgcacttattccagaaccaggatgtcttcttagacttactaaacaaggctacagagatcagtttcacagattggtttttccgcatcaggctgattaattgcatctccaactttatttatctgttccctgatgtcgcacaggttatttcctttatctgttatcaagcactaccatctcaaatactccctccgtcccaaaaaaaaggcaatctaggaggggtcacatcccctcctagtacaacgaatctggacagagtgttgtccagattcattgtactaggagggtcacatccactagattcattgtgtgtgtaatccattattctgattgcaggacatgattggtcatttgcttagcatgctgcatgatactgattaccgtgttaggttgtatttggctcggaaaattgttgtgctattccaaatatgggaaggacacagcgagttgttccatgatgtttggtaagtgaaacaattatgataaaataatgctgagctacatttctgaagtattagatactgatattatttctcatgctttgtattggccaatttcagatcaaaattttattgtggtactgtcactcttttaagtactagtagtagataggtatactagaccttttagactatgaaagcaatgcaaagcaagaggatgtgttaacagagccaatatttctacatgggttgctattgatgctgtaagagtggtcggatatgttaaataataagttgtttgcgatgttctttctgttactgcagtgcaaatcataattgctacttacttattctatttttgatcaaactaaaaaatgtttctctttattcacgaggggctagttgatttatgcttacaatttttaaaatgctgggaaaatattttactcaccgtagaagtttagaattagggactgtttggatccaggggacttttcatttacgtttgttataataagtgtgagagctggaaccacctcttggtggggtggtggaattgtggatgcatgactccacccacttggttcaaatcctagtatccaaacttgttcataggtgagtgtgctttattaggattttgtgaggttcttggatttatccttgacctttgttagttcaagcatgtgctaagcggctgcacttcgaggtgcacacatggtggtgtgtgcacgcgcacacatgtgtgtcttgtagttaaaaaggaaaaagaaagtgtgatagttagcctaccaagttttctgttaataaatactctcttttttaatggaaaacagctccagtattggtgtcaagatggtgcagttttcaaatgaaaatccagttagagctagagaagtgttggctattggtccacagcctgttcctattattgaaactgctctgattacactagctcatttgtccttacaaagtgaggatattgaggttgaggtatgctttgatctcaccagcttttattttgaaataagagtatatgtgtcatattgatttgcgtaccctactgagttctcttggattgggttgtgtgataaacgtattggtctgatctttgatgtatatagtatgtactgtattcagtttgcacttaatttatacaacagagttatgccttttatttctgatgttgcagtgtgtattcatgatttccgctgttgctgctatagagccttctcagcggtatttctcactacgaataaactatttacattggtgcatgcacatgttctttgcttcttattttcatgctacttccatttcagagaattaacttatgctctatttgattctgtctcaaagaggctcaattatgcttcacgaagtaaggtgagtagcatgtctcttttgttactttgctgagtattgtgagcatgttaattggatcttgagataacttgtttgtttggtttattgtaaaggataattgttcggttcatgcaaaataaaatttataccatgatttcctctttttttttttgcagtatttggaccaactgataggtccaattcttttccggtgggttgcttgtgaagtgagcctagtttcgcttgttgaggtaatcttctgctccagtgcttttcgtatgtcaattattgaattttgttaaaaaataattcactttactggtcagcctgatactggttctctgcaagtcctggaactgttggtgcttttgtgtgaaggtattggtgtgtagttggtgccttttcggtgttcttctccttggtgaaaccacctgggtttgtcattgaagtaatgaacatcgtagacttgaacttttattaactgttacgaaagattgatatacaaacatcattatttaatggttaaaccacgtgcctccacaaggataataagttactgacctacagaaggtttctctacactaaatttttcgtggctgttctgcttttatttttctatttgtgttgttttgctttcgttcttttcttgatgaagagtcgtcagagaagcaggttatttatagtaattcgatccatgctgttgcctgtaaatctttcagtttcatcatatttttgaatcattcatatgttttgctgtattttatttatcatatacaggtgaaagaaatgtttggctttaaatcggatgagccaaagaacttcattgaacattgctgctcatggttactttctttccttattctgaggggtgagactgccgatcttaattggctatccaaggtgaatggatatttgttttaatattggcagtcatgtagttcaatatttgttgtgtttattgttattctaaaattctggaagcttgccagttttttatttaactgtcaccgtgttaaggactaggatctccatgtggaactcctaaatatggtcctaacttgttggtttaataaacttttatacccctgatttttttaacttaactgtagaaagtggtcatactgtgtaacatgtcaaacaccaatttcccttaaaattatcaaactgtgaagtattttcccttttcaaaatttgtttgagtgtttcgatggtacttcgttctatgtatttgtgtaacctgatctggtcctaatctctctttttatgtgtatttcttactcagattttgtctcaacctttgtctgctgttataaagggatactttgtcccgatctttggattgtgcattgctgccagatatggctcagggccagaaaaggacttagcagagactgtcttatgtgaatcccttttgcagcttggtgaaatttctgagcctgagcgcgatgatctcattaaaaaacatatggtatgctccctgaatagccttttcccttcaatctgcatgcattgcattctgtttcattctttctatgtaatttgctgcaactttgtcatctggcacatttacattctctcttgttcagtgaattttccaaaatagctaaatattaaattcagatgtatgtcttgcattacagtacatatataagtgatattgtttaggcttcttttatgactgggtgttgtgttgtgctaaaataattttatattactttagtcctcatcactttcacttttttatttctaagtttccattgcccctttgctcacattttggcatctctattccactgcggttgactagtttcggtggcggatctagaaatatttatgagcctgggcaagtctaattaacaacgccaacagatcccatataactccatagactatgtatcatataacatttttttatcatattctaatttagaggaaacctatggttgtgtttttgcaaactatgggacttaggccctgtttgattcagcttaggattattataatctagctattaggagtaagctgaaacaaacaagtagattattatagcagattattataaactataagccagattattataatctaataagctgctctaaaggagcttttttcagattatcgagtggctaaagacccactacccctacatacttgagaaaaattacccacctatgccatcaaccgaacagatagctgagggcattatagacttaataatctagattataataatcataagctggaacaaacagggcctagtaatttgttatcttgaaaaaaatataatgggtgctagaaaatttactttgccttcaggctgcagatgtctaatagcttccactcaagtagtagataaaatgatctagtaaacaatcatggtgcttcaggctactctagatgattgtgtatgtaacatctattaacagattattaaaacgtacttatgttgcttcatgctggctgctgtatactgtggctaagcaccgagatttagaactaatctaatgatgcatgcggcgccggagcccgggcagctgccccgggttgctgggccctagctccgccgctgactagtttagtctacttgataatctacagagctataaaccgatccacatttttgtacttttttttttctcactcttctcctgttttctaggtttccatagttggctttttgctatcagtttcatcttcttcacgtcagccagaaatcccacacttctccaaggaggctgtggcacactcggtgaaaacagttgttgacggatttatggatgcaatgtatactcttctttttttcattttcaatacatacataatgcttacatgccaattcagtagcattgttgtgattttccacatttcagggatggtaatttggctgaaacagttgttattgataaaatcaatatattccgttcagacagggtttttaaggtacccgatctacatcttgttgcatgcttgtctaatctctgaactaaaacagaattggaatgtctttttctattatatcattttcttttatagataaagtttatcattttctaagacatcaagaactgtaatggagagcccaaggtttaggtttctctatttaagtgtattcttggttgtcacggttaatgttaactggtatagatctaaaaaaattgtttatctcgtaaacaacccatcttcaatctcagtggccgatgagaatagagattgaatatgttaaacgtaccagttgttaacatattttattgtttagggggaattatacttgttttcttgtacattttatagtacaagttgctaccggttttgctatgactttttactatcatccagttgttattttaacggagttgcaagacattcatcatttcgttctaatctacatattatattgtttttatgatcataattggatttgaccaagttccatctaatttgcttcccattgcagtttctgttggcaatacatcagcaaattgcagatgctagccatcctaggcatattcgccatcggctttgtgccattgaggttttgatagatgtacttgggcatagagtggctctttacagcacttggttgtgagtgtttttatctattctctttcctaattgtagttgagcccctccacacacgcacgctacaaacacacacacacacacacaaaaaaaaaaggcctcaggaattgtacaatgattcacttttggacatgttcttgtccaaaaagaatatgttgcttatgtgaacataaatgtttagtaacctccaaggagtactagctgtacatactggcactaattaagagttcaagtcccactttaagttgaatattacttcctttgtgtcaattcgtcgtttctttcaagtcccatttttttctggatagactaacacactgatagcatgtgttggcttgcatataagcttgcgattatggcctattgacttgattttcatgttgcggattatttattttgtttttactatgtgttggagatcgtttgtggatttatctgcttgtgtatttatattaacgtttgagcaatcatctttttcaactgcagctatattatttgtatagtggggagttacatccagagacaaccattgcaagaccaatgctgcaatatcttgtccaagttgttggctgctttcaattcgaactgttctactgaaactgatgctgcgcttggcaagcagcttcaggtggtcctcataaatagtttttcataatttatcgatagtatgtctgctcgcttactccttataaatggactttgtacagctcttagttccaaaattggtcacttgttgccttcgtaatgagaagggagggaaaggtgctattgcagactcatcaagagttttatctttgcttcgtcaattgacagttgatgctgatccattgctttatgattacataagagtatgactcatctccactctccatctattctgattggttctttgcttattctttacgatccattgcttcatattttttaatctgccattgatttgcttagttcttaatgatcttacaggatttggagccacttcctagctttgattgcttaaaagatatacaagtgttccatgcttcactttctggttcctatgattcaagagatcagtttctaaaggttgctattttaaattctcattttttttgagtttacattcactatgagctaatgcactgtttttacttcctgtagtttgttagcagggctcctcacttgccaccagagctgtttctgctgaggtataatttccttaattctctctcaagtctaagagccttttctaatggggtttctctgttaattgtgtgtaaatgtgttaaaatgcatcttgtgtttcttttcaaggaggtatggtgtttttcattgttctaacataatttatttccttctattcttgtacttttaagtcttcgtatgcatcacaagaagttattattgggagagatcatatatagaggcgatgtatctgtggataatgcagacacaattagctgttggcacagtgacccggatgttgtttctgctgtatggactcttgttgacctctgtagctcatcgtctgtggcaaatgaagcttcatcggtgcttgctgattttatttctagggtgtgctttcagtctttattcttaatccattggcatgctcctccattatgttgttgatttgcatttttctcgtcgcaataactcgatctctttaaactaatgcaggctggcatatctgatgtgcatcaagtgatatttcatgtgccgaatcttactgaaaagtatcccatacaaccacatatttccaaggaggataaattgccctcggactatggcatttctgatgatattttggttggtcttctgaaacttttgaaagcttgtttgtctgatgagtcagctgaaataatagatgttacttcacggacactgagggtaagtcgtttagtgttatttttgctcttaactccctccgattcttgaaagaacgttgtagagcatgacaggtgtgtcctgtaatttttttatctgactggacttatccccttgaaatttgtaagcactgttctcttttttcttgttgctatcatgaattttctgtaccaaaaccacactggatagtggcatacccacaaatagaatgcactgattaaactttctacggggtcagccaagcccatactgtaataaatttggagcctcaagtattacttccaagatgcatttcatttactgaatttcttagtatgtggtcgtgcacaggttatcctattattttagttgcaaagaggctgagttgtaaaaaaagaagagaaatcaagtggaccaattgctgtatatgcgattttccatctgctgatcctagacttagaccctcttgttttgatcaaatcaagtttgatttctttagacatctctcgattaaaatacttaatagtacccaatttgttaaatattcacaaaaatgttcccactatatttgttttgactccttatgcagatgcaatacaatacagtatttgtgtaattgtgttgttgaaacaacaattgtgattttgagatcgaaatcgcagatgaatgattttgaatgcggtagctggaagctattttattacgggtgctgcaaaactttttcttgttttttcatgaacagggagttctgtcaacggcaaggggtctgaatgctctgcattgccttgattctcttgataggtctttgctgatggtatgtggtactatgttgtcttgtcattttgttttgcttattactaagttcaatttcctaactacctttactgcataggttcattcacgaggcataaatgctcaggtagttgaacaaacacttttgggcatggaaaaggtttctggtggtgagtcatagtttatgatctcaagcacgtctatgccaatagttgccagcacactgctctaaatcaatgttgtaaagatctaccacattgcacattcataaaaaacaatcactcattcataaatctatgggtcaatctcatgatccccgttctgtccacatgcacataatttgtgaattatttcttctggtaaaacaagagaataaaagggtgttgcactgcatccgtttttttttttataaaaaaacattgatgtaatgtcttgtttaattaggaaagcatccataatgtagaacactattgaacaagcttctccatggtgcagtgcttgtttattatgctccctatggtatgacatttattattctctcttttttcctgccaaactttggctcgatagtttcacttgaagattcagatttatggagaactgatggtcggacttacaagcaatggctatgcaccttggtgggctcactaatttgtcattgtgatgacatcatcttgaggtaccagtttcaactgagaaatacacctgtaacagtaactaaagcttaacacatcttcttcaatgtgactgtattgttgctgtttgaaatgatgttcttcttatagactttgtaggagtattgcttttctcaaagttgaggttgctgaacttttgcttgcaagtgctcttgtgaacattgcgggcaatttggattcaaatgctggcatctgcagattaatttcatctatggtttgttgcatcccaagttatttgattacttgaaggttgcacggttggattattgccaatctgttgatgacttatgttttactttaggtggaggaaaaaatattttgtgactccaatcatttgatgaagtcagtttatctgtttttggatgcgctgaatgttgtcaggtcttattatgttgcagaaaaagccagaggttgcccttcaaatactctcaaggtattctgttactgttaatttataattgtgtcaggaaagaaatatatgttatcatatcataatcaatacacagatgttatttgtaatgtcattgttactctattactacctccgtcccaaaataaggagttttaggcttagacacgggtattaagaaagtatgattggctgagaagaaaagtaggtggagaatttgaattgtggaaggttgtgattggttgagaaaagaatgtaggtgagaagttgttatattttgggacaatttttgaatgctagaagttgttatattttgggacagggggagtaatatttttcatcattaatattgagcacttgatatacttgtttctgtttatttgtcttttgaactacgtattgaaccttgtaggatggtagatctgttagatccaaaagtcgatcaccaaccaccaccccatcatcctcctggaagaaggtattttattctactctctctctctctctctcacgcacacacacacacacatcctggagtaacatttgctagtacgtttcttctgtttttattgtcatagtatagcagtgcataagagtgtggcattgtcagtctaatttctttcggaaaaaaattgtgattaccaagtacaaatgactatagtcctgtacactccttggaaaacttgaattcaattgatgttactgttagcaaatgattccagcatttagcttttttgctgttatgtcaggctttctagatggattattgtatgcataaggtagattcttgtgctatggtaaggattgattggctattcgcaaatgaaagagcttttgcttttacctatgcttcaatggacctgttatttttctgtggttcagctggcacatgtgattgaaggttgtaagctagggaaaatttgcagctgatgtccagaatcttaacacatcgtttattggacaggtgtactggctttcagttgattattttgtggctgccagagctgctaatgtaagtgtgctaccctgcccacagctacatcattatgctgtttaggtcctttgtactgtattataccagactcgactttacattcaaaatattttctggaacttgatattaagtttagaggccattcaaaactggacatgttgttcatgggtaaattatatgatacacaagacatcataggccaaccttaggctagattttccacttggccttgtcaacactcaacagagatacatgtattgcatttgacactataatcctaatggccttcttagcccagacaaagatacatctaccacataactcttagggttgtaatctgattctagttccagttcatggtttggttcctgttaaaaaaatcaatggctggattgatacaacacttgtgctgttttgcatgggttctgcaagctccttaaagctagcaaggggtcgtctctttcacctgaaaccccattgtacccaatcctattcctaccctactactcttcgttgtacgtagcaaaataattatttggactagtttttttttctcgagaatttatttggactagcaatgggccatgaagacatctataggccatgcaaatgcttgttgtgcttcatgcttgagcttgcactttttacacatgtgccactggtgattgaaatgccttgtacctcaattctcctgtttcctttgtttgtattaattttgaacttctggatcattgcagaggtgctcatgtgactttgcaacactaatgtatgttgagctttggtgtgaggaaaaattcaatatgctagcattaggacctccagatttttcgcacgaagagtcggtctgtctcttatcctttcttcaactattactttcttgtgtgtgattttagctctaccgtagttttgccacatgcccatttatgtttcttgcctttttacagttgcccccacatattgatctactggttgcttcatttactcgcataaatgagctggacagcatttatgggatcacactggcgaatgaggtttctcataaaaaaattctcactattttttgttgagttttggtaggcttaggttcatactttctatatgaactccaagttattcttaaagtggtcattggtcatggtacatttctgtatgaacttataagttagggctatcagatatacatgtgtagacccattatttaagtgttaagatcttaaagttatgttttcctcttgtttgtcgttattattctctttgagcagataacttcacaaatcattagatatgagcatgagggtgattggagtagtgctcttgaatatcacgatttacttgtaagatcaactcgaaaggagaaccatggcagtttggctgggacagcattgactggaccatctgatgtgccttctaaagctgaagagaagatgctgaactggcaaatgcacaaaggtctgatgagatctttgcagaagactggatgtagtcatgtccttgatgtctactgccaaggtttaagcaaccaaaaaagttgtcttcaacaagattcagaatttattgatatgcaagttagtacatatttcatataaccttacatcctgcaacattttttccagtagtatggcctaatttttattgcctgtcatgcagtatgaagctgcttggagagctggaaattgggatttctcctttttcattccatactcttctcagccttctacccattcccaaagttactgccttttcaatggaaatttgcacaggtccctaattttccttactcttaagttacacatctcaatgcttttgcatatttatagctgaaagaatagcttattatctttagtattgtgttgactgttgagaaacaaaaggcatggttaataatttatagtattgtagaacctgttaccttcgattgaattttaaggactcagtggcatgaactgactaagcaagataggtacgacctggacctaggcattttttaccatattagatgcatattatcagatccgtacataatataattgtgctatttatgccattctatctagaatatattagaaggtgtgcattgcactttgttgattgttggattacaaagttaatacatgtactttcttaattcggcttactggatccttgaaataaatgaaacaagggtttgttgaaaaatagttctaacttcggaccaatagaaacctgttacctaacttctcatatacaacttatttctccatgctttagttgcttaagagctctgcagaatggtgattccgaggagttccatgtgaagctttctaactccaagatggtatttaatttcatctgtggttcacttccctctgttggatttattgtgaatctagcttctaatacttattattttatccccttttaggatcttgtgctggctctttcaaatgctagcaaggagagcacaaaatacatccattctactgttatcaaactacaggtactggcttgttatcttacaatgatatacttgttgtgatacttggtatgaggtacattgttactctcttttgttattttatagatgttagatcatcttactatggcttgggacctacgatggaaattctgtctcaatcagacatcaaagtcttatgttggaaacaaggatttttctccagttccaactgttcctacaaggatgcaggtttgtttcacatctgttgtagtcatatataatattttggctagttctctcattattttgtttgaaataaatgcgactcaatttacattcagatttcagatgtaagtttggaactgttgttgtgtctatatctatttatgtaacctttttaggttgccatgtgcaagcgttcgcgaaaaaggttgccatgtgcaagaaatacccccactgtttcacagcattatacatgtaacactttagcatgcattgtctgttcttatggagatagttctgacatgatcttctgttcaaaatagacaattggtttccttcacatacatgtaacactgtcaaatgtgcatcgaggttgatacagaccagtcactgtcttatattgacttttgtatcctcccactgattgtaaatcactttggatgcctaagatagtagaatagctacatgtacatgttctttttcattccccatactaagctgcttgagtttgtttggccgagaaaacaactttaagtcttttatctctgaagagaatgcacatatgtatatgtggtttaccactgtctttactctttaacattccttgtttaactatttgaattttccttgtgaactaatcgtttcctacatattttggttgtagttggaactgctgaataaagagtggactttcatcctgtgtcaaacagaacgtaaccttgaccttttggaaccttttctagcattccgcagtgccgtccttaagatcttaggttctgaagagcatctcagagaacatttatttcaatctgcttcagcactccggaaggttgtcttgctgcttttaactgcagtcacagtttcatgctctttctcataataattctgtggttccttttctggattcagggagcaagattttctttggctgcagctgctttatatgaactcaaagaacttcgttaccacatggatcatcaagctatgccaaattcttatttcctatttaaggtaaaaaaaatcaccttatgtactccctactgaaacatatgtttctattcttttcaacataatcccaaaggtaagtagaaaggtatagctacttgaatttgttatttcaatccatgagcactttgagaaatttcattgtaaaaagtggcgaagagcatttctgagagctgccatttaacctcctacttttctcctttgttgctggctttgggcatgtgagcatcagccacatagcaaagctctacacacaccatcagctggcagagcagcacttgcctttctgcttttagcaaggcaggataaacttgttgcatatgttggctaccatatcagttaattgcattaagtcagcatagttagtctaatttgtctgttagctgtgttattcaaatattaataaacagatagattggttcaggtgtttggctattatatattagtacttcagtacttcattatcatcatttgttcttaaagttcctagactctcctcttctttgatctagcctcagagcctctaaccatgtaatagtgacgcagatggttacatgaggttcctaccctctgttctcatatcatacattcgtacccaacaaattaagtactagtagtactggttttaaatgatcagtccatgtagcctttccagtacacatttagttcttaatcggccttgtctttttaatatttgttgataagtcatcttttaatattagtgtcccgttggggacaaaagagctctatagttctagagaatttgccctgtttcctataaaatccatgtaaaacaaataggactaaagttgcccatagaattgttatcatagctttgaaactgggaatcgctcgaaccagcaagcccactggttcactggtttcgattggtggttcctatataataatattatagtggtttggaaaaataaaacctaaagtaagctgcctttgttgataatattacacatattggtttatatatattgcttatatgttgtgaattatctgtgatccatgaagttcatgtcctgcctttacactccagcttgaagaagctaaactgctgagagctcaagggcagcatgatatggctataaatcttgggaaatacattctaaagaaccatcctgataagaagaatgtatcagatgtctatcgattagtcggcaagtggttggctgaaacaagatcgagcaagtaaccatttatttctactttgtgctttgcacttgtttcatgtattgagaactgttctctattttctgtttgtgatatatgtatatatatattgtagttcaagaactatcattgatgactacctaaggcattccgtagattttactgaattgcacaagtgcccagacaaaaagtacaagtctaggcagtgccgaacatatttccatctagcgcattacacagatggcttattcaaaagctatgaggaaagactttcatccaacgaatggcaagcagctctgcgattaagaaaatacaaggtaaggaactaagtttgacagtggcatcatatcgatatcgaacttgaaactgtatatctcaatacattttctatttaatgcagtctaaggagctggatacactgatgaaaagacttaaaagttcatcaaaggtaagcactgcattttttcatggtgtctgaaaatgtcaaggagcatgggcactgttggctactgcatactaatccttaaaattttcagagtgaaaagactgattactcagtgaaaatccaagagttacagaaacaacttgcacttgacgaagaagaggcagggaagattcaggtgtgcatgtgtagtttaaagtatataaaatatgcctctcatgatgcattcagtcaaattttcaatacgcctatctggtcacagacctatccaacatcgaggtcctgactccaacttaaatatagcatttgctgctatcacaaattcatcacgcactatatcaatagtactaaccagatcaataaccatatatccacaaatattgtgcttctggccacagcaaccacactgttcatttttctatgtgtgcatgatgcggtgttctaaaaaaatttctaacaaaaacacctggatgatattttatgccttcacagtgcacacatgccaaatttagcgctaaaattcaaaaaagcagcaaggtaacaaacattattgccactatcatgcatcattctcctgtactactcttttcagttatccagaacctgcatcatgtgctattgtcttgtactactccctttttttttgtcatctacagtatttaatatcgacaagttggaccttgaaatatgcatgtgcatagaattacaagagccacatc

SEQ ID NO: 50312 - DNA, 17646 bp, Oryza sativa
tattctagctttgaaaatacgatggtgcatgtttactgctctgcattgtatacctactattttaaacattcactgaactctcttattaggatgatcgggacaaattcttgaatctagcgcttcaggggtaccaacgctcactcgttgtcggtgggaaatatgatctacaagtggtatgccatttccatttcaagatcttataatctttgaatcggcaggtgccagttaatgtcgtgtaatatgtaatcctgttcatatatgaaatctcctgcttgttattgtttcatattatttcagtcacaatatgcttgtgttgtcactataaaaatgttttcatatggtgtgaagtattcacctcctgcttatcattgcaagttgcaatcatccattttcggatatagtattgtttcttgtgttagtcacaatatgcttcatagttgctctggtattcttttaacatttaatgcgaagcattcatctcctgcaaataattgtaaagcacccattgtcctttatatgtcattgctgttatcgtttcttgttaagagttcttcctgtttcagtcacaatgtgcttgcagcaataaaattgtttagtttcttttgtacgctgtgctctttgtatatctcggggtatagggacactgttatttatagcagtgctaaacatacgttcaggttttccggttggtctcactatggtttagtcttttctcaagagagcaagttgtgaaagcaatgatgaaaacaacaaaagaggtaaatcttcaaatttcacttattactctcttggtgcttttatcagcttcatggaaatgttcttattgtataggtccagtcctacaaattcataccattggtctatcaaattgcttctagacttggtagctcaaaagatgcgcagggctcaacaaacttccaggtatacatgtcttactctttcagagatttgtttgcattgggtaaacatgaatcttataacgccatcttttttttttcttgcagaatgcgctagcttctcttctgaagaaaatggccattgatcatccttatcatacaatatttcaggtattgtagttgctgatctttatatatgtcgaaaggaactaaatgatatgtcagataggattaactagcctgctgaatgcctaaaacaatatgacatttcagtaatgtaaccgctaacactaaggcaaaatatactaatatagtctgccaaacatgagctctgggatggggcctttgaatcatttcaaatcacctgtagccaggtcatcgtttttgaggggtgagagtaagaaatcattctagacacctagaggctcattacagaggttccagtgtctaactacgactgtgggtaagttctactgaggaaaggatccaatacacttaaacattgtcaaatctctactatatataagaaccacatggtggtgatggtgaatctgccatcccaccacctccagagttgcggatcttctaaagctggttatatatatcttttatgcatttggtttggctttttgtggattgattgtgaattatatatgtttttcctcaaaaaatatattttgttttcaagtttattacttatgatttatgtttttagatctgctataatgcacaggtatttttattgttattaaaaaaatacttggaataagattagagtcaaacgtgtcaaacttgaaaataaaatacatttttagtgttattacatctatacttgactctacccttattccttctaagtttttttaatggcaataaaaatacctttgcattacaactgatctaaaaatataattcataagttctaaacttgaaaatgaaatatattttagtgcacttacatatgtgcttaaaatggcacacattctcagtttgttcacttacatgactctgcaattagctcatttacgtgtactttatgtatttgaaggcagctgcagtgcattttaatcattctctagaattaagagtcatctcttttgccattttaagcatgttgtttggtactcagcttttggctctagcaaatggtgaccgcgtcaaagacaagcaaaggagtagaagttcttttattgtagacatggacaagaaacttgctgctgaaaatctgttaaaggatttatcttcttctcatggagctttgattcgtcaggtttgctactcttttcaaatatctatatattcttattcagtcatctcagatggaagtcaaaatgcatttattgttaaagtgtactctttattatgttcatttgcacatcttgtagatgaagcaaatggttgagatctacattaagttggctgaactagagaccaagaaggaggtagttatcttttcaaaagcaacttgtgctagatttttgtccatattatccatgttaaaatattgatgccgtccatcttattatcaggacacgaacaaaagaattccactacctagggagatccgcagcatttgtcagcttgaacttgtaagggaaattttacttctatgaactttttcttgtacttctatgggggataactggtttgtgctatcacatgctagtagtgcttggtagaacctctcaaatctctgaattaaaaacttataggtggaacaaaattgcttcgttctgttcgtttataaacttttttattctttggttgaagaaactaagaagatagttttatgtacttaaaaaacctaacattctagcggatgcgttgtgtcacagcaattttgatagcttttgttttctattattgccttcattccatattcttttagtttattgatagcactggcggtccatttcaaattatccatagaaatttcacttctctgcatttttttttgaaccatttctatttggttttggtaggttcctgttgtaactgctagtattccagtcgatcctaattgtcagtatgaagaaggttcctttccacattttaatgggctagcagattctattatgtaagttggtctgcaatttacccattacttgtgactgaagatttaccttttgatctttattaactgttgggactcttccattgtggtagggtaatgaatggaattaatgctccgaaggttattgaatgtattggctctgatggtaacaaatatcgccaactcgcaaaatctggaaatgatgacctgcgacaagatgctgtatgttcttattcctacattttaagcatgagaaagttttacaagaatgcatttaccatgtattgtttgagagctttcaagtaccaacaaagttctagctttcttattttatctttttctcctagcctatgtactatgaatctgctcatttaaacttgcatcatgggatgtctatctgtgtgttaatttgtgatccacataagtgccctagatgtttgtcttcattagcaagactacatatgtatttcagggaaatgattagtacatgtatttgcatagcaactagtgtgtacccaattgctagtaacagctagtgcaaagtatgactaaaacagttgggctactggcatttgaccatatcgtagaacactatctgttacctaccgtaagcaattctgtttagtgggacaaaggagacatggtttggaataatgcctgcagtatacttttatctcttgtcatagtgctttacagtgttattatctcacatttttagactatcaccaaactgatgagttagcaacaggaagtaaacatagcaaccagctaccattgtagttctgtcagtattttttggtcactgtctgctaaggtcaattgaaatgaattgcgtggagaaatttttttcagcaatggcctatcttgtggatgaatgagttgtgctatattgagtacatttacaggtgatggaacaatttttcagtctagtaaatatgttcttgcaaaatcacagagatacatctgagaggagattgagaattcgcacatataaggtagaaacaaaattcatgaatttgaatttaatcaagagattcgctccttttcttttcattattgttcttagatatcttcatgtccatcttagtttttcattataccttctttgtagtttacacaaaattttaactagtttatgtaacttaggttgttcccttcaccccaagtgctggtgttgttgaatgggtaaacgggactgttcctcttgctgaatatcttgtgggaaggtattctgcgtgcacggttcctgctattttatgcaatatacattacaaatgctttatatttatgtagtttttttcccctttggtccatacagtacaagaagtggtggagcacatggaagatatggaactggagactggacatatcatcaatgcagggagaccatgacaaatgtatgtttacttgtggaacttttttaaaaaatatttgctatttataccatgacaacatatgtccaatactccaatctaaaagcatttcttttttttaataggaaaaagacaagaggagggcgtttgtcaaagtctgcaacaacttcaggtcttctgttatctcttatattcatttgctactaggacaatatggggacacatgaaaacatggcattcacatacatttctttgtcctgtaataccaggcctgtgatgcaccacttcttccttgagagattcttgcagcctgcagattggttccaaagtagacttgcttacacaagaagtgtggcagcaagctcaatggtaatctttgtagttaatgagcagtatatgaaatcatttgtctggatctgtactggttactggagaatgataagcactggctgtcaattttgtcggttcaggtaggatatattgtgggacttggagatcgtcattcccagaatattctcattgatcaagagacagctgaggttgtacacatagatcttggtgttgcatttgaacagggtctcatgcttaaaactcctgaacgggtatgtgatgaagcatcatatttgtattcctaaaattgtcatcttgctgtttacgtttgtgaaactctggtgtgtgtgagtttttttttaacgtaaaatggatgttttatattgtcattttctttatatgtacgtacgtattttccattttttttcttttgtaatagcctgaattaagttttatacctctacttgcaggttccatttcgcctgacgagggacatgatagatggcatgggagttactggcgttgaaggtgtatttagaaggtgttgtgagaaaactctttcggtcatgagggcaaataaagaagcgttggtcactattattgaagtatgtttgttatcaaaaggctttttatgtatctggaaaaatcaatatttcaatttcccctggtaacatatgtaatatgccaggtcttcgtccatgatccgttgtataaatgggctctttcaccactgaaggctttacagcgtcaaaaggtaattgaaaatatattaattttcctcatggtgtgcactactgtgttctaagattcatcttgtttctcttttcaatgtacattgaaagttgttggaattacccattagtgctgaatgttgttcactgcactccagtgcagggttcatacaaccagcatctactgggcatacattctgtttggactgtcagcattatgactagtaccagccaatatttagtattcaaacaaacttgctggaatgttattcccaaaactaagccctttggcaatgccataggagcgagcccctatttgtgtcatgatgctatggcaaggttgctttgtcttactgcatcagctacagtgccatggtgaaaagggtttaaaataaaaaatggcaaaggcaaaggtagtgttaaagaaacacacacctatgcccataaaggttctatgcagcaggttgacagcctgcagttaatgatggaatgtagataatatgttggattatatataattgtatcaaaatatgtaaaagtttattataaatgtatctttaaagcctttttagtacgtataaaacacgggagtaaatggtctgtcaattttacaagcataacaagtaaattcacaagtaaacttttagcaccgctatgtggaagacaagtatgcagtcgtaagttatgtagcaaatgaatatgctaacctatatttttgcaggaaagtgaagacattgactcgtgcttggatgactcgcaagaggcttgcgagggcaacaaggatgcagcccgagctatcctccgtgttaagcagaaactagatggatatgaagatggtgaaatgagaagtgtacagggccaggtaaccaagcactctttgacccttggtgatgcgtgtgcttgcaaagaggaaatatatgtttatgatgtttgtatttgttgatgcaaaactacacattcctttatgtttgggtttcaggtgcaacaactgatacaggatgcagtagatgcggaccggttgtgccaaatgtttccagggtggggagcatggttgtaagcagtaagcactatgccactatgaacaaaaagatggaatctgagccaaggcaaaaatgtgcccatgaagcttttagttgatgccctcagggtgctctcccacacatacattcatactgtatgggatgggatgggttctttaattgatgccctcactcaaacagcagtagagttaatgacaagacagtggcatttggttgttgaaagattcaaagggcatgtctacatacatcaaacagctgatgcctttcgcagttgaacacgatgagaagattttcttggcgtttgcccaggcacaaacaaggtgcggtgtacagtgttgagtgtttcctcaaccccctgttacgatgcaatgtagagctgacacacaaacgaaaaacatagttttttttttttggccatctgttggtgcgtgagcgtgtacattatcgtagaaagagcttttcctgtatcattatttgagcagcgcagcgccttatgtatcgatcgatttttgcccaacaggcagagttttgcgttaatgagtcgttatctgcattgatgtgtctcctgactcctgagagcagattgtatggtggtgctttgattttttttttttgtcgattttcatggtgccagaactgcaatcgtctaaaatatgcatgtacatatgatgtcctagtaactcgtaactgaacaatacatgaacaatttttttaaagaaaactttgttggtataaccggttacaatactcgatcgcatgttgtatataattacataggagtatataatagggtgcgacgacgttagcagggatgaccaaaaggttgatagactcgcgaacggaaataaaggggttgtttagatttatgtcatttcaaaccatatcattttcggctaaaattgttaaagatgtatgtaattctgctaaaacttggcaatattgtcaacttaccaaaattttgacaatacaaaaatttagtaaaatttattttggctacaatatgagcaaccccaaaatacttcagggcgtatttatatattactaatagataagaagttattgtttccgaaataaagaactggaaaagaaaaggaggaaagggtgaaagagaaggcacggcccagtggatgcatgatgatgggccatggcctgctttgtggagtccatatctgatctgatctgagggataaaaagaaaaaaagaaaaaaaatctcatcttccaatcccaacctggtctggtggaattcctgaatccgggtcgatcgagagctcacgatgtcggccatggagaccgacatcaacgcgccgccgccccccgcccccgcccccgccggcgccggcgagggatcctcctctgccgccggcccctcctcccgcaagcccaacaagcgcttcgagatcaagaagtggaacgccgtcgcgctctgggcatggggtaccctacgcgcatccttccttctctactcccccctaaccctaataatctaacaatcttctgagttctgatttgatccttgttcctcctcctcagatatcgtcgtcgacaactgcgccatctgccgcaaccacatcatggatctatgtcagtccgccctcccttctcttctcttgttctttttatttccccttctttctgttacttattattaagggcgatttgaatactaatctgcttccttggctgcaggcatcgagtgccaggcgaaccaggccagcgccaccagtgaggagtgcactgtcgcttggggtacgcttccatccacttttaccaaccaatcacaccttgtttcaattgccgcatgctaaacttttctctagactggctcaccattcaggaagcaaatcttcatgtatatatcactccgccatttgccatgaccaatgtcttaattatcccattcatatatatatagctattgactgatgcctgttaatgtgttattctggttgatcaactgtcagtccactaggccagtagtctctaaccaatttgaactacacatgttctgtgcctctgttcttgatggatatggctcagtgtaatgatgtaatcgttgtgttttcaactttaggataccaggtagcgtatttttttcaaattggagagagtgattgacttataatgtagtgtaaagatacatgtgtatgtgctaaggaaaatgtttatgtgctaaaaaaaatgaaaccaaatctaactacatgcgatgtagtggtttttgttaacaagagtgtagttgagattttgaaaagaagttgtgtattcttttacatggatacgcgcatatggttccaaaccatattttaacacatcatcaggtaagattggaggacacccaagcgttcttcacccaatgcatattcctgagctttgttgcattaactccactaccatgctcacatctttattcttattactcatagagtcaagtcatgtttctgaaattatatttaagtcttttccatgttcctcgtcaaatgaccatcctcagctcatatctaatcatactacagtattcgtaatagaagttcacccagttttatagtttgcagtgctgatggttccttattgaactgaaaaagcaagtgtggttgtagacttgaactaatgtctaatggtgggatggagcagccatgagtccatggaattctagcttccttcatatattttgtctataacaaaggaattaacaattaacattgagacatatttggatgtgtatttggatttagatctttattagacataagaattttgagattagctattgttgaagctacacctggtcgtgtggttgatgtcgtcgtagacttgtagttctatggtacttaaggggagtcagtttgatgtatgttctggtactggcagggcaatctagatatgaccctgtgacaggctaaattctaatgttcaatgtttgataacaataccagtttctaggtttcgttaatcattgatatttgtttggagtaaattccccaggcatatactacaagtaacaagtatgtaatgactctctagacctaggcccttgatattataatctgccttcataattgaataataaaactctgtaaattatccaaacatactctgttagccatgaaccaaatatcactgcaagaaatgtatatgtggattaattttttaaaaaaaacattcaaagaatttatgcatagctgatgtattctttaccttttctgatggtgcttgatttcatccctgatttattcttggttttcctgtatatgatatttgcttggttgaattgttgagtcttaagctttactggatctaacatgatttgctttcgtgtacaccaggtgtctgtaatcatgcttttcacttccattgcatcagcaggtggctcaagactcgccaagtgtgcccgttaggtagttgcagttcctgtgtatgatttcctcttggagttaagtatgttggtgtgtgctgatcaatagctcttgttccatcttgcagataacagtgaatgggaatttcagaaatatgggcactagacaccacctgctgtctgcgcttgtttgttgccacggctgcgctacaaacacaagccgtatcatctgccgaacagctccatcgttagcttcttttgatgccttacatctatcgctggacgtttatcgtgcgtacttgtcccatacagggattgtgtttggatgatttgtagagagggtactgtatggcataagatccttcatattaatgttctgtgggtcacatatcaacttgctattattgtattcagcggttctctctctattttgccttaagctgtggtaccattttaagtccagtgcttgcttttgattgcttttctgagctttccaggacatggaatcgagcctgtgaatgtcgtcggccggtttatcctttcgactaataatttaaattgtccagtgttggttaggaatggagtatcagattctggcggtttgcatgctgtttggtcggcgacgtgccttatcctgaagatttatatatagtactttgattgatgtcaagaaggaaatttctttaagaaactttttacaaatagcgattggtagaactgattaacaacatccacggctcagaaaaggaacgcaaacatatttgattcttccctaaattaatttgccattgttatttttacttgaccatccgtcaaaatttacatgaatacacaacgcacggacgaacgatttattcatgtgaaggcatgatttacatccttaaaattctctcgcatctagatatagctagagagtggccagctgctgactatgcatggagctggcacggcagtagtgtacaatgctactgtaattttgtattgctacaagtactagacaggtacagggctgaggccagtggatggctgtaggctggcagcatactccctcgcccacagatcataatgtatgatctcctccagtgatggccttgttactagctcattccgatgagcgtcgcatgtcagctccaccaccttgaagatgtccaggtacccgatcctgcaaaaacataaccacaatcatctattcatttgcttatatatatgtaaagtttatctgacgggaaaatgtctacttgcaaagaaatagccgcggaaacattaattcaccagtttaaataacttgcaatgaagttttgtcagccattcaccatttagaaaacaattcgcccttcgacaaaaacaaaccttttattttgcaccaatggataccattttggtacttaccttctgatggctacagtgcaagaacaggtaccttaccttctgacagtgcaagaacaggtaccttaccttctgatggctacagtgcaagaacaggtaccccagctaagctccaaggtttaatcaggccttttactactagcataaattgagacgttgctggttttttacgatccatgatagatattaaggctcagaaagtgtctgagaatatttaagctttaaggacatgtgttctcttttcaacttctcatggctacagcatggcattcacaacaataggtagcccccagctaagctagcaagttacaatatataaacaggcctactagcatcaatcaagatgttgtcggtttattataatccatgatatatcttaaggctcagaaagtgccggagaatattagctttgacgacatgtatgctctctcctttcagctctcactttccaaagggcaagagatatctatggactttggtagataccagttattcgttttgctgcattgctgcaatcagcaggacataattctcctttaaaattgcagagaataggtgcgtaaacaaaatcagacgatggaatccactatgcaatggaaagaggaaaagggatgatgatgagtgtcatacttttcatcgatgaacaactccacagccttctcattagcagcactcagaactcctgtcatggtgcccccagctcttccagctgcataggcgagatccatcgacgggtatttcacattgtcaggagctttgaatgtcagtgaacccagcctgcattatcaaattaaaaattaacccttcgtgcaatgaaaaaaggtcttcacggttaagtactataacttaacaattttttgttgcatctagttcttttactttattaaccttttattctttaaatttattactactcccttcgtcccaaaatatagctagtaacatgaagcagcgttcatgcctaacaaccaaagcataattcattacaagcgttaactacttgcgtatcactggtaaccaaccagccaaaagggacttaatcgatccattgaactttgtatgaaggttcgatacgagcttcattgaatttaagtagagtagatccacatattaactgttataggatggctgctcaagcttactgataatctgagtgggctatgagagaaccatgcgataacaataagaaagctaaaattctttgaggtcattctcgaacaaaattatcagtggtaatgcaaaagtagcacagcatttaagggaagagcctgtacttgcaaagatctagtcggggccaggtgacctctgagcaatagattctgtctggccaagacatggtgtataagattggtatccgcatatctggccatcccagttgagccaacacagatgaatcctggagaaacagaacttcatgaatacttgaaaaaaaatattaagccaaacgtaaacatgaaaatacggttgccatatcaggattaagtgtgcatgcattaacagtttaaaatccactgcagttgagcataaccgctaaacattttccatagctgtgctgtaggactcacctgggtttcaatcatagagtgtatgatagattgtgggtggatcacaatttcaatgtcatcgtattcagcaccaaataaataatgtgcttcaataacttctaaaccctgtatgaatcaagtgatcattttagtgcaaatactgccaacatgacctcagtaaaattctgaaagtttactgcaaacaccttgttgaataatgtagcagaatctacagtaatcttcttccccatattccagttcgggtgctttaaagcatcagcaacttttacttctttcaacttgtcaactggccagtccctgacatcatcaatggatataagatggagtccaatgtccagtagaaaaacatatataacatgtatgtcagtagatttacctgaaagcaccacctgatgcagtcaaaataatgcggcgaagtgctccttcgggcaagccttgtatacactatgatagtagagggaaactgcaaatcagcatataatagaacaacagtaaactataacaagcaacatacatcttactgctactttgtttaagtgttaaagataaagccactagtgtataagaggtttttgaacaggcaacgttgagtacgtaccagactatcacaaccttacaccaaacttatatcagatgaaccaagtaaaattagttacaggtaatttattttctgtggtacctgaaatatagcagagtgctcagaatcagcaggaagtattttcactttgtgcttttgtgcaaggggaagcacaaaaggaccacctgcaataagtgtctctttgttcgccaatgctatatctttcccagcttcaattgcagcaactgtaggctggcagagcaaagaaatttaagtaggcaaatcagcaagtggtgccagattctggtaatgtagtttgcatgcatacagaacttcagcaagcattcaattctttcgtttggctacacaactcattcgtctagataaatcaaacttttaagaaataagtaccaaaaagaagatcaagatattgagtagtctaaaagtagcatcatcaaggtatgatgggtgacctgatatacaaaacggtccatgcacgaatgttctacaagataagaataggatatatgtaccactaccgttttagttgttgcatatcaaactttattttttggtgcatcagaactctattaaaaaaaatctcaaattgctagacacttttgagtagataatcagcaactctacaaaaggactgttttggcatgagctcttccaattcaaacatactcgccttgaaaaattgcaagtacattcatgtaaccataataacgtatgtattccaagtgtttcagtactatatgtttaaaatggcctgttgttatggtaatataacactgggaatataattttcaagcacatatattttcatttctttctcaataaattcttgaatatacttgttgaaacatcaaagaaataattgagtttttgtaatattaacacctaatattaaaggaagcagagcaaagaatatgcaatataaaaagaaagattaccttcagtcctgcacaccctactatcccagtaacaactgtaactgcatctgggtggcgagcaacctattatatgagagttgaatctttataaaattcacagcaaagcatcagctatttaaacataaatatgacatgaaaaactcacctctatgacaccttgctcaccaggaataatttctggcttccaatcacaatcagctaaggcttcctttagctcatcaactaatgactcatttcttacagcaacaagctttggtttgaatgttttcacctgcttagttaaacaacctatattcagttaactttcatgtccataatcctaccatgaaaggtcgaaagaagggatattttcctcacaaaatcattatacctgatcagctagaagagtcacattggagccagcagcaagagcaacaacccggaatttatctggattctccgcaactatgtccaatgtctttttagttatgcaaagaaaagaaaagataaaacactattagtaccacagaatataaacgtcgcattttcatgtccaactaatttcaatgaatagctcaagacatgttgattgatcttgaaagggtcaactcgtatcatcagataaataggtcaaacatttactcttagatgaactaattgaccaaacattgatgtactagcacaactgacagatataaaaaaggtatggagtattaatttccatccgttaatcttagatcttgatgttccatttacctgtgtgccaatagaaccggttgagccaacaattgagataggcttggggccatcccatgacctcctcccaggttcaacaacggctcgaccaggccatgctggtggtggagcctgttgcattgaacagcaagtccttctcagggaaactgctcttctgtccctcgtttgaaacgggaggtccactgcaataaagacagccaaattaagatatatgaatgaaaatagtactagtaatcaatgttcaggcatatatacgtgcctacaactctctgctaactcgtttgctgcaatatgctcaagaaacatggcagaaaaaaaaaatagtcctgaggcctgagctaattgaggccgatcttgacaatttggcagactgcgtgtttcatgtgcaccaagcaatttagagtaaaagcacgttacagtagtgcaactcatctgaatagaaccatatcactagaaagtagaaactgaattggaatctatgcagaatatattctcagaacactagatattccaaagatagaagttgcaagcatgaagataatgctcagatatttcagaatttaatccacccagttgattacaaaaaggggttcgattctagacacgtaatactgacaacagcataattctcgaccaagaggaagttgcataaattctggaagaattgtgtcttatacccgtataagagaaaaatctgaacccgtttttaatctcaaagaaatgaattcagaccccttttttttctgcgaaccggggaaattccaccttttcagatgtcaaaatcaaaacagttaaggcacagagtttgcaactttacaatgactgtgtgtctatgttctccagaactcagaagctgccattcccatgcactgtgagaacgaagaccaattttattttagcccaagcaatccaaaccaaaattgtggcataaatccttgcaaaagcagcagctttcctaatcccactcacagcatgggtgccggctgtgtcgagtgagtagaagtgcctaatttaatcggcaccaggaatgggtgctctttgaacacactgcggattatcttgaaacaggctaaacagacgaaatgaagtctaaacaagatgagaggaaaacagaagcaagtcgagggccaagaaacaagaaagagcagtaaagttgatccggaaggggataagaaagaggaaaagatccaacctttgagctggttgaaagctcctcctctgttggagtcgaggaatgagaccgcggccaagtccccggggaaagagacgaccttgagcgccatggccaccctgactgagttaatgctcgactcgacgtctggtcgggatgcagaagcgggcgaatgggggagggaaggagttgtatataaacagaggagaggaggaagaagaagattgtgtggagcggagtggagggataagacgacgagatgggaatctgagactcctatggactgcagcgccagcagccgatgctccttgagggagatggacttctctcttcttcttccgaatgcccactcccaacagaaaagaaaagaaaaaacaaaaacaaaacgtgaggacgaaatgccctctctatcactgtaccgtactttatttatttcatattcatcacttgcataaattttattcaaactcggtcaaatttataatattcttcgtacattcgtatgttactggctttccttatgggttaaatacttatctcctatgcttcatcgtttgttctttggcttatcagccacaaccgaatttaagttttaaaacttaattttagagttgttttgattgtttttctcattataatttattttccatcattgaattttaagtcgtttataaaatctctactattataaaaactgaagatgtttttaccagtactttggtacgccatctgtgtataagtcagttttaagtttgttcgcttttggaaatacatatccgtaagtttgttcgtttttaaaaataccgtattagaaatctctttaaaaaacttatatgctaacttgacattattttcttgaaaaatatatattcaagcgaattcttacagaaaatttcacagtaaacaataataagattaaaatagccttcacccgttgcaacgcacgagtattttttttctagtatattaaaagttttatttaaatttttttaagacattaataagtgttataagttataatcaattgtatgtaaaatgatagaactagatatattgtttgctttgagatattacggccttacgaccagtagtggaaccaccacccgacgaaccatccagtagaaatttaatgctaatgtatgataaaaaaatatttttttctagcaaatactcaatgcaattattaggttattccgggctttgaaatattgtgaagcagtctctcatgttttgggatggagggagtagtatttttgttgggtgagtaattaaattgcagtgcagtacttggaaggagggggaagaataaatgggagatttagtgggccgcctatggatgtgtcgcacaaactaaaacgagttattgctaataaaattgtgggcagcacttgtggcgtggttgaatattcaggcattttctttcttcgcaggcgaatggcgtggtcggccggtcggcctcgtgggatgacctaccctacttaac

SEQ ID NO: 50313 - DNA, 6342 bp, Oryza sativa
  unsure (1)..(6342): unsure at all n locations
ttttttaagacattagataagtgttataagttataatcaattgtatgtaaaatgatagaactagatatattgtttgctttgagatattacggccttacgaccagtagtggaaccaccacccgacgaaccatccagtagaaatttaatgctaatgtatgataaaaaaatatttttttctagcaaatactcaatgcaattattaggttattccgggctttganatattgtgaagcagtctctcatgttttgggatggagggagtagtatttttgttgggtgagtaattaaattgcagtgcagtacttggaaggagggggaagaataaatgggagatttagtgggccgcctatggatgtgtcgcacaaactaaaacgagttattgctaataaaattgtgggcagcacttgtggcgtggttgaatattcaggcattttctttcttcgcaggcgaatggcgtggtcggccggtcggcctcgtgggatgacctaccctacttaacatgacaattacccatacacatgggacatactccatcttgacacgacatgtgtgtgtatctcatcaacccatacatacacatctccgtatatctgatagaagtatgacacgtgtacagctgcttgcgaagagatactagtgcatccactcagctggatcactgactctaaattttggtagtggaaatgcacagcaaattaaggtgaggtctggccctttcatttcatttcttttgacctgcttcaatcagtccatagtgccaccactatggaaaagaggagctatctatagctagttacgcactgcgtttcgccgatattttactacagaaatttgtgtgctttcatcttcttcttaaaactgtatcttctaatagcactagtatttggtaaattgcttgtcttcctctatcagtttaagctttttagttgaaccaatccttacgtgtgcaactcaataagtacaaacctaaaattttgcacttaccaattggagaggaggtcaagctgcttctgcatttctgaacatctgcgtgcctgatcttcagtcgtgtggagggagactgaaaacaacacaacagtatgctcgaaatctgacagtttccaatgcatgtataatagtgcgtcaaagcttcagaggcatgcagtggaatttcccagccacgagtttgaataactgaatagctaaggcaccagccaaatgttgttattatgttaattgcaggtttgaccggtgaattagtaggactgtgaaatggacgagaccataatcaggcatgctttgaacatgcatggatttctagttcacgtgttgccctacttgcgacatcccgcaagaccaaccacaagtcaaaccaagtctgaatttttcttgtttttgtactacaaggagcaacgaaattaacaaccacgagtttgaaaaatatcataatatatacttctgtctctgcatctcggcatgtttttttccatacattttttttttggagtaccaagagaagaagagaggaggagatgccatgtcaccatcacaaggcctggttttttccaaggagaaaatgaaaggaaacaaagaaatgcaacagactacgaaacttggagccactctctgtctgtgtcccatgtgcattgtctgcacttgtcgataactaacgcccagatataatagatccacatgtaaaacaaggcatgaaaataatgttgtttttcttgtaaaaaaaatacaaggtacgcaagaaagcaagcagcgcgagcatcttgtttttcttggccattactccctccctccctaaatataagttattttggttaaacgtgacatatcctagaataacgaataacgaatctagacagaaaaagaatatgtcacattcgactaaaatcctttatatctagagacagacatagtataatcccttatatttagagacagacagagtataatctcagtagagtcagtattcacacccacagtgaatgaatacacaacatttgttcctcttctttttctcataggtaatcgtcactagtctgtattttgtacacgagagacgcatgcatcgcgtggcaaacaaaaaaaaaagaaatggagtaattaagcagcagcttcccgctcttgctcggcctcgccattgcccgcattggccatggcggcgccaccggcgacgtcacctgactgtggctgctctgtcgccgcggcggattccgacggtctcgatgccgctgcaacttgctgcctcggctgccgtatggcggccacggcctccggcatgacgacgcccggtggctgtgggggaacccagcgacgctggaacgggctttcagctggtggagctggagctggaactggagctggagctggagcttcatcgatggcgttggtggatccatggtgatactgctgatacggaggagcaccgtggtagttcgtcaatggcgagccagggttccacctgtcattgctcatctgaggctgaaatccgtacccaggcctctgcatccgctgctgctgaaataagtactcacacaccatcaagttttggaatactatcatgtctactgcacctagaatccatgatcatacgatggcctacctcaacataggatctcgccggaaatgctccaggtgaaggttctcccggtactggcatgaacggatgcctccctgataaagataacacgaaagagggcacacaaaataagtgcaaggcagaaaaaaatattctcaggtgatgatacaagaaagttgtgctgcttctggtggaggctacttaccggagtcaaaatcactgcgtggtgatgtgttgtatgcgtttgtttgctgtaaatagagaaaccgaatgagaactacaacggaatgatgcaaagattaaaaaaaaaggtattgacagaaagggtaaataagaataatgagttcacaatggggtaaataacaataagctatacctgagaagctctccatgaatttgtagttggccctattcagacagataacgtcaatattagcaacagatttaaagaaaccaatgcaacaaaaaagaattgattctaaccattccatggggcagattgaaaatgatcctccattagattgtactggtaaaacctattctcactcatacgattcaaggaatcactcaaggatctaaacgcctctgcttgcgaatcaaatgcttgtgccaactttgtaagtatcttcttatctataaacaagtgagattcattaagacgatcaaacccgaaacagtgatagctattgtacatttcttctgctaaaacatgctaatgtatcaacggaaaattatgaaaccttcatcctttgaagcaagcaactcttggtttgttttagcaatatcagaaaacgctgatgcagaatcttgtatggctgctttgatttcttcataaaacttggatttaagttcattcccagaaatttcatccccttcaacatgggctccttggatccaagattttagcctaggaacaaacaatttctgtacaaaacatgcacgcatatagagttaatttctcaagaacttgctaaaattaagatagtctgcaaaattcacgagatataccttgaggatgacagcagcactagccccaactccgaggaaaacacctacaccaatgagagtacgggaccagctaagttgcggctgcgcatgtggaacgataggaccagtgttaatggcttgtggtgcttgaactgtctcgtaaggttgtactccagcagattgatttgcgatgccggctggaagcaaagaaaataacacggcctttaagtgatcaagctaacaaaaagagtttatttttcagtgtattgtaagatttttgggtacagacttgcaatcacagatatgaactactatcaaagcacaataatttatagaaccaatctaaagatctaaaatcttgatgtaatttgaattaatttagtgaaaaagagctgaaaataagacattccaatcaagtaaacaaaagaaaagaagctgccaatagatcatcacttgagcaaactcagtgaaaccaataaaacttctgcatgttgtgtgcgtccaagttaaccaacaacaatatagcaaagcctggtggctattatgtcataatactatattaggacaatccactcaaccaaaagtaagacaaacgcagtgatataatatcactgcaacccattgctgtgctagtgctaaatgtttatcatgtagagcaatagggtaccttgttgtgaagcaacagctgcaacatctgtactgtttggctgtggatcctacaaaaganccaatttttaaaggcccttggttttntccaagggnnaaancggtntntncatncttaattattttcatttggaggtatacaaacagccatgtaggggcggtagaaagtaaatcatacaggaacccgacggaaggcctcgtcgatttcttcctttgtaaggcctttcttttccagaaaagagcgcctgtaaaatactggagaacccttcacttttggatgtccaagaaagttaacagcattctgtatgtaatcctcccgcattggctgtggggtttgaagtaccaaattgtctgagaattcacctctaccagaaccatctgcagcatgagcaaatgggaatgcagttcgattttcaggacaggggaatctgagtgactataactaacaaaataacaagataataactcaaggtttcagaatagccaatttctccccggtggttccaaattcatttggtgctatggacctctaaattgtcgatatttgcagcaaaaactgcagccagccactggacttgtgcccacaaccacaagagggcatgaacttgtcttggctgaatcgcctcaaaagctagttgcccttgctaacgaggctagaattagtgatgatatgagcagccaggactcttacgcttattccagtaggcaatcgcggtacaagattcggcggttctcatgttctaaccctcaaaattaccaaaccctcgtctctcaacagaaagagaagagttgctcataaactcagtcccaaattatatggctaacaatcggcgggatagaaacatcgagcaagaagcgccaagattccaagtctgaagaaaagcgtcatcttgatccaaaggattggacggggagcgccacgattttcggaggatatgagacagtaagagaggggaagaaaaacctgaccttgcggcgagggagtggaagattgggcggccatcggggtagctcaggagcgcacgaatcaagaaagagatttcaggcggcggcgagtcgtcggaggaaagaagcagcgatgagcatgtgcgatattcacatgtactttatctgcacgcggagggtgtttattttgtttcctccaagaaaacgaaacgaaacgtgtcgcttcgctcacacacaatttcatcaaagcaatccccttctcttcttctctctgtgttgccatggataactgtggtgaggactgatggtcacttgcagttcggcatttattctttttctttcttttttctatctactaacagaaggctatgggtaaaaaaaatgtccgtgttttattttgcaaatgcttttatatatatatatatatatatatatatatatatatatatatatattcacttgatttaaataaatatttaaaaattttcatggactgatttataaaacgtgtaaaagtagttgtgacgtgccgatggtagatccaccaccacttaggctgtgcttggaaaggtggtttattaatgcataattagttaagtattaggtaaaaattaaaatgaattaatatgtttttttacacaactttcgtatattttttttttttgcaaacactataacttagccttattcttgtattgtgatatatagaatatcaaagaaagattattccgatcgcataggtggatgtccacccaactgttgtgccgtcgatgcatcccccgagatatgtgcacaggcagattcgtattcggtgatgggcgtgggatatgggtggcacagatcttaaagaacattggatggagattggcgtaggtggacatccacctaggtgtataaaattgattctcgaatatcaaatagtagtaacaagatcctaagcgtggttattttccaaaacaaaaaaatgttaggatttttagtaaataaaatactaggaggtagtacatgataccataataattttttaaagaaactctatattcctcctacctcacaaggaatttttgaaaagataaataaagatgtgctcacaagcattttttttcctacagtattatcctaggtgtgttcggctccaagaaaaaaaagaaagggagtacttatgcatttttcgaaag

SEQ ID NO: 50314 - DNA, 4698 bp, Oryza sativa
ttcagtttttagtgtccatcgatacaacagttaatataaaaaaagaaaagaatgacagtcaaaatatatcatccattgcttgcttatgctctccaatgtgattatgcttattgcaatcattctctgcctcttcaaatgtaaagaatatcatatcataaatatatggtgacaccaagagaaaatgtctaaaaaaaactttgaaaattgtacaacaacaaaaaatctgaaacatatcgtaagtagcacaaaagcatggctggggtctagtatttttttagagaaggggtgtggagtctagtatacagatccaacctgtaatcacattcataaatatcatactatggcaaatgtaaatacagtatccctcccacttgccttcttagtttaggatatgatagacagttcaacgcttcatattaccacggctattgttgctatgacctcagaaagtaataattaaacacaaatttcagtagattgtttacttgaggcaatagtgtgacatggaagaacacttactgactaatggttgataaggaattccagtgcagatgaatgtactcgaggagcccaattcaacaatattggtatggttcaacacccagaagttagacacaataccaacaaaaaagaatgtgtaaatttctatgactcttatctatagcatataatacaatgacttctgaaggagccaacttgcatataattctagatttttcttatcacaacttgtcacaactaaatttttttagcagctaacttgtcacaactaattttttttagcaaatatcgaattaatccaatactcatggaatttatttggaaactgaattttatatgtttgtgtgcaaaagtaataaagatactatctcaatccacttacaaaccattatgctgctagttttaaacccatttgttttcatatgcattttgaaatgagtataacatgatatatgaaattcaattgtgcgtgtaattgtttatcattaatgaatttgaaccatcaacacatttttctattgtataactataatatttattgcttacaatctttctatgtttgtaggacacgttctttttacagtgatcttaaatgaaacctgcataataaaaaaaatgcaaatacataagtgcctttaaacaccccgttttagaacttgttgatcttttttagtccaaacttactatttttgatttaggtcttaattctcaggcgtgtactgttaactgacttaatcccactttagcagctaggacaagaatgtgctcaacttctcagagttagctgaagacctggtatctgcacatcatatacaatgaacactggcaggagcaagaagttatactaaccactgctatcgatgttgacttccccaatcgtgcagtttttgggacctttagtctttccgttggcaatcttcaccagagggggacgagaagaataactggagaaggggatcgaggcgctgcagactgcagaggaggtcaaggggatctctagtggagatgcaaaagacgaggcgacggcgattcgtaaagtaacgttctatgcgtgccgccatcggatggagccatgcttcgaattataccctgctattgccggagagagctctgatcgatgggaggaggtggtgctgttggggatgaagagggggcgtggctaggaggaggcggaggcggagaagggatggcgagaaggagcgacgggaatgagaggaggcgccgtagcggcggggaggagaagaggcggaggcgctgcaacgcacgggagggaggagggggaaaatgaaaatgtgcagagaggggaggaccagaaggtgagaggatttgaagtgggctgaaaataaaggccgaaagcccatatgagataagctttggtttggggtccggctatgtcggcgacgataccaaacagaagcattatccgtatccgtaccaaacaccaacactgcgaattatatatatatatatatatatatatatatatatatatatatatagatatatcttcctctacatctacacgacgtacacttggatactgcaggtagattagattagatgatcggccggccatggccaccttccgggaccacctcgccgtcatcgccgaggcgctctgcgcgatcgccgccgacatgaatgcggccgcccgcgccctcgacccctccaccgtcatcagcctcgcctgcgccgccttcaccgtcgccatcgtgctcgtctgctacgccgacatctgcggccgcctcgccacgctccactcgcagacgcagacgccggcgggggaggacgaggacaataatgccacgccgccggaggctcctgctgcttcttcccttaaggaccgccagcgctccagccatggcaccgacacctcctcctcctccgagtcgtcgtcgtcgtcttcgtcttcatcatccgagtcctcgtcctcgtcttcgtcttcatcatccgagtcctcctcctcgtcgtcggatgatgacctagcgcggcgacgtcagcagagaaacccttctcctccgccgcagtacaagaaggaggcaaggaggagcccttctccatcgccgccatcgtcgtcgtcaacctcaagctctagctcgagctcaggctcaagttggtggactcgctctgccaggagtttctactgatccaacaattgttattactagtgcttgaatactcccatataacataggtttctattggaatattatattagggcaatttcagagttttttcatcatttatacattcatcattcataaatgtttaatgtagtggttgtttagaatccattaatattctattgattctccttttttcataatagcaagttttataatataggtgactgttacctccaatttcatatatatcatctttatatagatttaagaggtaaccagctaccttcgtcccataataagttgacctatgagatatgatagtagtactaagaatttagacagagtatatctaaattaatagtactaaaatatatcacattccatactaagtaacattattcttagacgaagggagtatacaataatagttactctaacacacaaacccccaataactctaatgctctcatatttttactgaaatttgtgtaatggttgctctttacatgagggatagctcattcactctctaatataatcctttctctcttccacatctgcaaatgagcctacacggcatataggggcaagtacttaaggggtttaggacaataacatagggggggtcttaagcctttaaggtggatcttatacattgtgagattaattcttacaggaggcatttggttaaggtggccatatgcataaagaccacccacaagtaactaaaaagtcactcttcactctcacatggtagtactaagggtgaaaacggaatcggtagcatctctttcaaaaagacgctcgatcggtcggtaattgactatatttatcatttaaacgacacttgtccaatacgatacagaaagaaattgagaaaaaaaaacaaaatttacatatagccaaaaacgaaatcagcaactataaaaaacaatgcccttcatacagaaacaacgcttggtcaatcgggaatttccatgaccattttcacccttaggtagtacttctctctgggtactcttgtgtttgtaaggtccaccttaatactgtctcttaccatatacaatgtaaacataacaatatacattgacagacattccacttatagtacttgctaaaggcatatgcttttttagcaaaatctctaacccaacaaccactagccatgagagagggatgaaagaaattatttatttatttcttatggctaagtaattaagtatattacattgtatttgttacttattagtcttataatgtatataaactgatagtagtattgtttattccttctcaattttaaagatacactggtgattctcttaatgatacgcagagagatgaatgtgaaaaaaaacgcagtgcctaactaatctcactttttgaacctgatatttaaaatctcacttgccatgcatggataaacattgcacttgttcaaggcataacattgcagtgatcacaacaaaaacagcagattgacggaagagctcgattatattacaattacagatgctcgtccattgttccaccacccaaataaaacgacattcagagatagataatcaccagaaaaactgctgcttgtcgtctctcaagtaagtcgatcgaggcaggcattaatgatggaaaatcgtcaataataaacagaaaaaaaatgaaagaaggggaatactaaatcatagcaagccttactgccgcataatagggggccggcgcattgaaaaaggaaaaaagaaactgaaaaaacaaagtgcatacatcatacacggcgaagacgaagccgtcatccagattatactctcagagatgcagatcgtcgggtggttctgtagcgagggaagcaccggagaaggctctgttgatgatgatgattatgatgctggtgatggtgatggtgcagcggatgcggaggcggtatatatgactgcaagaaggatggatcctcttcaagagcttctatgtagctctcaagtatggcgacgatgtcgtcgaactgaggccttctgtctgggttggtcgcccagcactgagttatcagatggcttattgccacagggcatgaaggagg

SEQ ID NO: 50315 - DNA, 11797 bp, Oryza sativa
  unsure (1)..(11797): unsure at all n locations
attaaatgtccgccatagtttccataagggaaaaaaaacattttttactctcttacagaaagaacccaaaattttctactggtactgcgactgaaaaggcagcagcatctcatgattttaacagcctacattatagccaaggaaacaaagatggacatgaagattggagaggtggcatgtcaaaaattcataccttcaaggcaacagcaacagcagcttgctcgggtgtcatctcactgaatggtaccaaagcagtcaaaatctcccacaagacaattccaaagctgtatacatcaaccttcctcgtatggtgtttctctttgatcatttctggagccatccacctatacgttccagtaaaacccttaccacttccgcactgcgattctaagcacgaaattccaaaatctgccacctttactgacatatctccatcgagaagtatattctctgacttcaagtctctgtgaagtatgccttgcgagtgtaagtagctcattccacgagcaatctctaaggataacttcaacactaattcaattggaacagaatgaggttcttgctgatgtagatatttcctaagggagccacctgccatgtactcagtaatgatacagaagactggtggtttcttgcatgctgcaacaaactgaaaaacaagagtttagatatatttcttatcagtttgagactcaacaaaatgagcaaacgagattaattggttacaagagttccttcacaagttaaaagtagtgggcatctttcatttcaaatccagcatgctttatatgtagagaaattctttatttgcctctgtaagttggccacttcccttaattacctctctgaaactgctcatccattcaatgacccttgttcttaacttttaccctctatttgcccctcccatcactctgcgcactgtgcaaatttcgaaggggcaaatagaggataacaggttagaaaaggggtgacgaagggatgaacagtttatctatcaaactatcagaaccaagacctattttagcaatatatttaacatggacagctaaaatattataacggcaaataatgcaacagaggaaaacgatttgagatcaaatgcggcctaacactcatataaaccaatttcacaaataattaaggttcttgcagaaatttgccagtattactgaagaacatttggagtgcaacttgcatagatgtcacatgatttttgtgcttactcaacttcggttggtttgacaaagtgatactttccatgtgatctgtgggaccagtaatccaggtaggcacttgataaagtgaaaagtaacatagatttttatctgtaggcaaagtcacgaactatcactctctgagtcaattctccgtattaaattcttacgagagacacttttcttggcatatgaaagcagttaagtttggatgtcatatatggtccaccacgcactttaattaggaaaatagcatcttttaacttctcatacaagtatctaacattatcacctataatgctgtatatggcatgaactcatcaagcataggataaaaacctgaatacaaccattggctggtggctctctttacccaacttcttcataatgaagccaattcacataagttataaaagtggtgcggacagtgattggactaatcaattaacctaaagactggctagcttttgcagcactcgtgtaaaaatatcctgatataccgccaatcaaagaaacagaggggttaaactttcctataaaccacctccagtggatggctaaaaatagttaggcggcttagagaagtttattagatgtgcttctccattaaatacgaagctctgttgagttttctccaaagaaaggaagctctattaagtaatatatatgatggaaagtgcacaaaaaaacattcaggatctcacaaaaaatcactaacaatcattaccagctctctgctcgatggatcgaaagggtgagatatgaacgtagagaaagagtagggaggagaacagtattgctgtaacatttgtacgtgactcagatttcgctatcttaactatcaatatcatactactggaagagaagtttttttttttctgccatgttcactccctcctcattgggttagtataaacaagcatgaatcatgtcgcacccagacttatcttctcgaccccatccttccgcccaatcaaaacaaggcataaagtaagaacctttaatgtgaagatcggttagcataacaaatcctacagcctagtgcacgcatggggcacaccaataaagcgtaaaggaactaagatgtgaaactaacaggctgttcaagtgagataatctagtattcaatatctggtacagacaaaaccaaccaaaccaaaacgcaacaacttgtgttagtagtaaacatctacgagcgcactagaaattaaattggacttgatggatggaagtgcacaaaaatgatggagaagtccccacaagatgcacaggacagaatccattataattgaaataataatagtaacaagttattaataaaggtactagaaaagaagaagaaatagaaattgaaattgaatcgaagaagaaggaagaaaggtaccgagatgatgttggggtggcggaggcggaggaggagggcgacctcggaggcgaactggcgctcgagctcggcggcgagggcggcgtcttcctcaggctggctaaccatcttgatggcaacgtcgcgggcggcgtagcggccggagtagacgcggctgtgcctgccggtggcgaacttggtccggatctccagcttggacaggtcggcgctccacagctcctcgccgccaccccggatcttggctcccggcggagccaccaggtacttggaccacgacaccgccttcttgtactcccccagcgacagccgcctctccagcctcttcccctgcccaccgccattgccgccgccctgctgctgctgctgcttgaagcatttcatctcctcttcctttctttctttctttcttttccgcgataagcttggatcttcttggaatcaatgcacgaaacgctcgcggaagtggaagcgaatcggcgcctggaatctcgctctcgctcgcggggattcaaagctttatgggaggaaggataaaaggcggattcaaagcgaaaaaatcgggattttcggtagaggataacaaaaaaaaagagcaggacacggatatcggaggggatttgcggaaagacaacattatttgtgggtgtggctgggaagatgagacgggcgattcaatcgcatcctaatcgaatcgatccaaacaaggcaagcaagaaaaagagagagagagagagagagatgattcttttgatgagagtgtaaaaagcgaacaagaagaagaagaagacgacgacgatgaagtggcaagtgcagccagcagaggtcgtcaggttattagtgaagagaagagagtgatgagctttttcggtggttcaggggtgccgagattagaacagatttgtttgttttggcggaaacagctgttgattgcaagtgtcgagtgacaccacgacagatgacctcacctcaatagaagacactctttcttttcttttctttttagttagctcaagagaagacgcgtttatatgtttccttcctcccttttaagtacagtacagtaatcacaggacagcgagctgccaagccaaagagatctgctttttctgtaggaaaggaagaaatcacaggacatccatccatgggagaccatgcattcgggataagctctgaagaaatgcccaacatttcgtattgcaaaacttgatactccctccgtttcgttttatttgacaccgttgactttttagcacatgtttgaccgcttgtcttattcaaaaaatttaaataattattaatttttttcctatcatttgattcatcgttaaatatacttttatgcatatgtataattttacatatttcacaaaagtttttaaataagacgaatggtcaaacatgtnataaaaagtcnnnggngtcnnatnaaacgaaacggagggagtatatcatgtcccagcctcccagggagcagtacacgactacacgtctacacgatccatccatcaacggatcaaccgactagacatgaacaaatcaccgcacgtgggtgagaacggtcgattcctcctcattcgagcacacgaaatagtaaagtaaggtgctctataaaacatgtatatctcaacaatatactagattaatagtaaaccatctcaatagtatgtctatataggtatctatagctctctcatacattgtctcgtttttctctatagactatctctaagttagtagatagctttgctctctcttcatttaatatcttccaagtaggaaaatatgctgacatgagtctcttgtagagagcctatagataaccattgcgggtgcccttagttaaatctaactctgagtatagatcccaaggtcgcataattagttttgtgttgtattctgttcattgaaaaaaatgccgttgtatattctgttgcacttctctctcgtaaatacgcaagcgtattccaaataataaaaacgacacctgacaccgtatatatgaatcatcttagatacaagttgtgcagccaaataataagccaccgaaagcgttttatgtgatcaaccagatgcccgcacggtcgcctgatatgtaacggcacagcacaagtaaaaaaaataaaatacttcctgcatcttggtctaatggttaaaatacgtccaggattgtagcttactgtagcaatttttttaaagcgctttgcaccactacttgtagctgacgatctggtccgttcatcaacaaagtagatggctcctatagcttaacatgcagttcctatagaaactgtgcctgatcccagttcacttatagcagcaggttaacctccttacaagtggagtacaccatctatcctacaaaaaccaacgcctagctttcaatctggacataagctatatttaaattcaaagcagaaattgatgtatttttacagagaaagtactctattcgttctaaaatatattaacctaaattaaaaaaaactagcatgatggcccgcgcagattgcgcggctagcatcattatattttctctcatataatagcatatatgttttctcattatattattcaaatatattaaaataacaacataattttaaattttgcaataactttacaaaactactaatgtgtaatattcatattgcattttatatacgtgttagttattaattatttttaagataaaattttagttatttgtaaattatatatattcctatatggactctagactcgtcttttaatatttcttttttctgtaaattgtatttctatatagactatatgttcttcttctaatattatttatttttatttctgaaattttattatttctaattatatttctatgtggactctaaactcatctttcaatattatttaatttttaatttcgaattttagttacttctaaattgtattcctatattagcattaaactcttcttcccattttttcttaatttcgaattttaactatttgtaaattgtatttttatacggactctaaactctacttttaattttattatgtttattccaaattttagttagttttaagtttctatatagactctatactctacttctaatattccttatttttaattccgaatttcagttatttcctaattgtatttctacatggactctatactctacttctaatattccttatttttaattccaaatttcagttatttcctaattgtatttctatatggactccggtctcctcttctaatattccttattttttaattccgaatttcagctatttcctaattgtatttctatatggactccggtctcctcttctaatattccttattttttaattccgaatttaagctatttctaaattgtatttctatatggactctgctttttctttttctccgattaatgtgagaatttctaggccatgagagcgaacgtggaggctcatttttctattcctttaattatataataatagatagatatgatattttctaatctaaatggattagaaaatatcatatttttacaagtagacagcgtggtcaggccggtgtgcttgtacaagcagagtttgaaatagagcaggaattgtacgcgaggggcggcagtggtacaacgacctgggaatactggagcaagagtagaaagaattgccagtcatttgggttatggtacttacctacctagctatactatacaggatcaattaaaaatctagatttgttagttagttagagatcagcgcatatatatatgatggatcatatattgttgtcgatcgatcgagtatgtaccgtaggccactcatcaaggcattgcatatttgcatgcatgatgatgatgagttatttaattagcaagtggccattagattagagagagcaagtggatcggatatactccagtattattgtacaatatgggaggaggaccactgcatatatgtactcctacagtatttatgcaacttggttgtgggggatggttgaaggacggccgtatcacccatccgtatacggaagcaactcaactacttgtcttgtccgccacgcccactatcagccttgcattgcatatgctctacttaattaaaaccagcatcgaccaaagttattcattcagactaaactcttccttaaaatacacttaatttgcactggtttttagataatggaaaaataatactagctaccatgctgcttaattaatatactttctcaattctctccgttatcgcacagttgcaaattaaacacactcccgcttccattttgcttaccgttctactaattctcacgctgaactaggaggtacgataaattgcattgctattgattacattataatcatctttcaagaggtatagttatttatttttttagaagcttctaattaatataagtatgagtatggctgtattgatgaagggtaggggaaaaaatagcaccaaaattattttgaaatgtaagaacaacaagtactatcttaataaaaaaattaaatgctagaacaataattaattgaaatgtaagtgaacataatgcatgtatgaatcgatcgatcgatatcgctatccgatccctaccagctgcacaacgatggatcgatctccatcatcatgtgcccttcaatcctccaaccaatcacatgccaaagatgcttacatacatacagctaacgcattattgtcttctttcctagctgctttgccaaagtgttttcggcagctagctagctacctgcttttaactctgtcacacttggatagagatggtaattaactgtccattcacccttctaattattcgcctaaaatgtgtttagttccgttggatcggctcactttccatccctgtttttgtcccctatatatagagacagccaaacatatatatatgcaattgattacatcatatatgcttggccatgagtagagaagagagctgatcctcgagttatagctcaccaccaccaccacgtactgctacaaatatgaacatatacgctaggctagctagtatttgttgcatcctttttcttcttacaagttgccaaggtgtgtaaaaacatctggttgtcatgcgagcttggtctttggagagcagatatatattgtattccctccgtttcgttttatttgacgccgttgactttttatcacatgtttgaccattcgtcttattcaaaaacttttgtgaaatatgtaaaattatacgtatgcataaaagtatatttaacgatgaatcaaatgataggaaaagaattaataattatttaaattttttaaataagacaagcggtcaaacatgtgctaaaaagtcaatggtgtcaaataaaacgaaacggagggagtacaatatacctatctcttgtaagtaaacatatagggatataaattataattgttcactactactacagaacatctaaaaattcccggttgtaaacctggataggtgccggttttatagtcggcaacaattatatattcgtcaccaatgacttgatagaattgatatttttgggctccccacaatttaaagaaaatacatagacgccggctagaactccatattgattcaacaacaacaatccccatccacactgatcaagaaattcaattattattccccatccatcatatatcaacaccaggaagatgaaggactacacgagatcaagaacccactacccccctccctccagtcctagcggagccactaatgtcatcgtcgccaatctgcaccaccgtgttccgctagcggtttatggcaaggaggagcggcgtgggagacaatgactaccgacggcgtcgtcgtcgtaggctagccctctccgcgtcgaggtcgacgccgccagatcagtggcacgcgagctccaggcagcttggtctagtggttcacaagctgtgaggatgggcgacaacagcgaggaggcacgtatgcagtgaggaggagaaagagggaggagaggacaatgcagcggcgacgaggttgtgaagttgaggggcggcgggataagtgtgtgtgtgtgagagagagagagaggggggatggataaggaggggctggttgactcggtggggttaaaaggaatcaccatcccatgatctattggctcgggctagctttttataaaaccgacacctataatataagtataggtgccgattcttttgaaaaaaatccgcactagtattattggtgctggtctttatattagaaccggtgtctatagttgctcaaaggtgtcagttttttttttatcccatagaaacgaaaaaggttaatagatatcgattttaaatgaaccgacaaccatgagtcggtacctacggaggattttatagtaatggtccgtacttttatttcagattaacggctaataatatacagttccccaatgctaacagcataactgtgccctcataacctcatttatgtttgagtaattttacagctcttgaaaaattactaaaagtcatcatgtaaaatttagtagcacctgttaataccaaataccaagacatgtacataagctctagatcttacgcttaaagtttttctcttaattaaagaccgtgaaatttctctttacctcagcgtggacccaaagtagtgagcatgtgagtactatcttcacgtgcatacctgctggtttcaatttcttttttttaaaaaaaacttattttacaattaagcctttctaaaacttaataaaaaaaatagatacatagctcggtgccaagggtatttggagctgaagttgaatggtctcagcgtcaaataaagtggtgtcgaaacctaatcctcagcacctacctccgtgtgccacctatatgaacaacttccctctctcccctattacacctttttgaatcatattgatttgctatcaataggatataaaaaatgcttattgcatgcttcctaagcccgaagtaattaattcaacatctttatcttcaaggaaaaaaaaaaaggttacgataatactcgatttcttaattaacttgcaatgatttttttttcttttttttaggaattgacaatgagttggatccttattgggttcggcggtggtggacggcagggagagacggcaagaaagctacccaaagtgtggtgtgtgcatgcatttaattgagatatatgtgtacaacatatataatcgaatgaaatcttcgtttatcttgatttgtagagacaaaaatcttgcatcgatagtggaggcttgagagccttatcaaccccatgctggatccgtcctcacgctagcctgactgatgtgtcaaaacattcagatattaaaaattaagtcttagagggggttcgtttttaaaataaaaaaatataaaaagttttaaaaaaacggataaaacgggggagcctcaatacaggataattcgtatgtatgggtggatttttttccccctcaatacaggataatccctcaattggaagcattcctgttaatattgtttgtttggaccagagtaaactgcgaatttgtttaatcagaatgtacgtatacgtacgaattacagcattcatctagaacgtacgtacctcggtatacgtagcagctagtagtaggcatacatcgattgcaaattcaattcgctcgtgactacttcacgggcgaccctgcctaacaacaacgtaccatgctcatctgatctgatcgatcaatccccataattaatgtgactagtactccctctatcgtaataattttatttttagctcattttatttatctcaaagtaatttttttaaagcaattattccatcgaagtttgtaaaagtataaaataactgtatcaggaatagataaaatagaaaataattgtttgcattgatatatgtgagatagatgagaaatgaacttattttaagatgaaagatgtactactttctactaataactatttttttaagatgaatttgaataaacaactatcattaatctttagaattaattactttacgggaagtgcttctatgcttctttaaaaaaaacatgcacgaaaattaaagcacatcaacggtgaggattaaaagttgattaacagagtaatcccctttaacgaggggtaattttgtcctaagaaaaagctgaccatatctagcccaccctgtccgcatatcagaatcgactggttcctccttgacttgcacctttgacggaggcgccatcttcgccgccgccgccggcaccgccatcccaccgggtcgaacgaacccatcttgcccgacgccggcacgcttgccggcggcattcgacgacagccttgtggcgtccatgctcgcgcatgccggcgcctccgcgggctcctctccttgacctgcagcaccgtaaacggaggcaccatcttcgccgccgccgctgccatcacttcgtcctctccctgttcctggacgtcctcgccatggctcccggcggcggcgggggccgcggggcgggaagcctggagggcctgcagctagctgaagcgggcgtggatggaggactggagggaggagaggtgggagtcgaggtcggaccagcggaaggggaggaggatgggcgagtggaggacgaggctgtcgcaggcctcgcggaggcgttgcttcttgccatgcagcgtcgcgatggcggcctccacctgcgccggccgtcgtcatcgccatcagagatggttcagggcacagggccgttgccgtggcggcggcggcgagctgttgcataatctccatcgccatcgattcttcgtgcggccggtaagaagccgacgcagtttatatataggcacgcggccgcgaacagtccgagacggataggatcagcgcatacaaccaattctatgtaaattcaaaagattgtgatcagccttgtgttaagttcagttcaattctgaatgcatatcagaggtatcaccatatactgaggaataaaatggacatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50316 - DNA, 6613 bp, Oryza sativa
  unsure (1)..(6613): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatcttttgtaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctatcccgcagcagttagaccatcttccaatgacagtcctgggcgccgtgggcctaccactagcgtcaacctctcttataacttgcactgtggtcggccatatattttgtgaccgcggatttctactagacctacttgcacttgtctcgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagagaaaatcataaggaaaagagcaagtgcaggaaatctgttcttatgcataaaaaaagaacaagtgtagaggtatataaccactgaatcaatcatgcaaatttaaaaaacagcagcagcaagggtacataatttgcatgattgacataaaacagcagcaggaggagtatatatgccacaggggtagcaacagcaggggcaaattaactaaaacaacatgtctagatatactcctcttatcaatccagaagaaaagagcaagtgcagaaaaaagaggaaatagaaaataaaatagaacaagtgtagttcatctgttcttatcaataaaatagaacaagtgtagttcatcttttcttatccataaggaaaagagcaagtgcaggaaattagagtaggaaacagcaacagcagggtggaaattcacataaacagcaacagcagggtggaaattcacataaacagcaacagcagagggaaattcacatagacagcaagggtatataaatcaacaagtgtagataatctgttcttatccataaagaaaagaacaggtatagatagaatgttattaagcaattcatccttggccatttaacaagaagtacaggggcaacaacagcagtggtatataaatcatgcatatattattgtagataaaaaaatgaacaagtgcagaaaatctgttcttatgcataaaaaaagagagattcactgcaccaaaatcatgtaatacggggtatactatgaaagatatggcctcagttttgctcagaaatatgcatcaattatattcatttccatgaagggataaaaagaggaaatcataacatcaaaagagcaaatctgttcttatgcataaaaaaagaacaagtgtagatactctgttcttatccataaagaacaagtgtagaggtatataaccactgagtcaatcatgcaaatttaaaaaacagcccacaataagggtacagataaactattcttattgagcaattcattacttattgagccacaacaggggcaaaaagaagaatagataaaaaaatgatcaagtgtagataatctgttcttattgagcaattcatcactggccatttatcaatccagaagaaaagagcaagtgcagaaaatctgttcttatgcataaaaaaagagcaagtgcacaaaatctgttcttatgcataaaaaaagaacaagtgtagaggtatataactactctacactggccatttaataaggaacaagtgaacaagtgtaggggcagtagcaggggtgtagataaaaaaggagacagtactactaacttcatgtaaacagcaattcatccattcaattcaagcaagtctacataataaaacagcccacaatattgtggcagcagcagcaagggtatataaatcatgtatataaacaacaattcatacaattgacctattcatagacaaaaagggtatataaatcaacaagtttagataatctgcaaagcctccttaatcatcaaattatgacagaaaacaaaatgcatggagaattttggtgtctaggtcggttccgtccatggactacactggcctatccaccaaaattccccatgcactttgtattctgtgatggtttgataacctcggaactacattaaatctgcggccaatctatcaattcttcccttgtaactagatttcaaaccctacacctaataaaggtccttaattatcaaagaattatagaaaacaaaatgcattaaaaattcatgctaagatcctctattgatgctaagattcactgcaccaaaatcatgtatataaaatctagcccctacattcatccaaaccatccccagacaacagatcacatttaattcatctatacagcagcaccaataatcgaaacagcaaatcacatttcattcatctaaacaatgcaattcatccatcggaaaaaaggaggaatgggggagggtggcggcatacttggagaagcggcgtacttggagacggcggcgcaggccgtagtcgtcctggatcctggtggcggcggcggagaggcagtggcgaagaggtcgaggcggtcggcggtggtcggggatcccggcgtcggggaggtcagggtcggggaggtcggggaagtcgatggacggacggcggagaggacgaccggcggcgagggcggcggtggaggcggcggcggagagggcggtggagaggacggcagagatggcggcagagagggcagcggagatggcggcggagagggcagaggagaggttgaggcggcgacggtggagatgtcggcagagagggcggcggcgaggagggtctggatggcggcggagaggtcgagacggcgacggtggagatggcggtggagatggatggcggcggtcgagagagtgagtgcggcggcggtggtgcaggccggcgtcggtggagaggtcgaggcggcggtggagaggagggcgtagagggcggcagagaggtcgagagaggcgaggcggcggtcgagagagtgagtgagtgagagtgggcgccggatctggatcgatctagaagatgtccaaccctaggtcaaccctagtcaaactcacctgtgacgggctccaactatgtggccgtcacaggtgaggtcacctgtgacgggcgccaaccgtggagccgtcacaggtaagaccacctgtgacgggcccagcactctggggccgtcacaggtgaggtcacctgtgacggccctacagatagggcccaaaaggattaatgccgtccgtacacattgcgaaacgcatgtttcttgggtcatttgagaattcctggtaaatcctatcgattgtcctccactgtactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttccttcaccttcactctttgctcgtttgtatcttgatgccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatgagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggtttctattcacgggcccgtcactggtattctctcacctgtgacgggccagaaatgaaagccgtcacaggtggcggcccatcacctctgacggcttctaatgtatcggccggtcacaggtgaggggataccagtgacgggttggaagaaaaactcgtcactggtatacctctgacgggttttcctttcggcccgtcacaggtgaggggatacctgtgacgggccgcggccagatgcctcaccggtgacggcatcccgtataacccgtcaaaggtaatggtcactactgaccaattcgtttgcccgtcacaggtatcccgtcagaggtgtgaggatctggcgtagtgccagctgctgctgcttaatttgggtggtggtcacaagcaaactaactaaaggaaatgttaatactaacatatactaattaatagattaagatcagcagcaagcctgcagttccatccaaggtttaccttaccgccggggccgccccggcggtaagcacggttaccgcgcggtaaccgcggtaaccgtgaaaaaccgtacaaaaccgtgcaaaatttatcaaaatttcaaaatatttttaaaatttatttgtatttaaggagtttaccgcggtatttatattaccgtacccccgcggtaagcccggtaaccgcgcggttaccggcggtaaggtaaaccctggttccatctccattagtcctctcaggagttaagaggaagctccactttaatcaccaactagtgtagtaggataggagcagcagaaaaaagcagacaagctcatcatcatcatcaaacacaggtcgatcagggggcaagaagtagtgcttcttcctttattattattattattattattattattagagcaggtacaatagcaggctattagccagctataaacatattttaatgatataaacgatgagagagaagagcagcgggctacagatctatagccagctgcagcacgtactccaagacacactgtgtatatgacaggtgggaccatatactaatagtatagtaagcaactattgtatgaattgactattagattggctacagatgaattggagctggtagtgggctgtactattagacttgctcttatggaccaattgggtgggggtgcttaattaatactactatagattatcataccatcaataattatccttaattactcccttatctccacatagtagagtatcgatcgtactacgtacaatagggcgggccggcgatgatgaatatcaatgctagctagctcaaccagcacgcactagttcgatcgatgtactgtactgtctgcagccatatagataatcttaagggaaagcaaaaactcaactaattaatatatagcatcgatcatgtagtatcttgatagtgcatcagtgagttcgtcgttaatgaatgaatgataattaattaagtagagctagcgacgtcgtccagatcgagataataaatacgaaatgaatgaaataagtacctggacgacgagcggcgggacggcgacgaaggtggcggcgtggactctgtagagcagcttcctccaggacttgtgcggctggcggtggcaccggcacggaggaagtcggcggcggtgagggtgggcaggaaggcctcggcgaagagcgcgccctcggcattgcagtcgagcacaagcttatcgtcggcgtggtgcctgagccttccggcgagt

SEQ ID NO: 50317 - DNA, 24233 bp, Oryza sativa
cgcccgccctctcctctatctacctaccttatttatataggacggactgaccacatctaatctaaagacttcaaacctcctccgggctgcttatacctggccaaacgggcggcccggcccagcacggcacgggcacgccggcggcacggcccgctagggcacggcccgttaggcacgactcctatagcgggccgtgccgtgccggcccacgtgcctactccccggcccaagcacggcccgagggaacgtcgtgccgtgccgtgccggcacgggcacgtcaatggcccatgggccgtggtcagcccgttggcacgacggactgcagccaaggacgcgggcacgcggcacggccgaaggactcggctaggcgacaacgccgagtcgccgacaaggcgcgcgcgcggcgcggctgaaattttcaacgcggcacgcgggagcgagcggccggggccgcgcgaccggccggccgaagggcgacacgtggcggcggtggcgctggacttgctgacgctgtccgtcaccgtgtgtctattgcctgtcagtctgtcactgtcaggctgtcactctgtcagtggaacaattcaaatcaaagagaaaggtctgaaagttaactaagctaagagaaaattaatggatagttggagaaaaatagaaaaataattagacttagaaaaatattagaaaaatatgaggaaaaaagagtaatgacctttattgatgtttacatgatacatgctgcctcgttaaaaactttatcatgtaaaaactcatatttgagaaaaccatgacaaagaaaagagtacagccaacaggtcaatacttaaaaaatataaactagctaccctaattgttcgtcatctaaataaaggttttcgaactgtgcggccaattcttggttgtcagcagtgtattgggcatgttctgcagcaagttcccagtctttgacgcttaatagtatttccacatgatcgctgctcagacttgttctcctatcctcgataattcttccgcatagactgaaggctgattcggaggataccgaagatacgggcaccgtcaacacatcccgtgctagttttgatagcacaggatatgacatcttatgatcattccaccacccgagtacgttgaagtctgacgtttcatgcctgatggcatcgctatccaaatagttggacaactcttcggcaggaccatgcgatctagcgtccccacttgctgctgatgaactggtaccaccaccatggctagaagatgaactgccccaaattctgctccactgtaattttttcttacctgctgcaggtacaggtgggggtctttgcaagcgatctccctgaaactttaattcatactttcgaaatacctcatagaatttagttttgacatcagcataataggtagaataatcaacattaataatatctccaataagtgaaagaatattgaggaatccccgtaattttcccctaggatcaagaataaatgcaaaagaatacaacatggggatgtctttccaatatttaagatatttttgtttcatattaaagacaacgggcattaaaaggtcatcattttcatactctttcaacaaagtggcaatttcaagaatattatgcaaaattaaattagctgttggataatatacttgagataacagaagagtacagtcatgaaacgtttcaagaaattgattgaacctttcaacaatgtgccaggtatgatcagtcagtattggctggccatcactgttttttgggccattacgtgtttgaaggaaaacagtaagtaaatccttgtaaggtaatacaacctttaacataaaataagtggcattccaccgatggtctgcatcggttaaaaacttacgtgggggctcacccgatgcacaacaataccttttccactgtgcaatccgtgggtttgaagcagttaaccacgtgattgcttgacgaacagcgtcgatgtgtacattaactctcttaaacccacatttaacaattagattaatgatatggcatgcacaacgctgatgcagaagaaatgattgagcataaatacaaaataatggttgtagaatttccatggccctagaatttgcagatgcattatccattgttacagcaaaaattttatctgcaaggttaaactcatcaataacctctcgaattctctctgctatattttcaccagtatgtgaaacatcaattaaccttaagccaagaactcttttttgcatttgccaatcatcatcaatgaaatgtacaactacactaaggtaatcctctttagccctactactccatatgtctgaggtgacactgacagaaaaggtgcatgtactaaataattccttcagtgattcataacctttgtcatagacatttttcaaatcacgggttgtggtttgtctactaacagcttgaaacctaggattatgagaattttttatgtaattttcaaatgcaggactctcaccaaagttcaagggtaaatcttgtctagcaattaaacgggcaagattttctcgagctaccataggatcatactcccacgtacgtaccgtaccatcaggatttagtagtagttgttgctgtcgtagttggattccttgcttctttgcacaagcctcggcatgccgcttcaaatgtcctgttccaccagatgattttgcagataacttatttttgcatattctacatctcgcgaatgttacctgccttccatcagggcctgtcatggccacctcatcgaaatgttgccaaacaccggaagttcttgatctctttgagccggtgttcgtcgatgcactcccactcatagtgccggatgcttctgaacccgccggtggctccataactggtggtgttggagccgatccggtggcatcatactcaccagttgggaatgacctcgacacgtagttagggtcgaaatcacctaacgtgaacgatggaatgttcgattcatccattctgaaaatttaaaacaacataaacaaatttcagaatatttattcgcataacataaaataaaataatacataaaactgaatatatgacgtacttctttcttaccacctttgcttggctttacacctcttgtatgcactatttttagtcacaaactatttttgattttacacaaaattttgtcaaattttgtctaaatcaaaaaatcgatctatcacacgaaagagcacaacagagcacaaaatgggaggtatggatgattcagaatgctctggtgggtgtcctatttatagaaataaatttcatatttttttcgaatttttttcctttttttttgctctccaacggctacttctggtcgttgggattagctcactagccgttgggggacacgtggcactctcgcattcgtcgtttgactagccgttcggccgccgtacggggtctcgccgagtcgctgtctcggctgctcccaacgaggcacggaggcagagtggcagacaggcagacaggcagcgagagcgagtgagcgaccgacccagcgtgaggcagcgtcccagcctcccagctggccagccccagcgacacgccgacacgtcgcgacgccgcttgccacgcgccacgcgcgaacgaagcgacgcgcgcttcccgccgcctggccccgcggctgccctcggcggctcggccgcttggcgccacgtgcgcggtgccgcggtgtgcgcggccgagccgatcccgtgccgtgccgtgctcgcgggccgtgccgggccgtgccagccctctacagtaaacgtgccgtgccgtgctggcccacgggctatggcgtcggcccagacacggcacgggtaaacgggccgtgccggcacggcccacaggccggcgtgccgtgccgggcctgggccttctacagtgcggtcgtgcttgggccggcccggcttggcacggcccatttggccaggtatagggctgctcgtccctcagcgttttgcgctggcgtggacgcggccggggcgcgacacgtcacggggcgctggaaaatgggtgggatttcgcgagctctcctgcctccgcgtcgtcttggaatttttgcacaaaagccctcgcttttatagttattttgttatacgtcctcgttgtagctttttcggctccataatcttacgtttagaccctccgagtcctgagaaatccgagacgaaggagacaaaaatgggaaaaaagaaccgtgctctgaattatggaaactgaggggccttttcgcattatctttcctcctccccgtctcccccgaaaccctagccgccaccgttcactcgcctgtctcctctctatcgctctccccttcccacgacgcttccgtggctcctcctcctcgcgccctcgctgcgtcgccgccgttgcccgccctcctcgcagcgccgccgccgccacccgctctcctcgctgcgtcgccgtcgcctgctcctctcacacccagctggatcgccgtgccttcttctcgccgtcgtggtgagcttgtgggggtcggatgatgagctcgccatggcggagaccaaccaccacctcttgtgtgctgcattgagttgaccagccgagctttctcggagaaagaaaaaaaaaaggagaagggagaggcatctggttcctccttaacgccgtgggactaaatccggtggagggcaggccgtggtcaccggatctggcagccacgacctcctcgccggcagatccggtcatccggaggcgagggctagcacattgaggttcattgcaagtgtcgacgtcggccgttccttcagagtggtgagttccaggggggaaggccctgctcccctgccctttctttcttcactctccctctctctctgatccaaatccaaagacgatgggatgttccatgttacagatccaggttggcttttggctgtcgaatcagttgatggtgagttcttggtcgcttgatttagcggcaccgggctcgtcgatgacagatcgggcggcgctgaggaggatgaagttcccgtccactcccgcgtcctctgctggaagccttcttcgccgggaggattcctggtaatgcttgccccgcctccgccggtgacttcttggttttgtctccgttcttgatctggatgttgtcgtgttcatttcttggcagcgcgggatgcggcggtgctgatcccggtgtacggatcctgggcgtgattcggtgagctgagaactggtttgctgctgctgcggcgtgcgccatggatggcgacgcggatgccgtggtgaatggccgcccgaaatgcaccgcaactcgtgggtggatcttgcggaggagagtccagattttgatttttggttttgtgggtgatctgttccgcaaaagtcggggaggcacgggagcgggcaggcgtgccagatcttaggtgacggagggcgacgtctgcggcttcccggtgtgccgcccctgctatgagtacgagcgaaaggatggcgcccaggcttgcccccagtgcaagaccaagtacaagcgccacaaaggtaatgcccccgtttccgccgatttcgcccccatcagctgtaaataaattcagaaacatctcagaaaaaaaaaagtctggatctctagaggaggctgacgaactgaagcggcaaggcgaggcgatgaggctagggcctggggatggcgagcacaagtggacctgctgcgtgcacctcgacgctcctccatctatcccgcacacgaaccaccttattttctttctcctccggatttcggccgctcatcctcttccctgggtaaagatcactcgtgttcccctcccgctccttgtctatatgcttattcggcttagttccaaggtgctacgtgagttcttgcatgtattggtcgcgatctgatagtagtctggtagattattccattcccgtactcttggaaggggaaaaggcgatagtttcagaattaggtactgctattgatttatttgtcaactgttggtaggctgcttgtttctgatgtatgccatgcagttcatttgtttatgtgagatgaacaagttgcggtttgttagtggagtgatactgggagcatcctccagtctaagtacaggaagctgtgtgtggttttggtttcctgttatggtagcacatttttgcatcctgcttatggtgccaactacagatagcaagttcttttttcctaaaatgtttcgccatagttttgatctgttcaccaccatacagactaattacagagtcagtatgctctttaaagcataccgtcttttttttctgaccattttgtggttttgtctcacagtggagtagtttgagctttgcactatgggttggcacttgcaggggctgataactggaggtgtgattctgctcgtcagtagcaggaagaattcacacaattttctgttcagcaaggacctcttcttcgtgtattgcttccaccaatcatatttaatgctgggtgagttttctgtgtagctataattcatgtaattagctcccaaccaaagtggagtttatttcttttccttccatatgttattttagttcggctttggctaaaatcttgagaacaaaattcactgcaataggactcacttgagatattcatgcatttcagcagcataaattttgttctatcattttttccgttctgtataaaatgttgtttttatatttatgaattcatcaaaaccatgtttgtaagacttaaacatctgtgatttgtcaatgtgaaggtacacttactgaactagatgtatgaaatagtcaacggcccacctattcttatgaaattattctgaaaattaattaaacaatcacagttgtaatgatatcagtatgttaataatgtatctgatctcctaatgaatttctaaaaacgctaatgagatgcatcagatcaaaatattaccactaggccacttcctttaagtgggaggcacttgctctgtactctgtcctattgccactatattgtttaatcattctgcatatttaaaactaatgtgagttttgttaaaaggtcatagccgcaacacagctaattataaagagggtaagttcttgaatgtgtgggctaagtgacattagtatggcaggactaataataagcagtgtgtatttgcagtgtcatgaacatgttaaactagacaatttatttgcactgtcatgcaaatacacagtttgaggcctcttttctatttacataatttactgcatatttgcatttttactgctccttggtttgaacaggaaagtataatgaagtctatctttattgggaatattggcagactgactctaaatttccactgcagctcggataaaagaagtggacacataccttatcgagactcaaagttgacacgcattctccagctttctttgggtggaaatgcaagagcatccatcatctgtaccatgagtccagcgcaaacacatgtagaacaatctagaaatacgtactctattctttgcaacctgtgccaaggaggttacaaataatgcaaaagttaatatggtaagatctgtgactgtgagacatcatttattcacttatcagaatgcaaatcttcatcccttggtacatacaggtggtatcagataagcaattggtgaagcaccttcagatagaagttgctagacttgaaactgaactgagaatccctgatcgtgcctcctcttctgagatcattataatggaaaggaacaggaagattagacaggtaaatgcctatgctcaaggatgaaattaactggaatcatttccattttgtaactgacctaattaattgaacacagcaggtggaaaaagaaatggaggaactcaagaagcaacgagacaatgcacagtcgaaacttgaattacagaagaagatgggtgataatcagccagtgagtatttaccttctccttgcgaatttacttttctcaaaggatatcagcctgtcagaaccacattcttttactgtcaacctaatctttctgaaaaccatgttataaaccccccgaaaaatagtaaggcttcggggtggccagggggcgacggaggtagcaagcaccctgactggccagcggaaaacgaggaacatatatagcagtggcagcgggagatgtgggagggccagcgccgaagaggatcgtgaagccgacgagccgcgtgaaacacatgcttggagccgatccaagcaaattgctcgattcgtggcatgttttgctgagtctaagcatgacgtacttatcaagatgggtgtgtgcaatgcaaggcaatgatgcacaaaatccatcctcgattcttaagttaaaagtgttccaagtcccatgctccttggtacatgcttcaactaggcagcccgaagactccgggaagctctctcgggtgcccagaggaccatttctaggggccccaaggccaagctctacgccttccacttgcaagcccaaaaactcaggagactccgtcaaacctcctagggtgctcggagggccattgctcgggggctgtggcctttttgtttgggaataagttcatctaaggtcccttaacttgtcaaccaatccgatttacgtccttcaactgcaaaactagatacaacgggtccctcagctatcaaaaccggtgcagattaggtccctcggcggtttcgatagcggttttggcgcctacgtggctaattcgatctgacatggcaccgatgtgggcgcttacgtggcaatttgatccgaaaaaaggacccatatgtcagtttcacacacattaataaaagaatggtggggcccacgttggccccacatgtctccccatcctcttctgcttcctctctctccccatctcccctccttttatctctcttgcgacgacggcggcggcggaaatggcgaagagtggccgccggccatctcgctcttgcacgcgctcgccggtagaccagagagctcgcctagctccttcccaccggtcgtcgcccttgtccccgatggccgccatccgctgcccttctccctgatgaccgccggcaggagaggagggagcggcgccaccactttcaccagcaccccacagcgacggcttgccggcgccgctcaccgcagtgacaacgatgaccgtggatgcggcggcgccagcgctggcctcgacgtcctttgctcgtcggaggatgaggcgccgtcgacgtacattccgatggcggccttcctgacctcgagcacgaacagcagcagcgtgcagcgtgaaacagacgatggcctggaagacggagagctggacaactgttagcattatttttgtgtggcagttagcttcgtgcatgcggctagctagtggctgccgaattaatcagatcgcgtgctgcgtgcgcgtacgatgcggccgaagtttgtttgcttagtggtgtgtctgttgggctataaaattcatgtaatctcctgagttaagttccaagtgaatgagaaaaactagataaggcgttcgtcgtcgagaaattcttctgtgtttgtccacaaagattttcgctccagctagttgaagtgcgcgtgttgctgtaatccttggccagagctgacaacgacgagctgctgcgcccactcgccatacatggcgcacgccgacgacgagcgagttggtcagcgtggacagcgagaagctggtgatggagcagcgacggacggcgcagccgcctttactcatgaaccgtgcccagacgccgatgacggcgacgggttcgtcctgactagatccagatccctcgggatccaccaagagaggcttgagctcggcagcggcgacgagggggtcgggtaaggcgcgggcagcacgaagtcgagcggcgaggtcggctacgaggaggcagcggcgaggtgctcctgccgcttttgagctcgtggcgggcggcgaggaggcggtcggagaggcctggggacgaggagagtggggcgagcgccgaagcgagagaggaaaggggagagagatgaagagatgggagatggggagagagaggaggaagaagaggggtgaaatgacatgtggggcccacgtgggcccagccattttttattaatttgtgtgtgaaactgacatgtgggtctcacggggtttattattttcccgaattgaattgccacgtaagcgccacgtcagtgccacgtcagatcgagaccgagtcaaattagccacgtaggcgccacgtcagccaaaactgctattgaaaccgccgagggacctaattcgtaccagatttgatagttgagggatccgttgtatctggttttgtgattgaaggatgaaaatcggattcgttgacaagttaagggacctttgatgaacttattccttttgtttggctgggagactccagaaagtctcctcgagtgttgatgcccatttccagggcctccgagccacagtttctgccacaacgatgtggcaggccaaaggctctagggccatgctcaaagactccatgatcgtgttggcgatgccataacgactagttgggagttgggggtatttatacccactaacccacactttctcctctttgatttttcaccccatctctgtctctctctcattaagctctcctctctctcctacctttgaggcaaatctttatgggatttgagttggaatttcaggggattaagtgcttgtgaactaggatttatgcttgagcacttgagatcgacgctggacctttcacatgcttgtttactcttgaagggcagcctgctatctgtttaggtatctccttcaagtttctaagtcagtgtggcaagcccaagaaaatttgtgaaggctctactccaccttcgcaaggaaaacggggttaaataatccccaccgatggactaggttttccctttaagacttgatattaggattctattgtggtagtagcgttaatttatctcctagcttgaaacctctgtagaacttagtggaactaccaaactagactgagggttccgaagaattgatcggagtgttcgaggaagtatttaatcaaagttcgtttaaaattataggtttaatctatttaccctcccttttgggcccaacaagtaactttcagatttaacatctatgtatttcacgtgggcatagacacacgtaaattctctaaagagataagaaaaggaaaatatatatatatggtgttcaattaaatgggcaaagctaggcaggaggtaaatagggggcagtgggccactcaatgactgtattgtcgtactggtgaggttagtactagtactggtttggaattggatgcaaaaaaattaatgcaataaatatggcatgctaagtactcctttggtaaaaaaatactcaacttagaagtgaaaaatatggagagagtattactaagggcatcaggcaatgagggttcatgcaggccgtaaaccagggagcaggggagaagcccatgaggctgttagctgatgggcctgtacggtctcgtgtgtacacaaatatttgggaaaaaagtacaccgaaggtccctcaacttgtcatcgagttacgaaagcatcccccaaccgcaaaaccggatatatgacatccctcaacatacaaaaccgttcactttaaaccggggtcaaaaccaccgaaggacctaaagtgaacggttttgtaagctgagggatgtcatatatactcgatgacaagttgaggggccttcggtgtacttttccccacaaatttgcgattagtcctgggcctagatatggccggcgattttcactatatatatgttatgtacacaaattaaccattacttaattaattaacaagaacatatatataattaagaacatgaaagatcgatcatttgcaaacgagtgggccatgcaccatcctggtacgtagtacgttgatgcatggtccggtcctatatataattgcatgccttgatggagtgcagtgcagtgcaggcggcggccggctacaaagccttcgatctgcctctgttgttggtcggtgcctccagtccagctgctagctgcatactcctatttggtaccttcgacgtacgtaatcttgatccaattttcatttataaattaattaactacgaagaaattaatctgtttataattaatttcttaactctcaaatcatttagtatatattaatttcctcgcaaagataacttagtatataatgttaactttaaacggtatgaaactagttaattattaggtggtttaatttcgatgaagtgacatttatatatctcaagtgtgtacatagacaaaatgttatgacaccgtacgtgattcacgtgtaattaatacgaagaagtaatatcaataatgacaattatatcaacttaattaaacaacgatcgagagggccggggttagatttcgatgtagagtatcgaattgcaatgttaagtgagcatatatattccctccggacccgcttttgtcttcttctcaatcagctttagaggacacacaggaccaaaggccgggcccctcctccggtcggctcgcttttacttttctttttaattttcctactgcatcgccatccatgtaaccctatcttcatatagtatattatactccctccgtttcaaaatatttgacaccgttgactttatagtacgtgtttgaccattcgtcttattcagaaaatttaagtaattatttattcttttcatatcatttgattcattgttaaatatactttcacgtacacatatagttttacatatttcacgatttttttttgataagacgaacggtcaaacatgtgctaaatagtcaacggtgtcaaatattttgaaagggagggagtaattgactgtatgcagtgtttttctcagttttctatggagaagattcctccatcgatctcacttgagctagttacatgcattaatctattaattagacaagggagaaagagagagagaggagaagaaaattaaagacaaccttataactaatctatatattactcatatatattagctataatatacatatatgctagtaattggttcttctattaaacttgcactaattaattaaccgtagttacaagcactgtctactatatgatgatagtataatatgcaaattaatgttacttatgtgaaatcactttcaactagttaccagggaaaaaatattaattccaatggcgtgtcctacgtactccaatggttctacattaaatataagcattttgtctactaatatataataagtaaaaaatgtttatatttttgttcagttacacagccaaaaatttgataatatagtattttgaaacaaatcaagggagaacatataattatgttgaaataatgttttctagattaagcccgccattaattttttttagaaacatattataaacacaggcgcttacaacacgcatactcacctctatgaacacacacgcacacgcacattccatccctatgagcatttttaaaagactgatcagtatatttattttaagattgatgaagtcaccaccgacggccacctaacattaactgatcttgttttatgagaaaactaattaagttactaagaggaatgagtaatatatgcgtgcatgcatgctcttctcgaagaagagacgacatccgaaacaaagcaaaacactatgattaggccataatggggtggaagctaagggtactgcatgcaatgcaaaagtttgtaatcatgcatggcagcaagcaaaatgtatggccatgtttagttctcaccaaactttctctaaactcccatcacatcacattcaaaactttcctactcacataaactcccaacttgttttccaaactcccaacttttttccaaacttctctctaattttagaaactaagggcccctttgaatcgtaggaataaaaaaacggaggaatagaaaaaacataggattctggcaggaatgtaagtgtaaaacagatgattgcgaaacacaagaaaaacacaggaatgatcgtttgattggaccacaggaaaaacacaggaatcggatgagagagatagactcaaaggatttttaccaagaggttggacctcttgctaaggccccctttgggctcctttgatttgtaggaaaagtgtagaaaattggaggatttcaatcctatggaaaaaatttctatggaagcctttaaaataaaggattgaatcctatactatcctttaaaattcctatggaatggctaatcctgtagagattttggaggaaagttagcaagaggtggaaaaattcctttgagtctatctctctcatccgattcctgcgtttttcctgtggtccaatcaaacggtcattcctgtgtttttcctgtattttccaatcctctgttttacacctgcattcatgtcagaatcctacgtttttcctcagtttttccattcctgcgattcaaaggggccctgaatcaaaggaattatgaaggaattttataggattgaaatcctataggaaattttcctatgtatccctttgattcaaaggattgaagttttccaaatcctacaaaattcctatggaatggtttattgcatatagattttggaggaaacttagcgagaggtccaacctcttggaaaaaatcctttgagtctatctctctcatccgattcctttgtttttcctgtggtccaatcaaacgatcatgagggcccctttgatttggaggaaaatcataggaattttgaaggatttcaatcctataggaaaattttctatgaagccatttgaaacaaaggattgaatccaatccaatcctttgaaattcctatggaatggacaatcctatagagattttggaggaaatttagcaagagcttcaacctcttggtaactttcctttgagtctatctctctcatccaatttctacgtttttcctgcggttcaatcaaacgtttattcctatgtttttcctgcgttttgcaatcctctgttttacacttgcattcctatcaaaatcctgtgtttttcctattcctacgttttctcaatcctgcgattcaaatgggccctcattcctgtgtttttcctgtgttttgcaatcttctattttacacttgcattcctgtcagaatcctatgtttttctattcctccgtttttccattcccgtccatctaatgcataaaagcagcaattaattaaagcagaactctctgtaatattccctccgtcccagaatatagcaagctagtactggatgtgacatatcctattactacgaattaataggatatgtcacatccggtactaggttgctatattctgggacggatggagtaataataattaatcaaaagatacatatactatttgatagaggtagcgcgagagctagctagtaggcctttagagaagaagtgatggatggattagatgcgcttaaagctacgtacgacatatttgatggaacttttggaggtgatcgagtacatttttcctttccctttttattgtttgcctttttctctttattttccctttcctttctcccgatacctttcgatgttacctttcatttctttaattaagatcgatgcatgcatggctctggctctccatatgaatatatgatctctagctcatctttatatacagtacatatgtctctcctttttatactgatgtgatcgatgtatgttaagggtgggtttagttggggaaaagaaaatttttgggtgtcacatcagacgtttgaccgaatgtcggaagtgtttttggacacaaatgaaaaaactaatttcagaactcgtctggaaaccgcgagacgaatctttcgagcctacttaagccgtcattagcacacgtgggttactgtagcacttatggctaatcatggcctaattaggctcaaaagattcgtctcgcgatttatagctaaactgtgcaattggtttttctttttgtccacatttaatgctccatacatatgtccaaagattcgatgcgatgggtgaaggggaaaaaattttgggaactaaactggccctaagcttgacccccatgcatcgagagtacttaatctcatcgatcgacacgtcttgatattattctgaaatgcatgtaggagctaagtaaggtcgatcatttatgcatatatatatatatatatatatatatatatatatatatatatatatatatatatatatatatatatatatatatatatatatatatagggccaaggaagtaaattaaggagatttatagtttgagagcaagtttaatagtatagccaactactggctccaaatcatctatagccaatgtaatagtcaattcatataatagttgcttactatactattaatacctggtcctacctgtcatacacacattacgtcttggagtccgtgctgcagctgactacagatgtatagcccgctgctcttctctctcttcctttatctctttaaaatatggttatagctggcttatagcctgctattgtacctgctctaatatagcatctgcccatacatacacactgaaagatgcagctgcagcagatcagtgtcgatctctagcttttgctcatatatatggctgcccaaccggcctttctccagtgacatgacatgcatcaatggacgatcgatatatgttctggggctccatctgatcatccatcagtcttcctgtttattgcagagtagatatatatattagcttgtctatatatattggctacatgcatgcatgcatgttttctcgaggtgtagctaggacaggcaatgctgtgtgaagcacaagttcgtgcgtgcatactataatattagtgcatccattccaaaatataacaatctacaaataaacggaacatatttatatatgaatctgaacattatagtcttattcagatttatgtgactataatgtgttccatttaattatagattattatattttaggattgtggggtatatattatccggtttaatttaatttttatggttggaggccgaaggaccagagaactggagaaggaagaagggccagctagctagcgtgctgctgctgctgctgagaccaactttaactttatgcaccctaagccatatgtatgcatggaatcatatactacatcacaattaccgagatcacaaagaggtcccttttctgaggaaaaggaccggaactactgctatctctcgtccctttatttcaaaagctacataaagtatatactactagttggaagcccaaaagatcagataatactctccctaattatttaggccatcttgatcttctcctacaatgtcacacaccctactgatctctaattaattaatttgcgtaccctagctagctagtaatcgatagttatatttcatcatggcacatagaccaaggataagtaattttacttatcatccatttaaacatactactagtaaacaagcgattcattaatatttatatttctcaatgctcatgtaaccaatcatgtgtggaacaatgaagagtcacgcattaaatccgagaaagtcattaagatgataggttgttggattgaaatatgcctatcaaaaataaaattttcagatttggaaatatgactatcaaaagtagatggagggagtatttcacttaccaggcaggcatgtaatgaacgtggacgtcatccaaaattaaacgagagtacgcccaaggataatgatctagctatgtaaggatcgatatataagaggacaccgagagagtcccgaagttcgccatgcatccggttgcatgctgctcaagttgagcaaattgaattctccaggagctagctcctgcttcatcgacgcatgtatgcctgcagctattcagatcaattaccggccgggcattgacaaattaaacggtgaggtcgtcgatcgatcgatcgatgtcggccggaagcttgccggcgagctcgttgcatgcattgttctccgccctagctaaacacggttagcttgatatcactgatgatcgatgggatagagtcagagaacatcttgttccttaattatctcaattcgtgagatgttggacgatatctcgatagggagagaaggcgttgttctggatcatcaccgtgctcaggggtcaattttacactgagcaggggcaaagacgtaaatttttacttccttacttgagtaagagcaagtttaatactacaaccaactactacaaactccaattcatttataaccaatctaataacttattcatacaatagttacctataagcatatactacacacacaacgtattggaatcctccgtgctgctgctggctacagatctgtagcccgctttccttctccctcttcacttctctcctccacatgtgcatacaactgacttataatctgctattgtactcgctgcaatagactcttgaccctcactaacctttaccacacaatatcgtccatggaccaaattattctgtgaattgtatttcacttccattcctgcttccgcccttgtatatgtatcgacttgtcacagatgtcgatcagtttatactacaggcctgtttggtacagttccaacttcagctccacctttttcagagttcagcttaaatgggagtagagttgggtggaactctctcacacaaaatgaactagagaggtggagctgagtttagacagctccacaactctactccagactcaactcctgaagctaaatttaggagttggaactctatcaaacaggccttacaaggtcatagatgccacgatgaataattgcattactttttgcttgctgttttctgaatttgaagggcaacacagttaattagtcatgcagcaatctatattaattggtcaatcatgcatgcaagcatctgcttatggatctaaagacagaaatcccaactatgacgatagtacagagagagagagagagagagagagagttgcagatgtctcttgatactgagttgcctttgtaacttaactactgtaaggaggcatggcatgggaacaaagttaccaaccaatataaaaagagagaaagcggcgaggaagccttagcttatgggcacctggatccattatttcccaatctcaatagtcaatagtatacttcttctctccttttacacacatgcatgttgttgagagattctaaaagctcattcagtagctagtagtagtacgtgcatcgatcatgtgtcaatgtgtgcgtgtgtggcctatcttttcttactctcttggaaggaacatcaaataaaaagatcatcatcattataaaccttttagtatcatcatcatgatggcctcctcctcttcctcctccagcctctgtgataatcatctcttgcaagatgacctgatcccatggccttccatgccctttgctcctgctcccaacacctttggattgaaccaccaatggagccagcctccaatgctgtaagatatatagctttacacacacatacatatttatatatagatatagtttattcatgcatcttttctttgagttgttcatgcatatatgttgttccctctgaaaaggatcgaaaatgaagttatatgtatgtcttttgagtttgtattgtagatcatgcacctgggattcctaggatttggattttcttctctggcttcttgtctgctacctccttgttccttctgagattctggggaattgtagcaagcacaacaaaatgacaacttcagaggaaacaatgtgtgcattaattatattggcagcatggatctagctaggcttattgatttgttggtttccttgatgtaaaaagcttccatccgctcgcattacctttgttccttttgtcatgcatgatcaaggtctgtatatctcataataatctggtagatagatgataccagtgataataacaaattaagtaattaatatctgactcgattttcttaatttctctcttgatcagaagcagcagtactgatcagttaagctcatatgagcttgaatcactccaatcagttgaaagtcagctggcagctgctgctcctccgacattaagcccccatctgcaggctcatcaactcagcacggtgctaatgatgcaggagctagggttccaatggagcagctgcgctgcgccagcagatcaacatagtattgcaagctccacgaataataatagtaatgtgatgatgaacgaggaggagctacggccacgtcctgatcaatccctaatcagcaatccaaggtcatgcagcgccaccacgcttcttcctccgccgcatctacatctggacggcgctgtgctcccgagcatcaacgtctcgcggctgcagaagctggccgccggcgatgagccgctgcagatatgttgcaagaggcaggctgctgctgctgcagtggtcggccatagcagcataagagatgagcatgtgccctgcccctatgctggccctcctgctcatctaattcaaggaccatccaacaccctgcaggtcagtacataatcacagcatttatgcactagttatacattaattaatccagctggctagcttaattaattgccttctcttctcatatagtacatggtccttggaggagtacgtgctaaactgtctgactaacacttaattgttactgtagacatattggaactgattaagctaataatggtgataagtgataaccaaactagtaattaggaacatgcatgcattttcagcctatacttacacatgcaaatacttacacatcaggcatgatgataattaacttttgtctctgtcatgattgtgacatatcaggttttgacggatctcgatacatacatatatatattatcctgccatggtcaaatatatgacgaaattaattagcattgacgggctaaaatgcatgaatcagtatctcggagtgccaatttgaagtatattcagtagtgcccttgtaagacagatacatatttatatgcatttgccctgattcagatgtctcctagatatactgtcagcaagctagctagctagcttaattagcttaactggtacgtaagggaacgatctgcatgtcttgggcagagtagagaacaagagaacatgtttgtgcttggcaaaagcctgtgagttgttaattgtaggaccatttgtctgtaatgaactggggacagcataagcatatatgtgcagcaagcttaggtgacacagctgaaacagtagcagcaagctagctagttaggtaattttgctttcccggcctgcctgaaccaattagctagctaggcccggtccattcacaaaaagtacagccttttgttctgcacatatgcagcttttaagggtgacatgcgtcatctttttgccccaaaaagtactggtactacattgaacatgcatcagttgcagcaacatgcatcctggactggagttgatcagtggtacttcagtttgcaacacataattatatttacttgcagtgatgaaactagcttaattacttggaagctcaatacgtaagcaatttaacaagcaggtcaatttgtgtacctacacatgcagatgaagaggaatacgaatgcagcagctcaagggagaggtggccgccatgggagttcaacggagcacagatcatcaacagcgctgccgccatcgtcaaagaagccccggctcgagtcacactcctcctcaatgcttccttcattcaaggtccgtatatacacatacaaagatcgatctgaccgatcgatgtttgatcatttatctgctctgcatgaacattggacaatggtaatgcatatcctaattcaactaattattataggtaaggaaagagaaactaggggatagaattgccgcccttcagcaactggtctcaccctttggtaaggtatgtaccaacaatcaatgaatgcattaccagttttcggtaataaaatattccccctttgatagaatttgattttaaaatgatgagatgcagactgataccgcatcggtactcatggaggccatcggttacatcaaattttttcaggaccaagttgaggtatgtaacaatgcacatctacctgtgaattaatctttggcctgagctgagaattaattgttcctgtgctgttttgcaaaaaaataataataaaacattgcaatgtaagcagactttgagcggtccatacctgagatcatccaagaacagcaagaaattagcctgcagggcagcacaacaacaacgggtaaaaagataaacttttctgttcatttagtttcagaagagaaattaaaactatgttaactgacctgtcatgtttgcttggtgtcaattgattaattaatcaattagaaggggacgtcaaatggaggggacgcagcagcaaagcttgacctccgaagtagaggactctgcctggtgcccctgtcgtgcacctcctacgtcaccaacgagaatggggtttggcctccacccaatttcagaggaaactgaactaatctatcacagattcatactactagctaggagtactatacaacaatgtcagctcatctagctagctagctacagcagatccaacacacaaagttgtactactcatcaaactgagcaacattactggactcggctggaggatctcagtatccgattcctctgcttttgtctggtgtgtatgtctcctctttgttaagaatttggtctttgctcaggcacacatcatatactacagcagtcaagtagccagagcagagacctgtctgatatgtgacatccagatcatacttttttttcttgcagcaaaacacaactctagctagctacttgaattagctagtctccacttcacaatgagcacgtcagatgtgtctgaaccaaacgtggttcgtttctttcattaatcacatgtaaacaaacaacagaaaccaagaacacataccccccccccccaatgtaaagaacacagttgaggtgggttcacacaattgcatctattacaaccactgttgagctatgtacttccaatgtaataataataagctataaagcagaaaagtggtagctgaagcctcgacatatttagctctgtttacctcacgtactacccccatcactatccgttattcaagatgtagatcccttgctgcttgtagtcatgaaagattcaccacagccgcactcccctttggaatttggattgatgaacacaaattcagacctacaggagaagcctccgtaaggtagtgaaaggaggtaataagtagagaggaggaaatgttgtgcacaaatcataaaccttagcgggtcatcaacataatccatcttggtgccgatgacatgcatcagagccttgggatcgattagtactttaactcctttatcttcaacaacctcatcaaacttgcctttttcatctgaataaacagatatttcgctctttagcatgaatagaaataaaaacataatagcagtagaggaagaggaacatgtagccgttggacaatggagatgatgattcagttcacaaaaaggaagatatccactaattaatggggaaattactgacatctatatagagaaaatattacaaagaaacagagacagcgtcagcttctacaaacattttgcaaatagtaatggtattcttgatgattgaaagacaggacaggacctaagtttatcattacacgggcaatgtttgacagagtagcgcaataagatatgacattagattccccgcaaaaagaagcaatgagatataaacattagattccacgcaaaaagaagaaaacatattaacattagatgtgaaagtatcctaacaaggcatggtaaggatatcaaacatggatatgagctgaagataaaaatcaattagttgataagaatcataaactcaatatgtaaaggcctgcaaatagggattgatattcctacactggtttgaccaataatagatacttcatccgtttcacaatgtaagtcattctagcattttccacattcatattgatgctaatgaatgtgggaaatactagaatgacttacattgtgaaacggagggagtaattactaatgtaataatggttatgttatgtaggaaaggccgatcggagttgtaggaacattagcagggtttttaggatgtttgaccaaatgagactcgcaatgcatagcatagatgggccactaatcccaaatggatataacgtctaaattcgacaagagagaaagaatattgaggcctaaatgtcaaccatattgagagaatattgattggcccatttttatttgataagaaatggc

SEQ ID NO: 50318 - DNA, 1682 bp, Oryza sativa
cctcctccctagcaagcaagcgacaaggctccagctcctagcatacatataaaaggatttgacaccttttctaacctcacaatccactctaggtatccaccaatcataaaaaccaaacatcatcttgctgcctgctgcggagaagtgaaagaacctccttttgcaaaacattgaaccagacagaattcacgagctcagcaaatgattgatcgtaatttggtactagtagtctctagtttacttttaagactctgcacacaggtgaggtgacagctgacaacaaacacgttcagattttcatacatccaaacttttatgttactttattatactatatatatatatatgagttttctcgagcaaattgaataatcagcgagacttgtagtgcagtgcaggttaccaccatccattccattcatctcatctcacaaattaagaaacaaagaaagaaaccgagcataggaggtctaactaacaaacaatcaagccatcaatgaccatggtctgaatctttgtttctttcttggaagcttgacaagtaaaaggcaagcccttttttctttttcttcagttcttgaggtcagggagcagcaggccactggcgttcatctgcttgtacatccactgccagttctccggcctcacctccccgcccagagccctcaccactgacccaccgctgcacgcccctaccttgcagcactcctccaatgccagccctttcaccaacccgtacaggaacccgctcgcaaacagatcccccgcccccgtcgcgtccaccgcattactctccccggttgccgccacttgaaccacctgcattttatttttcactttacatgttaacaaagccgccttcttgttgctcaaacaaactgcaaaggaaaccattctcaactctgaaccatgcatcatgcatgtgtatcaaatactagtatgcatcacaataacatcccaaataacattgctattgtagtacatcacaataaccttgatctcacctgcttcccatgcttcgctatgcatcccttagaagctagggtcaccacggcccatttacagtacttggccaagaaagcaagtgcctcctctggatcaaatgtcagctctcccctgaaaaaacacgcacacatcagatatactataataggtatcactcactgaagaacatctgaaacaataaggcgatgagggtatcaccctagaagctctctagcttcatcctcattggcaaagcaaaggtcaatgttgccagtttccaaaaggtcaatgagttgtgtcctatagtcacgaaccatctgtgtaataaataaacaaaatcagactggtgcctgtaccaaaaaaagaccttacggtaccaatgagctgcggtcagacctcaaaactagccaaatccaatgatactgagagaccttcttgtttagcaatcctaatagcttcaaggatctgttccatgttctgtcttgcatatcgtacaaccaaccactgcattacatcatgatgacaaaaacattccatgtcaaaaaataaacatatttattatgacatagtaagattttttgtgtgatggtaacatatgctggaatttgtgtgcacagaatgtggcgtaagaggaaaaggaccaccttggagcctttgaagtcctcttttttgaactcgttggcctgttaatgagtaaa

SEQ ID NO: 50319 - DNA, 775 bp, Oryza sativa
cataattcaaaggtaaagttatcgacccttgcatcaaatagcagaagtagctatcacccggagaccagggaagctaatatgaggcagttggtggcgagttagaagcaaatgacaagcatggtatcttagtaatgacgagctgatctcgacacatgacatgaagcgggtaacttgtatgaggttgactccaaagatatgaactatgcgaagttctggaactgaagccccatcttcaagtgccgcaacccagtcgaagtcagctaaaggttcaaccctggttcgagtcaggtgaaaagaagattccacctgcaacaggagatcgagccaagcagtccagagtggagaagctttgttaggcaagtttgttatagaaagcggagcggaagaagtcagacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaaattcgaaaagaaattggcaaaccctaaaatacgtacaagaaaaattcaaatgtggcccagagaatttttgttaaattctccttggtctaaaaggagccctcaaattttagtggaatttcagagcacgaataataattattaagaaataaacaatgttaaaataattttataaaaagaaaaaccctaaaaagtctttcccccccctttcccctcttgggccggctcggcc

SEQ ID NO: 50320 - DNA, 739 bp, Oryza sativa
gatcgaccatcgtgaactatcattaagccatcatgaaataatagtaaatcattagttatcccataagtgtactaatgtttctaagcagggctaagcaattatatctaatatctagttgaaccaatataaataaagctcaactagtcaaattaatataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttctttcgcgaaaacggactctccggaaacgacggaatctaagcaaaaagaagcaaaatcaccaaaacagcacataaacaagcatgaacagtacatgtggatatttttaatgtgtagatcttaattttagaaaaatttagagacttgaaccaactaaatcggagctaagatgaattagttatgaatttttaaagattaaatcggattaaacacttaaatcgattaaaattgaattatgacgcaataatgaattatttttgaaaaggaaaaagggattattgcgtcagcgggctagggtttggtggaccgggcgcacgggcggcggttcacacgaacggacggccgagattgatccgatccaaatcggacggccgagatcgatcggg

SEQ ID NO: 50321 - DNA, 880 bp, Oryza sativa
gtcgccgtcgactcggggtgagccgtggaccgccgtttcgtttccccctttccctcccctctctcggccgctgctccgccgtgccggtggtcgccggcggcgaccatcggggcgagggcgctgcctcccgccggccgcgccgccgtggctgccttcgggcgcaccgagtggctgccgcgtggggcccggccgtcagccgcccgcgccctcgggtgcggctgacgcgtggggcccgcggcgccggtcggagtgagccgcgtgcacccggtccaccgtggaccgtgaggctgccgcgtgggccccactcccgtggacccggtccgcgcgcccctcccttcggctgatgcaataaatccaattttaaattaaaatttaaataaagaaattcgcaaatattcatttaaagagcatataaacttcaaatggctataacttggccatttgaactcggaattggaccgttcaagtctctaatttttccttaagaagtcaagaacccatttttgtgctttgttaatgctttttatatggagtttgttagagtaaaagccttttcttttccgttggtcgtgtagacgctgcagcttcggaggatccgctcttcgtggaagttgaagccggcatttgggaaagcgagcaaggcaagacacatcatccttgaacatattgaatcccaatttatgaaattattttgatttaaattattgcatcattgctttatttaaattcccgcgttatcactgttttatttagccatgcctatttacctttgttaatacattattattgttattgttattattaccttgttcaccctaggaaaataaaaaccccaactagtgggtactctactcctggttccactagtatgaatttaggt

SEQ ID NO: 50322 - DNA, 1139 bp, Oryza sativa
gtccttaattgccatgggtgcgaccagcaaaaccatgcactcgcagcccgccattcagtgtattttaattaactaacaccattgcggtggcaccaatccaaagctatgctaatagacaaagtctatgtaataatgtgatacccatttgtgtactagttgaactaagcatggctaagcattttcctaaaccaacatctagtcattttgatacccaagttatcaatggcataaggtaaacaataaatggctgagtaataggacccatcccacatgacattgtaaaaggatgcaacatttaatagaaatgcgggatatttgtaaattgggtacaatatgatcaattgtaatgcatgacttgccttgctctcgcactgatgagacctcagcaacgtcttcgagaaaccgcggatcgacgaaacggccagtctacgcgacaaacaaagcacacaagcaaaacatgctataagactactgaaacaggaaacaaaaccatttttaatggattctagggatttttataaatttactgagacttgaatggatttaaacagagctcggatgaattagttatgattttcagaagataaactgtgtttttactataaaagaaaagccttattggtttattgcgcaatatatattcccagatgatgtcagcaggggggcgccgacatgcgggcctcactggcagcggctcaaagggggtggtccaccgtggaccaggtccacggggccggggtggtggtgtatcacgtggcgtcgacgtggcaccacgtggctggccacgcgggccatgggatggacggccacgatcgggcgagggccgatcgggcggttggggacgggcggcaccgaggccagcccgggcatggcgcacggtggcgaccggcgaccggccggcggcaacggccggcgacgcggacggcggcgcggtgcgacggcacgcatgcggggagcggcggcgcgcacgagagaggagaggaaggggaggaaaagggggtcctcaccgaaggggcgacagcgaccggtgcgggaggggaggagcggcggcgcaggaggcagtggcgaccggcgcggaagcggcggcagcgcacgggcgaagcggcggcgagcgtgcggggaggcggcgcatgcgggag

SEQ ID NO: 50323 - DNA, 2250 bp, Oryza sativa
  unsure (1)..(2250): unsure at all n locations
atggcgatgaatcagagggggaggcggtggcggagtgcggcagcgcgagcgtcaggttaggggcggcaccgatctgggcgacggacgggacgggggcgcgggcgcgctccatggcaatgtgcagagggaaggtgtgggaagaggcagcgattgatttgctcgcatgcgtgattttcggccggtcaccccgcgtgcgcgcaatctctctcccacagtgtgaccccgcgtgcgccggtaccgttggatctagaagcgttggatgatttggaccgttagatttgatgaatgagtaatgtaggtgtaagagtgagttggtgaattatagggtagatagactatagttcgatttttatattttcctcaattttctactattaatgtaggattttctagacaatgagagtactaaacgtggaggcttctttttctattaatttattaagttaatagatttctagtatttattaaagtaccatgtggtaagttaggagcgtttgtaggagtgtcatatggcggtttaggattatttgtaggaagtttaatggatttctagtatataatagatagatagactagttttcacgagccgagctaagccgaatcggctcgttagccccccttacatgcgcgaggttgatccgacagctaatggcagtggactgagatctattatattattaaaacagccttgaaaggaggcaccacgttcgctgtggaggctaaaaattcccacattaatcatagaaaaagaaaagaagaatccaaatagaaatccaaatataaaaatagctaacattcggaattaaaaatatgcattattgaaagaggagtccatatagcaacccaatacatgattaattaaaactcggaataaaaataaaataaattttgaaattagaaaaagaaaaaaaaacaagagttcgagaaggaatacaatttaaaaatatcttanattcagaattaaaaaagtccatacaggaatccaatacaagattaattaaatttccgaataaaaaaataaaaaacaccgaaattagaagaaagaaaagaaaagaagagttcaagtaggaatactgtcagggttattgataccacatacctaatagtagttgactaaatctcggcaggacccaccacataccatgtcttatacggaaaaaaccttcggatataggaggagttccgtataaggaaggatgaatagagttctacatgaaaacgacaaggactactcggattgtatctatattggtttccctagttctacttagacaaagggacacctatgggtataaatacaaggtcccctaggaggagaggggacacagaacaatagatcaagacacaagatcaacatacaagccaacatggcgccaagacaagacgccggatatcgacttcagagataagcatagctagtcccctacggtgtctacggatactatcaggagagacataacgatgtctttgatctcgccggatgcagattcgaggaggaaggctactctgttgtcgactacgagtcagcacttcagaccgccaagtcgacaacagttatataggctaccccaaatattgtactggtgcgattttggtgaataagagcaacgaccggcttcggccaacaggagtagggttattacctgacaattcaggggcccgaacctatataaaaatcctcgtccccatctcttttacctaagtctcgcatatatcctggtaccaacgatccccatactatgcaaataccgtagtcgtgacatcaaacgtcgacaaatacaatttaaaattaacttaaatttggaattaaatataagcaatattgataagagtaaatataagaacccaatagtagattaattaaaaaatccgaaatttgacgggccgtagaggagtatagttgcatcgtttgacgggacttctaaaaattaataataaactctaaaaactataaggtccaatttttaaaggtttggaacttctaaaaaatataaaaaaaccaacgataattatgtttgatttttaaaatagcaatggcaataaagagaagatgcagtggacggttgtagaggagtataatgcagcatttaatgggacttctaaaaattatacaaaagaaccctaataggacgataaactctaaaaactataagtttttaagatctaatttttaaaggttctaagaagaatgaatagaaacggtggtagatcaagcaagctaataaagaataatatgacagaagtaagtgg

SEQ ID NO: 50324 - DNA, 955 bp, Oryza sativa
  unsure (1)..(955): unsure at all n locations
gtaggctagtatcggtctgaaattcatttcctattgatccccagtgagcagaaaagagcaggcaagtataggtcataaaaaataaagtgcatcggtgttctcccgaccattttagttttgcagcaaaagaaccagcgaccgcggctggggagatctgttcgggggagttgacaatgagatggtggccagcggccctgagtcccggcggcagaggtggagtacagacggacggcgaggcggcactgaaggaatagtgatcgctggtgacgacgacgcacgctacgacggcggctgctcggcggcagaggtgtagtatggacggacggcgaggcgacacagagggaatggtgatcgctggtgtctggtgacgacgacgcacgctacgacggcggctgcgagcggagaagggtagtcggcgatgaggggctcgaccccgccgcaactcctcccgagcggcacgaagggcggcggcgtgagaggggcggcggagcagcggcagcaggcgtgagaggggcggcggagcggcagcggcaggcatgataggggcggcggtgtgggcgtggcggcaggggcgggccgtttttagggcacgggtgcgggcgtgagaggaggcgctggtggggtcgtgagagggggaggcgcggggtgcggtgtcagtacgtctagattggttcaccatccctcctgcgtattttttaagtagtataaatattcgtagaaatatccataatttcttgaagtgtcacatggcggcttaagaatgctccacggatatgaaatcatgtgactaanaaaccatgtaattttttttacaaggttattaatgtttatgcggtggcttagtctactaattntaaattatgtagcaaaatcttacagtataataatatcaattttaacttcgcccggccctccggcgttagcactagccgttggatgctgctggccaacggcc

SEQ ID NO: 50325 - DNA, 743 bp, Oryza sativa
ccgcgcttttcccggccaccaaccatggccgccggccgccattcccgtcgccgttccgccctcccccgtggccggctccctcttttctcatataaaatgggatcctcatcccccgttctctcgttttagccccctcccgagcctccccgtggtccctagccatctccccgccgccctcctctctctcccacgccgccggccgcctccagccgcctgtgccgcctcgcccgcgcaccggccggccgtgccgtcgcctcctccagcgtcgcagccgcctcctcttccccggcgccacctccgatttgtggggaaatcgccggaacggtgcccccgccggcaaccagtggcattggtgccactgtactccctccagccggctcctgtacgtcgccggtgcgccgatcgacgccgccgtctcctccttcgacaccgcggcatcgcctccttccccggcatcacctcctcctcgcccgaagctcgccggagtggcctcgtcgtcggcgtccagtacctcccggtctccggtcggctcctgtacgtcgccggtacgccgatcgacgtcgccatctcctccgtcgacgtcgcagcgttgtcctcacctccagctgctcctcggtttcgccggaacaccgccgtgtcgccaccaacccctccacccgcctcgcccgagtccctccgccgcccgttcctcctcgcttgtttaccggtcagccgcggcaccaccacctccggcatcgcagcgg

SEQ ID NO: 50326 - DNA, 1277 bp, Oryza sativa
taaggcatgctctcgttgtggagaaatcggtcatgttgccagctcgtgtgccactacatgcgttcattgtgaggaagaccatccacccgataggtgtccaacgagcaggatcacttgtttcttttgtgaaggaactgatcatgtaccaaaagattgtcgattcagttttctgctgacgaagaagatggccaaccaacccgtcagttccaacggagagaagcatcaaggaaacacaaatcctcgccaagattacagtttcagcctaactccagtgccaggacagaggaaacaaaatgagaaaagaaaatgccgagtccgggaagatatctgttgcttcaattgtcaaggaatgggtcatttcgccgacaagtgcccaaaaccgagaaacgtagctgccagcacgtcagtccacgcaaacccccgcaatcagaagcttgctcctcaacgaattgtcatccatgcatcccgaagcagtcctatagcccgcgttgcaacagctccaattccaatgagtgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcactgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcatagcaaccattctctgcatcgacagcctcagcaaagaattgtcgtagatggaagaagttgtgtctctccccgacctactccaggccgagccaagagcaatcaacctccggagggcgataccaagcagaagaccgtcatccgcttcaaccagcaatcagaaggaagcttctcctgtgaatgatagcattatgtagtcctgtcacatcatcacagaaccaatcaaggatgcagtcactagaacaatgccagctatatctctccagaatcaaaatgagcagccatgtttgtggttttcagttcgctacttatcatggtgtaatcgaaagtttgcagcaaccatgtaatacataaatatattcatgtctataaacagtgagcttgctatgctt

SEQ ID NO: 50327 - DNA, 5089 bp, Oryza sativa
tcattcaccaaggtgtcgacgatagtatcaatgatggcacccaaaatgacaaccctagcaattgtgactctgagaaagactccaatggtgatagcaactatggtaccactgatgccaatgttagcaaggatttccaaccaccaattccaactccaagtcagaatgatcgtccccagacggatagctcagcaaagaagacgttgatttgctacaattgcaaaggaccagggcattactcgagggactgcctgcatccaaggcaaagtcgatctccacattaccgccaatttacacgaagcagacatcccaatcgtattgtggtcactggagcaaacgccgtacccgtgaggcctcgtgttaatcagaacccatagcagaaacaatgtgccgatgctaagcacctttccttttaggcagtgcttagtattcatgtaatgagggagaaatgtgtaatacagacaagttctatgagggttcttttggaagatgtggatatgtgattatgtgtataattgcttactgataaaggagacctagggtctcatttcagacgaactatgttctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcggatatacctgcaagcagttaagaagatccaggagacatcaatatttgagaacatagtagtcgatggttggtaattaatctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccctgaaggtagtcagtgcagctttttgacgaaccacatcaaggtttcactgaaaggcagcaagccaaaggatctcatcgtccccagaagcgtccgcaatccacattaaagaataccacctgttagaggtaagccgaaagatgattgataaaagagattggcaaagatgttctctagcatgaaagaagtaggccgaaaggtgattgataaacagaaacatgctctgcatcgctcacggaagacccctgattgtaattgccccgcaacagtcaccttgtcattaagtaagcaagatgacctaggtaaaagtgtttctaggaaggcaaagagtgaaatcttccactcggtatcagatgctacacggagtgaaaaatgcaagcaccggttaccaggcaacgccacgtcctggagatgatccaatgggaaagaactcatcaaggttaaaggtgtaaaggaatacgttgaatgctaactgatgacaacatgaagagaatagcggaaagtaaactgaacataaagaaagtgaatctgagttgcttgttcgtgagagctattcccagttatgaatcaagtgatatgttcgaagatagtctacagaggtcagtttaaaatcacatgtaacagcgaagcctcagatttggcaggataatgattagacaataacaaatccagcagtaaagccatttgggaagacgtcaaagtatatcaagtaggataagttggctctcttgggaagcataattcaaaggcaaagttatcgacccttgcatcaaatagcagaagtagctatcacccggagaccaggaaagctaatatgacgcagttggtggcgagttagaagtaaatgacaagcatggtattctcatgatgacaagcatggtatcttagtaatgacgagctgatctcgacgcatgacatgaagcgggtaacttgtatgaggttgacgccaaagatatgaatgataagaagttctagaaccgaagccccatcctcaaccaccgcagcctagtctgggtcagttagaagttcaaccagggacaagtcgggtgaagagaagattccatctgcaacaggagatcgagccaagcgttccagagtggagaagttttgttaggcaagttggttatagaagacggagcggaagaagtcagacaagaagagaagactgcccaacctatcttcatgctagcctcctcgaatctcggggacgagattcttgtaaggggggtggatttgtcacgtcctgataaattcatcccgaaataaaaatcattctctaaaaggaataatagaattaattaaaatttgaaaagaaattggcaaacattaaaatacgtacaagaaaaattcaaatgtgacccggagaatttttgttaaattctccttggtctaaaaggagccctcaaattttagtggaattttcagagcacaaataataattattaagaaataaacaaagttaaaatagttttataaaaagaaaaaccctaaaaagtcttctttcccccccttcccttcttgggccggctcggcccaattctctccctccctctctctcctctcccccgcggcccatcggctcctccccgcgcgcgcgccgctgacaggcgggcccgcccgccaccctcgctgacgggtggggcccacctgtcatcgccttcctcccgccgctcccgccgctcgcccgtgccctagcgccgccgccgccgcggattccgccgcatcccgccgtccccgcgcaccataatgaggggggaatcattccccgcgattccctctcccgattcccccactttcccctctctctctccctcggattcgtccgattttgtgcccgcgatcctcgccggcgcaatcaatggcggccgagatctccgcgccggtttccatctcctccggccgctttccctctctcccgacgctttttaattgttccccgtgcctctctcctccgtttgcgccgttcgccgctcgctctcaccgtcggaatcgcgctcgcgccgctttcctcttctccgcgcgccgacgagttccggttcgccgccgccgtcgctccggacttcctcccctctcggcgtcgcctccttcggcttcgccgcgtcgtcgtcgaccccgtccgctcctccgtttcgctcgccgaccgtcggagcgccgtcgtcctcgtcgtcccgaaccgcgccgccgccttcctccgtttcggccgccgttcccgtcgtcgccgtcgaccggggtgagccgaagaccgctccattcgcttcccccttccctcctctctctcgggtgccgctccgccgcgccggtggtcgccggcggtgaccatcggggcgcgggcgcgtccgcctcccgtcggccgtgccggcgaggctgccttcgggcgcgccctcgcggctgccaagtgggcccggccgtcagccgcccgcgcccgcgggtgcggctgacgcgtgggacccacggcgccgaccgccgccagccgcgtgcacccggtccaccgtggaccgagaggctgacgcgtgggccccactcccgtggacccggtccgcgcgcccctcccgtcgcctgatgcaataaatccgattttaaattaaaatttaaatgaagaaattcgtaaatatccatttaaagagcatataaacttcaaatggccataacttggccatttgaactcggaattggaccgttcaagtctctaatttttccttaagaagtcaagaacccatttttgtgctttgtttctgcttgttatatggagtttagtagagtaaaagccgtttcttttccgttggtcgtgtagacgctgcagctcggaagatccgctcttcgtggaagttgaagccggcgtttgggaaagcgagcaaggcaagtcacatcatccttgaacatattgaatcccagtttataaaattattttgatttaaattattgcatagtcgctttatttaaattcccgcgttatcactgttttatttagccatgcctatttacctttgttatgaccttattattattgttattgttattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaagggcttagtttgtggctcagtctggttataaacaaaagtacacggatggagatggatgaagtcgggggtcgatggacatctccaggacaaatgaaggctacacgagctgcggcccggtagtcgagatgtcatatggcagagggttggtgccctgctgctaggggctcagtcctgcctgcctgtcccggagattccggctgtaggcgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcataggccttgggttaaggcaggttcgtgagggttcacggccttgtttaataatactgtgtagctctaggatcgtctttataaaatggctttgggcaactaagtgacttttaaatgctgtttactgcaaaacttaatccctatattattattcccttgtacctcccttgcattaatcatgcatctgccggtgtggcttgctgagtactgtggttgtactcattgttgctcaatctttcccct

SEQ ID NO: 50328 - DNA, 2532 bp, Oryza sativa
tcaagaacccatttttgtgctttgtttctgctgttatgtggagtttagtagagtaaaagccttttctttttcgttagtcgtgtagacgctgcagcttcggaagatccgctcttcgtggaagttgaagccggtgtttgggaaagcgagcaaggcaagtcacatcatccttgagcatattgaaccccagtttataaaattattttgatttaaattattgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgcgctgctgctaggggctcagtcctgcctgcctgtcccgggggttccggctgtaggcaggattgggtcggtactcttgtctatggctaggatgggttggaaactatgtcacgtcttccgtccgtataccgtggtggtatgtggcacgtggttacacgtgaggaacacctctgatcagagtataatctattcgaatagccgcgccctcggatatgggcaagccgagcaatgtacccaagtcagtgttttaattcttaaaatttgctcaacaactaaaatgtggaatggttggcctgggttggcttgggacgagctgggacccaggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgctgtttactgcaaaacttaacccctatattattatccccttgtacctcccttgcattaatcatgcatctgccggtgtggcttgctgagtactgtggttgtactcattcttgctcaatctttctcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggtaattttctcggtcgcgacaagctggtatcagagccatctcgactgtaggataagccaagtggataaaacccaaggacatattttataaataaaactatttgcgaaagttccttttttctccttcccctaatgctatttgcaaaaggtttactcccttcttccttcttcggatttcaactagtactagatggtcaggtcagtgaagaagaagacatcgtcagttgtttgccgaagctccggaagactgcaggatccgctagcgaagtggaggaagcactgaagccagctgtgaagcaggagtgaagatcttgagaacccgtcacagaacctaagccaccctctagggtagagttgttagtcgtgtgtttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctatccaaacctttgcaacagatggctgacaatgagaaaggcaataaggtcagaagtcaggacattggtacctcaagctctcgagtgaatgaagcaccagacaccagttgtgtggcagtggtccaacacctgattaaccagaacaaattgcttatagagatactacagcagcatcggatgccaattttgaacccgagtcagatacaacctcaagtgcagttggaggcagtccaagcactcacaccacaagtcagcgcaccgccaacatcccagaagacccctcatgccatgccacatgttgacccaaaagaagcaagtatcatctgttt

SEQ ID NO: 50329 - DNA, 1782 bp, Oryza sativa
agcatataaacttcaaatggctataacttggccatttgaactcggaattggaccgttcaagtctctaatttttccttaagaagtcaagaacccatttttgtgctttgttaatgctttttatatggagtttgttagagtaaaagccttttcttttccgttggtcgtgtagacgctgcagcttcggaggatccgctcttcgtggaagttgaagccggcatttgggaaagcgagcaaggcaagacacatcatccttgaacatattgaatcccaatttatgaaattattttgatttaaattattgcatcatcgctttatttaaattcccgcgttatcactgttttatttagccatgcctatttacctttgttatgaccttattattattgttattgttattattaccttgttcaccctaggataaacaaaacccccaactagtggacactctactcgtggtatcactagtatgattttaggtagatgcttcgctgattaattaggtaacattaggtggttttaaaactctagattgtggtaatattcatatcacttggacacattggatttgttggattgttgtggaattggattcataccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggttcgatggacatctccagggcaaatgaaggctacacgagctgcggcccggtagtcgagatgtcatgacacagggccggtgtcctgctgctagggggctcagtcctgcctgcctgtcccgggggttccggccgtaggtgggattgggtcggtactcttgtctatggctaggatgggttgggaactatgtcacgtcttccgcctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggactcagggtcgggttgccagttcggtctgaatcatcgtaggccttgggttaaggcaggttcgtgtgggttcacggccttgattaataatattgtatagctctaggatcgtgtttacaaaatagcttgagcaactaaatgtctttaaatgctgtttacttcaaccctaacccctctatgttataattcccttgtactcccttgcatttattctgcacttgtgggtgtgtcttgttgagtacggtggttgtactcagtcttgctcaatttttcccaagcccagaagaggagctccttgaagatgaaggctttggtgtctagctcgtgcctgccgtcaagtgcctgtggtcgtcgccctagtcttccgctgtttctcgtttgtctttgtgtgtgctgggccttcgctgcccatgtaataaattaactatttacgcttccgcttgttaaactctgatttgtatcaacttttgctgtaccttgcctcctgggacaaggattaatgcacgcacgtaaggaatgcccgttgggttatttccggtcgtgacacaccatca

SEQ ID NO: 50330 - DNA, 1768 bp, Oryza sativa
taaatgctgtttattgcaaaacctaacccctatattataactccattgtactcctttgcaattatgctgcacttgtgggtgtgtcttgttgagtacggtagttgtactcagtcttgtttaatttttcccaaacccagcagaggagcccctggaggatgaaggctttggtgtctagctcgtgcctgccgtcaagcgcctgtggtcgtcgccttagtcttctgctgtttttcgttgtctttgagtgtgctgggccgtcgctgcccatgtaataaataactatttacgcttccgcttgttaaactctgaattgtatcaacttttggtgtaccttgcctcctaggacaaggaataatacacgcacgtaaggaacgcccgttgggttatttccggtcgtgacaataatgatctaattataattgttaagtgcttttcttgtttaaaatccttaaattataaattgttgtttaaaaggaattattagaaatgattttaaaagcctaaaagagaagatctaattttaatttgttaaatctcaatataaaattgggctagataaaattttgttaaatactttgcttaattctataattcctagatttttctgggatttatttgagctaaggaagtgtttttaataaatggaattgcatttcatgaataatttaaattgaaaaaggttttttttttttggctttgggccgaaagccggcccaaaaccctccctctctctatctctctccctcctcggcccagtccggcccagtccgccgagccgccactcttctctctcagccgctgacaggtggggcccgtctgtcaggcctgtcttcctcctcgcgccgccgccgccgcccgaaaccctagcgcaagcgccgccgtctccttccaaatccggccgttcctttccgtttctggtgaaattgattgaggggaaacgatctccgggatctcctccaccttttcccctttggaaacatcggctaaatcggtttggaatgtgtttgattcgagttcgaatcggatcggtctctttccttcaaaccccgatctttccttctcgtcgccggcagccgtgggccttcaccgttgcctcttagcccctttataaggatccccggtgtctcctctacccgccgccaccctcgcctttgcctctcgtcgtccgtagcgccctagctccgtgtgccctagcgccgccgtcgccgccgtcgcttcagccgtgcgccgccgccgttccagacgtcgccgtcgctcgggaagatcgccatcgtggtcgccgtcgcgtcgccgtcctcgtccaccgcttcaccgccgccgaagaccatcggagcaccgtcgccgccgtcgacccgatcttctccgccgccttttcctcgacgccgccgccgtccgttggtcttccgccgacgttttggtcatcggtgagttcgccgcgccgtgatctacgtcttggtgccctccgtttgtgccgtagagccgccgttcgccggcgagcatacgcgcccgagccgcccgagtcgccgccggtgctgacgtcatcgctgacgttgtcgctgacgtcatcgggaccgtccgccgtgagccggtcgtggacagatcgatctcgaccgtccgttttggatagggttgatctcggccgttcgttcccatgaaccgttgccgtgcacccggtccaccgcgaaaccctagccgctgacgcaataatcctccttttccttttcaaaaataattcattattgcgtcataattcaattaaaatccatataag

SEQ ID NO: 50331 - DNA, 2728 bp, Oryza sativa
accacaagccagcgtgggcaacggctttacctttcgtatagcatggttcattgcggggcaccagactgagaagtggcggagatagcccacgggggtcgctggggagtccatgccttatttataagggggtgattatgatccaggaatggtgcactgcggtggattgtgttatgcaaggggtaatgtcacagcccctttccgaggtaccgtggtggtactgaggcacatggtgacatgatgtggggctgtgtcttgtgggtacagtggtacacctctggccagagtaaaactattcgaatagccgtgcccacggttatgggcgggttgagcaatgtttttcgtgattagtcccacacttctcacaataattatggatgttatatctggtaataatttgcttagctcctggattggagattagatctgtacagccgggtatggttgtttcagaatggttgggcctgagcagcatgggcgtgttgttcagtgttgattaaaatttctgattaattactccactgttttacttctcttaaatgttttgctaaatgctgcttttgcaaatgagcctatattatgccaacctttggtatctttgcgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagatttttttttttccgctgcagttttcttcatggtgaggactaagtgcctctttagtaagtatttatcgttttagatattttgatgaatctgtatattaaattgttagtttgtgtacctcggctgattcctggacgaggattttatgcacaaataagttcggaaattactagtgaattttcgggcgtgacaacttacgccatggagtaatcttaacaaaagataatctgattaaaaggaattggagaggaaacaagtctagttctttctgccacaaagatgaaactattaatcatttgttctttgattgttattttgcccgcgcggtttggtctttaattcagtttgcttcgaatattagttttatctaatagtacaactcatatgtttgggcattggataagaagacaatcacgcaatttgagatctttggtcttattaggtgcaactaccactatttggtctatttggcttttcagaaataatgtggtttttgaaaggaaaaaacatatcttctcctttgcaggttatctttttgattacacattggctccgctcataggctatgcttcagaaggtcaatttgcagggtactatcattgcggtttgtcaacaattagagttagtggccatatagtagttttctaccccagcacatgggtgacgttctaggctacggttagcgggctcctaaagttctttttgtttctgctattttggatgatgagtttatcttttgtttctttcttgttggctgtgtgtactctttggtgcagaagccgaatgtgctctcagaataattgtatcacttgatgaaatttactgagattaataaagcttccattatgtaaaaaactggttctgaataggctaaaaaaaacaccattccacaatgctttgctgaaagggaacaagttaataaggtcaaagaattctcctactaatgaccatgaaactgtgttaccagaaccataaacaattacagttgctctcatctaaatctaatactgcttaatcaaaactgtaacataacatatgatgaaatagagacaaacgaggttagctccacaatcatttgggtgttgctccttaatcaaaactgtaattctcttgaaaaaaacaagctatgtgtggcaaatggtttggtcatcactcccaataaagcaacgtacagaacatccacgatctaattactgcaaagttactgcaaagtttccataatgccaaggttaggcttgttgcgcacagtaagaaaagatggcgattgtccaacatgttctagcaatttcttgttttttcccatcggatttgattttttatcattgttcaaatgactttagaatgtgtatctgcacttcattgttcaaaagagagtagtggtggctcgctagatgatcaacagtaacaacgaacaggtaaaaaagagtttaaatatgaacaactgcagatgaaagagtaaaaaacaaaggagttgggacatcacgtcttaccttgggtgatcagatgtagaatacttgtaaatcttggtttgattcttctaatctcttgagttgatccttcaggtcgacgctgcaacgcattgctagtagttttttcagtgaagctgggatgccctcctcgggcaacgatctgatttcaggacatccgacgatgcctaatgtgcagatagaagaaaggagatgcaacccttcgggaagggactgcagacggtggcactcatagaattctagatttcggagggaggtgaggagctgaagtgcctgctcctgctcttttgtgaaatttttcatccacaaatcataagtgaacctcaacctgtagagggtggaagcgaggaggctgcaaatgggggcaacaaacaccgctgagatgctgtccacctcaagcttcttaagctgttggaatgaaccaacaggtattgccttcgtcgttgacaccgctgcgaacaaatgtgctgctacggagcagcgatg

SEQ ID NO: 50332 - DNA, 1069 bp, Oryza sativa
tttcacacaaatatcatcacataaccaactaggaccagtggaaccaccatgatttcttattccaaatgctctaagattagaaggtggctgaagaccttcaataatctcagatccactattctgctgctctgcaccccaaactagttctagtgtctttagattccttttcaacatcaattcagcaccatttgcttcttccgttgttgctatattttcaagattatttatttgtagtgctcctccaagctctttcaaataccccaattctctaagttcaaacccagtgcgctctttcttaacatggaattcttgcagcctccgtaaatacttcatctttccaatcccacgaatattggaacaaagttcttttttggcaaggaaataatgtaaattggctagacgattaatgtcgtcaggcaaaatataattaccatggcctaggtccaaaaacttcatgtgataaaatctacatattgtggctggcaaagacatttctaagttatgaggtacttcaagctttaggtatcgaaggtgaatcagttttgaaaagttgaaagggaaagatttgatagagtttacaaacataaatagaacacgaaggcattttgttttttttgaatatatttttgaaaaatatagccatattgtcattgtatcgtccaaaaaacatcaaagtccgtaaattttctatgtctatttttctcttcaaattttccatttctctctcaaaactttggccatatttatgatgtacagtgatagatatatgtcgaatagattgtgggatgttatcagatctaaaactttgtggacttatatttagagaacttttacggtacattctactgtaagtatatacttgcagtatatagaaaggtaagtttggtatttgtgaaaaatatagaaagggctgtttagtaatttgaatttgagatttatttgcacccggagttaattctcggacgggttgtttagttggtattagttctggatctcgtagtacgttctgctagagcagcagcgcttctttgggaatacattgtgcgtggcggcgaaccgattgtcgacg

SEQ ID NO: 50333 - DNA, 1409 bp, Oryza sativa
tcaattgaagcttgttcgcaatatgagggtgcagagcgacgtgtggtttgcggactacctccttcgagttgggaatggcaccgaggaggtgaaacggatatttgcatgtcgtgcaaagagaatgaaacggacctcgaaaggctcatcgatactgtgttccccaacctaaacgataatcttacgaacccaaactacatcacatgtaggaccataatgtccacccggaatgagttcgtggatcgaattaacatgaaaatgattgggcggtttagaggagaggtggtgacatatcatagctttgatcgaccagaggatgacccttataactattacccgcctgaattcttgaactctctaactctaaatgggctacctccgcatgtgcttaagctgaagattaactgccccatcatgctattgaggaacattgacccagccaacggactttgcaatgggacaaggctggtggttcgtgagttcggaagaaatgctattgacgtagagattgtggtagggcagcatgctggtaagagagttttccttcctcggatacctcaatgtccttcggatgatgagatgttcccctttcgcttcaagaggaagcaatttctggttagattgagctttgcattgaccatcaataaggcgcagggacaaacaattccaaatgcaggcgtctatttaccagagtctgtcttctctcatggtcaactatacgtcacgttgtctagagcaacctctagaacaaacataaaaatactatcgatgccggtagaagacaagaaacaaaagaaaaagtctaagcgtactggcgtgaaggacaatgagaagaaaggaaagaaattgtctaaacagacagcagcatacacaaaaaatattgtgtatagagaggtcctcacagattagaaaaggtatattatgtgactattaaccatccataatatgcttgcttaaattccattctttctgtaatttttatattccaagtctaacatttcgtgtgtttttttcttggacagcagtaaacattactttcggtgggattttggcacggactatatgcaccattacgggtattgtgatactactttttttctggatgatattgatctggagcccttgcctcgcctgtaatccatctcctagggtggtcagcaaggaagagcaaaagagggtgcagtggccaagtgtagcagctttgctgctctcccctgctgtcgaccatccatctataccaggccactattagattcacatggacaaaaaaaaataggcaaattttgctacaggacatcgcgacttcgtgggtttagctgtaggacactgcacaaagtcacttttggggaaagacactctcaaaatgtggttatttgccaggggacaccgcaaccaataaaatattaatttct

SEQ ID NO: 50334 - DNA, 1653 bp, Oryza sativa
cgttgcaatgcctcagtagcggcctcgctgttaaaggaggaagagagaggaagagaaagagatgagggcaatttggtcatgccatgtaaaaaagtaggccccttctcgcttagtcagcacaaaaatattaatttaatgaatgaagtgtcccctagcaaataaccacattttgagagtgtctttccccaaaagtgacttcgtgcggtgccctacagctaaaaccacaaagtcgtgatatcttgtagcaaaatttgccaaaaaaataattaatctaaacatataagttggccatagctgtatacagtatacgtaacatgtaacttgtttttgtttgtctgcaaatttaaatggcaaagtttcataattagttggagttgaaaattatattttgtatagctgatttgattaccttaggaacattacaaatggttgtccacaagcacgagcagggaaagtctcctactacagcatatctgacttaatcaattccctggaagaaacaatgcttttgatctgttcttcacacgtcttcctgaccaatttgttaaacaattcaataaaaataccttctttacctatatgcacactctttttctgctaaatattaattgctattgtatactagtagtgcactatacttactttatactccatcatgcagataacccatgagccagtactggtgttttactactctgatctaccagctatttggttccttgatgtgaatgtaaactggaaggagcaatgcaagaagcttccttttcattgccaatggcactggttgaacatgctcttgtcttcctgtagaagtgttgctggcatttgtgatttctgtacttgattttactgataaaaagtgtggatcatgcaatttattgataggggcaatgtttgccggttgaaaaaaatgagatgtgatttgttaattgtgatcgttcgggattacaatttaaacagataatatgctttcagagaggagatcgggtaggttacatcaaaaggaattattctcttgtcatgaaaattggaattaaaatgtacgtagaatcgtgtgttcagctggtagaaaatgctaccagataactgatgcaacagaaacagtagagtttcaagagctattagtctaagaataattgatattgtgcaagaacgtgattgtccctgatgaatttcaaaaaagaatttttaaagcacctccagagcttcacactgccaagaagctctctctgtatcagatgtggcacatctagcttgattagaaactagaaaggttaactccaagcagcagatctgcaacacccgccaaggaatattttgatggaatattttgcttgcttatttgcactcttggaattaattgataaaggaaacaagctatgggcctaatcggcccatataacatctgactattacggtccaacgccagaaataggaataagttcatctgaggtcccttgactttacaccaaatccgattttcgtccctcgatcggaaaaccagacacaacgggtccctcaactatcacaaccgatgcagatcaggtccctcggcggttttaagggcggttttggctaatgtggcgcatacgtggctaatttgactcagtcttcgttcgacatggcattgacgcggcgcttacgtggcaattc

SEQ ID NO: 50335 - DNA, 737 bp, Oryza sativa
  unsure (1)..(737): unsure at all n locations
gtttaatgcacattcagcttagaaattctggttcatgaatttctaggcgagacatcctagcttcctccacgcccggaatccccgcctcatcccctctcgcaggcgatcgatcctccaccctcccgtacgcggtaggcctcccgcctccgccaatcaacgccgtcgtcctctcccgtctcgccgatgggatattgacccggcaccaacgtctttctcgctttcgtctccccgcgccgacgagagtggcgtcccgaccgtattcccactttctcagttccccacgagaaaatggacatttcgccatgttcaaaacgcggtttcgctagaatgccatcccgaagacgtgattcgataaactgccaatatgaagcgtgcgtctaccgccactttgccattttcgctattttattcattttcgaaaagattttctctcctctactaggtgttgagacaaaatttccccttatcaactcagagaacacggtgagagaggagacagaaaaggggcgccgacgccgctgctgccggccggcgccgcctctccgcatcatgcgcggcaacatcgtgtgcgtccgccgcggcggcctttgcatgctctgcccggcggcggagcgggtgaccgacgaagagatgatgaggggcaccaacgccgcgccgncgncggtgcccggaacgggatcgatcatcgacgaggccctctgcctgatgaagctccgcgagaacgtcgtcgactcgat

SEQ ID NO: 50336 - DNA, 1034 bp, Oryza sativa
aaaaggaaaaaaaaagaaggaagaaagaagaaagaaagaaaagaggaaatactattatgtttgagctaaacttcatatatcagagttgtgcatgagttgttcctagtgctatcttggggtattgtttgtgtctaggctcgcgtctctagtacgttctagcctaagaccagcacggtcttgactttgaacaattattcaactttgcattatctgatttgagcattggctattcctttgctacatattaaagcctacccagagctccacatatttgattacagccgtaccgcaagtgtttgccaaagcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatatgcaagataattggggatagctgtgctcaacatcgacatcttcgtcgagacacgaggagggatcaacatgaccattataaggtaagtgatgatgttctaggtaagatcaaatctgcactgccttatttcgagggaaactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaacgatatttcagagatatttatgttcccatgtattatgctgacattttgttcaacaaactgcaatgtttaaaacaagataccagagctgttacttcatactatcatgatatgcaagcttgtttattacgtgtggtttagatgaatgcgaagaagctaaagaattgaggtttttatgtgggcttaacaaagaaattcaggacatgcttgattg

SEQ ID NO: 50337 - DNA, 866 bp, Oryza sativa
ttatatttcacatctttggtgaatataatgatcttggaatatattttgtgcatagagtttacatctgctcggatttagaacctcctgtacatgtggataaaatatgcaagctagagaaaaatgttattgctaaccaaattgtctcgagtttgcctagttttgattggaagaaacaggttgttgtaaatggactacgcaaagagcaccatatggaaaaaccgaggacggttttccgtgaagaaggggaggatgatgtgaccatggctaccacggatgcaaccattgctcacatcatggatgaacaagaagatatcgagatcaagtactccaagtgctggaatccgattcggccacctactacactgctgatttcaaacggccaccgaatctgcatacgacctccgttttcggcccgggagtacttgatggaaagctctcggagccctctttctaacggatccagcctcttctctgaattctatctcgtgtggccagaatcacaggaacaaggtgttgcatcacctataatgggcctatgggcttgtaacttcatttgggaacccggcccaggtggggcccatgtggggtgcgccccaagctggtggagcacgacctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgccatatcagattgcttttatcttgttcttgcttgtttcttcgatttgcttgcaggaatagggttgatctg

SEQ ID NO: 50338 - DNA, 725 bp, Oryza sativa
cacttctcctggtcgtcaccatctgaaaaccccacacggaaccagcaaacagagagagctgacaattaaaactaaccacccacgactaccataattcttgagtttaatactgctattaaattggttcattaaggttcaaattgcttaggcaaataaaataaagacaggctccgacatagttataccacacaccggcataaccatgccccatacgactctagcaaaacaaacaaacgaaaagaacacacgcgcaagcctactaactgctcgtctaccgctgcgacgggccaggacggaaggtgagcagcagcgcatcctccgtgctccctacgccggaggcttccccctcctgaggaaccacgggcgcgggctcggcacgaggggtctccacgaagcaggtccacgccagggactgacaaacaagctcgggcctggaggtactcttgcgagcggtgatcttctggctgcggcagacgcggcggcgcttgggacgacagacctctccctgggcgaccttgagctgacagagctgcgcctccagcacgtccagatccttcttcagctgcagattctcctgacgcagctccaggatcttcatgttgttatcgaccatcccgcggcgcaccatctggtggaagtcgatacgggccgcgtcgtacgcctccaccatgcgcgccaggtgcatgatggtagcgtcatcctccgagctagcatcccggaaggtg

SEQ ID NO: 50339 - DNA, 766 bp, Oryza sativa
aggataatcctagaatcccatctttcttctggatttggagaaatgtcgattttcaagaaagaacgcgaatcttatgatatggtgggaatctcttatcatcatcatccacgccttaaatgtatcctaatgcccagctcaggtgtcagtgacaacaatggtgcttaggaataagtagattatagaagctaagggctcagacaaaatccattcacgaacaatattatttattttgttttcttgcgtatcctcaaaaatgtttacaagcatgcttttttgcgtattcatggccaacaagaatacaaaggaaataatagtatcacctctgtgttcagcatgagaagtcttctcttctccaaagtatttcttgtactgccaagctatcctcaaagcctcgtcctacacaattacatgtcgagatcaacattaaaataataacacttttcagggctcaagttgactgccaaatattcttcctcgagacatacacttgttcggccatcgctacttgttccagcccccatccctctttgtcgtccatcctcctttgaagatgcaacagcaggtaatgtaccaaggaacaagcggggttccttcataggtcctgcgaagagcagcggttgtttgtgcacaacaccctgcgccatgaagctccgaagcagtaggaggtggtgaggcgcatcagaatcctccatgatcattacaactgatccaataagaaaacccccacctagaatccctgcatccgttaaactagtaaattatggtg

SEQ ID NO: 50340 - DNA, 5612 bp, Oryza sativa
  unsure (1)..(5612): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctgcaaatcctgtaacgccccaatttccgtatacccttaaaaactatttaataaaattctatgttcaaaagtttggttatttgagtgtatctaggtttgagtaccaaagatctcaattaattcattcctttgtgaactcaaaatcttgaccaaaatattctatcctaaattaaatttctaagattcaaatttcgaggttcgagtcccctcctaaaccattcaaaaattcatacaagaactcatataaagtcgtagaatcattagagttccaaggtcctaagcaaagtccctcgaaatttcatttcctaaaattcctggaaattggaaaatattactattccggcacaactaacggaggaggaggaggaaggggaggatgaagagcggcagaagcaagatgaggtggtagagctgtacaacctccgccatggctggtgggttagcttggatcaaatcaaagcataaaggattttgtatctaagcaatggagtttaaatgcttgcattttgcttgctgtttttgctcaataggtggctgattgttgggccttgtttaggggagccgcagatttgatattcttctgctggtaaccaacttctgaaaatttagagacgctgggtttttcagcttttagatttttcattttctggattctacaactatggatttttagaaaaatttgggtaacaatatggaccgtttgaggagctgaagattccgggtgtgtttagatcctaaaatattttggctaaaaatatcacatcaaatgtttggacacatgcatggagcattaaatgtggacgaaaaaaaccaattgcacagtttgcatgtaaattgtgagataaatcttttgagcctaattacgccatgatttgacaatgtgatgctacagtaaacatttgctaatgatggattaattaggcttaataaatttgtctcacagtttacagacgaaatctataatttgttttgttattagtctatgtttaatacttcaaatgtgtgtccgtatactttaaaaaaatttggccaaagaactaaacacggcctctgtgagaagctatagctgctaaaagctcttccaaacaatcccttgttcttagtcagctctgcattctgcacccagctagttttttgaattagaaattattgccaaaaggaattatgaaaattaatggaatctttgtgtattctatccagtgtttcataaaaaaaacaatttgttgctagcgtttcgttggttatcagaaatttagaaacaatttaatgaaatttcgaatttaatttgttttaatttatccagattactcagcggtttcttgataggaaccggctaagataactgatggccacagtaaccaggtgatattttaactacttgatcattggatcgttattttgaggaatctaattatttactatgatagatggatgatactcattaattcggtatatggtgacttttatatccctcattgcactaacgagatggttgactaacctatatcggttcctgatttcctacaattaaacgaattgtaagaacaagtgatcaattaactaaggctatagctatagcctcgattattggtcagatctgcatcaacctaatgaattactttcaaagaaaactaatgtcatctctgtgtataataacagcctgatcactaagcatctaagccgccaaagtaaatagaaaaggcatgctgctaacattcgcatcccacgccatactcgcatcccgctaagctacgagctcatatatgatatatacaactagccaggcaactgcacgtacatgataaggattttctatacatggatgtcatgaaacccatcatttacgcgcgacttagatagttataggaaaaagtaacattaattgtgatgttataaatcgatacacaaacgtacaagattagattgatatacaactagagaaataacactactacacgaatgatttttcatggacgccgggcccttttgggcgggccatgagtggaaccgcacgggataatcgagcgaccggcatcgggcggacgcccacacgggaaaatcaattatcccgtgctggcatcttaatccaaccgcacgggataatcctcattatcccgtgcggtcaacttaagtggaccacatagaaaaatcgattttcgcgtgcgggctttttaagtggaccgcacaggaaaataaaatatcacttcctattttctctctcacccacttcaattttttttgacaccctctcttcctttttccctattatattcctctcctcccctcccctctctctcgtctctctctgcctctttcctctcctcccctcctctcctcaccgagtgcgcacgggacgggtgccaccgccgatggcgtgggaggcgacgcggagagcgatggagccgcggccgcgccccctcaacgacgatgacgactgaccttgacgatgatgacgatggtggcgagctcgcgccaacgatggcggcctcgggagacatatccatcgtcggtgggctcgggggaggcggatccattgccggtgggctcaggggtgcggcggaggctgccgacgacgatgacgacgacgaggcaacgcggcggccgttgccgccgacgacgacgaggaggcggtggccgggagcagcaccgccgctgcctccacttgaccactcttcccctcctcccaacgctcgcgcaaggcgtccgggagcggcgccgccctccccactcccggatccggtggcggcggctaccccacgccggatccagtggcggtgggagccggcgcggcagtggcggcagggtgccccgatctatggttaggatttcaattttttgaaattttatttttttttcagatttttatttttccgtgcgggtgacataagcacccgcacgagaaaatcacgattttcccagacagcccgctccaaacgggcgaatctaccgcacgcaaaaatcaaaacatccacacgcaaaaatatctattgtagtagtgtaaaaataatagaaactgatagtaaatagaacctgtataacgcagataaaatttattattttttcttcatgtgtagatcaaatttagacttcatatttatatagagtcttacatcgtcatagtttatcttatcaaattttatgaattttttatataactatttgaactacatgcatacacttaaatgttatggcacctgggtgtagaaaatacttgcccacgtagactagcatcatgtgcaaacacagtagcaacagttctttagctagcttgagaaaattcattgcaatggcaacctctggctacacaactgcctccctaggctcccatcggatggcctaataagaaaaaaaaccaaattttaaattttcaaacttaattttgagaatgactttgagatattttcaacgtagatttttttagcattggcttttaaatcacaaagaacacatatataaaagttttacctacaaattcaatttttattttctaataagccgttttggcttattagaaaaaaagcgaaacgatggcgcccctaaagtccctatggtggagctttagctcgtgcttgtcgcagggtgactgtgaggcagagagaagttggggaaagaaagagagtggtgctaacaggtggcactcatattttggtggtgtttgtatctcctgaagattaagataaagataaagtgtttcaggtaaaataaggtgataataacgtatgattaattgagttttaattattataaacttaaaaaaatagattaatctattattttagaacaactttcgcatagaaagttttcgcacgaaacacatcgtttaacagtttgaaaagcgtgccacgaatattcaaaactttatccactctttgtggtggaaacgagacctttattttattttactgacagatgggcagtgcagatgttttctataattcagcatgaaaccagcaggggcggatcgaaatagtgctaaactgaagttgctgtaaagttttcgtacgaaacacaccgtttaacagtaatatagacaaaataatgtagatgaacttgcataataattcaaatatccagtaattaaacatccagtgatcgcatagtgctaaactgaagttactatcctgaaaaaacacaaactatatactttatactagatacatatgagcaaaataaatagcaccacaagtatttttctttgcacaaacatgatattataaatgaatattaaaaagcttagaccaggtggccgtgcagtatccaaccggctatacagtaccaaagaacaacacttaacggctcagagccttagagccccaaaaatctctagaaataaaatacctaaaccaaagaaatcaatagaagttttaaacattatttaggtgacatgttatgtaaatgtaagtggaaaagaaattagtttgcaaactgaatgggaagttggagaaattcattgagacattgggatgtgcgtagttgattagacacaatacgtttggctgctcactgcccagcaggcaatagctagtcggctggatagtattagctaattttagctgaagcaatttaagcaaatgtgatgggttttcgtggctgcttccatggacgattaaatttgacaaattgaccctctcattaaacttattataagaatagactgtgtcaaaaactaattttaaaattgagtcgtgatctcagcgccatcgggattgacgctgaggtataacctctcagcgccaatgtttttggcgctaagatcactggtgcacaacccatctttaacaccggttcgcaacccctttagttccggttttacaaccaggacaccaaatccggaaataaagatggatatctttaattctgattaaaataatcgggactccatctttagtcccggttggtgttatcaaccgggactaaatttttagccagttctttttttttctgctcacatgatttgggcacaaatcatttataaaatcattcataaaatcatccttaaatcatttgagcaccacgaatcattcctccataaatcattcgagcaccacaaaacattcaaaaaatgcccaaagctgcattttctccatatcccattcacaaaattcccaaatacatcacaaatcattcacaagataacaaaaacatctacaaattctaaaccaaaattatccacaatttcatccacacatcgcacagatcggaaaattcatcacacatatcgggaaaggaatcgcatagatcgagaggagggcgccggccatcgccggccttgctggcctcgctggccgcccgtgggagcgggctcggcctcctcgccggccgcccacctgccgctccgccgcccgcccgtgggagcaagctcggccgcctcgctggccggccggccgccgctccgctgcccgcccgtgggaacgggcttgaagccctcgtcggcccgccgctcgcccgcta

SEQ ID NO: 50341 - DNA, 6217 bp, Oryza sativa
ctttcacagctatttacccagtagatatgtcagcgccaatgaagttgacgctgaagtctcctgacgtggcgattttgtgccaccttggacaatatcttaacaccaaaaaccttggcgctgagacgttatatctcagcgccaaacgccaaacccggtggcgctgaggtcgcggcttatttttggaatagtttttgacacggtctattcttataataagtttgttaaaagggtcaatttgtcaaatttttggtccaggacgtggtggtgtcaaaggataaatctcactggtgtcatccattaaagaacatcatagatacttgggttaaacaagaatccattggtgccaggtgacaccacacctaacacgaagaatattatttaaattatattgacaattgtcggtgaataggaacggggtacctatttatccagcaaaaggattattattaaataaacaacatgctcagaatgtctttgaaaataaaaataaaaccctagggtggcgtcgctaggggccctttccagagggcctcaggcccacgtaagatttcatatacagcgttcctcctggatgggggagaacgttgcgtatatggctcaaaactctaagtattgaagtagcttgcggcctggtttgggtcacaaataaaccgcaaacgtgccttaagaatatagcttagggtcagcctcgggcatggccatgttctgggcctcgggcttgccctaacccttgcagtttttatggtcctcggcaagaggggcatggcaacatgcaagtcctatatcttaagaagatgagctaagatctgcctcggatgcggtctaactctaggccctgggctcaccttagcccatacaggtcgcacgttgctcgaggaagaaaagcaacgaggcttgccaaacataaatgcgtgatcccatgtgtgctttgggcctggccttgcctcgggccctaggctcccccgagatcttgtatagctcacgtcccctgcttagaggggcgtgagaaggtacaagacgcacaatctcaaaatattcttccatcgacgacgtcttcaagaagctcatcaagaaataataaacattctttaagcgcggcagggcgcgacctcaaaaactctcaggaagtggggcatgctccccaccataaataaaacaggtttacagggggatccccggccagtctgaattgaaaggacgtggacaagacgttagcgttgagtcactttggatggtggcgcctgggacacgtgtcccgcatgactcgcgccacttgagttagccaaatgggcgttgtttcaggcaggtcgggcctcgtcgggcccaccatgcaccacatggtgagcgtattggtggaggcccaactgtctcgaatggagctcgggagcccggggctgtgaaccgtatagacttgaaaggttccttgatggttgcgttagaaatctggccggcagcgacaagacggctcataagacaagactaagagtagatttgtaataatgtgagcccctcctagactggaaggggattatatatggatgaagggttgctttctgttaggttagtacttccgctttgtagcctgaaaaaaaggcctctcttatactgagctgatctagagaagataacgaacatcaatacaggagtaaagtattacacctccgggtggcctgaatccgtataacctcatgcctccttctccttgcggggtggccgggcccacgaaaccaccgtgatcgcagatacctcgcaccgcacgcggactaaccccctggtcgaatctccactctcggggagggatctccactccccactgtctgagggaccgccccctcgacaacaataactgaaggatacttcgtacttggttttattattgagggaggaaaaatcggagcgtgccaatccatagttaagggaggtagtatatatataggcattttccttaggaatatgtgaattgacaatgtgcctatttttttttaagaaatcgtgcgttctacttatcgtagagagtcaaaatacatattgcacgagtgatatatttgtagcttcagagctacgacaaggctattgagaacagcatgatttgcggatggtcccgtcaaagaagtctaaattacatctagatccaacaaataagaaaataaggactccgaaagaaaataaaaaagcaatccagtccttgagctcgctgcttcttcttcttccagagttccagtgtgttcaactcgatgcatatggcaatggatacagtagcgaggctagctacaggagaagatgacaagccacaaacccgataggggcctcccaaagttggatgttaaagcaagcaaggcaagaaaaagaaaactcagctaaaccttagaacttaacttcgttgctgcagacaaaggccctattcatttctccaacaaatgttagataaatttttcgatactcgtggcatactttttaaacggctaaacggtgtgtttcgtgtgaaaactttatatatgaaacttgttctaaaatatcagattaatctatttttcaagttgtaataattaaaacttaattaatcacacgttattatcgtctcgttttgtatgaatcacttaatatttatctttatcttcatcttaagagatacaaacaccaccaaagaaacactagaggaatagcaggaacctcatcgaagaaagtttgattggccagtgcaacctcttcgaatcctactttcgcagcagatatgttgcttgcccttcaacaattgtaggtgtgagagcttaaccctacaaccgttggccagacaacgaagctagtgcaaacaccagctatttcgtcgatgagccatggttgccacgatgaggaagacagacacccgcatcttcaaactatgcaagagggagagggaaggaacaacaacaacaacaacggaacgagccgaactatgagataaacccaactgctcaccggccagactccccccaccccggccaccaacctgatagccaacggccaccagagacgtagatggaggggaaagggagtctcatgggaggaaaagctggtcgcgtttgggatcgcctctcaatctctcatgttagaataggtgtcgaatatactagtcctatatatgatcatagttggacttggagttgtaataggtggtaggggtggagataaagttggactctgtaacccggcaactctcttaaatagagagggggcaccacaatatagcgtagatacgcagggagatgatggcagcgtagccatggacttatagcggctaggagctatgttggttgaggagaagcgtccataatcagagccccggagatgtagccttcggctgaatttcgttaacaaatatagcatatctcgtatgatcaatgattgaatcgatcgagaaggttagtcgtcgttacgctatatcgactaacttttataacatctcatagccttaggatggatcgagagaggagcttagtttgtttttcttgtgtgacatatggtgacataggctgttacttcacagttatttttgttgggtggggacgtggggtggggttcatggagtggttgaacattagcaaacatcttccgaaaacgttcgagatcgaacatgtgattaaaaaaggtgattccggtcatactcaaatgccggccgccagttctaaagtaatgtcgtcgttctcatcagccattagcgcctagaataatccaaggtcaaccacccattcatttatcatgatgcatgcatgcttaatactgacactggatgcgtgtcaaattggagttccaatataatgggcactatgatttgctctaaatattggtcattacagactaataatccaaagactcgacacattttcaccatggctggatttccagtctacctgctcttcctcgctgccctgatcatccttcccatggccaacctcatccgttctgcacgccaccggcgtcttgccggcgcacggcggccgccgccggggccgtgggcgctcccggtgatcggccacctccaccacctcctcgccggaaagctcccgcaccaccacaagctgcgtgacctcgccgcgcgccacggcccgctcatgctgctccgcttcggcgagctccccgtcgtggtggcctcgtcggcggacgcggcgcgcgagatcgcgaaggcgcacgacctcgccttcgcgacgcgccccgtcacccggacggcgcggctgaccctgccggagggaggcgagggcgtcatcttcgcgccctacggcgacgggtggaggcagctccggaagatctgcaccctcgagctcctcagcgcccgccgcgtgctgtccttccgagccgtccgcgagcaggaggtccggtgcctcctcctcgccgtggcgtcgccgtcgccggaagggacgacggcgacggcgagtgtcgtcaacctgagcaggatgatatcgtcgtgcgtcgccgactcgtcggtgcgcgccatcatcggaagcggccggttcaaggacagggagacgttcctccggctgatggagcgagggatcaagctgttctcctgcccgagcttgccggacctcttcccgtcgtcgcggctggccatgctcgtcagccgagttcctggccgcatgaggcggcagaggaaggagatgatggagttcatggagaccatcatcgaggagcatcaggcggcgcgccaggcctccatggagctcgagaaagaggacctggtagacgtactcctaagagttcagagagatggtagccttcagttttccctcaccacggacaacatcaaagctgccattgctgtgagttacaatctaaaacttacatggatgcttttattttttttccgggttttctaattaacattcaatactccatccgttttatattacaagactttttagcattgcccacattcatatagatgttatatgtatagattcattaacatcaatctatataaatgtggacaatgctagaagtcttataatatgaaatggaggaagtagtaaataggaggagaaatattacatattttgataaatccgattcactagaagattcatgcgccacgcctcctctaattttactgactccagcaactccaacggtgaaaattggtggtggcctgacctgttagggttcgggtatgtggtcgaggtaggggagaggggagagtggagataggggcattccccaccttagatggatgctgggggaaggggggagggagggcagcgatagcgaggcggtggcggcatcaccaaagccgtggggtcgacaatgggcaatgagcagggtaggcgacagggcaaattaaggctgtgtttagttcacactgaagtttggaagtttggttgaaattgtaacgatgtgactgaaaaattgtatatgtataaaaggtttgatgtgatggaaagttggaagtttagaaaaaaaaactttagaattaaacagggcctaaaaaaatagctggatcataagatggtgagcgaccatagcttatccgcctgcgataaccactggagatagggagaaggcagagcagggcaagggagacgacaaagatgttaggtggttgtcggtgacatgggaccgggagtatcatgacttagagacttgaggcagacacgatcacccacgtggcaccgggagtatcatgacttagagacttgaggcagacacgatcacccacgtggcctaaccccctcggggggggggggggtcgggcccgagggtgatacggccgcccttctctttgtctccccgaggggtcggaccgctcccgtctcggccccgagggccgaggcgccccgaccccttgtgggttttgcgccgtgtatatggggtaggtgagcatagcggggctcacctaaccacatttattgcggtttggacgagcgcgtcacgccgcatgtaacgcagtgcagcgcgctcgtttatccggtctgtgaccagtcacagacatatcagatcgtgggttaggtggcgataggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctga

SEQ ID NO: 50342 - DNA, 14737 bp, Oryza sativa
atacatagatccacaaaaacacaggagtagggtattacgcttctcagcggcccgaacctgtatatatcgcccgtgtcttgtgtgtttccattctcgcgaaccttccacacacagactaggagcttagaatctcacccagggcccccggccgaaccggcaaaggggggcctgcgcggtctcccggtgaggagccccacgctccgtcatctggcgcgccaggtagggggctttgcgtgtgtttttctaagctctcgcattctttcgtgtgcgccaagcttttcctgttcagcccaatggccgaacaagcaaaggcgcacaacctctctccgagtgttagcggtgacgacggggagccgaacccacgccgtcgagctcgtactccaccgccccctccacgccaaagtcctaggcgggaggagacgctcgagagggtcgaaggatccgcgacttcgacatccacgggtgatggggaagggcggcgagatggggagcgtcgcctcctcgtctacggcgacggcagcacgccccagggcgcgctccaagctacgggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggcttcgtgtcgtcaaggcggagggcgcggcgagcggcggctgttgctcgccattcagccgccactccttcgtcagcgcctccgacccaggaagaactgcgtggggggccggatgcccgcatcagtatcgagcgccggcgtaatggccggcgtgctgcccacgcaacggagggcgcctcctcgtccggagtgtcacatcaacacggacgcggggatcagccctccgtgcccccggttggtggtgtcggctgtagagcctttgtggcaagccttcgaaacgtccgttggcccccaggttccggcccaccatcgccgaaaaatatgataggagtgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaaccgcatgcttgaaaagatcgcctccaaagagccccagactaccgcggagctttttcagctcgcggaccgagtggctcgtaaggaagaggcatggacctggaacccctccggttccggtgtggcagcttcggccgcccccggatccgctgctcggacagggcggcgtgacaggaggaggaagaagaggtcagcccattccgacgacgagggtcatgtcctcgccgtcgagggcgcttcgcgggccacccgaaaggggaggcctgcgagcaacaaaaagaaggaggccggcgctcccagtagggagcgcccaaccggcaagtggttcatcgtccacaacacctcccttcacgacctcgcggactgccgcgcagtcaaaagtttggctgagcggacgaggaagtgggaggaggagaggaggcaggagcgccgagagggcaagtcctcggcggttccttccggcaatcggcgaagtgaggccaagcagaaggcccccgccgaggacatcgatgacggcgatgatgacctaggtttccaagagcctggggccaccatttccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccagggaggacagatcgcaatggtggtttcccccactgtttgcaacgtgaagctggggcgtgtcctcattgatgggggagcagccctcaacatcctttcccccgcagcctttgacgctatcaaggccccgggaatggtgctccggccgttccagccgattatcggtgtgacgccgggtcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccatctctgtccatggcgacctcaaagtcgcgcttgcttgtatggagcagcgcgcggaccacctcaccgccgcgtccaagcccgagggaggcgatgagaggcttggcacctccgcccccgccgccccgaggcagcggatagtcacatgcgacgaggtcccggtcaaggaggttgccctgggcgacggcccgtccaagaccacacggatcggtggtcttctggacggcaaataggaagacgcgctcgtctctttcttgcgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcagggtgcgatcttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgttactctacttagcggcgaccccgcaagtggttagtgcggcgttggttgtggagcgcgatgaggacaatcctcattccgcgcacccccaccctgtgctggcttggcccgggagagagcagggaggagaggcccccgagccgaacggtggcccaaggcccccgacgaccggagcaggcactctgcccgcttgtcagacggtgccaggtgcccccgacccccagtatggcccgagggccactgcgggaaggccgcacctatcgccctctgaccccgaggctaactctgtgacgactcgacccgggagagagcagggagaagaggcccccgagccgaacggtggcctaaggcccctgacgaccggagttggccctttgcccgcttgtccaacgacgccaggagcccccgacccccaggacggccccgaggccactgtgggaaggccgcccctgtcgtctccgaccccgaggtcgtcggcacagaagacgagtgcaccccgcgaggccgcttggacaaagagcaccccagggatgtggcccctagcgaagaggatcggccccaccgaaaggtgcagcggcccgtctactttgttagtgaggccctccgggacgccaagacccgataccctcaggcccagaagatgctttacgctattctgatggcttcgaggaaactgtgccattatttccaggcgcatcgggtcacggtgattacgtcttaccccctcggccaaatcttgcataatcgagagggtactggacgggtggtgaaatgggcaatcgaactttctgagtttgatttgcactttgaaccacgccacgctatcaagagccaggccctcgtcgattttgtggcagagtggaccccagctcccgagcccgtctcagtccccgaggccagctcgggcccctcacagctgcctcacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctagtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacaggataacacggttgccgacgaactctcacggctcgcttcctcgcgagcccagaccccaccgggcgcctttgaagaaaggcttgcccagccgtcggcgtgacccaaccccttaggggagacggacgcgcctgacaggccctcgatgcccgtcggagtccaggcctcgggacccgaggggagcgctcccagctcccttagattgattgcttggatcgctgagatccaagcatacctcacagataagactctacccgaggaccgcgaagggagtgaacgcgtccaacgcatctccaaatgctacgtgctggtagaagggaccctctatcggcgcgcggctaacggaattctcctgaagtgcattcctcgggaacaaggcgtcgaacttcttgccgatatccatgaaggcgaatgcggatcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgactactgcgaagacatgggcatcaagctctgctttgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctgggcgaaccgaaccacgccaagccgagcaaccggggaaacgcctttcttcctcgtctacggcgcggaagcggttctcccatccgagctcaccctgagctcccctcgggccaccatgtactgcgaggctgatgaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctctgttcggctggccacgggcgacggcacagagttgcctaacccgtggaacatcgaacaccttcgtcgcttctacccctaaagggggatcgggtgtcaggtttcgggctcgggccaaccccgcacccccctcgggcgtgcagggttggccgggagctaccacatatgcatattcttatttctcttatatctgtatttcaataaaagtattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcatcacgctcccggcctggccagtctcgacatgtggatctccccaggcactagccccgacccgagccatttgaggactaggacctgggcacgagcccttgttcaagccaagacacaaaaggaccgcggcacagaccatcctcgtctcatacacacaacaaatagaattgacacaaaaaattttcctctttatttgattgcagattaaattagtctatacaagaagggggcccgaaggcctcggaagaagaaaagaagaaactatttaaagattggcgggggcctgggggctcactccgatgcacccgggtcgccagcctcgtcgccattgtcgcccactccgccgtcatcgtcctcctcgtcggagttgagggcgaacgcgagccgaggggccgaaccctcgaagttgtggacgatatggtcggcggcgtcccggacctgcgcgcgcgcgccgtcctcggtccagggagggaactcgtccagcgccgtccatggggagaagtcgggatccctggcttggtaactcgccagtacgagctccaccgctcctcgggcgaggtccctcgaggatgacttaatcgtcctctcgagctcctcgggaagccgttggagagtcccggctatctccgagaggcgctgggcgaggcccccctggttggcggcgtacttcgcagtccgcccgccccagagcccgcctgccggccggcgcggtctagacgggagacggcgtcccgaagcatgccgggccctacctcgcctgccaagcggagggcctcgacctccccggcggacgagtctagcgcgccctgcagatcggcgatggtgtgttcagtagctgcgaggcgggcggttaagtcgctttcacccgcggccgccccgccactgcgcgccctcgcgtccatctccctctcccgcgcctcgagctcagcggcccgctgattcagcgcggccctctcggcgcgggcaccttctagattacggcgcgcctgctcctcccgcactgcctcgcggagggataggctgtccgccagccgttgcgccgcggcctcggcctccttgagagctcgctcccgctcggtgagcgcgtcctcgcggaggcggagcgcggactcctcttcggcgcaggcggcctcgtgcgcagtcagcgttgcctcccggatggcaacggcagcctcgcgatccgctaggtccctctccacggcacaggcacgctcttccagcgccatggcacgggcctcaagggcttcttcgcgccgccgggatgccacctcggtctccgccgcccgccgttctcgggcagcggcagcgtcaaggaccccctgggcggcgtcgagcttcttccctagctccacctcccagctcccgtattgaaggcggagggtgtcctgcgcctcgttcatcacggtggtggcgatgagggcagccccccgctcctcctccacctccttggcgatctcccccagcaccttccgacgggcttcgagctctgagacgtgccggcggtgtgccttgcggcccacctccaccatggcctccaccgagcgtcgcccctcttcgacacgtgcccatgcggcgtcgagctccgcccgctctgcttgcagggcctccacctgggcatttaacccgtccaacaccgtggtgtttgcgacggccaaggcctgcagaaggggttctgcgctcagtggagcaacggaaggtgtggggaagagccgcctcgaagaggatgccgcgcggcttggcccgccgatggacgtgccggactcggggatgttccccggacctggtttgtcctgagcgtcgcacgagggagtgggcccaagcgatgcacccgcggcctcgccgcgagttgcctcggaagtcgttgtcgcctcggcctggcgaagtctagcctcctcccgagcggcttcttcagcttggcgagctcggacggccacctgggcagcttcctcggcttctcgaaggcgatccacggcctcttgccggtcagtttcacgggtcgcctcggaggatgtcgtcgcctcggcctggcagagtccggcctcctcccgagcggcttcctcggtctggcgagcccgggcggcctcccgagcggcctcctcggcttcccgaaggcgatccgcggcttctcgccggtcagatttccgcctccgggcctctgtggtcgccgggtcctcggcctcagactggccggacttggaatggcgggagggacgcgacgggatctcgctgaagcagaagaaaagccagaagacaaacaagatgggtgaatgaaaacttgtgttggaagaatgaatacagccacaatgggcgtgggacgaacctgcgagggggtcggttaaacgaccaccttggaggggaaatgaggtttccccgggatggttctgtcccccccatcttgcggagccgtttcttcttccgctccctctcgagctgcggcgtcggcgcggccccctccgggcgcctgctgctgacacgcgccgccccgccccctcggggaggagatggggaggaagtaccctcttgctttctcttccctcgggcgtcggcagggcggctgccccccgagcccccatcacggggcccagaagcacgaccccctcccggggtagattgttcccccctgcggctcccgcccgagccatcgtggcctcgaggagcccgctcctccgacgccccgaccgcctgcatgatggtcaggatgttggcgcgatatggatcgctgcagagggggaggactccttgggggatgagggatgcctccgcggagctgagattcagcatccgttggatcattaccttgaagtcttcggggacccagtcccatttgaccccccggtgggtcctcatacagtcctcggacccggtgtactcccaggcaccccgggcgcgccgctggagtggcgcgatccggcgacgaaggtagtcgccatacaccatggcccctgtgagccccagggatcgcaggcccgccaggcggtcgaggacggcgtcatagccatctcccagatctaccggcgcccgccagctggaggcctgcgccgggggctggctcggaagtcggaggcgcgcttcgtcggcgaggggggtgtagaaccagtcgctcttccagtcatcccacttcttgcggaggacgcagggaatatagcggttcaacaccggcccccgcggctggaagtagcagccaccaaccaccgacggcggcgacaccgactgtacggtgaagaaccaccgaaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccattgcaaaagggaggaagaagacggaccgccccgggtagcatggcaccgggcgtccctcgcccagcgtaactatctcccggccggtggcagattccggcatgaagcggcgcggcagcccggcctgcctctcgctcacgatgcgggaaggcggcagcacgctaccatcaagcaaagcggagccccgtgccatgacgccggaggaagagatgtttaagagcgagcgcgtgtggcgaaggtagggcacaggaaacaaggagttagggcgcaagcggcgaagacaagggaaataatggcgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccaaagcgccatcaccatatctccaggaaaaacgaaccggcttgtcccgatttttagaccggccccaccatgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatatataccaggcttcatcctaaccattacaagcaagacattgtatgaagaggggcgaacatgcagattgataaactgacgcgtggtggacaagaatgaccgatttgtgaccggtctgacactgatcatgtcgtcaacagacagccatgttcccacgtcgcgcctgcttccggcggaagtggaggtaggtatgggctgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaagggggatggattttcggatccagaacgatcagagagggagagagtaagggctctctggttctccagctcttttgtagcttcttcatacatagatccacaaaaacacaggagtagggtatttacgcttttcaccggcccgaacctgtatacatcgcccgtgtcttgtgtgtttccattctcgcgaaccttccacacacagactaggagcttagaatctcacccagggcccccggccgaaccggcaaaggggggcctgcgcggtctcccggtgaggagccccacgctccgtcagtggtggtggacaaagaagccgatggaggatggtagtatagagggttcgtcggcgagcctcgctggtgttggaggtgacgttagcgatgtgaataggcagcagtgagagggttgggggggaggatggcagcgccggcaactaggccattaagggcaatatatatatatgagaccatggatgtaatctaggtttttaggttgtgatccaatggtttaatatttgcaatatttgtctgcaaatttttctgtcaaattatatacttttttgcaagattcatttttctttagaaaattcagttgaatatttgtttttcttccgattcatgtaggatctgtttataggtggcagcgagacggcggcgacgacgctgcaatgggcaatgtcagagctgttgaacaatccaaaggtgatgcagaaggcacaagacgagatacgacaagtgctttatggacaagaaagaataaccgaggagaccataagtagtctgcattacttacacttagtcatcaaggagacgcttcggctacaccctccaacgccactacttctaccaagggaatgtcgtgaaccatgccaaatattaggattcgacgtgtctaaaggggctatggtactcatcaatgcatggtctattggtagggacccaagcaactggcatgcacccgaaaaattcatgccagagaggttcgagcaaaacaacattgactttaaggaaacaagctttgagtacataccttttggagcaggacgaagaatctgcccaggcatgacgtttaggctagcaaacatcgagcttttactcgcaagccttctgtatcactttgactgggagcttccatatgggatgcaggcaggcgacctcgatatgactgaaactctggcggttaccgcacggcgaaaagccgacctgttggtagttccagttgtgcgtgtccccatcgtgggttaattagccatccacatttcagttgaccgttattcatatcgatcagtgtctcgctgtcctttgtccaaatgtcaaattaatcagccccaataatgatcatatatatgttttgtttgacttttagtttgttcgagcagcagtaagtagataggctaagctttgaacaaacattcaatgtcgttcatgaaatgtatctgcgagtgatctccaatggtatcttgacagtgatgttttccaacctgttcagacaatatttttcaacatgttcagacaatttttgtccctgcttagaaacttatcaagatcagaattcagattattagaaccaacttacaacaatgaacaaactgcaaatgatctgaagtccaaaaaaacaactatgcctatgctgaattagcaacgactgaatgagaacatgcaaagcgagagctcatctgctcaccttcctggatactcacacgtcgtatgcatccattctcctcccgtttcatccccccctcaaaaacttcttgtcaacatttggcagagcagcggtgatttcaccgtgccatgttttggaatttcgacatcctgtctcagtgtctccacacaaaatgtttttatttttgtttttgttttgttttgcagaggccaaatgagtatcagctccacaacctcagggcagtaggacactctgtttggctgggctataacttttcagataaacagataattagttaagataatatagatgcttagatttgatttggtcaccacatgactaacactagtacatgccgataaaaatgctgctttgcaatatgagaacgataagtatcttgatatgaaattaaatactcctactaaaataacaagtaatatgaagaataaaaaagaaaagtattttttatgataacgaaaagaaatccggtctctatgttcacacacggccctttcagtgtagtatgctaaaaccttgtcacggcccagaattaacgtcgtctgaatgtcaacatgaaagaactcatttgctcatgggcttcaccttcctgcacactcacgggtcagatatatccattctcctcccatttctttccaccctcgaaaattttgtcaacatttggcacagctgcagtgatttcactgtgccatgttctggaatgttggcatcctatctcactgttgtgtctggctgcttggctggccaatgaattgtcagatataatagactagtattagacaaaataatatagatagttagatttaatccattatctaaaagagcttagatttgatcaggtcatcacatggctaccactagtagatgtcagtatcactttggacatttggacaaacactttcttatcggcacagcttctgagctccttcagttcaatccacccattcgatagtccaaaggagcaaaagccatagccatggcggcggcggcgtcgtctgttctggcctacctgctcgtcgttgctctccttgccatcgtgcctctcgtctacttcggctgggtggcgcgccggcgcggcgagggcgggcggctgccgccgtcgccgtgggggctgccggtgatcgggcacctgcaccacctggcgggcgcgctcccgcaccacgccatgcgcgacctggcgcggcgccacggcccgctcatgctgctccgcctcggcgagctccccgtcgtggtggcgtcctccgcggaggcggcgcgcgaggtgatgaggacgcgcgacatcgagttcgccacgcgacccatgagccggatgacgcggctcgtcttccccgcgggcaccgaggggatcatcttcgcgccctacggcgacgagtggcgggagctccgcaaggtctgcaccgtcgagctgctcagcgcgcgacgcgtccagtccttccg

SEQ ID NO: 50343 - DNA, 2838 bp, Oryza sativa
ttttacttcctattatttgtacaggacatgtttgcgggaggcagcgagactgcggggacggcgttgcaatggatcatggccgagctcataagaaacccaagagtgatgcacaaggtacaagatgaggtacgacaaacacttgccggtcgtgacagagtaactgaagatgcaataagcaacttgaactacatgcaccttgtcatcaaggaggcgttgcggctgcatcctcctgtgcctctactactgccacgggagtgtagaaacacctgccaagtcttaggattcgatgtgcccaaaggagcaatggtgcttgtgaacgcgtgggcgattagcagggaccctcagtattgggatgaacccgaggaatttatccctgagaggtttgaggatagcaacattgatttcaaggggacaaactttgagtacacaccattcggggcaggacgaagaatgtgccctggcatcgcatttggtctggcaaatgtagagcttatgctcgcaagcctcctataccatttcaactggcaattgccagatgggatggatactgcggatctagacatgacggaggagatggtggttagtgcccgacggctccatgaccttttacttgttcctgtggtccatgttccattgccagtagcctcatcatagtggtgtatacaactactagttgggatagctcctgtacttgtatggctcgatttaattaaaagtttaaagtccaacggcgaacttctttgaaaaaaagatttgaagtcgaaaaatagagttattttgtgtgtgtgagagagaggggggatctagtaatatgaaagagaaggctcaacacatgggataggccaacataccagtacaagaaagtaagaaagtatgggtatagcaaccaatgaatataaaacattaaaaatacttggactgccttaattgaaaaggtcaaacaaccaaagtttcatacaaggacatccacacattgtccttaattagcaacttgaggggatacctccctgaaaaagaaagatgattttagcagcttattatggggttgtggtattaaaaaatttgaacaattattggtatcttgtgccactctgagacaagataaatgttggtcatcagttcatcaccacatgcaactgttcacaaataaacgaaggcccatacaaggtatattattgagatagtgttagcaagtctttatataaccgaacactttagactcatcatcggaccggacagaaaattaggggcctgaagtgttcggttatactgcgccagaccaacttttacttgttcctgtggtccatgtcccaacacttagcattatttttcccaaccttgcctcctatttgcacgaatctcaaagcaaatccaacgatccaaaatttgaatgttttgccctcaagaaaacttccaacagatgaataacgatctattcgtgtataatacgactagttggatagctcgtgtatctgtatggttcggtttatttaaaagtttaaagtctagcagtaaacttctttgaaaaggagattaaaataaaaaataaacttgtctttttctaaaagaaaaggaaaatctaggaatatgaagagaatagagataaggaagagaatagagataggacattgagcatcaccaagagtttccatatcattccctatgagagaatttgagaatccttttttttcaaaaaccaattccaatagactccctacctgcactcccaaccgatcaaactcccaaatccggatgattcgttttccacttcttatagggaagagattttgctcccaatccaccacacaccgcttttctgtgagtgcttggtgaaatattcccgtgcggctcatcttcggtaacatcggcgtggcggcgcacggccaccgcggcgagtcgggagccaagctcttggacgtgcaagcagagggtttttctcgtgaaggagatcgtcacactgctcccagtcgagaggggcatcgccacgacaaggttcatgcgtgcttggacttcgccgcaccgacatgatcctgcacgctggtgtggcgtggcgtggcgcgtgctgagacgacgcttgaggacctcctgatccccaacatcgatcggcaactttgtggagatgctcaacaacgtggactgcatacatggagcagatgctggagcagttcatcgatcgacgccgaacatgttggtgactgttcgccgcctcgccggacgccggagataaacgtcgacgaagcccagctggtcgacgcatgcatcaagcgagctcatgcagttagaacagtggccaagctcatcgacggatacctctcaacctctaggttctaaaccatctttggtcggtctggcaaaatcaacaatagtcccggttccaaaaagaaacagaacaaaaggttgcttttagtcctggttataaaaattttgatctttagtcccggttggtaacaccaaccgggagtaaagatggttcatagcctgtcagaggcatatcagggggtcgaggatctttaggccttgtttgtttcagcttaagattactgtaatctatattattgagacaaattactataagctgaattataataagccgacatagaataagttgttagctttttgtttctctggatcattagctggttgttaggtgttagcaacccaataatctaaaaaaagcacaattagagtggattactagattatagtaatttggcttatagattgtaataatctatcataataagctatatgtttatttcaatttactcctaataatccagattataataatcctaagctgaaacaaacagggccttagtcccggttggtgtcaccaac

SEQ ID NO: 50344 - DNA, 3210 bp, Oryza sativa
caaatttgtgattcattgcatggatctgagatgtataatcgatctgtgatgcatttggtttgtgtgtaatttgtttaagatttgtgatggtttgtaagatttaggatttgtatttgtgatgtgaatgatttggtatattacattgatttggggatttgggtatatgcatggcactcagatttggggatttggtttttgatttgtgtatatatatccaactcgatttgggagaaaataaaaagaaaacggaccaaccgggactacctctatcgtctctttagtctccaaccaggactaaacaccaaccgggactaaagatcgatctttactcccgttatttcacccgggactaaagatagcgatttttagtcctggatttacaaggggttataaaccaggagtaaagatgatttctccaccagtgcaggtttcagagcatcgccgagctcatcccagactaagccaaggccaccgacgatggcatctaccacagcaccattgacatctaacacccaccttaaatttctgttgatacactcttagataatttttgttgatagttttctagggggcaccttttagttttagaaagccaattttaaccaatcttttggagggatgaaaattttaagaccctaaattctagttaggattcccataactcttggttatacagtattaccaatgcaagaaagaatggtaacaaaggagtaaaaaacacattaattgaaggtcaaacaaccaaagtttcatacaaggacattcacacatggtccttaccaacttgaggggatataccttcatgaaaaggaaaggtggctttagcagtttcttgagttttgataataaaaacctttaacaattattgggttcttctaacactcttgcacagtatacacgatggtcatcatcagttcatgattcatcaccacatgcaattattgctcatcaccggactgaaaaacgaaaaagtctattttgaccctctcaactattttcggaatcttatgtgtatcgttcaaccacaacattgggtatatcagaccccaagtattaaaaccaatacaaaatgactcccttggttattttcagggtggttttgtctggcgtgacgcactaaccttggttagactggctggttttagggctagtacttgaggaaaaaagagagagtaaaaatataacgggatccacatgtcagtgaagtacccctcctttcttcctcttatttagctgccctcttcctccttggcaagcggcaagcggcaagttgaacttcaggtagagagaggaaaggctagggagagagagaaaacgcgcgcaggtgggggatgctttggggcttgagaaagccgtggctgctcgtcatcgtcgtggtggatgactgcggaaaagaagcagcaacaatagctcgcaatcttttgcccctactgccagctccccttctaggatctagagactgttgtgcctccatttaggctccgcccaaagcgctgataactaacgggcgtggtggggtgcagcatgacgacatgggagatcttcatgttggtggagtcgtcgatgacgacaaaactgtacagaggggacactgaggtgagcaagacaggctacgcatctgctatagaggatgctggcatgaccgatggacacctcatccgtcgccaccgcggaagagatgatagagggaagaaagaagatgagatgcgggatttacatgtgggtttcattgctttttttgctttcatgatacccacgtaggataaagactagttcaacgtgccacttaagcaccacgtgacatgatcgatgtccaaactgcttggggagacaaattaaactggtattaatagtggagagatgcaatttacctgtttacagttgagggatacaaaacagattcagcttatagttgatggaatcaaaatggacttctcctaagaaactatgagtcgaaaggcccatactaagccttgtaataaatgacgcaaaatgagcccataaatggcccaccaggggcccacctatttccaacgtgtgcaaacgaatccaagccccataaatggcctacacgacacaaggccgtaaactgcgaacgcgattactcgacaggataaagcagagcaacgggagccatggttctgcaccaaccgaactaaaagagccgttcgttgctccacttatgatttcgcagattagtgatgaactgatgatattctaatttttggtttaggcgtgctttagccacagaaattagaaggcatggataaatgctaccggagtatatactccatttatctcgaaatacatcttatatcaatatttgtggtgatagctaggttgtgtctaatccagtagtaaggtactacatccgttttgctgctgacttttgggcacacgtttgaccattagttttatttaaaaattttatgtaattacaatttattttgttgtgttgttttatcactaataatagtttaagtatgatttatatcttatgcatttacataatttttttaataagacgaatggtcaaacatgtgttcaaaagttaatagcgtcatcaattaaaaaatggagggagtactatattttgggatgaagggtatgttactttagaatgatgtctaattcgcatatctgaattctttctttttaagatattgatttcttaattgttatatgacattgtacattgaagctttattaataaggttttgcctcatggagtggtttattattcgttgagctgatgaaatagtaaacgtcttctccaaaacaaatgacaatactgaaacttacgtacttgatggccacgtcattcatgtcgaactcgaacttatagataatcatcagtcatcagatctgcgcaaatttactccaaggtcaatatcacatttgtagttcaataggcctaatgtcaacttgaagttaccaataggcgtgtcaactaaaaaaaaagatgggctctagaaacacaaatagattaaagtagaacacagaaggttctcaacatcactaaacgcaagggtaaaagcatcatcggtttcttttcttactcagaaactgataaaaaccagagttcagtggagggaaaattaattctgatttggagaaaattaactgcaaagatctgaggtccaaaaacaccctagttaatattcggagtaaaacctgaaaacattgggagtcagcatgggctgcaggaat

SEQ ID NO: 50345 - DNA, 12621 bp, Oryza sativa
  unsure (1)..(12621): unsure at all n locations
attcctgcagcccccagcagacaggctgcagctccttcagtttaagccatggcggcgtttctggtctacgtgctcgtccttgtccctctagccgtcgtgcctttcgtctacttcaaccgcgtcgcgcgccggcgcggcggcgacgtccggctgcctccgtcgccgtgggggttgccggtgatcggccacctccaccacctggtgggcgcgctcccgcacgtcgccatgcgcgacctggcgcggcgccacggcccgctcatgctgctccggctcggcgagctccccgtcgtcgtcgcgtcctccgcggaggcggcgcgcgaagtgatgaagacgcgcgacctcgacttcgccacgcggcccatgagccggatggcgcggctcgtcttcccggagggcggcgagggcatcatcttcgcgccgtacggcgaccggtggagggagctccgcaagatctgcaccgtcgagctgctcagcgggcggcgcgtccagtccttccgaccagtccgcgaggaggaggccggccgcctactccgggcggtggcggcggcgtcgccggggcaggccgtcaacctgagcgagctgctgtcggcgcacgccgccgactcgtcggtgcgcgccatcatgggcgatcggttcagggaccgcgacgcgttcttggcgatgctggagcgcggcctcaagctgttcgccaagcctgcactgccggatctctacccgtcgtcgcgcctcgccatgctcctcagtcgaatgccgcgtcggatgaagcagcatcaccgggacatggtcgcgttcctggacgccatcatccaggagcaccaagagaacagatcagccgccgccgacgacgacaacgacttgctcgacgtgctcttgaggatccagagggaaggcgacctgcagtttcccctgtccagtgaaagcatcaaggcaacaattggagtaaggaccttttaactacgaaataccacgtcactttctaggaaatgtaatactacttgcctcaatatatagcaatctagaaccgaatatgatacatcctaatgttataaatctgaataggcctatggtttgaaacggaggtagtaacgctaatgaatttggcttcgtgttatgtgtgtacaggacatgttggttgggggcagcgagaccgcagcaacgacgctgcattggatcatggcggagctcgtgaggaatccgaaagtgatgcagaaggcacaagatgaagtacgacgagagctcatcgggcatcgtaaagtgacagaagataccctatgtagactgaattacatgcatatggtcatcaaggaggcactccggctacacccaccgggatcattgctgctaccacgggaatgccgacgcacgtgccaagtcctaggatacgatatacccaagggagcaacggtgtttgttaacgtatcggctattggtagggatcccaagtactgggacgaagctgaagagtttattccagagaggtttgagcatagtgatgttgactttaaaggcacacattttgagtacacaccatttggagcaggtcggaggatgtgccctggcatggcgtttggtctagccaatgtggagctcacattagcgagcctcctgtaccatttcaactgggaactgccgagcgggatacacgctgagaacctagacatgacagaggagatgcgattcaccacgcggcggctccatgaccttgtccttattcctgtagtccacgtacccttgcctacaatataagctcatcatagcacactgatttttgtacaacacttaagcaatctttttgactggcaactcaaaggtgcaaccacctatggtgaagcttgaggctatatgtgaaaaataaattttcataagcggcttcttataagatttccacctacactaatcgtactttgatatgcaccttatcatgaaatgtatttggaagctttgcttgtttgatgtgattgttatgttaaactttttcttgtaatttctttgtggaaattttgtgacacatttggaattcctaagagctctcatgtttttcctatgatatacatatatctcaatgtctcatgtgtaatttcttatgcaaacctaatctaatgagaagatacaaccttcaagactatctcttttgtgaaacccatttagggctatcaacgaatcgagctcaaacgagcttgattacctaggctcaagcttgacaaatgctcaagtcaagcctacgtagttcatgcatctttgtacaagtgtgccggaaagatcaaaccaatagaactgctcatatcacagtagtcatagtatctattgaagacctcaaataggaaggcctataaattcccccatgcagcccaattccttggggagagcccacatatgcctgatgcatctggaaaagctcttgagcacgttggcgtgtgagcccagctagctgcacgaacaggctcctttctatttttggctatctttcggatttagctcgttcccttctttgcccacccccgacttctgtcaattgtttaaagagcatagcccatgaatgaaccatatgagcaccggctctatgaagttcgaatcaaatctttgggttcccgtgaataagaattgttgggtgcacaaagcaagtgcttctagctgtttcacttgcttctttcttatcgtggccccaggtttgccacaattgtagcaacctcctttctttttcttctaaggttatttctgagtaatctattcaactaggagcctgcgctataaaatagagataaaaggattaccatatgctcattcatcaaaaactatagagacatgaaaagaaaaatgatatttttatcaaatcaacagaaggaaagatcctttaccaggtttgaattccaccgtcctactggcttgcttctctcgtctatcctcccatcgattcttcctcatgttgtgtcatgcaccacctctaccaatctatggatgcttctcaaaagctcttactcctctcaatcgaggaactaaattagaagaaccagagaagagaagtaaaaagcatgcaagtgactacaagctaggtctactattgatacgccttgaggaaggaagtggtgagacccaatgacagatcaaagtcgaagtaagtgaaaagaaaagggaccctctgctgaccggaggaagcattttggaaaataaaaactcgatctatacctctataggtagcagagcagagggaatgtcgccctcgttcccgaggaataattctcttaatgaactacttccgaatatagaagtgaataccaattctactagttgttaggaagagctagggttgttttgctagagctcacgtgtacgggggtacgcatggagaaaaaggtctagaaggacaattttcaacacaaacccataatcttttacaaatttgagccccccccccccacctaatgtaaaataagcatggaagaatatctttggtgacaattcttcgagggaagaacaacttgtcgaaagatctcaatacctagaggaaaggatggtacaattagccaagagagtgaaattttccgtaaccatcctgaaatcggttgaccattctggttctaatttgaaatcgtagtgagaatatctagcatacatctgcataagacaaccagtcaatccggagtttagtaaaacacgttgtctcatggcctattagtagaataatatatatgctaaagataatcccctactaagaaaattagattatagttaaccacattaatgaaagagaagaaaaagaaaacgtttagagtaactcgagacgatgccacgttgctacatgtagtttttttaacctatcgctatatattggcacttccgtgtgatgtggcaagattcatccatttaatgacatgttcatttgctaccgctcataagctcaatacacgattaatgacttgttcggtttggagcaaattccctcccttttgggatttaaccaaacaggatctaatggttccactacaatatataatagcaactactccctttatttttcaatagatgacactgttaacttttaaacacataacaattcatcttatttaaaatttttatgcaaatatataatatataaatcatgcttaaaatactgtgtgataaaacaactcacaaaataaattatatttacataattttctttaataatacgaaccatcaaacatttaaaaaaaatcaatggtttcatttactttaaaaaaacggaggtaatatattatagagagagtactaacgaaagcaagttggttggacgtatgtccgctagacgcctggcacagacacaaggaggcatgggcggagatggagatcggccttccgccgtgcagtgatgccgaacgcttctgtcatgtcgagcttggccgggtcggccaagccgggcacctcccaatcaaagtggaaaagcaagctggcgagagggagctccacgttggcgagcccgaacgccatccctgggcacattcgccgcccagcaccaaacggcaggaactcgaagtcggttcccctgaagtccaccgccgccgtcgcctcaccgtcctcgaaccgctccggccggaactcctccggcgagccgccgggccagtaccgctcgtcgaggccgatcgcccaggcgttgaccagcacctgcgtgccgcgcgtcacgtcgtagccgagcacccggcacggctcccggcactcgcgtggcagcagcagcggcagcggagggtgtagccggagcgtctcacggatgacgagttgcaggtaccggagctcgccgagcgcgtcctctgacacggcgccggccgcggcgaaggcacggcgaacctcagccatcaccttgtgcatggccgtcgggttccggatcagctnnnnnnnnnnnnnnnnnnnnnncgtcgccgacgtctcgctgccggcgctgaagatgtcctgcgtgcacgcgacatcatcgtcaaaaatactctcgaggaatacaatgatcacaccacatcacttacaaagatgatggatttgatgtcgtccatggcgagcgggaactggagcccaccctccttctgtatccttagcagaacatcgacgaggtcctcgccgccggcgctagttctctcttggtgttcctggatgatgccgtcgaggattttgtacaccgagttgcggcactcctcggcgcggcgtacgacactgctcagccgaccggcgagacgcgacgactgttggaaataaacacgtcatggtgtattcctggcgtggttgagtcagtgtgtgtgtgtcgtgctgctgcatgtgtgcgtcgtatgcgttctgttagtttggttgagtcgtgatcacgagtgcatggctgctgcatggttgtttgcatggccgttgcagtgttgatcgagtcgtgggtgtgcatggtgtgcgtggcgtcagttcttgcggaggaagccgcgtcgtccgggcgagcgtgtggctcacggcgacgtcgagcgggttctgcggaacgtggcgcaatggccggcatggaggctagctcccggtgtgtcaccggtctataagaggcccctgtactccttcgttgtttctttgcaaggttcagtgagtaataaagccaagatacaggagcgatcggctccgcggcgttcgtcgctgtaaaatccattgttcatcgtctccctcaccggcgtttgtgttcgtgagtgtgagagtgttcctgggctgagccaacaacgacggccacaggtcggccgggttaaaccctcccgcgaactcgatggtgcgctcgagcaggacgagaaactccccgcggtccttgcaccggttgtcgaacacggtgcgcgccgtgatgtcactcacgagcgcggagagcgcggcgcgcatctccacggtgcccgcggccacggcgaccgcgcgcagcagggcggcgacctcctcctcgcggatggagcggaaggagtggacgcggcgcgcggtgaggagctcggtgacggcgatcttccggacctggcgccagtagtccccgtacggcgcgaagacgaggtcccggccgccgttggtgagcacgcgcagggtggcgctcagcggccgcatcgcgaacgccgtgtcgtgggtcttcgtcacctcgcgcgccgcgtccctggacgacacgacgagcgtgggcacctcgccgatccggagcagcatgacgggcccgtggcgacgagccaggtcacgcatcgcgcggtgcgggatctgccccacgaggtggtgcaggctacctatgatcggcagcgtccatggccccggcggcagccgtagcccgccgtcgccatgcgctgccggcggcggcgagcgcctgcgcctggcgagcagcacgacgaacagcgacacgagagccaagccgacgtagacgtagccatgagacgcgtcttccatttccctttcctttcgcaaaggatttatgtggcagtgtgggtgtacatatcgagacgacatttatatactacctcattactagtagtactatctaatcttggataaaacaagattatcaagaacaaaaacaagattatcttgtatgcacgaaggcgtccatggcgagagctgttccaagacgattgggttcattacatagattagtatggtatactaagttattgacatgcatgaagcgcgcacgcaagcatatatgcgacataaaaatgcccattgaggaaatcaagttgactttgttaaattaaattaataaggataaaattcagtagggaaaattaaatagggtaaggtttatcgtcttccgttaagaatgaacgaatacacaattcgatgtcggtccctcgacctcaacagcatgctcgtgcacctcatggcaacaattaataacaaccttcccgctgacttatctcaggctaccattagctccttcaaagctactcccccgtctcaaaataacttaatctaaaagaggatatgaccagaccactctaaagacaacgaatctcattccctcttaggttgagtttttttgagacgaagggagtaagtttcagtttccccctagtgaacaaggtatcgacaaggctgacacattggcaaggaaagcttctgaatcaagccggtagatccgcccttgtaaggccctgtttagttcatgaaatgagaatttttggatgccacatcaaatgtttgaccggatgtcaaaagaggtttttggatacgaataaaaaaaactaatttcataactcggctggaaaccgcgagacaaatctttcgaacctaattaagccgtcattagcacatgtggattactgtagcacttatggctaatcatagactaattaggctaaaaagattcgtttcacgatttccatgcaaactatgcactatttttgtttttatctatatttaatgctccatgtgtgtgtcaaaaattcgatgtgacgttgttgagaaaaaattttggaaactaaaccaggcctaaaggtggtgctaatctcgcaacccatctaccatctcacctccatcaggtttccaaagcggtgttagaggcgctagacaagctcaggagaaaattcctttgggctaggggagagaacttatcaggaggaaaatgtgaagtgaattaggaatggctttatcgctcgaaatagcttgggggactcggggtcctcgatctataatgcttcgcaaacatataaatttaaattcaacttatacaggtagaaataaaaataacaaatttaactatgaaaagaacatgtaattcactgccaaatttgtttttttaattatataaatcaaattttaactcgcatatttataaaaagatataccgtatattaacctatcttataaagtatttaaaattttttgataacattttgattgtcaagcataaaacaagagaatgtacccttaaggaaaaaggaaacacttccatatacctccataaatgtttgacggtggtcagttgaattttgagctatccaaacgtatggagagagtactctagactagatgtgtgtcgtggcaacatagagaaggccgtcgtcgtccagcgaagccagctagacgccgggcacagacacgcggaggagtggccggagatggagattctccttccggcgtgaagtgataccgaacgcctcagtcatgtcgagcttggtcgggtcggccatgccaggcacctcccagtcgaagtggaagagcaggctggagagagggagctccacgttggcaagcccgaacgccatcccggggcacatccgccggccgccgccgaacggcaggagctcgaagtcggcgcccctgaagtccaccgcggcggtcgcctcaccgtcgtcgaaccgctccggccggaactcctccggcgagccgccgggccagtaccgctcgtcgcgaccgatcgtgcactcgcgtggcagcagcagcggcagcggagggtgtagccggagcgtctcacggatgacgagttgcaggtaccggagctcgccgagcgcgtcctctgacacggcgccggccgcggcctaagcatgcatgagacggactcgaaaaacgaagaatctgtatcgtttggcacagtttcagttctagataaattggagttggaagctaaagttgtgctgaccggggcctaagcatgcatgagacgggactcgaacccctgatccttaacgcggaagcagcgaccacgcaagccaacacaaccacaaatcacctttttttttctaaatgtacttgttacatgtaagttatgtgcattacattataattacactctatctatagtataactttatttcaatttttttcaaaaaaaaattatcgaatgttttataatctcaacatacgggcaaaagaacacatcacaactttttattaagaaaaaagcctcaaccaaatctgtcgagaaaggccacgaattctgacccccacacacgggctcacccctatagctatagattggtccttgacttgtgttttaaggcctccacccctacacgagaataggtccttcgtatatcgattcttaacatgtaattttacaagggactagcttgtaaaattttaattagatatgaaattcgttcctataagaaatcgaacccatgaccagaaggtagtgtaactattacatgcactttggctcgaagctatatttatatacctcataactgtctaatcttagataaaacaagattatctagaacaaaacaatattatcttggatgcacgaaggcgtccatatcatgatcagagctgttccaagacgattgggtagactaatataaattagtatggatgaatcacacatgcaagtatacgtgccacatgaaaatgccctttgatgaaatcaaattgactttgttacattaaatcattaaattaataaatgtaaaattcagtacggaaaaataaataggataaaatggagctttatgataagaatggacgaatattcaacattattgatggcggcaatatatattaaaactgggtctaaaagtatgtattactccatccagtcatttatatttgaaatatgggatttactagatttcaggctcataaaaatttataaattttcagtcatctaaaattacacacattgctaaaactaaaatcatagtgctatgcaatgtgaaatttcaactctaaatattttgttatatgtgattttactttatttttatctaaatttgaatttctctgcgatgtattttttttaaaaaaaattgttcaaccttctaaagaagggactataatttgttaaataaataacaaaagagtaatgggaaccattatattataatacaatgggtgacaaaagtaactaaaattttcgaaaaattctatgtgcctcaaatctatacactcccttgaatatacatgacttatgggagtagcataccgacctcatctgatgtactatctcattgattttatatgtcctcatcgatttatatgtcgtatttcgattttaaattcctccaattgacctgacaagtgaagtaggttgaagaaatagaaaacggccatgatcggttattgaaagtcgctctatagcttgcacctatatattttggatgcccgcagccacagccgctgaagcaagaacagctgcggaacatgcccaaggtcatcaccttcaaaatatatgggatttttgcaacagtttgttgcaagtttttgggacaaatattttcaagtgtttcatagctcatttggaaccttacaaatttaactaatcattgctctcacggatttataggatgttgaatcctcttgttgtgttaaatgatgctcacattattttggattctgcaataaaactttcaaattaacatgttgttaatcccttctgttgcaactctatttattttgtttcaatacaatctagtactatggattagtagtgatgtttcaccctcaacctttgcttgatttcttttttgtgtgtttgtggtttgatgtttttccactgcaggggtagacaggtcaaacgcgctcactattgaattctcatcattagaatattgtttgaattcttgatattgttaaattcaattttggtaatttgttgtgagggtgaggtcacaatagtagtgccacctctattgattcccattgagttccgtgcaccgccattgatgcctatggagttccacgtggcagtgagtctatagagaagagacatgcagcgccatgacccgcataccctctccttatctctgcttgcatcacgtatccgctcgagggtgcgagtatttggtaggagtgcaacccagaaggattcgggagcggggactgattttaccccattgttcactggtgccaaggccgagtgaactcgtaggggagcaggggcagggtttttcctgtccaacttgcccctgccccaccccagtgccaatctatgcttgtttatactatcttctaatctttatatctctagtttgcttactattgttgagaaactttggtttatgtcatgatgatttatgttaatgtcgtcattgtttacgctctttttttattaaatattatggtgaattgtcaatatttctaacaaatatttaaaagttacgatttgtttggaaatccgcaaaagagttgctacgtgtttaatgcaaggagtcaagtgctataactaattaaagccaaaatggaattggttttgtgtatcttggttatgcagaggtcgagagtattctcagtcggtggtatcacttttatataattagctaagtttaataaagcttccattatatgttaaagaaattggaatatgtcaatgactacagaaaaaaccacttagtttaaaaatccgagcaatagtcgtgtactattaatagccacaaacagcacattctactatattaattagctgagactatctagtcagaattcttgtcacgcaattgcttggataactctccttaatagttttagttttattggtatcaatcctttctgctgcataatttggagaagaatatcaggttcatctgctactgttcgcaagttcatttgtactggttcatctcctaagtaaccaactttgtttgatttgtactaggtatggctcattcgaagtcggatggcacgagcttttggtggcacgcaaaatgccagtaatatatgaataattaactgttataaacttacaaatgaatttgtttaattttagaaaagaaaaactttatatataaagctattacaagacgtatcgtgtaatagtttgggatacgcgctagggagaagaggagagtagagccaagctcatataaaggactagatctgtatggtggcaagcatacataatattaatcaccgctccgagccggccggcaacatcagctagacgccagacacgagcacgggcacacgaagtgtggggcggagcgggaggtcggccttccggcgggcggtgataccaaatccctcagtcatgtcaaactcagcggggtcggccacgtcgggcgcctcccagtcgaagtggaatagcaggctagcgagcgcgagctccacgttggcgagcccgaacgccaacccagggcacatccgccggccagcgccaaacggcaggagctcgaagtcggcgcccctgaaatccaccgccgcggccgcctctccgtcttcgaaccgctctggccggaactcctcgggcgagccgccgggccagtaccgctcgtcgcggccgattgcccagacgttgaccagcacctgcgtgccgcgcggcacgtcgtagccgagcacccggcacggctcccggcactcacgcggcagcagcagcggcaacggcgtgtgtagccggaacgtctctcggatgacgaggtgcatgtagtggagcttgccgagcgcgctctccaacaccaccccgtccgcagcgaaggcacgccgcacctcggccgttgccttccgcatggccttcgggttccggatcagctccgccatcacccactcaagtgtcgtcgccgatgtttcgctgccggcgccgaagatgtcctgcatatggtacatttttgcgcgtaggtgtgtgaaatgattagcacgagacaaaaaaaatccgaccaaaataatttatggtaaaactttttttatccacattatttagtggtaaaaggtcaacattgtaaaacaggtgaaataacttaaaaggaaaatgtatga

SEQ ID NO: 50346 - DNA, 4674 bp, Oryza sativa
agaggaggagatggagttggcagggggaggtcggcgcgcacggcggtggccatggcgggcgaggctggagcgtggcggagaggcggacggcgagcggaggcgtcatcaaggcggggtcatggcaaagaggcatgtgacggccagaggcgtaggcgcagcaggggccaccttgtcttccccttagatctccctcccattctccttcctccctcgtcttcccatctccatctcctcccccttttgtggcgctggcagccgccgtccgcgacggcgcatcttgtgcttgagagagagaggacaggtgggtctctttttttttataaataaaatgcttaggttgagcaatacctggtttttaggtgcaggggataattcggtcgactgcgatagttccggggagtaattcgtactattttctaacttaaaatataaactctgttttaacatttgtattttgagaaaaaaatattttactctcctgaactatttcaccagagcacatgaaggcctacattttttttagctcattttatagcccggattctggaaacggttcactttcttatccctatgtttttctctctctataagtgtcatattttcaagtgaaatttttggtatgatggatacattaaaatttactgtacgtcccaatatgttttttatttttttttcacttttcacatagttaggttgaaaacacttcaaactaatgatgtcaattattatcaagtttgatagaatatatccaatccaataatttatagtacggagggaatagccaaattaaagccatatgcaagcggcaatgcaaagatcggatcgggttttttttattacttctggaagccgaaggtacgactcccgttctcaaaaaaaaattaaagaaggtacgactcttattcccttattggtaaccaatcatgcatgcatgttcctaattaaactttgcactgtgtagcagctgatgtgcacgatgctatttttagaaaccagtcgtccagggtatacactaatacatcactaaatgtatgaaaagtgtcaagtcaaaaaaaatgaaaagtgcacattatataaatagatctagaagtagagaggagaatcgtacgcttgaagaagagaatgaaggagaaaggttgcccctccacatatgttgtatctatatttcttttctttgtaaacattatataacccttctgacctatacatgtagcaaagtaattgtataatactaatatctagttatttgtacttgcttgtacggttagaggtgttatttgtccagataactcgaaggcacctctattaggacatcataaattcataatccaaaaaaaatcttaactataaaactaaaggggcattaattttgcaatcttcaatatcaaaaccagttcaaacatctctccaagataaatcatccaggttttatttgtagtctcatgcttttgatattctaacaacacgatttttactaacattgcaaatgcttttaatttttgatataccattttttctaactgggttctgtacttctgtgcaagtatataaaaattgtgaactaaaaaataacagttttcaaaaatgattgggttgccttggagtgatatttgaccgtttcttaggttagtatattctaaccagttttagtagttcaaggtaaaaaatgtgtccacgttgatcagttattagtatattactgatagttggtggacgatttgccgttgataaagattccatttgaaaatgagttccatgatgtaccatatctcctatatgtagaattttgttccctttttattatccgcacttgctatttgtcctcgcaaacaataaaatattgtccgcattgctattttttctataatgccgaaaatacttccaaacgtgtctttgtttgctccaggatagctctattaacatttatattaacatttagtaatattacgacatttgtgcccctgttttctctccatgtctgtccgactacaactagttgttgagttctctaagctctaagtgaaaaaaaaaagtctcaggagaacgggtcgctttatgaaagtaaaatgacactctatagttcttaatactagctccatccaaaattctaagtactatttcttttttcaccaagactaagaagtcattaactcattcaccatgtgacaaaaccaatgaatatgcaaccaattaataagtactaaaatagcttcttggattctcatcaataatttaatttagcacataatgactacaaataagacttagattttttggaaaacccaaagaatgaaaatagaatgaaaataggtcttaaacttttggaaggagggagtatataacattgttgactttttagaatatatttaccgttcgtcttaattatttagaaatttacgtaattatcatttattttactgtgatttaatttatcattaaagatttttaaacatactaacttataattttttgtgtttccaaattactgtgaataatacgaatgatatcaactttaaatatatcaaattttgaataagaggctatagatgaatattactgctgatagttacttacaaagatgacttgtttgatggcgagcatgtcgaccgggaactccagcccgccctccttctgtatcctcagcagcacgtccagaaggtcctcgccgtcgccgtcgccgtcaccggcgccgcagctgccgctactcgtcctctccatgtgctcctggatgatgccgtcgaggatgccgtacacggtgtcgtggcactcctcggcctcccgcacggcgccgccgaggcggccggcgaggcgcgacgacggccacaggtccgccgggttgaacccggccgacagctcgatggtgcgctgcagcttgcggaggaacacgtcgcggtccttgcaccggtcgccaatcacggcgcgcaccgtggtctcggccacgagcgcggacagcgccgcccgcagctccacggcgcgcccggccgcggccgccgcggccaccgcccgcagcatggcggccacctcctcctcacggatggcgcggaaggaggcgacgcggcgcgcggtgaggagctccgtgacggcgatcttccggagctggcgccagctgcccccgtacggcgcgaagatgatgccgcggccgccgctggtgagcacgcgcacggtggcgctcagcggccgcgacgcgaacgccgcgtcgtgcgcccgcatcacctcccgcgccgcgtcccgcgacgacaccaccagcgtgggcacctcgccgagccggagcatcatgaccggcccgtggcggcgcgccaggtcgcgcatcgcgcggtgcgggagcttgccggcgaggtggtgcaggctgccgatgaccggcagctgccacggccctggcggcagccgcagcccgccgtcgccatgcgccgccgagcgcctgcgcctggcgaacagcacgacgagcaacgacgcgagagccaagccgaggtagaagtaatcatctgccattgctgtgtcgcgcaggatgcttgggctgctattgtttgcaactgtaggtgtgtacaaaatatataatggaggcgacggctcgtgcaaagaccccgcgggttggatgacgtcgtttcagtgtggagctccaagtaatctggatggcgaagatgcggttttgcaactggacaatcgggtgttttatatctttgtgtttaagttggccttaaaacaaaaataagaaaaatcaaatttagtgtaattgcatactgatattatgattcaacttatcagtctaaaaattaatgtactaattgtacaccgagcaaattcctacctgaataaaacggagagaatatgtttattcttttgtttcaaagacactgaattagaacttttattatcttctaaacctttttaatttttaatatataaaatgaaatctctcaaattttatttttaaatctgaaacttttgtccacaccatcatgtctgacgtggcgaaactcttgccacaccagcttaaggtttacttttagaaataactttggagattttatttttaaattaaaacttcaaaaggttcaaaactaaaaaaaagtaaccgaatcataactataacgatttaaaacgaagaatcttttttaggtgttgttatttgaaatagtttgcactgttagttaattacattatttatttatttatattctatagagggacatgtagctgtttaattgtaggaaaaagtacgaattgcactcgtgaacaattgcggttgtccgatttaccaccctaaacttcaataccagttatttttgaccctaaactttgtaaaccggatgaattagttccctagatcgattcagggcggttttggtcctacgtggacgcatacgtggcagtctagtcagccaaaatagataaaataaaatatgggacccacttgtcagcccaatcccttttcttctccccttctcttcaccccttcccctctctctctcgctccttggcgcactgaggcaggcgacagaataggcggcggtggcggcggaagaggcggcggcggcagcccacttgtcgtgtcggtgcggcggccgaaccaaatcaagaacgtcgtgtcggcgcggcggcgcggggtcggggcggcgcggggtctggggcgggggcaggggggagcggtggcgagcgcgtgctgctggccgcgcc

SEQ ID NO: 50347 - DNA, 1996 bp, Oryza sativa
ctttagcctctccgccgcgctcacctctgcctcgccgccgcgctcgcctctccgccgctctcgcctctccgccgcgctcgccgctgcctcgccgccgcgctcgcctctccgcatccgccgtcgcctggagaagtgagagagagagagtattgagaagagagagtagtgtatgacaggtgggtcccataattttttataaagagaatgatgactggagtaattcgtccggtatttatagttgggagtgaagaatgtccgattttatagttcggggtaattcggacgaccgtgatagttggagggtaattcgtacttgtcccttaattgtaacgctaataagtactaataattgaattaattgtttatcagatcccttcagatctcatgcacgttcagcgtgtactatctggtggtacacctctcgcatggcctgctgtctgtcttgtcagttatcagccacaagcatatattttaatattaaattttgattctagaattgattttatatttttttaactttactttttagcattttcttttaaaccacaactattatcccataaatatttgtacggtttattctcatagcagtttgtatgctgcacagttttatggataattggatatacagtaggactttcatcgtctcataataagtttatttttagttcttttcatttgttttaaaataagtttatttgagctattgaagtttgtgaacttatgatatataaatgtacttagagtagatgaaatttaggaaaacaggagtattatagtcttttttttattggtatgtgtggaattattttagaattgagaaagtacaatgcagtaccgcatcatctatagtacgagcaactaacaaatgaggccgggcacgtatatcaatccctatttcgatccatcagctcctacaagtgtagaggcaatattgtaaagaaccatgcctatataaatctgtgttttttctttttgtcaccatgtaatgacgcatgcaacaagatcctgaggtattcttgtgttcatgagactatcaaggtgtcaatcgaagttgcctgtctccttttggtgaagaacattaaggctatgtttagattcaaactttgaattcaaacttcagtcctttttcatcacatcaacctatcatacacataacttttcagtcacatcatctccaacttcaactaaaatccaaactttgccatctaactaaacacagcctaattggaatcctcctccaaagtgatttggggtctggaccaatcaggtattcaggtggagtactacatattttcgctgcaaggttgttgagctttgtgcttagtgatgtgactgaccttggccggccggcggaagccggcttaagaatttcttctcgttttctttttagggcatgttgaggttccaaataaaatttttcacgctgtcacatcgaatatttagacacatatatagagtattaaatgtagacgaaaataaattacacggttcgctaggaaattacgagacgaatcttttaagcataattacgccatgatttaacaatataatgctacagtaaacatttgctaataacgaattaattaggcttaataaatttgtctcgcagttttccggtggattctgtaatttattttgttattagattacgtttaatactttaaatgtgtatcaatatatccgatgtgacatgtaggggaaaatttttttgccaattaaacaagcccttagaaagggaagactctattaccagaaatgattgtgacattacaagccaaaaaaatattaataagtatatcaaataacagactattctttctttagataagtataacagactattctgaagtctaccagggacggcaactggtagtctggacaaagcgataggaaacagaagccgaatctgaacgaaagcaagaaacgattccgctgttgctgcttcacacacaatcgaacgaatgggacgtgctatttcacgctgcaaatcgga

SEQ ID NO: 50348 - DNA, 2015 bp, Oryza sativa
catgggctgcaccaacaacccaaacacagtccaataagattcgggtcgtgccgagctggctcgaaggtacgaaagcccaccgtgctcctccttggaataagtctattttatgtccctcatatctttgggccgtgtcttatatggctggaataagtctattttgcattctttatctctttgggctgtgccttatatggctaaaataagtctatttctctccctcatctattttgcctccctaatcattggaacatgtcgtatcgggatggtccaccatgctgaggcagaggcccaagcacagcccaaaggttgggccaggccatgccatgcctgggccaggttgtctagcctcaggccttttggcaatctataatccaccttgtctagaatactaattagtgtatgattactaagtaggttaaattatgattaatgatattaaacatgtttgatattgattagtaattagcacgataaaactagtgtaaacaagtgctaatttgtattattaattgtatgacttactattattatagcacttctatatctgtacctaactaaaatattcgtatttttcctttagtcacacttttttcgtccgtccgattccctccatctcagcacgtgcatgcgcagatttgaagagaaacagactcgaactataaagctagggtttctcttccaacatctatacgacgtggttttgttttgattcttgggaaaacagaaaggggagaagataaggatcaaaacccctcactcaatttctaattatctccatggatgtggactgatttcacggaggaggcggattcaggcgtcatcgggcagatgcggcaatacggacggaggtaggagacgacccggtagcactggcccacatgacagtaaaagaaggagcgagggaggctgattagacttgtagtgctttgctgggccggatgcgtacttgcgggccgaggaagaggggaggagaagggagaaaagtgggccggctaggctgcaggccgaggaaggaaacgggatgaaattggcgtagagagaatggagagtttttatttagatttttttaaaataaattcttaaatgatgtttgtattattaaagttagcaattgagatctgaaaatttcaagaaaattccagagagtgtaattaatcatggagaacttcattaaaaattaaatttagctatatcattttatttccacacttactttacttttaaattaatttaaacacctacctacttaaaaaatcaagtattccaggaaatgtgtatttaatttaattacataatgtaaatctttctcaaattctcctcaattttctcatcttttcttcccgttgcaacacacgggcattttttcgaggaagatattataattaagtttattgctttcatccaatccatcctcatcctaccaatcaaataagcttatcccatcctaaaaaaaacttagcttcatcctctaaaatatagatggctatattacatccaaccataaccttgaaccaaacataccctatccgattgatgaaacactagtgaccaaaggccaactcaagagactagaccacttgcacgacaacctaggacccaggttggtcgggggctatcactaaccaacctggagaacattgtcacctgccctcacgtccaactcgcatacggccacaccttacctcatcatgagttcatgactaagattatttaagttgtggtcttatgatcttctcatcttctgatttttgcatcaatttagcctaaaacttaggctaggattttgtttcactcttatttaatttacttcacaattttagatgtttatcatgttagtaattgttggtatttctcaatgtcacagctagaatccgcaagcgcacggatatactgatgtagcacttcccctacggagtattccaaaggtatcaaatccaagagaacgtgtatgattatctcctcgttaggttcatccaaagacacaaagctaatgtgggcagagggtagagagg

SEQ ID NO: 50349 - DNA, 1991 bp, Oryza sativa
tcccgtatgctaattaggaactaaccaagaagtaattctcactaagcaaatcttaattactcagaatgatatttctattaaagcagagtaaataacaagatacaaaagtaggaggagattatcgacaactccgggattcctccgattccttccaccttaccctctccctattctaatatacaataaagtatactagagcctcttataattcagcttatgatttggtgtgtgtttacaagtgaggatgagaggggtatttataggtgaagtgccttgggagtgtggagatgctccaagcatccaaagagcatcatctctcttgtgttgccaagcgttcaagctaatgacggtttctaccggtgaaaacggccataactgtcattgggaggcggattgctaccgaactgaacttgggctggggcgaacggcctctgctagggttcagccgaactcaggggttcggccgaacccgggacggctccgttcgctccggttttcgtcctggacactcattttggggccctcaattcattggtatgaatgtttggcccatatggaggtgtttaatttatgggtccaaaactccttaagttcggatacgagtttgattctcatcctccttcatgtatatttcctctcaaccttggtagtttgtcacctgcatataaatatacaccaacacttgtggaaattattataaataagccctaccactatgttggatgtttacaattatggtcttatgctggtattaacggtgttaattcgatacttaacagccatcaacagtaatgtttatttgtgttactttaactgatacatgatttatctcttctctgtccctactattatatattataaaaattgaagatgtttccgcggtccgtcatccgtgtttgagtcgattataaaaattgaagatgtttccgcagttcgtcattcgtgtttgagtcaactttaattttatgttttagttttagtctatatctcttctctatctctatctctatctctactattataaaaattaaaaatgtttttgccggtattttggtacgtcatccgtgtatgagtcggtttttaagttcgtttgcttttagaaatacatattcgtatttcagtcggtttttaagatggtaatatagaaggaattatatgagaaatatgtttaaaaaaactcgcatgctaactgagacgatcggattccttagtgcagctaatgatttcctaaaaatatatatatccaagtgaactcccacagtgaattttatccttgtaaatatagcgccggctgggccggcgacgtcgatgacctagacgcccggcacgggcactctaaggattggacggagcaggaggttggccttgcggcgcgccgtgatgccgaacgcctctgtcatgtcgaactcggtcgggtcagccacaccggaggcctcccagtcgatgtggaagagcaggctggcgagtgggagctccacgtttgcgaacccgaacgccatcccggggcacatccgccggccgccgccgaacggcaggagctcgaagtcggcgcccttgaagtccaccgcggcggccgcctcgccgtcgccgaaccgctccggccggaactcctccggcgagccgccgggccagtaccgctcgtcgcggccgatcgcccaggcgttcaccagcacctgcgcgccgcgcggcacgtcgtagccgagcacccggcacggctcccggcactcgcgcgggagcagcagcggcagcggcgggtgcagccggagcgtctccctgacgacgaggcgaaggtacgggagctcgccgacggcgagcgcgctctctgacacggcgccggccgcctcgaagtcacggcgaacctcggccgtcgccttcttcatcgccgccgggttccggattagctccgcgaacgcccaccccagcgtcgtcgccgacgtctcgcagcctccgctgatgacatcctgcgtgtgtttcatcgtttttttttatga

SEQ ID NO: 50350 - DNA, 6835 bp, Oryza sativa
  unsure (1)..(6835): unsure at all n locations
ccacggcgcgcacggtggagtcggccacgagcgcgcacagcgccgcccgcagctccacggtccgcccgtccgccgcggccgcggcgaccgcgcgcagcgtggcggcgacctcctcctcgcggatggggcggaaggacaggacgcgtcgcgccgagaggagctccgtgacggcgatcttcctcagctggcgccagtagtccccgtacggcgcgaaggctatgtccctgcctcctttggtggccgcgcgcacgctggcgctcagcggccgcgacgcgaacgccgcgtcgtgcgtccgcatcacctcccgcgccgcgtcccgcgacgacaccaccagcgtgggcacctctccgagccgtagcatcatgaccggcccgtggcggcgcgccaggtcgcgcatcgcgcggtgcgggagcttgccggcgaggtggtgcaggctgccgatgaccggcagctgccatggccccggcggcaaccgcagcccggcgtcgccatgtgccgccgccgccgatcgcctgcgcctggcgaacagcacgacgagcaacgacacgagagctaagccgaggtagaagtaaccatctgccattgctgtgtcgcgcaggcaggatgctggggcgctcggctagtgtttgccagtgttggtgcgtacaaaatgtagtggaggagacggctcgtggatgaaggggatttggttcttaatctgtagtgatgtcgttttcagtatggagctccataatccggatgcgacgaaaatgcagttaatcttcgtgaggacaaatgaatgttatcttgtttatttctggtcatttataacgttaatcgtaaaatgagtataaattaaccggctaggtttctggaatctatttatccggatttaaattcttaagtgggcataagcacttgtctttatgactaattattatttcattaatagacaatgtgcctctcgatagcaagccgtcatatcacaacttcctgaatattaagatgtgtcggcccacctaatttgaaaatcaaatttaatgaagagagtactaaatattaaagtttaattgcatacctaatgccatttatagtgcgcgtgcttgacgttcggccccgaccatccacatcggggattccatgccacgcacacatctgcgctcccaacctgaagaccgtggaaccaaacaaagccaccggttcttcatcaaaatttggatagacatttgtcaaggcggaatgaggcacagggcgagcagcgtgttgggtgaggtgtggccccgtgcgacgcctccacacctcgtgcaaggcggcggaggtcgccagcgaggccaccatcacgagctgcgtcgtcgccaaagcggtgctcgctaaatcctgtgaacccgaggtcggatctgcttagtggggtggtggtcgagtgaggagaagggaggatggtggcgacagaggaaaaggaggtggcaaactaaccttgttttcgttcccgttcagcgccgccaagctcgtcgtcgtccccgctccgaaccacctcggtctgcagcagcagcagcttgacggagagggagaggagctcgtcagtatccggccaagggaggaaagccaccagttggagtaggacatgagtgggggtctttgaagagctcccgccgtcccttgctcccacgctgccgatctcgccgtctcccgcagtccacgccgcccaagggaatagggccgccagttggggaaggaggatatataggaggggtggtgtgccggtggcgactgtatggtgaggagcgtgggtcgccgttgggggatgggaacgggagaggcgtcggtggcactggaagggcaacggggaaagtgaggaaggagggattttatatatgtttccgattttgagggtgttttgtgtaaaatttgaagtattctctaaattgacaaactacgagaactttaatgtaaaatgttaggggctgatatgaaaagttaaagccacaggtataactcctttgcattgtgggataaagagagagttgagacccgttgccccatgctacacgaggtttctcgtaacaaagtgatgcactgtggaataaagagagagttgagacccattaccccatcctacatgatgcttctcataataaagtggttctctgtgaatggctcgatagaattactgccaacatgccttaggtttcacgatgtttctagctccatcataagatccatataagcagtgagatatatattatgtggggattcttcgcaatcattactatactacaaaaattagcgtgtctattgacgcgttgtccctttagcatatatagatcatttctttattttccatttacccttctgcgaagatcgcacatttaaaaggataatttagtgggagtatcgcgtgttaatgacctgtaggtttttaacagagtgaaacaattgaggctaaagttagaacaaaccgataaattttgataaaaacaactacacttttcatttcaattatatttatttgtgctgctaaaattctagtatgtgtctgaacctgaaattgattatctttttctttcttccttcctgtttgtgctgtctcctaggccaattggatcgtttagcacttcaaagtgccaccaggcccatgcagacccagctgcccaagctgctgctcgtgcggtcgtgcccaagcaagccgtaggtcacgcagtgtgtgtgtgggtgcggcttccctgttcctacttccgtattcccgtcccttttcctgctacgtggcctactcctattcgcttcttgtttgcctggtggccccacccttcttcttccccaaatcaaaaacagaaacgtataattttttcagccttcattactccattgttatattggattagttccgcttggacacttccacctccaatgatgccccgtagccgcaggtgatttcctcttggcagctttcttcgctaatcggatgtgtggcgcatctcaatagctttgattatgtctgcaagtttcaagatgtgctcaggtaacaccaaaaactgttactcgggtgcttcctatcatccatggatgaacatggagacaaaggtttttggaagttttgtccttttatgaatgtgtagcagttaatctgctaggagttcatttcaattttcatcggtggaagcctgtaagagagtacatactcacagagtcgcagacttgcacggttgcaccagaatgtatgaaaaaaataagaaacaaagaaaaggatggaaagaggcatcgccctagttgaaattgttatcaattaatgatcttctataacagtattgattttgttcttgcctcaagctagctaaggtttccgttttgtccctttgataccacacatgccattgatgcaaaagcacagtaatttgttcaggatggtttagggcaggcaacactagcaaggaagaatccaagaggacctctccaggtgatgagcatgcacccgataaccagcaaatcagcaaaagttgttcagacctgaacgatgtgaggatcagtctggaccctgtagggagagtgttggagactcgatttttgtttttccgatggatgggaaggaagtagggccaccggtgaaacaaaagcaaatggatgtacgccatgtagcggaaacagggacgggaatacggaagtaggaagtacagggaagccgcatctgggggaggggggtgccacctatgtttccggatacggttttggactttttcttttcctggtaacttgaatttatcttagaaatccagcctattttcatactggcggacttgaaagcttctaaggaatcccttgaagtcttggacaaacagagaagagaagatagttcttgtgggcgggaaacgaaaccatcacaggagggaagtgcaaggtgaattggacgtggactttcctctctactgcctcgggaggtcttggcatcctgagtctcgaaaaattcgcaagggcccttcgattgcgatggctctggcatgaatggaagtcaccggaaaaggcttgggcgtggggtcagaaacaccttgtgataaaactgacaagctattgtttgaaacagcaactacaaaacaaattggagatggagcgaaagtgaagttctgggagttggcttggctccgggcaaagattgaaggatgtcacaccactagtccacgcggcctctaggaaaaagagcaggaccctcaaacatgctgctttggtagatcaatggctgcacgaccttgctcttccaacaaacgaaggatggacaacggatctgattgaccagctcatcaccatttggagcgccgttcagaatgtacacttcacggaacatgaagaccagatcacctggaagctaaacaaccatggcgaatacacggccaccacagcttataaggtgcagctcctgggtacaacatcgtcaaatttcgacaccctaatatggaggccttggatgccgcacaagtgcaagtcctttgcctagctgatactccaatacagagagtggacatcagacagactagccaccagaggctggcccaacggatccacatgccctttatgtcgccagactcaagagacggctttgcacctgctagcggaatatagatacataaggagaatctggaatgaaatcgcgcagtggacaggcaacgaccatctaagaccttctagttggcaagtaactttgacagtatgagtggtgggaggccaccgtaagcatacgggaagcacacgctaaccttgcttgtgaaccgggagatatggaatgaaaggaaccgaaggactttccagcacaaggagttgccagcgccaactctgctagccaagataaaggaggaagcaaaaacgtaggggctggcgggcgcaaaaaatctcatcgcctggttgacaatgtaattgccaatagttaggaccgtggccctggtttgtttcctgtacattctccctttttatacagtttcttctctattcaatanaattggtggcctagtcgattcgttcaaaaaaaaaattatcttacaaatcgaggtgccacatgaaccaatcagatgttgacataacagcattagaagtattggttgatggattgattggttgattaataagccctgggacgttgtacgtatttatcttttgtttcaggacgcacatgtcagtttctacagccattacagaagcagtattggtatactactttcttcaatgcagttgtgtgtttctgtgtacaacgtttaaccactgtcttatttgaaaaatatataaaaaaataaaaaatagtcacacataaagtattattcatgttttatcatctaataacaataaaatactaatcgtaaatttttttcaaataaatcagatggtcaattgttggatataaacagtgcaaaactatgatatttctggaacggagttaggacaaaggatcatgaggtcacaagtcacaagactcacaaaaagcacgcacatttactccactcttactgatactgctactttatctctgtcgtaaaatataaagaaatttatacaaataacaatatagacataatttcttatattttaattagagttagtagtcacttagtttacaacacacagctccgtactagtagtattatggaagaggtcggtggcgctgtctggcggaggacgacggacacggcgcaacgatgcgcccgtctgaggttggtagcggccgtgcgatgcaacagctggagcagcgcttcagtcagccatgcagctgcgcggccctgtggctgcaaggcatggacagggccggcggccgtgcgacggcggggcggtgcggcaagcaaccacggctactcgtttgttggtgcttctttcttttttttttctccatggctcggtgcaatgtctgtggccgatgcggcatggtgaaacgctcattggcgggcaaccgttcccaaaaaatccccaatcggcattcaccggcgactccacgtcggcgttggaggatttctccgagagcagtataaaggaacaagaatagagagaggaatctgttttcgtgattatattagtgagatgcaaaatggatttgcgagttgttacccttcttcttccttgatttctagtagaacgttatgctatcactggtggagaaaccatctttggtcggtcagccaaatttcacaacagtcccggttctaataaaaaccgggactaaaaaacatctttagtcctggtttaaaagttgaggagtactttttgatctttagtcccgggactaaagatcatttttactcccgattcaagaaattgtcgggttcaagacatacctcaactatttttactccccgttggtataaacaactgggactaaagatctatttttagtcccggttgtttataccaaccgggaggaaagagcacctcgagccgtgcgcgccatctttatccgctctcctctcgatctcctctcccctctcattaatatttcctctccatcccttcctctccccttcatccccttcctctccccttcattccctatctgatccttcctctcccctttcccttcctttcccgttcgcccctttcccctcttcggagcaccggccgggcgggagcggcggcggccgagcggctggccggccaggcgagcgcggcgagcggccaggcgagcgggagcggcacggccgggcgggcgagcgcccaggcgggagcggcgggaggccgggcgggagcggcgacggccgggcggccaggcagccaggcggctgggcgcggcgggccgtgctggcgcggaggcgagaggacgggaggccggcggcgccctcccctctgctgccggattttttttaatatgtgattcattggatttaatctgtgatgt

SEQ ID NO: 50351 - DNA, 1912 bp, Oryza sativa
gggttcccacccgcgagtaaagcccctttctccaccagtgtattatgcaacccctgtgctacatgtatagtacagaggggatgcataatgtataaaaaagtggagacataaaatataggggtaggacatactcttattcattcatccattgctcaagtgtacaatagtgagtttccaaccctctatttataagcataatgcatatataaaaagtaaggtgaagggtcttataagtatgttgggctgggtcttcatggtccaagcccaaatgtttcctaataagtgagacttattgcttggatgagcatatataatggtggttgcgttggataagcttatgtactgcgcgacatatggctgaggagttgtgacacctgtagtgcgcaacgagataatatttaaatgttcgacgaaacgtcggcgacctcggctagacgccgggcacgggcacgcggagtatggggcgaatgatgaggtcagccttccggcgaacaccgatgccgaacgcctcagtcatgtcgagcttggtcgggtcggccattccgggcacctcccagtcaaagtggaagagcaagctggcgagagggagctccacgttggcgagcccgaacgccaacccggggcacatccgccggccggcgccgaacggcagaagctcgtagtcggtgcccttgaaatccaacgcggcggctggctcgccgtcgccgaaccgctccggccggaactcctcgggcgagccgccaggccagtaccgcgggtcgcggccgatcgcccagacgttgaccagcacctgtgtgccgcgcggcacgtcgtagccgagcaccttgcactgctcccggcactcgcgcggcagcagcagtggccccggtgggtggagacggagcgtctccttgatgacgaggtgcaggtatcggagctcactgagcgcggcctctgacacaacgccggccgctgcgaaggcttgcctcacctcggccgtcgccttcttcatcgccatcgggttccggattagctcagcgatcgcccaccccagcgtcgtcgccgacgtctcgctgccggcgccaaagacattctgcatgcatgtgatccatatttttagcacgtggattttcatccctcgaggaacatcccctctttttttttttgcatgttatattaaaaattttttaaaaaaattgacaatatagattaatacgaaatatatgactccacaaacatgcaagaccaaattcaactactataagttgcaacaaaaataacaaattaaactgaaaatagttatcgtacattcgtagctatatttgttatttttgttacaacttgtagaagttgaatttaaacttgcatgtttgtggagtgatatatttcataataatctatgttgtcaatttttttcatattttttatgactatttaggtgatatgcacgaaacgaggggatatctcctcgatggatgattttactttcccatatttttattgaagctgcgtagctgaccatcacgaaagaacgaacagattggacttcatggctttcaatggcgatcaaattcgtaccgtaggctcactctaataaacccgagatacaagatacaaaaaaatcagacaattagaggcatagatgagggagaagcgctgaaaagaagcagaggaatgagatcagatagtaggaatttccggaagagggggactgggggaggtctctattagtttctacaggtgatgtttttatatatatactaccttcgttcttcgttttcttcaaatagatgatgtgattaaattttaaaataacatttagaataacagttagatacaagccctacttaaatttatataataataaaataagttagaacaaaataaataatattaatatttttcttttgaaaataagacaaatggacatatg

SEQ ID NO: 50352 - DNA, 1985 bp, Oryza sativa
aggatgtccactccattctaccttgaagacgcagcaatgaacacgaagagagccaactggcccaactctaaggttttgtagtgttcttatgatgttcatcatgtcttcactctgtacactcccatcgtttaaccttcagcttataagctatagccgaaatttgatatgagttacatttcactctttgtggtttttttaattaaagtttaactttcaatatttgattttaatttactaacaaactcatgtataaaagttttatcataattatcttttgttgttctaagcagtaacagcttatacacactactatagaacttcttctaatagggctcggctcatagtagccgattcaattggaaccggtacttattaccatttcccacctccatgggccaaaaaagtatacaaccgatacctttgaacaactataagtactggttttagagaaaaactagcagcaatactattgatattgattttttaaaagaaccagcacctataatgtattatagttgctggctaattaaaacacaggtatccgtaaaaaccaagctaagttgagcctctcattcttatccattcacgctgagtcctctaacccactgttctctcattttcccctcgccaccagcgagcactggtggcaccctctccctcgcgagtagtggcaacatcctctcctttgcgagcggcagcaacaccctctccctcgagagaaacgacgacatcctctccctcgcgagtggcaacggtgacggcggtggaaccgatgccaagtccagcaggcctgagttcggggtccatcggatttggcccccgcgctggtccccgagcagcatctgtcttctccttccttcgacgtcaacaagggtgagcggcggcgcccgttctagtgctctagtgcttgttctgggatgttggatgatgaatgcttgtttgattctattatgagcattcttgtgttattgtgcctttcaattcattttttttgttggatttggagcatcggttcaactcacttgagctgagtcttttcttttcgcaaatcgtacaatttataggtgccggtctatcgatagcgctcctcattagtgcgtctgttagatgccgagtgaaaaatccggcagctatatggctttcccatccgacacaatttacttttgtgaagtagtgacgtaagcaaagcgatgaccgtgcttaccagctaaaaagctatgtactgctttctggttaaaaaccatatgtgaccagatgccatagtgtcaagctggaggacaagttgacagttggaacatgacacggaaaatgatctaagggtctgtttaagagcaggtactgcaaacatattttatgaagataaataagaagagagaaaggcagtgagctacagatttatagccagctgtagcacggatcccaagatacagtgtgcgtatgacatgtgggaccaggtattaatagtgtagtatgtaactattgtatgaattagctattagattggctatagatgaattggagttagtagttagttatactattgaacttgctctgatagagcttcaatttttccatttaatgtaggagttaggtataaagtggagttgtggaacagtttaaatccagctccacctatcgagttaagaacactctacctagctgtgctcctattttaagatggagctgaaactatttggctgcgctccaacttcaggagagatgaagctggagctatgctaaacagtgccctaagataactcgtggggggcgtagtcacttacatggatgacagacttgatgacgtccatgtcaaacgggaactggagcccaccctccttctgtatccttagcaaaacatcgatgaggtcctcgtcggtggctccagcgccgccgccgctgctgccattcttctggaggtgctcctggatggtgctttcgaggacgctggacatcgtgtcccagcatttcttggcctggcgtatggt

SEQ ID NO: 50353 - DNA, 7101 bp, Oryza sativa
tacgcctggcgagttgcacggcgagcagggaaacgagcgccaggccaaggtacagataggtgtgaagatctgccattttttgtgtgtggtgtacgacgatgcttctgcagctgtgttgggaagtgagaggctctatgtactcgtatatatacgcaattcttgggtgttggttttaatggcgtctatatggagcaccaagacacaagagtctttcataatcagatgtgttctgtttttcacaaagaattaaatgtacattggtacaactaaaattaatgagtacaaaacaggaggtttgattatggtaacaaaaatgaaagtacaagtacgtattacgaagtaccgctaaaggacgagttacactacttacatgcttttataatatatcaccctagctccttcctccctctcgagacgtttgtaaaaaaaaaactactcccccggaccaataatataagagattttaagtttttgcttgcacagtttaaccactcgtcttattcaaaaaaatttgaaattattatttatttttttacttactttattatttaaagtaatttaagcacaacttttcgttttttatatttgcacaaattttttgaataagacaagtgatcaaacagtacaagcaaaaacttaaaattcattatatcgtgagacggagggagtaattgttcatgctaagccatcggtgactctcttgccttggtaaataaaatttaccacagtacacgttctaactaagacctccagaaaaatttaaatagattccatgtagtcatttttaattttttttccatcatgatagtatgacgataaattatctctttatcacaagtattactacagtgaatcaccattttgtttttcaaaaaaaaactacttactgaaattctagaaataaattaaaaaaattctacattgtcaattttcccactttattttacacaaaaaatcaacatataggttgggcaaaggagaaaggaactctcatcttagattaagtttcctataaataacaaattatggaaaatgaatcttgatattttaatttgtcaaaatttccttggaaaaccaataggatttagaggttggtggacgggagcgtccataccctcatttcaaattaggtttcttataaattgaaataaattagcggaaatgaatcatgatatttctaaaatttagcagaaaatcaaaaaattttgaagagggatgggaggagagaagaaaaatactatgagatatggatgctcagtgccaaaccaactggcataagggttgggtattggtattgagacatttaacttcagtgccaatagccttaggcgcgagctatgggtccactttcatagtaaagtttagaaaggggccattgtaaaataagtttttagaaataaccaaattgtaaaaaaaaatctggttatttgacactttttgatatggtgtgtaggctcgtatttaccacgaacaaaatagtgttggaattaatagatgggctaaggctcatccgaaaattaattctttagaaaatcacaaaggcccacctcatgggatggcatgcatgtggagtttagtaccaccttgcttattctaggagagggggaccttcttaaaagggaggatgccctcctagccacttgaagcatgtgtggtggagagaagaggggaaaaacgcgcgcacgctcgctcgcctagcctgggcaggtggcccgcgtgcacgacgtacacgtcgaatggtctgcgggaaatttggatttgttttgtttctgtttcaaaaaaatccggtgcgtggagtccggataggtttacgcgctttgtttctttttccaaaaaatgcccgcctaattcgaaatttggatttgttttgtttctgtttcaaaaaaatccggtgcgtggagtccggataggtttacgcgctttgtttctttttccaaaaaatgcccgcctaattcgaatggatttgttttgtttctgtttcaaaaaaatccggtgcgtggagtccggataggtttacgcgctttgtttctttttccaaaaaatgcccgcctaattcgaatttgttttgtttctatttccaaaaaatccggtgcgtgaaaacggcgtggagtccggataggttacgcgcgacttatccggttcggtttacacgagtgcaaaaatccggtgcgtgaaaacggtgtggagtccggataggttaggcgcgacttatccggttcggtttacgcgagtgccctgatcaggcgacctatctctatataaactgagccgccggtttacacgagtgcaaaaatccggtgtgtgaaaatggcgtggagtccggataggttatgcgcgacttatccggttcggtttacgcgagtgccctgatcaggcgacctatctctatataaaccaagccgccgccttcacgcaacacacgcgaaatctgtcagggttacgggttaggcataccctttacccttcgatatacgttacatatcggtatggtatacccgcgcgcatacagatactttctgtatattctatggaaatccttcacggaatctacggatgggaagaatcctactcggacaagactgggtcattgacgtatcgaatagggtctgatatctccgagttctacttggagacctccagatctgtgatataaaaaggaacccccggtgagggcttaaggcatcgaatctcagagccaacacaacccacatagcctatgaagccggagcctgcaaggagccaagccatcgagatctagtcgaaccaactcgactacgatctcgccggatccgacaagttccattgttccctttgtaacctgtgttttccaccatataatcccatatcaactggattagggctattacctaccaaggggcctgaaccagtataatcctcgtcttttgttgcttgatgtcgtattacgtagatccttgtaccaacgtaccccaataccctctatatccggtctatgggtaccacccgtcgacagtggcgcgccaggtagggggacttggtactcaaggttctactactatgtcatccagcttcgtcgacaacggcgtcaacaccaacctctgccaagtacaccctgcttcaacgatgctggtgtggactcaagtcggcgaaatcgtcttcccggtttacaccacaatgctgatctcaaccggtcccccaatgaccggaaacgagaacgtagtggctacaaaccaagacgacttcatgtcgaaaaatcctcccgctgagacggagaacagagcatcgacgacatccgagctcgagaaggattctgatgcggccaaaccttgttcttccgacatgaaccgcgagccgacaaagatgacttccgaagccacaaggtcctggtgttctatccacaaaaccagaaaacacactttgcaagcctgctgggttttcctcaacgtccgcgctgaaattcacgcctgcaaagagcgtggaattcagcgtgtttctccaactcgtgatgtctattgtcctattcacaagacaaagaatcacggcctctcaagctgcaaggtctttcttggcgccatgaaagatccgtctcctaagtcatacgtccccatcagggataacgacaaggaacaaggagcgacttcaatttcagatcgatttgttggggtaatcgatatcgatcctcacgaaccatcagtcttacaccttctcgaagactatgggtcatcgaaaacgagtgtgtcgtgggaggtattggctatcgatgacgttggcacgtcagcgcacgccaacgcagaagcaggaggacaattgactactccagcccagcaccataagggccattcaagctatactgagggaaactccatacgatcccattctgaacgatgacctcgagcgtttgatagaacgactacgggaatcagtgaccaacctcagcaacacgttcgaagaagccgctatcgcagcacacccggagcagccaccaactgacgatgtcaatggtgaagacctggaacggagggaatcaccccaacgagctacccctccacctcgcggcaccggcgatctccgagatcacatcaacggccgccgagaggcacgacgcacacgagacaatgtgaatcgttctcggcgtcatgtctcttcacggcgccatgataacggaaatcaaagagaccgctcaaacgaggaccgagaccaggacaaccaccacgatcacaacgatcgcgaacgacgggtgcgagacaatacaggtcgaggccgtcgccataacgacgatgatgacggagatcggcgccgagacaatagtgggagacgacgacaggattcccgagatccaggccgacatcctcgtaatcgtacgctggaagcaagcgacctgtcgtcatcgtcatcatcctcgtcctcctcatcgtcagacagacatccacgaaggacacacaaccgccgacaacccaccgcccccaacgctgggtgtagggctttcggtcgttccctacgtgatgtccgatggcctgagagattccgacctagagtaatagaaaagtatgatgggagcaccgacccagaggagttccttcaagtctactccacagtactctacgctgccggagcagacgacaacgcgttggcgaattatttaccaactgcgttgaaaggttctgcacgttcatggctgatgcatcttcctccctactcaatctcttcgtgggcagacctgtggcaacagttcgtcgccaatttccaaggaacatacaagcgccacgcgatagaagacgacctacacgcgttgactcagaactcgggtgaatcattgagggaatatcttcggcgcttcaatgagtgcagaaatacaatccccgaaatcaccgatgcttctgtaattcgcgccttcaaatccggtgtcagagatcgctacactacacaggagttggcgacaagacgcatcacaaccactcggagattgttcgagattgttgagcgatgcgcccacgcagatgatgcgctaagacgcaagaacgataagccgaagaccgggggagagaagaaaccagccacggacggatttgagtcaagcaaaaagaaaaatcgcaaaaatgggaaaaggaaagctcaagtggaagttctcgcagcagaatatgtgaaccctcccaagcgcccagacccacaaagtagcgacacaaagaaagcatggtgccccatacacaagacggacagacattccctggaagattgccttgttttcaaaaattcgctcgagaagcacatcggatttgaaaaagcaagcgagtacgcgtggtcgagaagaacgaggaggaggttcctcacgaatcggatccagcgtatccagactccgacctccacgtttcacacatctttggcgcttgcacaacgtactcctcaaagcgagaatacaagaaagtggaacgtgacgtttgttcgacatggcagggggctgcacccaagatgaagtggtctgagcagaagatagagttctcggaagaagaccaccccaagaccgccatcatcccaggacgatatccgatcgtggtcgaacccactattcggaacatcaaggtagcgcgagtcctcatcgacggtggcagctcaatcaatcttcttttcgccagcactttggaacgataggaattccgcaaagcgaattgacaccaaccgatcaacccttccacggaattactccccaatcatcgtccaaaccattgggcaagattacgttacccgtgattttcggccaagccaacaacttctgaacagagcagatcacctttgatgtcgctgaattcgacacagcttacaatgccatcatcgggagaactgcacttgcgaagttcatggccgcatctcactacgcgtatcaagtgctcaagatgccgggactgaatggaacaatcactattcaagggaacgcaaagctagcggtgcagtgcgacaagcggagcctcaacatggtcgagcaaacgcccagcccactcgccacgattacgccacccaagaaagtgagtaagacaaacaagacgccgaaaccagacggcaccatcaagatcgttccactctccagtgccaaccccgacaagaccgtcaagatcggggcgacactaaacgagaaataggaactcacgctcatcaccttcctccgcgataatgctgacgtgttcgcttggcagccgtccgacatgccgggggtccccagggaggtgattgagcacaaactcatggtgcaacccgatgccaagccagtaaagcaaagactgcggagatttgcaccagaccgaaaacaagccatacgagaagagctcgacaaacttctcaaagttggctttatcagagaagtacttcatccagagtggctagccaatccagtcatggtgcggaaggccaatggaaaatggagaatgtgtgttgacttcaccgacctcaataaggcatgccccaaggatcacttccctctccctcgaatagatcaactggtggattcaacaaccggttgcgagttgttgagcttcctcgacgcttactctagctaccaccaaatcaacatggcaaaagaggacgaagagaagacagcattcatcatgccgtttggggtattttgctacgttaagatgccgttcggactgataaccgtagggaataccttccagcgtacggtccagggcgcacttagcgaccagcttggcaacaatgtcgaggcatacgtcgacgacatcgttgtcaaaaccaagacatgcgactcattgattgccaatctgcggcaaacgttcgacaacctccgacgatatcgcctcatgctcaatccagagaagtgcacgttcggagtaccgtcgggcaagctactcggattcctcgtttctggcagaggaatagaagcaaaccccaagaagatcaaggcaatcgagaacatgaagtcgcccacaagactcaagtaggtacaaaagctaaccggatgcatggcggcactgagcaggttcgttgctaggatgggagaacgaggacaacctttcttcgctctgctgaagaaacaagacaaatttgtatggacacaggaagccgacgaggcatttgttgcactcaagcgctacctatcaaaccccctgtacttgt

SEQ ID NO: 50354 - DNA, 6660 bp, Oryza sativa
attacgttagcgaagctctccacgacgcaaagacaagatacccacagatccaaaagctgctttacacggtcatcatgacatcaaggaagctacgccactactttcaagcccacagagtcacagttgtctcctttttccctcttggcaaagttgtgagaaacaaagatgttgtcggccgcattgcgaaatgggtagtcgagctgagccagtttgatgtccactttgtgccacgaacagccatcaagtcccagatactcgccgatttcgttgccaattggactatgccggataacaagttagacaaccaagtcgataacgaaacatggacaatggcgttcgatggcgcactcaacagccaaggagcaggggcaggatttatcttgacgtctccttctgaagatcaattcaagcatgcaatccacctcaacttcagggcgaccaataacacagcagaatacgaaggactactcgctgggataagagctgcagctgcacttggagtcaagcgactaatcgtcaaaggggactccgagctagtcgcgaaccaggtgcacaaagattataaatgctctaaccccgagttatccaagtatcttgcagaagtcaggaagctagagaaaaggttcgatgcgatcgaggtccgacacgtctaccgcaaggacaacattgagccagacgacctagcacaacgtgcgttcagacgagaatcgctcgagcctggcacttttctcgacatcctgacgaagccatcagtgaaagaggttagcggcgaagttagcccggacacccccgacatcgagaccacagacgactggcgcatcccactaatcaaattcatcaacatcgaggagttgcccgaggacgatacagaggccgagaaaataacccgtaaagcaaagatctactgtatggtcggcaacgatctatacaagaaagcgccaaacggggtacttctcaaatgcgtctcgtccgacgacggcagacacctcctcctcggtatacatgaaggcatatgtgggtcacacgccgccggtcggacattggttgggaaagcttttcgacaaggctttttctggccaaccgctcttaaagatgcatgcgacatggtccagcgatgcgaagcctgtcaattccacagtaaacacacaaagctacccgcgcaagcgctccagactatccctctaacttggtcgttctcgtgctgggggctagatatacttgggccattcccacgagggcagggcggctacagattcctattcgtggcgatcgacaagttcaccaaatggatcgaagcagtacccacgggggaaatcaaggccgacaacgccatcaaattcatcaaagggatattttgcagatacggactaccgcaccgcatcataactgacaacggctcccagttcatcagcgccgatttccaggattactgcatcgggctgggggtcaaaatatgcttcgcctcggtctctcaccctcaaagcaacagacaagtcgagagggcaaacggcatagtactacaagggataaaaacccacgtctacgacagactcatgtcacacgacaaaaaatgggttgaagaaatcccatcagtactatgggccatacgcaccacaccgacaacgtctaacaaggaaacacccttcttcctcgtgtacggctctgaggctatgctccccggcgagctacgacatcagagtacatgagtacagaagcactccgacgaggaccagggggaacagcgggacatcgatgtaaatcttctcgaggagcatcgtgaacgggttgccgtccgagcagccagctatcaacaggccctccgccgttaccacgagaagcacatccgagcacgcatactttcgatcggcgactacgtcctccgacgagttcaaagccaagcagggcgaaacaaaccctcaccaaaatgggaaggaccttacacgatcacacaagtcttgcggctaggcgcattcaaaatcgcagacggcgacggtcgcgagttagcaaattcttggaacattgaccaactacgtaaattctacgtatgagtcaataccatccatacctgtaagacatcttacagtatcaatgaagcctatttttaggcccatattacaaccaaagtgttttcgcccgatgatcccttaccctgatgacacctagcgttgaaacctgtccttatgtccctttacgccgtcttggcaaggcctccgaggaacctaagggatcttcggctggggacgcccagagccgataaggtcttgtcagatcctgtagagacgaaagaccatgtaagatctggtcgtgtaagagttctcgccgtgcgtattaaccaagccgtgaaatcggaaatcaactttccaacttcacggctgggggctaggatcagagcttatttaaccaaggcgggtcaaaggtccaagagccttatcctccgagaaaattccttcgacgacaaggctgggggctagggagagtgtgcgactcaaacggctgactaaagtcgttaactgagaacgcactcttacacacgacatccagagtaagagacatttgttaaagatagatttctttactatttcacacaatacttcttacagtttttacacaaatcttttctacattacatctttttcctaagatatttgtcacagggtacgaaaactaccaagaaggccaacgccagtccatagactggaagatcttctcggccaacggcgacatcgacctcgccagatggtctatctccgtcggagtcctccgagaacgagcaaaaccctcatggagaaattcgaggtccaagcgcgggcgatgatctcgtaggcaagccaacacgtgccctccggcgtatcggcttgatcgacgacactcctgcttcaaggcctcgtcgatacgcttgccgatgccatcgagttgggcacaggccccgttctgccacgagatgtacccggccgccgactcctcaggatctccgcggaccactcgaagttctgtacagactctggccatggatgtgcagcaactcttcaagtacgagttaaaccacacctcatgacctcggagcgtttccacagcctgctctttcttcatggccagcatggttctctcgagttccgccacttcaaacttcatcttccagtattggatacgacgatcttggctagcaagggcaccctctaggtcggcataatttgataaccactaagtcaagctgtacgcctctttcgagaacatggctgatctagtcgggagggcatcaaggggtgaagggactactaacctaaggaagtcgtcgttatccctgtctccgtatcaagggtctgatccacattgtcgggcgacacgtgtggttcaaactcgagtaccggaattatcgccagtgactcgggctgcccgcgctgctggacatcctcgtcatcagcatctctacaaaggacaagagttcccgaggtcaacatacaaaagtaaactaggatgataattgcccgcacgaaggtggtcagaattcaggttttacaaattgtgccttggaagtacaagaagtcctactcttcaaatagggggagaacagactcccccaaatcaccgacttcttccatcacctccctccgcgtgtcactagccgccccatgatccaagatctcgcgcagatcgagttcaggacgcgacagctttacacacgcgaggacatgacacgccccggtgtagatcccgttcgacgtctcctccatgatcctggctgcatgcttggaggggatctcccccatcgccgtcgccagttccgcaagggaggaggtcagcgagaactcgtcgggattcaccgggatcgtaaacttgatgccgcactccccggcgagctggtgcaggccagtgtaggtgacccgcaacgagccccggatctccgacaggttgttcccgagatccgacatgcggtcctcgagccccttccgttgtcgctcgttgccggccaccaattccctcatcttcgtgaggtcttcacgagcttcagccaactcgcgcaccagccgatcagcacgcgcgttcgccagcgctgcttccgacctcgcctccacaatctcgcagccgatgccgcgagcacccgcttcgaggaggcgcccatcttgacttggagctcctcccaggtgaggatggcagctggtggatcatgacctgccgcgggatcgctgactggaccgctgggcgtcgcctctcggctcccggctgcgggcacgacatccgtcgaggccgcggcaggcgacgcgctggaagtccctccggacttagcttgcgcagcctttgcccgcgcctccctacgggacgaccacgggtcacacaacgcttgtatagaatcacggaaatctaaaaattcatctacttacttctcgccgatcgtcacaatatgttgtcgtcgtgctggtgggggtgacgtgtccgaggcctgaaagacattcaatgcaaagtaaggcaaaatccttctggctgcacaatctgacgataggataaattaccgagggggtcggcgccttgcgacgatgtccgcttacagaggagaacttcctcccctttgtcggaacattgccaccactagtggtggcagcagcagcatcagacgcctccttggcgaccttctctttcagagacgccgccacctgatggtccatgagtggctcgatgatgtcagtcagaggaagagcatacgcttaatcaagtcataaggtgatctcgaaggaaaaatccgcgatgcttatcggatgcacttatgttgatagcatcatcacgctcagccgcccccttttcacagaggggcgtggggatgttgctcgccgttgtcggaccgctgatcatcacctggccgacacggcactccacggcctcgatgtttagacctgtgaatcgagaaccaaatttcgatgagtcgataggaacgcgaacataagcatgtcaggataaatgtgagaaagataccccgaggagaaaccctggtcgcgtcctccggtccggaatagttataagctggataggcccgagcctggagcgactggatccgcttattaacgaagtctgcaacgacttcataccccgacaagccccgtactcggagatcatcgatgatgtcgataaacgactgaagagagggggtcaaggggggctttgcggtccaagaagaaatcttgtccggttgttctttgggaacaacaaagacggggttcgaatctttgatctcaaggtagaaccacctattccgccatttgctgcgagaagaagggcactggaaggggatataacgcgacttcaggccttcccgaagtcggaacccgacgcaaccagataccctgttggattccatccaacgcagttcatagtaagagcgaaagagatcaagaaaaggctctaccccaatgtaggcctcgcaaagatgggcaaagatgctaagaaaggcaatggaattggggttcaaatggagaagagaaagaccatagaaattcaaaaccaggagaagaaactcggaaggtggagtgagaagactgcagagaacataatcttcgatcgcaaccatgcgacccaagatgggctggggattagtacctcctgtttccctctccatggttccatggccaggaagggcgccgtattcctgaagcttcttcagcgacgcactggtggaagatgacttgccgaggttgattgctgattcaagatcgccggagaaagggcctaggttgatgaacgcttacaggtggaatgttttcaggtggaatgttttcaacacggttggcagacttcaaaatggatctccaaaattcctttaaataggcgcactaccgacggtgcgaattccaaggacagagagagatgcccgccggaaatttctgggtccgttatgcgcggcggttttttggacttcaatttaaaattcgctcatgaccgttgggctttgaatggcatgctcggctacggcctgtctccgcggtcctcgctccaggaatgacaacagtctcgacacccgaagtcgtgaatggttacacgagcccatttttaagcagaagtcgggggctactgtcagggttacgggttaggcataccctttacccttcgatatatgtaacatatcggtatggtatacccgcgcgcatacagatacttcctgtatattctatggaaatccttcacggaatctacggatgggaagaatcctactcggacaagactgggtcattaacgtatcgaatagggtctgatatctcctagttctacttggagacctccagatctgtgatataaaagggaccccccggtgagggcttaaggcatcgaatctcagagccaacacaacccacacagcctacgaagccggagcctgcaaggagccaagccatcgagatctagtcgaaccaacttgactacgatctcgccggatccgacaagttccattgttccctttgtaacctgtgttttccaccatataatcccatatcaactggattagggctattacctaccaaggggcctgaaccagtataatcctcgtcttttgttgcttgatatcgtattacgtagatccttgtaccaacgtaccccaataccctctatatccggtctacgggtaccacccgtcgacaaaatcaatctagggtttgcctcctactttgtgctgcgccg

SEQ ID NO: 50355 - DNA, 3508 bp, Oryza sativa
ttccagcaccgctctagccacagcggccatgtcgggctcagaatggggcaagaaagatgaagaagggggcggccgtgggagtgggaactagttacgtgactgggcgggctcaagtgaggctgtcttaggcgaggcgggcgtcatccactgccgtccctcttcctctcctcccccggaggtatatggacaccggcgaggcgagcctcaccgctcctcatcccttcctcccgcctccacccactcctcctctttctccgcctcctcctcggccgtggctatggcagccgacgtccagccttcatgtcctgcgccgcagaccaccgcctgcccctgcgccactcacctgcgctcgtgctcgcctccttctccaccacgctcacctcgccgtagcctcgccttgcaatgcctcccccgccaccgcgctcgtgttgcctcgccgctgcctccgccgtcgccctaaagaagagagagagggagtgagagattgggaaagagatagaggagagacaaactgacaggtggggccacctatttttttataaatgaattgctgactagactgccatgtaggatcaaaaccaccgcggattgagccggaggggttatttgtccggtttacaagatgaagaatgtccgattttgtggattggggggtaattcggtagagcgcgatagttcgggggaggggtaattcatacttttcccccacatatatgaaacattgagtaccaacaagcgaaactagagaagtaatacgagagatacaatatacttgaaaaagcacaatattgttgaaatattttttttacatgaatattaagttgtagctattgaaaccctacaaaatgcttaccaaaacattgcaagaacacggcatgcaacatttgcaaattaactagtgaaacatcatacgtatactagttgaaacattcacataaaacatgtgcaacatttaaaaaatacattaacaagctaaatattatttttattgaaatactacaatatgtggtattgttctaaagatttaattgcaaaaaatttagcggtgtaattatattatagattgaacaagtaatttaagagaaaaaataatttaaggattgctaaaaataggtataccaacccaactaaccatggttatttttactagtagtgaatttagcatacatgtatctagtagtgactaattacatatggagctccgtaggatgtagctccgccaggtctccataaccgtttgctggttgagcgacggaggctgaggagtgaggcaggtcgcgtcatcataattggtagtgctaactatatatcggacaacggtcagtcaaaatagctaggtccgcttattcagtccaactatttgtggtagcaccaatagtacccattattatgccgtgtttagtttccgtcctattcccaactttcgatcacataatatcacatcaaaaactttcctatacacataaactttcaacttgtttttcaaactcctaactttcttcaaactttcaacttttttcaggaactaaacacacccttacactggtagagaaagtgtcttttctccccccttatactcctggttttgcaaccggaagtatgaatccgggactaaagatgagtatctttaatcccagatcaaataaccgggtcaaaatcaatttttagtcccggttagtgttcccaaccaggactaaaaatgctagagctagaactggcgacgcgcagtttttttaattgttttttttctcatattgatttcactaatcactacatcacctaatcatccccaaatagagaaatccccaagtcatccccacatcacatctccaaaatcacagatcaaattcatcataaattctaaaaaaattacatcacaaattctggaaaaacaatcacaaatatatcacatattcacaacacagatcacatcacaaattctcaaaaaaatactacaaatcctaaaaaaaagaaaacaaattccgaagagctctgtgcctccccagccaccgttgctccaccgccgccgccggatctagtggaagggagcgcgggcgccgccgccgaccccgcccgcccggccagccgccgccgctcccgcccgatccagcgcccgctcccgctcctgctcacccggccggccgccgctgctcccgcccaccggcctgccgccgccgctcctgcccgatccagcgcagcagcgctcgcccgccgccgctctcgacttgccgccgccgccgaccccaaccggccgctgctgaccatagaggtcgtggtaggaggaggaggcggggagggggaggagaggggaacggggaggaaggagagaggagagagggatcagagagagacgattgagatgggatcgaggctggatagtggagatggttttaatgagagaggaagtggagatggtttttatcggtcttattgataagaccgagagagagaggactcggcgcgcgctcgggaggatttttgtcctagttggtataaagaaccgggactaaagatctatttttagtcccggttgtttataccaaccgggactaaagataattggggtccaactcgacctgataacttctttaaatcgggactaaaaatgatctttagtcccggttcctattcgaactgggactattgtgatttttaggcgaccgatcaaagatggtttctccagtagtgttaatcttctagctacaacttccactattgctgcagagaagctgcaaagccagcaatctctcctgaatacatccacaaaaatacaaatacacaattttatgatttgtataatgatatttattgataattatttagagccaataacatgacaattagagtttagtctactaaccctacacccgctagagatacatatacatttatatgaccacacttgattaggtttattatggtgaaaatacatgattttcacatgccttaaactggtgtccaataaatgaagattaagtaaggacacaaaatggaaaaaaagtaattagcacaagattaattgagttttaattattataaacttgaaaaatagatttatttagtattttagatcaacttttacaagaaaaaaatcatacgaaacacaccattcagtagagcagtttgaaaatcgtgccgatgaaaatcgagaaaaaatttgcatgtcaatgaaaaaagaacggggcttagaggtcgtgtagtgtggttgaccccatgcaaaaacatgctttgaccaactatataagaatagtttctacagtagtgcagtacgaactaacacattgtaccccatacgtgtacaaaacaatttagtctcaccacacacttataccttatacgtactaaacaatttagtctcatcacacattgtaccgtaccccatacatactaacgtgtacaaacccaataggacagggctattattgcctgaacctgtataatttttttctcatgcacatataagctggtcaatgcagtgcagtatcaattgtctttacataaatatgat

SEQ ID NO: 50356 - DNA, 1782 bp, Oryza sativa
ctcgcatgaagtacgagtgttcagtattgtgaaaatgccaagttcagttcctggaactctgaaccagtgaaccttgtgaaactcaaatgaagtggaagtgtggaactctgaaccttctttagtgttgtacgcagtggttattcagatcttgtctgtggaatataggatttgttaggaatttatgtcagacatgtattcagaactttctgatgatgactgttcttcaagctccttgttccgttttagttggagtattgttcttgaaaaggctcttttgtaaacctttctgtaattagttgtggttcagcgcataacgatgcaattagcttgcaaacaaatgtctggtttgcaggacttctaacttcttgccatgaggcctctgaaattcgtggatttatattggcttctctagatgagcttctcgagtgaaaagctttgtctgcttcaagtttcctggtggcctcaccgtagccctagctgccaatcgccctggcgctatttgaccttgcagctgccggcgcccttgcgatgcccgtcctcgctctggtggaatgggtaggagggactagaattaatgcggcgccgtcaggatcgaaccgggaggagggaggaagcgggagcactgacgggagggaaccacgaagtcgccggcgttccccatcggcccacctcccccgaggtcactgccgcccggaagaccaccacattggttgtctcaggctcgtcgccgtgttcgcctatacggtttctgttcgatttgatagtcgatgagtagacgactgcatcggacagatggtgctccgctccaacttgattcctgcatgcgaaagtacaaaattgccctcccaccatcaacaacattccgtacctgcttttgcgggagatgtggtaccgctaggtaccaagccttcctaggccgttagattgagtggaatggatggctaggatatggtacctcctccaatcaaggacagtaaaaagcctcttttaggtaacattgtaacacctaaattaaattaaatagcaagaaaaaatcatacaaacaagaaaaatcctacgttcctaatctttcttagaactaatcaaggaggaagtaagaaggctgcctgctatgttgtgcctctggtcctgcactgctgtgcttgctttgattgctgcgagatgggatcactggataaacaaaggaaagaagtactcccttcgtactcataacgaaagtcgttttggacagcgacacggtctctacaacacaattttgacttctcgtttctataaaaatatttgttgaaaagtgatatatgtatacttttatgaaagtatttttcaaaacaaatctattcctataacttttacattttcaaattcaacaatttaaaagttattcaagatttatatttccaaggtttgacttaaacattatcctgaacgacttccttaacgggtatagagggagtattgttattagtaaggtgagccattttaataatttggaatagaaaatgagccggaaaattattttggggctaagtgctctgaaaaaatagttcagaaagtaaaatgaaattctttttttagaaccgtaatacttgacacagattagagcggcataattccgcagctttttccttcaattatttctccacttatttaacagagaagctacaacatggcttgttgtgtttgacatatataattacgatattagcattactagtgacttgtataacggtgattaggagatgtaacacaagaaagaaggctgagcaggtggctgaaattctg

SEQ ID NO: 50357 - DNA, 1470 bp, Oryza sativa
cccataccagcagcgtcgccaccgtttcgccgccgccgctgaagaggtcctgcatatgaaagatggggggtcattgaatagactataggaatatgtggaagaaacaatagtgaggaagagtgcacaagcatgagcattctgtagttgcatgctcgtggtgtcttagtatcttcaccatgcaacttttagaaacaattatgtaattagaatataatgatagtacatgtaactataatgtaatttatttgtaactttcacgtaattttgaactgttggatttttttcaagatttatgtaagtgggaaagaaaaaaaggcacaacgcacacacgtgtgagaatataatgatagtactctctctattccataatataaagcacatctattttttttaatgttccataatataaagcatgcatgcatgcatacaattaactaggacctattctccattaaattattaattttttaaatcatccaccctcaagatctctaattctattggatacatgcattatatttattagggtgatctaaactaggagatgataataatggtttcttggtctttgggttgagggtggttgtgtcttatattttgaaatggagggagtatcatgttatggagggctttttctaaagttacatacaagtttaatgtagttgtggttatagtttaattacattatgattgtatattataattacaactgtccaatttttgaaaaaaaaaattgtagacaaaagtataggtgatttcttgtactccatccattccatactataagacataactactttttttttataatataagacatgcatgcatacaattaacttagtatattccctccaccaaattattattatttaactctttcatattcaagatttctaattctattggatcgttgtgccttatattttaaaatgaatggggtaactttttgcatgacataaggttggacatctacttaagtgattaattagagttcccgtatcttcaaccgggcacaaaagcgaaaaggctggtgagtgaatgttctacgctttacttctcttggcaccaaataaaccatcggtagatagcagtgatttacactttcgctttcattgaaaatttcggtatttcagcggcaaccgaaatttctgaaaatggggttttttgccgaaattattggaaaatataatattttttcataaatttgaataaattttgaccaagttcacaaaatattgaaaaaaaaatcggcaatatatgtgcttgtcggtggggggcaaaattactgaaattttgaaaatttcgttctgaaattgcaagccctctgtccatatgtcatagtgtcatgctccgtggcaagttgcaggttcctgttcttcataagaaatcacatgaaggcagttgatgaataaaatttaaaaatataccttttttttcataatttgcgtttttatatattgggaggaggat

SEQ ID NO: 50358 - DNA, 2068 bp, Oryza sativa
ttttaaatttcaaagatagattaatatgattttttaaagcaacttttctataaattttttttttgcaaaaaacacaccgtttagttgtttaggaagcgtgcgcgtggaaaacgaggtgttatctcctcgatgttacccgaacgaacgcagcctaagattattacccacattgggccaaaaagtaaacacacccaacaaacagcagaactagacattttcaagacactactacattgttgtcgcaaaaacggcacataagccactgctattccacttcctcctcgccttgagctagcttcttcttcaccgtcctgaccgccttcatcttggttcgtcctctctttccaagcccctgattctggcaagcagcaagttcttgaaaaagtctacctctccattgatcttcatcgatccagcggcctccactgttgcatcaaattcaccaccttgtcagcaatgctacaaatgttcataatgtatttagagatttactccggtccagtaaaaagtacctcgaggtacttagaatttcacagtatccaatctttttcgatggttgaatataacaatacctatcctgcacagttagatccaacgatcggaaacaatttagtaccgtgaagtaccggtacctcgagatactttttattggaccggagcaagtctcatatatttatcattgaaaactaaatcatttctcataagccaaatggcccaacaagctgcagaaacaaggcaaatacagctaggttgctcttctctccagggtccttcaaatttctgagcaagtcagctctgccctttgcttcgaggtacagagctctagtttaatactccatccgtttcacaatgtaagtcattttagcatttttcatattcatattaatgttaataaatctagatagatatatatgtctaaatttattaacataaatatgaatatggaaaatgttagaataacttacattgtaaaacggaggaagtatatctctcgcacagcaccatataaatcttgctggagcacatctaaacatcacatggtctacttcaatttctccacaaagtgtacagagttggtttcccagccaattcattttcttgagttgcttagcagcttgaaatctccctatcagcattagccatataaaaattttgattttcagggctattggagtttttcatatttctcaaccccccccccccccccaaaaaaaagtctattccttatacgtacaaggatttgactgagaatttgccccatttttttagtttccatttcatctcatctctgttagtactataattgagttgcacttcctgtagcaattccgggccttccattcctctagtttctcagctgatattgttagcaccggtagcaattttggtctcggtctgttctcttgtcagttagcatgatcaatggaaaattttcctaaatgttcctatcaatcgagaggaagatcatgggcttatttttgataatatataattcctgctgtgttgtcttagaagacattcttcaataatgatctttctctcctttaccgagtaaatttagatgagagagatctcttctttcctcttgttaaatatgtagtaactcttttttaatagtctattttaatataattttttatttactgtgcggcttcccctacagtattttttttaaaaaaagttgatcttaactggtacattaatgcggttcagaaaaagaaaacaagtgcttcattaaaacacgtatgctggcccatacggtttagaaaaagacatatataatcatgtttgcctagtgattcttgatggagaagaaagagaaagaataggacggatggatatgtggccctcacagttgtctaactagaccctctcgttattgaatctcttttgtggatttaattttttagaacgtgccaatttcatccaattttatatagcatgaaagttatatgcatttgaaatagttgtacaaaaattaaaagaaaactaaggtaagacattgtgagagtcgttttatccccggtaggtctcaggttttggtctctcatttacctttgctgcgaat

SEQ ID NO: 50359 - DNA, 17762 bp, Oryza sativa
ccctccgtgttgccaccactgtggcatgtggtggttgctgccgccacactcccatccttctgtcgaatctaggagggagggagggaggggaggggagccacgccacctgctttgagaagggtggagggtgaggtgaaggagagggaaagagaggtgggagagggaacgaattggtgggagagccattttgataattaggagtgtgaaataagcggaaaattattttgggggctaagtgctctggaaaaatagttcagaaagtaaaatggacttcttttttttacacccgtagtcggacaaaacatgagagatttgtgcggcataattccacggcttttctccttcaattctttctccacttatttaacagcgaggctacaacatggcttgttgtgtttgacatatataattgcgatattagtgttactggtgacttgtataacggtgattaggagatgtaacacaagaaagaaggctgagcagatggctgaaattctggcaacggcgtctagtagacgccgggcacgggcatgcggaggacggggcgtagcaggaggtcgcccttgcggcgcgccgtgatgcccaacgtctcggtcatgtccagcttggcagggtcggccatgtcgggcacctcccagtcgaagtggaaaagcagactggcgagcgtgagctcaatgttggcgagcgcaaacgccatcccggggcacatccgccgcccggcgccgaacggaaggagctcgaagttgttgcccctcaagtcgaccgcctcggcgccatcctcgaaccgctccggccggaactcctccggcgagctgccgtcgccgctgccgccggtccagcaccgctcgtcgcggccgatcgcccaggcgttgaccagcacctgcgtgccgcgcggcacgtcgtagccgagcacctggcacggctccgagcactcgcgcggcagcagcagcggcgctggcgggtgcagccgagacgcctccttgatgacaaggtgcaggtaccggagctcgccgagcgcgcccttgccctctgacacggcgccagccagtgcgaaggctcgtcgcacctccgttgtcgccttctgcatggccattgggttccggatcagttctgccattgcccagaccagcagcgtcgccaccgtttcgccgccgccgctgaagaggtcctgcatacgaagagattggggtcattgattgaatagattataggaatatgtaggaagtggatttttgcatcactcaaatgattatgaaaaaatttgaaaaaaaaaattaagaagatgtattaacacgtgatatatcactccacaaacatgcaagtaaaaattcaacttctacatctcacaacgaaaaaaacaaatttgactctgaatatacattaactagttgcggtttaatttgtttttttcgctgcaagatgtagaaattgaatttaaacttgcatgtttgtacattattatatgacatgttaatacacctcaatttttttattaccatttgagtgacatgcaaataacgaggggatatcccctcaagggattaaaatagttttccgaatatgtatgtgctgtagtcgcccatggtgtctttatcttccccatgcaacttgttaaaataaaaactcaagtttatggcgtgatgatataatattacgtgctagtctttcttactaattttaattaatttttaaaattgaaaatttttgcatgatatataaggttggagttccactccacttaagtgtgaatgccccatgctttccttttgttggcacccaccaaataaaccatagtatatcggtacgtaaaatctaaaccgagtttagaataggcagctacagatcggacgtccgatgaaacctatggcatcagacgcccgcctgtgatgactccattcgcagctgcacatacaggttttgtgggcccatgcgctactaccatactacacactacacctctagaagtattaattagtgcagcaagcaaggtgacatgctacatctattcaacatcttctctaaaacaacctttaacaaacctttaagcatcctttacttgtaaacaaattatcttatgtaatattcaattgcatcatcatatatattatagttaagtctttaaatcaagatctcacatgattatatttctaatatataaaattatttttctaattgacacattagtatataatacatgaaagtgaaacatcacatggtacttattaaaacatccaaattacataacatgcaacatttgcaataaaatagtgaaacatcacaaaatactggtgaaacatctaaataacattgcatgcaacattttataaatgaactagtgaaatatcacaaaatacatgttgaaacatccgaacaacactatgtgcaacaattaaaaaatcaattgcaacataacagtttgaaatatgcaacaatgtcgaattcggactgaaacatacacttctcacatgtgaaacatcgaaattttatggttgaaacatatatttattttagattaaaatacaatcatgtgtgatcttgtttgatagatttaattgtaatgaatataacggtataatcggattgtggattgggtaaatgaagtgaaaaaaatgtttgaagtttgaaaatatagtgtcatagatgaaatgaatataaatgatgtatcgatgcaagtgtaggtgatataacaaaataaagggtgctgcatgcacatgcctttctacgtataagagaaagggctcattagatgttgtctgtgttcgatattttgatctccatcagacgaccgaaagtaagcattctcggcttaaccagtgagggaagtactacacatgcatgccttttttctattagacatgcatgtcttttttcctctttttataaagttttctcttaaattacttatccgatctacaatccgattacaccattgtgttcattgcaattaaatcttcacaccaagatcttagatgattatattacgatgaaaaaatatttatacttttaaattacttttattatatgcgtaagttacttttatcatatatataaattacttttagatttgactgaattacttcttatacattcataatgctctaagttgattattttgttatttttttaatcaattttataatttatggactttaaatttaattttagatagaccatattttttctccctacaacgaatttacttttaatgttgtaacaacttacttcaattttgtgcttaagttacttttaggattgatataaattacttttagactttattaaatttacattcatagatacattttgtcgacgagtgatactcgtagaccagatgattagggtattggggtacgttggaacgatgaactacgtaatatgacatcaagcaaatagaagacaaggattatactggttcaggccccttatcaggtaatagccctacttcggtttatatgggattgatgatgaaaaaccacataatacaatggaagtagaccaaatcgatgataccgacgagatcgtgatcgatgtattcgacgagatctcctggcgacttggcttcgcacactccggcttcgtaggctgtgatgggtgtgttggtgatgagattcgatgccttgcacccctacctgcgggtccctttttataccgtgtaccatcttgatctccaagtaagactcggaaacatcggatcttgtacaacatactagaaactctataccttccaagtaggactttagaaatccttgactcgtagagatattttccatattttgtaatggattcctacaacgtatacgggaacaacccgtgtacatgaaggtataccatatccgtatattccataagtcgtagaataggaggtatttcttattcgtaatcatgacaaatatagttctatatggaaactataaggactactcggattgtatccatattggtctccctagttctacttggacaaagggacacctatgggtataaatagactccttaggaggagagtgggacaatcaagatagacacagaccaacaagacacaacagatcaacacacaagacaagacatgccagatatcaacatcagagattagtctagacataccccatccggtgcctacagaggccggcaagagggatctagcgtcatctctgatctcgacgagttcatacttgaggaggaagactaccttgtcgtcgactacgtgtcggttatccatgccgccaagtcgacgacagctagatatgttatcccaattattgtacttgcgtaattcagataaatgaagagcaacaccgactttggccaacaggagtagggctattacctatcagataaggggcccgaacctatataaaaatctttgtctccatacttcaatctcgtatataccctgataccaacgatccccatactatgcaaaataccgtagtcaagatctcaaatgttgacaagtacaatgatgcaaatagatcttgaaaacaatatgtgatttaaaagatataagttattaaagaggttaaatctaaaagtaatttatatatatgataaaataacttacatatataataaaagtaatttacaagataaataatttttttattagaatataatcatgtaagatcttgttataaagatttaattgtaacgatcacaacgatataatcagattatagatcggataagtgattttaaaaaaatttctataaaaagaaaaagcaagacatgcactaatgaatgtactagtagcaatcaaagtgaggtcaactgggtatgcgtgttgcgtggaggacccagtgctttttgtgcaaaaacaatgtgtgattttatttttagtaacacagtgctggtcgcggattaggactaacacgctactatgctcagtatagttgcgtccatatatcatatatagtgtcattgctccacatacggcaagttggaggttaccggcggcgacaatactttttttttaatgactcgcaccagacagtacgaaattcatattgataaagtaggaaaaaattataagattataaccttaagaatatggctgtcaacaagctgagcttgatcgaacgagcttatatgtgtaggctcgagctcgatactaactcgagccgagtctggtttgaacttcgagcataaaaacgggcgcgagctcggctcgctcgagcctcgagctttttcaattttagattttaaatagtctgtatagatgagagcatggggaatcacgacggcattggacaagtatacccaacattagggcaatagcaatgcttgaggtcttggtgaaaataaggtatgtcccaccataccctatgtccatggccacaatattgaaggcaagaatatatattaagatgggtcccacatctatgtaaataaattctattttaaggtaggttccaccatatcataatctattctcatcctctttaatgtgcatgtgtactttatctcatttttttttcttaaggttgagccataagctttatagttattttttagcatttaatatcttatggctagtgcctacaatatatatggctagtcattcttatagcacaatattgtagatgtccttagacttgtaccggaactattatcgttttaaaacatgatgtgactaataatagtaatattaatggagatgcatgcatgctaatagtactagcaggaggccagggcctgcaggcgtgaacccatgctctatttctatgcagctttttattaggagttgggagatgagtagtagttgtggtgtctctgctacaagaaaaattttaaaaatgtgagagacagtaacgccagctgaaaagaaatgttggcaacctaggctcaacgaactattcgagcttggctcgtcaagcttgcgagcttggaggaggtagacttgggctcggttcggattattcacgagtcgagcgagccaagctcgagcagctcaaaaggattcacagtttcggatcgaaatttttgaaatttcggttctatcgtacccccatacgatattattttggctgaaatttttagatttttttcatttttttcgtgaatttggtaatattttgttcaaattttgttcaaaaattcatataatttcggtctgaaataatttcggacacaccttcaaccgaaagtttgaacccttcagctcacgagcctcgggctttttggacagctatacttgggaggtcatactcaggaaaatgaaaaaaaaaacaccacccacactctgacagcatcaaaacacaaaacgcggcgacaatacttgttcttcatgagaaatcacacgaaggcatgcatgcagttggtcacttacagcgatgattaatttgatgctgtccatgtcgagcgggaactggagcccgccgccctccttgtgtatcctcagcagcgcgtccagaatgtcctcgccggcggcggacgatggagcagtcttcttctgctgcaggcgcttctcgatgaggcggtcaaggatgccaaacaccgtgtggaggttcgcctcaatctcgcgcacgccgccgctgagaaggccggcgagacgcgacgacggccacaggtccgccgccgggttgaacccgctcgcgagctccatggaacggtcgaacgcacggatgagcgcgtcgctctccttgcaccggtctcccaccacggcgcgcgacgtggagtcggtcacgagagcgcacagcgccgctcgtaactccacggcgcgcccgtccgcggcggccgcggccaccgtgcgcagcgtggcggcgacctcctcctcgcggatggcgcggaaggaggcgacgcggggcgcggagaggagctccgtggcggcgatcttcttgagctggcgccagtagtccccgtacggcgcgaaggcgatgtccctgcctcccatggtgcccgctcgcacggtggcgctcagcgcccgcgtggcgaacaccgcgtcgtgtgtcctcatcacctcctgcgccgcctccggcgacgacaccaccagcgtgggcacctcgccgagccggagcatcatgaccggcccgtggcggcgcgtaagatcgcgcatcgcgtggtgcgggagcttgccgatgaggtggtgcagactgccgatgaccggcagctgccatggccccggaggcagccgccgctgagccgtcgccgtgcggctgcacttcgtgagcagcacgccgagcagcgccacgagagccatggcgaggtagacgtaaccctgagatagtacatccgccatttttgcgtcgtgcgccatgcttgcttgagcggctagctagctttcagtttttggcagcgtgggtgtgtacatgttgaatttataagcacataacataacgatttaatttatttcatcatgatattacagagataaactagcataaacgcatcataaaatctacacatgtaaactagacagtaaagaatgaacagaccaaatatgcgtaatatgttgaacacatactgagggtatcggaaaaccggctgcttagcaggaaagactcgcggttgcgggctttaacgacggcgcgcagcacgcaagcgaaaaggaaaacaagccgttgtgatcgaacagggagcagtcgtacgaagcgcttcccataaactttattaccgccttctcccattgtatgacgtcgaaggcgaaggttccggagacctgctctcccgatcaccagcgcacgtcgacaagcggggtggagtagactacgagcgacagtgcagtatagaggaagagccaaaccctatattgatttcacgtgtattgcgtggaggctgtggtttgacttatatagagatatcaggacgcttgatcaggacgcatgtacgatctccactccacgtaactgaaccagatgagttgcgtgtaacttattcggactccacaccgtttcaccccagtgcaggacgtcgaaggcgaaggttccggagacctgcccccccatcaccgtaccggtgcacgccgacaagcgggatggagtagactacgagtgacggtgcaatacagaggaaaaagcaaaccctaaattgatttgacgtgtattgcgtggaggcggaggcttgacttttgatcaggacgcctgcacgatctctattccgtgtaaccgaaccggataagtcgcgtgtaacttatttggaccccatgccgtctcacgcaccggattattcgaactgcttccaaaaaacaaatccgaatttcccgcagcaaaacaaaactacaaaagtagaactgtttccgaaaaacaaatccgaattttccgcagcaaaacaaaactacaaaagtagactgcatctacacatgggtgatgaaccaattttgtcggaacattcgatgtgcacgtgcgccaccatgccaggtgaggcgaggagcacgtgttcaccctcttctctccgcacatgcctaaagtggctagaagagtatcatctttataaggaggtatccctctgtgtatggtggtactaaacttcccatgcacgtcatctcataaggtgtgcttttgtgattttccaaaaaaaatattctttgaatgggggtaaggtccatctattaattctatatgttggagatagctagttcaccatcgatcaaggactggatagtattttaatggtgtaaccggataagaatattcattaattatgatagttatgctttatctttatcttgaccaatttagtgagtagttgtaggttcgactcttgtgctagcgcaagatgattatatgtatatgtttgtccatctattatcttataatcttaaaaagaagccaccattctttctatgaaaacctaaaaattacacattaataggataaaacaagaaatatttatatagctaaaaaattactaaattaaccgaagaaatatatacgactaacttgtgtgttacacgacatgtgattactaaagttgttatctttaaaactctatcggtttatattaaaataaaagtccacgtcatttacagcccattaattattaattttaaattttataaataaataaaatattaaattgagagttaaagatagatctgatataccgtcaaattatagaattactaaattagagttcacgatagattcgaaggtgatgaagtatagtggttgaaacacatactccaacccaaaagtggtgaagtgcggttgttaagcgtctatttgaaagttcgtttcgcttttgctttttttttctgcacgtaaaatgagaaatgacattattatataatttattaagcattctattataaatataaaaaatatatttatttgattttcaaagaaactttatctatataaaaagtttgtgtaaaaaaatctatcatttagcaatttagaaagtgtgtggtgctgaagccaaacgaaggaatgaaagaagcctcgagcagtacagtaggatatttatttacagcttttaagaatggacgacgtgcatatatatcttcagtagagaggacgcggctgcaaaacatcatatggtgtttctccatttagcgaacaggatgagattagattggtgccggcgtcctgttgtgagttcgtcatgatcaaatcaccaatgagaaccggtttgggtcatcaatgatttggcttacgttcggcgtgatcaatgcactactgccacagaacgggctaacaataccggtttataggcctatcactactggttctctttgaaggttcacaccggtagcaattttggtctcggtcgtctgttctcttgtcagttagcatgatcaatggaaaattttcctaaatgttcctatcaatcgggaggaaaaccatgggcttatttttgatagtataattccctctgtgtagtcttagaagacattcttcaataatgatctttctctccttttccgagtaaatttagatgggagagatctcttatttcctcttgttaaatactactacgtagtatgtgtaactctttttaaattgtcctattttaatatactttttactgtggtagcttcttctacagtttttttttaaaaaagttgatgttgtatctttttttttaattttcctattttaatataatttttgatgtggggcttcctctacagtgttttttaaagttgatcttaactggtaattaatgcggtttagaaaaagaaaacaagtgcttcattaaaccatgtatgttggcccatacggtttagaagaagacatatacaatcatgtttcctcagtgattcttcacgaagagtcgtgatggtgaagaaagagaaataatacgacggatggatatgtggccctcccagtttcctaagtacatcctctcgttatcgaatctcttttgtggttttatttttttacgaatcgacgtttaaaacgtgccaattttgtccaatttcatttaatatagcatgaaagttccatgcattaattaaaatagttgtacaaatattaagagaaaattaagataagaattgtgagagtcgttttgtccctgctagggcttaggttttggtctctcactgacctttgcagtgaggaaaatcactgagagttctccgcgctaaaacaccctttggatccttccttttcatatctcccaagtcactagtagatatacgaatgataagattttcaaccatcaaaacaatggatttaatattctaaagtataataaataaagataattctaaagatcatacttaggttgaaataaaaaaaatacgggaaagagggaaggaacaaaataatctccatttttccatcaagtatgaccaattttagggttattgtataaaacctctaatttaaagtcccaagccattttcaacttcactttaattctagccttgaataagttcacttcaggtctctcatcttgttccttttcaccagcagatcctgctctaaccacaccacgtttcattatcgtctaataccgtattattgttaggtcatgtggactttgtcacaatgtttctcacccctttggcccctcccactgtatggcgttgtctcttgccctctcccctcataggttcctccaccgtgccaagcctagctatattccgtggcctaagctcacggggctccgacttgaccattcaaagcttaggctattcaaatttaaaagatttgcctctagtactctctccatttacttttgataggtatatttccaaatctaaaaattttgtgtttgatatgcatatttcaatccaaccacctatatcatcttaatgactttgtcgaatttgatgactctccatacttccgtgcaaaattggtgggcatcgagaaatgtaaatattgataaatcgcttgtttataaggaataactagtagcatgtttaaatggatgatatacttatccttagtaattgtgccaagataaaatataactatcaaaaatagatagagagagtatctaaaaccgatgtcatgttccttccatcccttcctcccatcacgtgtagcacgtccatatgttccgtgtgcgtaactacttctgtcaaataagtatgggcatattactattacatgtttgaacttgttggagagttaaaaagtaagagcatattcagtaaagcaccctaaactaaacactcatacaatttttgtttttgtgtgtgtggatgtgaagaaacgaggtccatacggacctctaatatacggccaaaaataagaaggcccccaaatcaactcgtatatcctatagacctgcggactccacatgcaggctgcagcccccaatcgtcttattttctttggcgaggaaaaattcttgatctcgcgtgccatcccatccttcctcagtcacgcgccatcgtcgtccttacactttatcctccagctagcaacttcagcatggcatgaactgatcaccattagttttctttccctgtagtagcaggctagcagctagctacatgcatgacgatcacctttcactttctttgtattgttagtatttgttactccatccctatctaaatataagggattttagttggacgtggcacattgttatattaggatgtgtcacgtccaaccaaaatcccttatatttagagatggatggagtatattgtcttattgacatgtagcatataatcctgtggcatacgtggcacttatcagatcatttagaaacaggagaagtggttgggtagttgacttatcactcatttatagctagcaatcatgatatagtctcaaacaaaaatcatgcatgtgtacgctacctttcagaaaatatataatattccctccgacttataatataagagattttagagaaatgtgctacatactttgttcagattcatagtattatgatgtgtctctctaaaatcccttatattatgggacagagggagtatatattaccatgcacgtatatgcggtttagagagagagaaaagagagggattaactatttttcaggatgatcttgattgaattgaaaaggaaatataattaattaattccatcttttgaccaattctcacttaatttaatatattaattgtgttatgaaaatagatgtacaacggaggcacgaatttttacgtggaaaacacttgcgggaaaaaaccacgggcgccgaccggcaatgatcactatagaggagatgattacaaacgtaggggaatcacaatgggaacgccaccccttccgtacggcttacaagagtatatataggggataaaagaaagacacctaataggactcctactaggaaactaatccgaatatattgtgggcccaaaattcggatcacatatttaacaatctccaccttgagacgaatttcctcttgtagcataaaaacatcaatcaccaaaaatacctcatgtaggtaaaatcaccgcgcgccaaatagtctctaagactatactataacacccaccaagcttgagcaaagctcaaacttagtagcaggaactggctttgtcatcatatcagctgggttatcatgagtacttattttgcataccttgacatcaccttcggcaatcacacctcaaataaagtgatatctcacatcaatgtgctttgttctctcatagaacatctgatcctttgtaaggcatattgcactttgactatcacaaaatatattaatgcaagacgtaactccacaaagctcagtgtacaaacctctaagccaaatagcttctttacaagcttcagaaatagccatatactctgcttcagtagtaaataaggcaacagttgcttgcaaacttgccttccaactaacagcacatcctccaatagtgaaaacataacctgtgagcgatcttctcctatccaaatctccagcaaaatctgaatccacataaccaacaagtccatctctagatctcccaaactgcaaacaagcactagatgtaccacgtaggtatctaaaaatccattgaacagctttccaatgctctttgccaggattagctatgtatctactgacaacactcaatgcatgtgataagtcaggacgacaacataccatggcatacataagtgaaccaactgcacttgaataaggaactctagacatgtactcaatatcataatctgactgtggacataaatctgaagataatctgaaatgtgcagctaaaggagtactcactggttttgcatcatgcatattgaaacgatgaagaactttttcaatataacatttctgactaagatataacttgccagaatgtctttctctagtaatttccataccgagaattttcttcgctgcacccaaatccttcatctcaaattcactactcaattgtgtcttcaactttgctatctctgatttatcttttgcagcaatcaacatatcatcgacataaagaagcaaatatatagctgaaccatcaacaactttgagataaacacagctatcataattggatcttctaaacttctgagaaagcatgaaagagtcaaatctcttataccactgtctaggtgactgcttcaacccataaagagatttcttcaacctacagactaggttctcttttccaggaacaacaaaaccttcaggttgctccatataaatgtcctcttctaactccccatgtaaaaatgcagtcttaacatccatttgctctagttcataatcatgcattgcaacaatactaagtaaagtgcgaattgaactatgcttcacaacaggggaaaagacatcattgaaatcaatacctggaatctggctataacctttagcaactagccttgctttgtatcttgcctcatcacttggagacataccttcctttcttttgaagatccacttgcaacggataggtttcttctcctttggcaacttcaccaattcccaagtatgattcttttcaagtgattccatctcatcatgcatagcagttatccatctattgcaatcatcagaaacaatagcctcagaatatgtagaaggttcggcattaccttcaatttcttctgccacactcaaagcataagcaactatgttcgcttcttcaatatatcttcgaggaggtttaatatttcttttgggcttatcttttgcaatagaacgttttggagactgatgaacaatagaagaatctgaatcttcaataacaggtgcatcttggttaatagcaacatcttctttttctggtgcatgccctgaactgatcaagtgctccacctcacacttgctttctcctgactctcaacaggaacattagtagaaggtttgtcatgtaatatacctgattcatggaagacaacatttctactaatcacaacctttttggtttcaggacaccataacttatagcctttcacaccagacggataaccaagaaaaatgcacttaatagctctaggctccaatttaccattatcaacatgagcataagcagtacaaccaaatactcttaagtctgaataatttgctggggaactagaccatacctcaattggagtcttcttatcaatggcataactgggtgatcgattgataagataacaagcagtagaaacagcttccacccaaaattgtttaggcaaacctgcattagacaacatacaacgggcctttgatataattgtcctgttcatacgctcagctacgccgttttgttgaggtgtgtgaggaacggtgtagtgacgcacaatgccttcagacttgcaatatgatttaaatatcttagaacagaactccatcccattgtcagtacgaaggattttcaccttcctctcagtttgtctttcaaccatagttttccactctttaaacacatcaaaagcttgatatttgtgcttcaagaaataaggccaaacttttcgcaaataatcatcaacgatagtcatcatgtaacgagcacctccaaaagatgtcttacgagcaggcccccataaatcagaatgcacataatcaagaataccttcagtagtatgtgtagatgtgttgaacttcaccctcttatgcttgccaaatatgcaatgctcacaaaatttgagcttctcgatgctttgtccatctagcaatcctcgcttgctcaattctgccaaaccaatttcactcatatgcccaagacgcatatgccaaagattagtagcatcggaattagataatgaattagaaactgctgcaacattacctaatatagttgtacctcgcagatggtacatgttggcaaatttaatatcagctttcatcacaacaagagagcctttagttaccttcaaaattccgtctccaccggaatatttgtaccctttgcgatcaagagtacataaagagatgagacttctcttcaaatttggaatatgccgcacatctgacaatgttctgatacagccatcaaacatcttgatctgaactgttccaatacctgcaacctcgcatggtgtatcatcacccatcaaaacagtaccaccttgcaaagcttcataggtggcaaaccaatccctattcgggcacatgtgataggtgcatgcagtatcaagaatccacttgtcactagtttgtgcacaaccagcataagcaacaagcaattctgcatcagacttctcatcagtaacaactgtggctttaccttcctcttctttcttaccttttggtatatactttccggttctcttgtctttgtcctgtagcttccaacactcagagatatcatgtccatctctcttgcagtatttgcatgacttatacctgcctctggactttgatctcccacggtagctacttgagcttttatctcttgattggttctttgtgttcttctcctgttgcctgccccgaacaaccaagccttctgcttgtgaatttgaaccttcagaggttaccatcttcttcatcttttctttggcatgcaaagcatcataaacttcttttaaagttagagtatcacggctataaagtatagtatccctgaagtttgcatatgagctaggcaatgaacacaatagaataaggcctaaatcctcttcatcatactttacctccgtagactcaaggttagcaacaatttccttgaaagcggagagatggtccatcacagactcatcatcttgcaacttgtgcaaaaataacttttgcttcaggtgcatcttactggtcagctccttagtcatgcatatctgttccagcttcaaccacagcccagcggttgtctcctccttaagcacctcctgcaaaatattgttagatagatgaagatgaatatatgacatagccttacgatcccttttctttcatcgttggaccaatcctgagtcctcttgtcaaatctagaaagcgcatcatcgaggtcttgctgtgcaagaacggctcgcatcttcacttgccaaagtgagaatcttgtgtctcggtccatgagcggtagatcatacttcaaactcgccatgggaattaatcctgaatttgctggtaagaaattagggtaaaatagcaaaaacgccggaagacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaagggatctgctaaagaaacattcaaggagtcaggtccacttacttttatctttctttccaattttatggggtgggttggtttgataagacccctttttgctttgttgataaataataaaaaaagagtttttttctataacctgcttgttttattataacaagtcctagcaatttcctccctggaaaaaagcctgaacagaacagccaagctttcggctgattgttttaatcctcgtgacgcgtgcgctgcttgtagtactcctctcacgacgcctgagcggctgctgctgcggtgctgcctttttatctcgcgcaggcgtgggacgaggccgactcggagtcgacaggtaggggggtgaacagattgattcgacggaacgacgaacacgacgacgcgtgccaccgattagatcgatttcttcgatcgggaaaaatcgccggtagccgggactgcagtagatcgatcttcaatgctctgataccacttgttatgaaaatagatacacaacggagacacgaatttttacgtggaaaacacttgcgggaaaaaaccacgggcgccgaccggcaatgatcactatagaggtgatgattacaaacgtaggggaatcacaatgagaacgccaccccttcccgtacggcttacaagtatatatcggggataaaagaaagacacctaataggactcctactaggaaact

SEQ ID NO: 50360 - DNA, 1417 bp, Oryza sativa
atcaatatggcatcccttcgcgttctcaacagccagcggtaatgcagggtcagtagttctcagcgtgagggtaatctcagagtttatgcgggtctctgaggttgttgcatcgtactcctcgctagctccttgtgctgcttcctttattgtgggtaggtaagtcatccttgactggtatcaagtatcagtcatgatatgtctagggtatcatggctgataccaagtatcaggcctggtaccacggagaatcatgaatgatgcccacaaatatcagccctagtacctaggtaccaagatttgatacctaggtactagccggtacccataggtaccaggtacgaaccgagtgtgagagggagcacacgtcatcgccgctagaccgaccagtgagccccttgctgtcatctcctatcctcttctcccttcctctccttaacatgccccttcccttcccttctgttgatgtagctgacgagacaagggaaaaaataagtgcatttgctatccgcttgcacgttaaagctcagctagacataggaaaggaagagggaggagtcacttaagtatcccgtcctaactggatcctatcgtctagtcgccctctaaaaaaatgactaaggattaacaaacggataataaatactagatcggtataccgttggtcccaaggaacattttaagtgatgatatcacacagacataagtatgatgccttaaactctagtacctaccatgttgatgctgatgataccataggtaacacacttagtgccgatgataccagatacgatacctatacgtaacacatctagtacctagataccatactaacatcatgatgatgtcgacaaacatactccctccgtctcataaaaaagtaacctaggataagatgtaatattttctgatacaaataatttgtacagtaggaaatatcacatctcattttatgttggttttttatgggacgggaggagtgatcggtgaactaatatattgtgaaattaattagtgggcttggcccaaacaagaaatagcccaagcaaatagcccatgtggtcttcgtagtgaggcaccgccgtcgcctcgccctcgacccctcccgccgccgtgggtttccgcctcgttctcgagcgctctcgccgccgccgcggcgtcctcgctgcggtcttctcccttccttctcctagtctaagccgccgctgtgaagtggagctcgatctgtgccccgtgaaacttcgccgccaactccatggccgccgccgccggaggccagaccgtcggccggagcagcttctctcgagcagcggcacctcatgtggcgtcctcatccaccgccgcaggagtcaagcttggtcctaatggcgccgccttcgtctcctcgggcatccccgacctcgacagtaagcagattctt

SEQ ID NO: 50361 - DNA, 4101 bp, Oryza sativa
aaattgaagtagacaattaagattgcttggagatgaattgtccaactaatatagatgctaaaatcatgcggagttgttaaacttgtctataagaacgtcatttaggaggaagagacaaaacttattaaaaaaacatgtgaaaaacaagcaattggcacaatgccttgcccttataaggctgtgtttagatccaaagtttgaatccaaacttcagtttttttctatcatatcaacctgtcatacacacacgacttttcagtcacatcatctccaattttaaccaaaattcaaactttgcgctgaactaaacacaacctaaaactatagacagaacaccacttgagatatcaacttgtccaatccgtcaccaatttctttccactgactgatttgatgggtttttgttatccccaaactaaaggcaacaatgaaagcacattcagatgttaaataacttgtgaagtcaaacattgtggtaggtatctccagttatgttctctctagaagcaaagcaagaaccagatcgacaaagagatctactcctataacacatttactctatataagggacagtgtaatgaatccacctacaccttttttttgcaggaaaagtcttcctcagaagaaccaacagtctctatacgaaagaaacatgcagtgcatacattgcaacatgaagaggaaaaaaaaaagcgagagagagtagtagtagcaagtaaataccatgagtaaaaagagccgcttgtatttatgcgagagatgatgatgatgaggctagcttttattgtgctagatctccaagcagtgctgtccaaccatcataaacagctgcgaagggaaggggggaatcaaatgcaagcaagcaaaatgtttccataagaggccaatccaagagtaccttgtaggtccttgttcctccttttcttgcctcccccctcctgtgctctctctcctctatccgtcaccccttgaggcagacttgcagggttgctgcagtccttatttactgctcatcaatcactcatcttctcctcctttgttgatcacagaccagtagaaacaatcacttcaatcccattttcagttcagttccccttgtcatgctacctacaacttagatccagccaaactgtgaaaagaagtaaatgaaggccgtacctttgggtgcaatatatgcttgagccccagatgctgcaaatccacctcttcctgtcttttggtgtgcatccaggcatcccagccgaagaacagcaacaatcaccatgcacagacaatgctacagcttgtgaaaacatcttatctgtctaatactacaatgttcaagttcatgacatagtgttggaatatgtgttcagtaaaaaaaaagaaatttactgctaagtagtaaaactccattgtggtatatatttcagtaggattttgttggatctgcaactcctatcccaatcaatccgatcctcctcttcagcttgaacgtggcaaggacccagggggaggcaacagttgtcaggcacttaaaaacaaagagcagtgtgcttttatgctcccctgccatgaaatgtggcaagtgtgtgtgcgaggaggggaatcaaatgctacaaaaggaggagctccccagaagtagccaatgcaacagtacgaagctcctttatttgtccaccaaacccaatgtaccaccaccaccaggcggcgcatttggaagttggaacgaagcaaattctggtcctctttgaattttccattactgtatctatagccttgagttacaacgatatgtaacttcacagcaattctcaactgcaaagagaagcatgagaacataaaaatgtttctttacaccataacccagatgattttagtggatgataagcatatcatccagcattcatttcttgaatgacaggaaatatttaagctgcaaagataagcagaacatgaatgaggctggtataaaaataggtaaaaaaaaaagctcatgatgtgcaaactgcaaagcaaatcagtaataaggcacatgctgaaagcaaccgcatgtagcaatgcaatgagagttccagatgcacattttattgcagaaatggcaggtgatcacattgcggtgcataatgaagcatcattatttacaaaaggagcactcttaagttttacaacacttatgaaccgagccagggcctacctgttaaataactaaattcaaggtctcaagcactcacatcacaggcagatgtcatatggaggacttaggattgcttaaagcttacaagaaacatgtgggctagatatgtcgataatcaggaaaaaaatacgttgcttcaaatataccttaacattgtatgattgaacccctaagttcatcttgtagactgtagtgtgtgcgtgtgtgttagaaaacaacacactcttactatttctccttggttgttaatccccccgcccccgccttttttaaaggagacatagggtaattaccatttgctcaaactacagtggatctttgaacctgcatttcactcacccattggagttttcgtcaagtatgttagccttagccaaatatctttcagcaaagtttgagtttgaagttgatatgaatttgcaacaagaaacgccgggggtcttccggctagcagcacaaggtggtgggctagttagcctaggttcgaagtcttatcacccctcttaataaaattcgatatgagaccccttcctctcatatctagagtttttttttaatttgcaacctccaggatatataattatttattattaaaaacatcaaactttgaaaaacacaagaaaaacccaaatatttttaatcacatataatgctttccatttttactgtaaaataaaaaagaactaattagaaccattctcactcgctgcaagcatattaattctttttcttcaaaaaataggcaggtgttttgcctagtatattaatagaatagaaagggttttgataacagcttggaaagctcccaagctaagggtggtgataaaatctaaagcccaatgttctgataagaactcggtgcattcgtgcgccaggtagacaacaagtatgacctccctccttgatctttgcttgggagagaagcacgttaattatactgtctaaaaacgtgccttgtgcagcctttggttcttttttttttttgccgggtcggccgaaggaacggcgaccaaatttcattaagatgggggaagtacataaagttacaaattgtttcttgcttacaacgacaggaagctgtcgagatggtgctatggcaaagccacagcctttggttcttcatattcctaatgctgtttgatcaggggtatatatataactttcaaggatcagtatcctgtatcctccgtcgagcacactgtctcctatgatctttgcctctcatcctgatctgcaagagtatagcatgggaagagattgcagttaggctgcacagatcaaagtcagaagatgccataattttcatagaccaacagtgttaagatcattgttgctatgaatgccagaataggaagacataatgatcaaatgttcatggagctacagaaaacagggtactagaaggaaagaaatggtgtaccgcatggtccgcatccgcatgtattacaaattttacatttacgcataaaattaaacatttgttgaaaagagtacggatgagtcaaccaccagacattattttggtttccaaaaaagtagccacagacagagcaagccttaatacaacgggtaattccacaaagtgagactagcagatgtactagaagagaataatttctgacaaaattggcatgtacgcactcagcacttgttaacacaatcagcaatcaacactatgtaactatgttcatccaaccagttacaaagcatacaatagaaacacacctaatgaaactgtgcttgaaacttttcaggcttgaacaaattgatagagataaggatcaacagttgggagggcttgatactgcattactgcacaccattttatcagctagttttgctaacgcgaagaattcccgaagaactcgcaccctttctcttccattacacccaaatcacacctaccacctgacgatggctcgctt

SEQ ID NO: 50362 - DNA, 5315 bp, Oryza sativa
ctgcagccccctcggcggtttcaagggcggttttgctgacgtggcggtgttgacttggtcttcgtcccacgtggcgttgacgcggcactgatgtaagattagatttaaaaatatatatgtgggaccaatttgtcattcacacacaaaaattataatagaatccactgacttgtgggggtccacatgtcattctctttccaacctttatgcctccctctttctcccttatctctctctttctcttcctgtcggcgagcagcgcggagagcttgccgagggcacggatggcggagcagagggcggcgagggaacggagtggagggctccaagggagtgcgcgaagctgtgaagccgtgaggcggcggtgggtggagaaagccggcgtgaaggccgggcggagcagcggcatcgagagctgccagtcaccgcggtcgctcctgtcgcgtatcctacagcgaggcgaccgcgacggcatcggtgggaagatcgggtgccgggtgcagctgccgtggcggtacagctccacctctgtgttgatgcgatgttgttaacactccccccgccccggtagtggcggcggcggcgtgggaagttcgggtgctggatgcggctaccggcgccggccaaggtcaaggtcatcgggagggcgccggagttgtccctcgacacgccgcggagttcttgtacactcgacgaggggagaaatggtataattcttgccgtgcgcggcgccggtgcagtgccggagacgagagcgacgacacggaggaggtgactgacacgtcggcgtccttcgccgccaagacagacgacgtggcggcaagaaggccaaggacggtggcggcggcggcgcggtgctggtgacggtggatggcgacgtggagctggagatggagacgctactgaaggcgtcggcgtacatcctgggcgcggcgggcagcagcatcgtgtacatggcggtgctggacgacggcgccgtgctggcggtgcgcaggatcgatagcgacgacgcatcgcccgcggcatggcgagagggctggccttcctccacgacaagaagttcgtgcggcaacgtccggccgagcaacatcctgctcgacgccgacatggagccgctattgacggacctcagaatctaccggctcatccgcggcgggggcacgctcaagccggcagcagcggcagcgccggggcagttcgggagcaagcggtcggcgaagtgcttgccggacctgtcgccgccgggcgcgaggccgctggcggggccgccgggtccggtgacgcggcggcacagtaccaggagaggagcgagccagagctgatgctgagcagcaacaaccacaccctcgtctacacctgcgacaacgtgcggtgcagtgcccgcacagcaactacgcgctcggcttcctcgaccgcttgctctgctgtttctttttgggggatttgggggaaaagatagagagggagaagatggctgacaagtgggccctacgctttttatattttctcctatcacttacatgtgggcctcatctgtattttggtgactgggctgacacatagcacaatagaccaagtcagcatgccacgtcagcaaaaccaccctcaaaaaccacttagggagtcaatttgtaccggttttagtaattgggggagtcatcctaaccggttttctggttgaggggtacgaattagattcggtgtatatttaagggagttaaagtggactttttccttaaaggtgtagtagatatttccggcccattaggcccacgagctttcctcttcgtaggctcgcggcgtctactcctccactccaccagagcgaaactgcaaggcggcaatggaggccggagatggaagaggaggaggagcggaggaggaggaggaggagcaggtgatgagcgaggtgcacctgggatgcccgccccgcttctccgggctctacgtctcccgcttcagcttctcctcccgcccgctaggtaacagcccggtctcgcgcattccgtcgaacaccttgcctgcaccgccttcttgggcgcaacccgatgtggggggtggatggaagagccatggtttagttcgattcgatgtttgcagggccatctgcgggcagcgacggcggagaatgtagcggtgtgcgcgagcaggtcgcggcgtcgagcagttcttgtgagcgtgcgtggggctgtttcttgctatggtgtagaggactgaaaggtggtgcttgcttgaactgattcttggctttgttgggaaggtggttcgcctgacgctgttaccgtggatgaggacggggatctcgttcttgacaggagaagaaggaacagaggcagtgaggcatttgttatttttaactgcattctgtcttgccgaaattggtggtttgtgcagttaatctgaccattggcttgcagggagtgatcatgtgctcactgttcagcatggtatcacctcctctcttaggagcgttggtctccaggtctgagaaaatgctgcttttgtaattccttttcgtcttcctttttgtttacgatcacgtttgttgttggttcacaggtttggaaggcggcattgctattaactgattttgtattgcataagagctttacatcgtctgagtttaatggtgttactgccatagagatcggtgctgggacaggtgattagtcgatgtgaaattagtcaaaaagtgttcccagaatcatgatttatgtgtcatttgttactaatttagtgatcctctacaatcatgaatgtttgccaggtttggtagggttggcactagctcgagttgctaagaaaatcttcattacaggtaggtagttaggccttctcgagtccgattctgtagagttgttcgttttagagttttaccttttgtccagttgcatgttccacatcaatccagtaggtataatttgatccgtatatctgacaaacagggttaattgaaatggcaaaactatataacagaaattggttcaaatgagaattcagttccatgtgcgaccgcataaatcaaaatttcctctactatacatggatctaattagtctaagaatgcaattccaattctaatccttatactcagtttcaatctatgaagctcaaagtcttatttagtgttcattgtcttgcattatttgactcaattttgctactaagataaggtaaataacccagcaggagtattacttactgttttccttagtcttagtaacctttccttgatatataaaaggttagttttgcatgacacctgtaatttggtaatgttaaaatcttgataacatttcggcatattcatcattgcaaatgatcagataggggctctgatatcctcgataactgcttggctaatgtccaacttaactcaagcatgctaaagtttgatgaagctaaagcctgtgtgcgggaactggattggaaaatgtcatggcctccacctgtgtttaaatgtgattcatctgatccaaggttatttctgcttctacaccaactattcccacttatacaaattttcatacatcataatatgcgttatctaccacgaattcatgtaaaaatgtgaatgcgagtatctgatagtcatgtgcgtcttcacaacttttggttaattaaaaattcatgtaaaacttgcaggattagtacattgttgtgtacaaagacatgggagtttttctacacttctttgtgtaatacgcttttgcatgttttatgtttttggtgaacataccctcagcattggttaggaacatgttctccaatgctgtttgagatacaaatttttttttaatgattgatgcctaagtaaaacggtttttccaatgcagttcaaaatacttatggtatacaagtgaaatcgaggcggctgagaaagctacaacactatttgctgcggatgttatttacagtgacgatctgactgatctgtttttcagcatagcaaagaaactgatgtctcatggtgctgagaaggtatcggtttatccggttaccgtcattttttcttaaaatttgacaaataccctaagacaagatgtttctcctctccatgctgaagacttggtattctccttcgtatctggtaggtattgtacttgaccctggagaagagatataacttcagtatggacgaactagatgttgtagccaatggttacaagcacttccgaagtttcttcacggttcaggatggtaggttgtttgcaaagcattttgatcagctaagaatacgtagaattggtatcaggatctcaattgtctgtgttcattccacagtactcagtctttcatttttcacaatcttttgttcgcagaaagcggagctctggatgataattcatgtagaccacattttgttggagagcagatggaccttgcagaggttcctcagtacatcagagaatatgacaggggcaaagatttggagatgtggaagataatgtacaacccaaatccagaatagcaatgtcttttacagaaattacccgctttttaatgtaccactacaatgcatttttgcatgtttgtataactgtgggtgtgtttagttctttgggtgtaaagtttttgaagtatacggatatacatttgaagtattaaacgtagactaataacaaaacaaactatagattccgcatgtaaaccgcgagacgaatttattaagcctaattaatccatcattagcaaatgtttactttagcatcacattatcaaatcatggcaaatcatggcgtaatttggtttaaaagattcgtctcgcaatttatatgcaaactgtgcaattggttttttctcacatttaatgtcccatgtatgtgttcaaacatttgatgtgatgttttcggctaaaattttttggatctaaacaaggcctgtattgtatatggcatccgcatatcataaacaaaagaagagagtgatatgttatttctcccttttgtcatcaagcttgcagactgatcacacagacacagaaggcaggagaacaagaatccacagcatattttatttcgagttctcatgtaaaagaacaaatttatccagagatctcccattctcccctactttaataacgcgtaaaagaccagtaggatgatgatcaccatgacggcgaagcatgcgcaggttccaaccgcagaatcctacaaccacgagtagatcaacacaggtcgatcaattcatccatcgtttgatcaaccccccccccccctcatcgtttgatcaaaaaaataacctaactatagatacctacagatgcgtccctccgtcccaaaaatagacaaatcatgggtttctgtatccaatat

SEQ ID NO: 50363 - DNA, 10232 bp, Oryza sativa
aaaaatcttgcgagaatagcgccttaacatctcatcctctgttgtaattttcctttttttctgctcttctcccccctgtctttcccctcgtcacctttggtgacatttgtacagtgcttatcttctgaaatataaaaccagctaagctggctaaggtttcaaaaaaaaatatcagcctagtgtgcacgtgtttaaccaaatcgatctgttataactaatacagagctaccacaagctaagctacatgagtccatctttccaactgcttgcatttattcttcatgtttcattgaactttttttcgcatacaacaaaactcaacgcgacaacatttaagctctccaaaaaagtgtccaagactatactctagaagtatttaattttaataaagacaatattaacgactcataatttaatgttcatttggctaaaacacatgtacactagagtggtttttgcaacaaaactgagtaggtcaacaaacatttgtaagaaaatgaattatgtgatgaaatgtcaaacttcaagtgatttatggggtgctttttcttttgcaaattctccaaaaattaaagctgaaaatctattgaaactaataattctattttaaaatatattacgctattgacttctagacatgatttttatcgttcgttttattaaaaaaccaatagaagtattatttatttggggtgacagcttgagcttaagaaataaggaggtggctgctagcgcgtctccttcttgacctccggcacaaggaggttatagagctcgagctcgacaaggcagcccccggtgagcgtttcctccattgccttcgaagtgaggctgtagagagcgagctcgatgaggcagcgctgccgctgcttctccccctcctccccaacactcacttcggattgagctaggggccatgttagattaaactcactttggattgagttagggggttattcatctagattagaaagtcatgatgtccgattttataatttatgggataatttggtcttttgcaatagtttaggggttaattcgtttttttcccaaaacaatgtaacacctctcattacttctcatgtacaaagtaaaattactctagaacatgtatatgtactggttctcctagcccgttggcctccattgaataataaaatctattatgacgcgatatttcaaaagcaaaactacacgaaccatcttatataatgggaaattacatcgaaaccgttgaaatctctactatattgatcctagctagctactgatcataacttgacttccattattaactcgtagccatgcatgttggtccatttgacaaaaaaggctggatcgatcacaaaaagataatgaagatggcgacgacgcagacgatcccgacggttatcaacgcacactgcaccaaagatgggaaaacacacacacacacaataacgagatcgcattagctctcaaatcaaaaatcgatccatagcgcttaattagtgcaataatgtggttgacatcggatgcgttgcgtgctatacgtaccttgcaggcggcatcatcatcgccgttggcggcggcggcagcggtggcggcgggcttcggcttctgaactagcggccggcgtacggacgacgacgacgacgacgacgacgacgacgagctcgagattgttactgctgcttagtcgaagaggatcatcggcactgggcagtgatggcaatgcatggctggtcgccggtcgcggtcgtcgtcggtcggcgcctcggccggcgcgcggcggctagctgaattaatccggcgagacgaggttcgacgtcgaggctgggagagagctgatcgctgtggttgtgcggtttgtgccgccgccaccgacggcgcgtcgttggatttatgggcgcgcgctgtcgaccaaccgatcgtgagcatggctaacagatacccacaaatatctctaaaatttagtttttagatttctaattcgattttatggtgtaaccagatttttatctctaggaaatatgttaaatcaactcccaataataaaaggtggatccactcatcactaccaacgttatgtatatataaaaaatggggaaatctaaatcgagagcgctctcggttacattttatagcgtgacgtgttcgatagccgtccattcacgcgtcgttgtcccagttgttcccaccacgcgtcattgacatccccatctaagccgttcgttttcgtcctcattcattcgccactgttcaaattatgggaatcgagagagagagagagagagagagaggggtggaggctatgacggttttgtcccatcgtggcaagggaaggtggaggttgtggcagtttcatcccatcgcggcagaggaggtgaaggctgtggtaggtttcggctgtttcccctcattgtggcgaagaggtagatggatgtagcagttttactccacaaatcacgacgaagaaggggagggtagtgattgtttcctcctaaaattctgatgaagcagcgactgacgacttctactacaacggcgacgagcggtggccgcgatgggattccgcggttgcgggcttcagctgtagcagagacgacaacatgcttttgaactagtaagtaacttttatatgtttcctaaaagttactagtaagtaacttttatatgtctaaaaagtaactatttaaattaccaagctttttgtaatcgattgtgcataactttcgaattgaaagaacttgggtatggaaccttcaaaagtaaattacgtgttactagtaagtaactcctatatgtctaaaaaggaacttttgaattgaaaagaattggatatggaaccttaaatttctccatgtataatatgttattatacatgtttctgatatacgtgtgctagtacaaataagtaatcatgtaagagatgctaaatgagcataagtttaaacttacatgtttctagcaagtaacttttatatgcccgagaagtaactttatgtatagtcgtttcaagtatagacttatttttctttttcacatttttacatgcagcttgttgtagaaaaggatatgaaaattggaactagatttttagggggtcgatgcagcatgttgctttaagtatctgtggcactcgttggtgctttatttttctatgaactacttgtgtgtttaattcttgttttgtgtttcttcttttggcgaacctgatctagatctattaaatgtgggatgtaaattacatgaaaattttttgggatcacctttttatttgattttgggtattccatgccttcttcttccttacttcagttctgttttctgactataatggcaacactggtttttggagaggcgaaggtgccgtgggcttcgctatctttttttattgctggaaatggtggtgctagttcttaggggagccaaaggtgctagttgtggtgggctttgggttggcccatgtgaggaaatttcgggcgtgcggtgcgtttttttgcattcttagaaatgagcgtatgggatggtcgtgaggtttccttttgaagaaagatgcaagttctatttttggaaagcgcgtgggtcgctggttagcgtaatcgtgctaccatgcactaggtagtcatgtttatctctttacccattccctcgtcacgcgcgaactctctccacgtgtcgcctcctcctttcgtagagctgaaattaagagcgagagcttcttctgacttgtagagagtgagaaaggagaagaaaatgattctaatttttagatacatctttagaagaaccgtttaagcaagattttcacataagaaatctaatttttaaaattaggttttacttaaaagaaaactatggataggtcaatcgatgcaaccatctactaactatctactctattcatgcatgaatgtatatattaattttaaaaataatatttcttataaactactcgtcagatctaccatctaagcatattgttgtattcgttgtaattaaatatttacaacaagagatcaaataattatattctgatgaaaaaaatatatgttccacactgttcaaactaagtttcacacgggatagcaacatgtttcaacttgtttttccactatgtttccaaaaaaaaaatgtttcaatagttgattttttttacatcatggacaacataatgtttcaccggtggcggtggctaacaaagctacacaactacctacccttactctttctcgtgtcacgctacttagggtctgtttgacacagctccagcatcacctctcctggagctagagcccagccaaacagtttcagctccacataaaatgagagtggagctaggtagagctatctcacaaaatgaactagaaatgtggagctgagtttgggcagctctacaactccactccagacccaactcctgaagttaaattgagttggagctctaacaaacaggctcttactctctctctctctccactccatatatgcatgcatataacgatattcaaaatactttttctcctattctatttatccgatctacgatccgaacacaccattgcactagatgtaattaaatctttataacaagatatcacataattattttctgataaaagaaaacaagatatcatatatgttttaaaccgttaaaacttcttgttttatatgtgatagtgacatgcttcatcgggtgtttccactatgtttcaaaaaatattttaaatgtgtcaatgcctgttttttcatttcaccacatataaaacttaatgtttcaccggtaatcaaccgaagcatttaaccatctgattttttattttttattttggaatcgggtgttcgtatgtagtttcctccattttacttacgtaggtactctatctccgagccggagtggaacgtgctgcgatcgagatgtatgtgtcggggataataaaagatcgggatcgagtataatacggcgagtgattaatcttcaacttattcaaacaaacacaaaatttccacatctaaatccaagacggaattgctaaagaattgtcgtaagcccccccttttattttttacggttttgctgcctgtcatttgacaaattctaagtacctgtatctttccacgaaatcgtttctctcttttattttctcgaaattagccatatcctctcgtttgagagaagtttctgacgagcaaagtccatcgtccttgcaagcaaataaccaaggattcagagatcaagacgcaaccttgactgaactgaataacagaagattaagcaagtagcagtgactgtccgatccagtgattcgcagatccaagacacgatcgttctctatcactctatcatgtctagtcttttgcagggccagtgagagcgcccattgctgtttctttttgtcctccggaacggctgaacctcgaagcaaagtggatctggagttcttgtgctgcaattttatcgattcaagcatgtcaatcttgtgaagcaatgtctcttgtttctgtgagacttctgaactttgacaggaactgaactgtataaggacaaagcttcaccatcacaatgggtcgtcaatttggaagctgtaacctgaacagagactctgcaactgtttgcctatttggaaaactagatatttcatccttagcatagtcgatgactgtgacgagtgtcattatattgtcactgttatttgttcctctttatgtgaaggccccaataataccatcttagtaataaatattaacctatttctccaacaaagaacactgcacaagatggagataccttggctcttttatcttttgtcagtactatgtatgacaatgttgtctcaggccatccattgtactttgctcatagcctcgtattcattgggagttggaactaggtacaagctttactttgaggattcaggctttgtcagctgctcatgggaacacaatctttaatttgagctaattaattagtaatttaaacaggtgtttccatgctcatgtaatcgagtccaagtgcaaacctattatactctctttttttttctgctaaacgtacatttttagcattgaagagttctgtacataatcttgtctttgctaatgccttttgtttgttagtgctttagtttgtcattacagtaagaaatgaggcgtacaagcagagaactgatgcgaaagagtgtggcacccggagccattgctggccacagatgcagaaatcttgcagaaaatggagcagccaagttctttcaaattcttatcataacaagatagtagctcagtaatctagtcagattgttgtgtcttgttgcactgaagtaaaatagagagataatagtactaggattcctttgctgacagtcagacagaggctttagtccagagctctttagaaggcaatcaagtgtgcttagatatttttggaccataccaaatcttcagataaccaaatcctctttggtttggctttcagcttttcagggaggaaagggcacaaaatcagcaaaatgattaataattagtggtgtaggttcagctgttcagttggatgtcaaatcatctacttaagttagtaatagtgactatgtcaaatcaaatcatctgttattactgagttactattaactgaatgtaactctgctctgcttctgaatttccttgcttagtgccatcaaattttaccatcttttgctgtggaaacaaagggtcaattatatagacaaagtgaatcactgaatctttcatcaactagcaacctttttttaccacacaaatgatagcaccacagcatggtcgagaaggatggagaagtagggaataataatatgttgcgcctgagacagtatttcaacaatcttagtacttggtatagcaattaccaaccatttgcagtccaaaatgacggcactgaaataaagttttgtagcctcatcattcccttggaaaaccagtggttgcatcttgcatcaagtaaaactaaaagtgtttggttaaaagcaaaacaaaaatactcaaaagtggactaatgtgggatccctgactggattttttttgaacctttttaatttttaattttaaaagtaaaccttttcaaaactaatttccaaaatctaaaccttctgaccatgccagcccgtctggcgtggcaaaacaacactgacacgtcacctgaagtaggtgtaacagttttatcctgccacgccagcaaaagcggtgtaaccaaataacgctaccacaccagtgagaccggcgtagccaaatacctctatcacactagcgagaccggcgtgataatattgttttgtcatggtagtttggctagcatgattaaaacattcagattttaaaataagtatttaaaataaaaaaggttcaaaaaaataaaaaaatattcccccaatgttgcgtatctttgatatatcatctctacgttaagattttacacctgtttattaccctcgatattttaaacccgaaatattagggcccatttaagataactgaaattgattgattcatggataatctgatctttgtgatatcttaagagtataaatgaatgcattagcttgtaaaattttaaaaagttgttttacaaacgtatttcaagaaaaaatatataattttctttttgcacgaaaaggtgttgcttggaagcttgggaagcgtacaaacaaaaatcaagaatttttaaaaatatggcatactccctccgtcccataatataagggattttgagtttttgcttgctgtttgaccactcgtcttattcaattttttttttgcaaatataaaaaacgaaaagttgtgcttaaaatactttggataataaagtaagtcaaaaaaaataaataataattccaaatttttttgaataagacgaatggtcaaacagtgcaagtaaaaagtcaaaatcccttatatcatgggatggaggaaataacttttagtatgggtcagtttgcgttttaatgatgttgtaaattacttgtatatccttccttttttttttcttaaagagaaggaaaaattttatgcctcatgagtcttgaattacatgtttttcttaagatataagaatttagtccggataagttccggtttttatattttgagatcgaggaaataacaagctttatttccaagtaatattcaaataactgtttaaaaaaattaaataactcgaaaaaggaaatgaccaaaatgccctcgctcccccctccaccgcttcccctccttcccccggcccccgcttcttctacagttctactccacacctcctctctctctctctcgctcgctcgctctcctctcctccctcgcgcgcgcggccggcgagcggagcgggtcggcaggtgcgcggacggcgtcgtctcctcccccgactccgccgcagcctcccaccctccctgtgccgcctcctcgcgcgcgctgccgccgccggcgagcaggtttggagttggggggcgacgtggcaggcctgcttgctcctctaaccgaattgaaggtatccgtttctcctcccctttgctacttcatgagccgtcatagattggagatccatccgggcgaacaatggattttgtgcggtttcttccattccacacccaatttgttaaccgtacaggttactagatggcagtttgcttgaagagaggattggggaattaatcggctgaacaccgattccccggcgttatgtcctcctctgctctcgtgccccattgactttttgcgttattgtaatggccaaattggccgggttgagtgagccttactggttactgagctgttcttgcttgagcttggagtgaccacattccccggcaagcacggttaaatcctggtgcccgtgaatattacgcatatgcatgtggactttcaaaaggattttagtaagatcagggatgtgcggctggtgtccgtctcttagagcctatgttaagtggtgtatatgcgggggtgtgagtgtggtgtcacgtgagtagtggtgtgtgtgcgtgtgtctgccgtgtaattgcaaaaaagaaaagcttctagtactttaccccactaaaaaagttttggatttctgatgctactagtttcagccacagaaaattgggttgagtttcatttggtggagtgctgtgctccaaaacaagaaaatcttggtgagaacatagaaagttgaatgttgcctgagtgcttaatggcgaaattgtgttggcaggaaatggcagggcaaagatctgattcgcagtcagatgaatcgttcgaatacatgttgcttgagagggaccctgatctttaccgtacagtcttctcgggcccgagccagataagtccgtggattgacccgagcgtgctgactttgcagcaccggatagggagaggtccatttggggatgtttggattgcaacccaccatcagaggacagaggatcatgatcggtaccatgaggtcgctgtgaagatgttgcatccaattagagaggaccaactgcaagccttctcagtgaggtttgacgagatctttagcaaatgccaaggtctaagcaatgtgtgcttcctacatggcatctcaacacagaatggaagggtatgtatgctattagtggtgtgttgatctttcttgtcttgattatctttgcacatcaggccagcctaatagcttattttgtatcatggttttttagatttgtatagcaatgaagttttacgaaggatccattggagataagatggcccggcttaaaggtggaaggatccctttatcagatgttttaaggtacggtagaatttcccacagtttatcacatatactaatattgccatgatcaacgcattacaaattgaaccttaggatttcagcatgtagtttgcaacttcctattgatgttctgactgctgacttggttggttggattatttgtctgatttcctttctcattttagcattggcacaagttcttattgatttctgagagtgatatggtctatttagaggaatttcgtgcttattttcttcagaatgtttcttatatatctttttaattcacagatatggtgctgatttggcccgtggcattatagacctgcactcaagaggaatattgattctaaatcttaagccctgtaattttctccttgatgaacatgaccatgctgtgctgggtgattttggaattccgtccttgctgtttgggctctcactgcctaatccagatcttatccaacgacttggaactccaaattacatggccccagaa

SEQ ID NO: 50364 - DNA, 885 bp, Oryza sativa
ctccccgtgtatataaacgtaaattatgaaaaaacatgggtatattttcaaattttattcggcagttgatcacttacagtgatgactaatgtgatgtcgtccatgtcgagcgggacctggaggccgccggcaccgccatccttgtgtatcctcagcagcacgtccagaatgtcctcgctggcggcggcggcgccggcgccgccaatcttctcctgcaggcgcttctggatgatgcggtcgaggatgcccaacaccgtgtggaggctcgcctcgatcttgcgcacggcgccgctgagacggccggcgagacgcgacgacggccacaggtcctccgggttgaacccgctcacgagctccatggaacgatcgatctcacggaggaacgcgtcgcgctcctggcaactctcccccaccatggcgcgcgcggtggagtctgccacgaccacgcacagcgccgctcgcatctccacggcgcgcccgtccgccgcggccgcggccaccgcgcgcagcatggtggcgacctcctcctctcggatggcgccgaaagaggcgacaccgcgccccgagaggagctgcctggcggcgatctttctgagctggcgccagcggtccccgtacggcgcgaacgcgatgtccctgcctcccatggtggccgctcgcacggtggcgctcagcgcacgcgtggcgaacaccgcgtcgtgcgtcctcatcacctcttgcgccgcctccggcgacgacaccaccagcgtgggcacctcgccgagccggagcatcatgaccggcccgtggcggcgcgcaagatcgcgcatcgcgtggtgcgggagcttgccggcgaggtggtgaagactgccaatgaccggcgctgccatggcccgggaggcagcc

SEQ ID NO: 50365 - DNA, 833 bp, Oryza sativa
tatttcgtccactattcttgccattaattgagggatttgaagttatttatctttgaaaactcgtctatttctctcgcaccagatttcccaactcaagagcatgtgcagtgagtgcatccccttactttgacatttgctttgttgctttgttcttgatcccaccagtcaactagactctcgtccgggttgtgcaacaaaactaaataaatggttaggattttgcaacaaaaataacttatgggatgaaatgtcaaacttcgagcgacttatggagtgttcttttacaaatttctcttaacttcttcgtaatgccgcccctagtcgcatacagatagaatacatcttgcaagcacggcagtaaatccatcatccatcgatcgacgccatacgtaaatcgtctccaactctaagtcgatcgatcgatcgatatatctcgccaacaggttaacttaaacccaacacgaaaacaccggaaaaaaaacccacgaaccctttgcatcgatctaccaacaaatcatcatccggattccagccatggacgacatgcatcaccatcatcatcatcatcaccaccaccaccaccatcaccaccaccacacccagccgccgcatcatcaccataatcaccatcaccaccaccaccacggtcaccatcaccatcatcaccagcagcagcagcagcggattgtcgccaagattctcaaagaaaccaacccaccgtcatcgtcggtggcggtgacggtggacacagcagcggcagcgccgctcctggagcccaagcctgacaccggcaacctcagcgatctggtaagtactccctccgtctaaaagca

SEQ ID NO: 50366 - DNA, 2040 bp, Oryza sativa
tccttcttttgttctctggccaaatcatcttacttttaaatttgaataatcattctatatactacttaaatttaaatcacttcaacatatataagcttatgttatttaatctacgttacatactattatttttatcttttgttatcacaataactcctgtagcaatacgcgggttttatctagttgtcctaacaggcggagccgcggaggggttggcgttagaataatttcctggctgttacgttaataggccaaaaaataaggcgatcaagagttgtattacaggagcatggatgcatgtatttgtagaccggctgcctgcttattttccactccctccgtattttaatatataacgctgttgaatttttaacaaacatttgacctttcgtcttattcaaaaaataaaaattatgtaattatcgtttattttattgtgacttgatttatcatcaaatgttctttaagcatgacataagtatttttgtatttgcataaaaaatttaaataaaacgaatgatcaaacgttggttaaaaagtcaacggtgtcatacattaaaattaaaatacggagggagtactatgatttagaagttagaacacgaatccaacacgtcatgtttgcctatacaaatacaaggccaggtttcaaaacagtgtacacaccaatccactgttagtagctgaagaaattagatctgcctattgtttcggaagatcaaaacatagctcttgctttcaagtggtgactggtacgcttcagttttcgtatctaaagtttatagaattgtttttatggtgttttgttcttacttgaggtccctttaattccaacaaactcataatattatttcttttctgaaaattgatattcatggatcatttttagtgaattaggcaaaatgaattttaaaatcacactgttcttatgtgagaaacacaatacaaacccaaacaatacaaacccaaagactcacatacacagacgcacgtacactcacctatgtgaacacgcacacatgaacatcctatttttacaagtatctcggcaagattaggccgtcatatgttgatattgacgaaatcacatcgttatcaacggcacatagtcttaacactaaaaaaatgattagccgtaaacttgagcatctgtttgatccagtaaacaagtttcaccacaaaaacaaactaaccagaaaagctacaccaacttcgcaaaatcacaccgtttggatcacatggagtggggttcgtgcaaatgaattttgtgtttgtgtagctaagttgtatccttggtctactccctccgtcccaaaaaagacaagatgcgacacattatagacgtccagattcgttgtactatgatgtgtcacatcgtagtacaaggttgattttttttatggagggagtatctgactatctggcagctgaaataccagcccatttttctctctaaaaaaagaaaaagaaataccaaaccaatatacctttaaaagaaaggaaaaagtacaccgaaggtccctcaacttgtcatcgagttacaacattgtcccccaaccacaaaaatagatatataacatccctcgatttataaaaaccgttcatgttaggtccttcggtggttttaccccgattttgtcctatatggttgctgaatcagcaaggaacccacgtgggccctacatgtcaggatgccacatcaacaccctccctcttccccctcctcttccttcctcctctctctcactcttctcttctcttctttaggtaagccggccgacgctgctgggaggaggccattggggtgaggcgggagaggaggcgatggcgggcgacgaggcggcggcggctacgacacgggagaaggcaagggcggcgcccggtcgtgaatggcgttgatggtgctgtgtcgtcggtggcggcgaagcgatcccgcgcgggcgggtgccgcgacgttgggcgatgaggagaacggcggagcaggcgggcgaagcgaggcaaggcgggtggagtggggcgatgtcgcgggtgggagaagca

SEQ ID NO: 50367 - DNA, 3941 bp, Oryza sativa
cctagttagcactggttttataagttgaggaacgcgttgtatctggttttgcggttcaaggacgattttgtaattcgacgacaagttgagggacctttggtgtacttgttcgtaaaagaaaagaaacaccggcccagtattgataagaagcccagacggaccaacaggccaagcccatcttatcccaagaaaaaaaaggggaaaaattactcctttctaagcgaaggcctaggctaaagaacagagaagagacctgctcttgcgatccttctcactctcttcctccccgagtcgacggccggccaccgacttgggggaaaccaagccaccgccgccgcagccgccgtaccccaccctccctcccggcggccgcgggccatagccgcgttctcccccgcgcgtctgcctgcggcgtggaggcgtggggggcgacggcgatggggtccatgacgatcggcgccaagtacaagaccacgctcaaggaccccggcaccaccggcgtcctgcgcatggtgcgtcgcgatcccccctctgttcctccctccctctctctctcccgcatagcgtcgcctctctccctccagctccgattggtcgggtttaacccttgcggccgtgccctactggatacacactccgcgggaggtgcggtgggtgtgctgattctgtggagggatgtcgcttgacgggagggttttgatcgggtgttggtcgcggtagtgtttgattgggtatgctagggcttctgatgctttcggaggggtttgtggtggaaaggaatcgaaccgatctgcggtagtcggatgtataagagggatgagcttctggagacattggtttagctagcttggtggttagttatttatgttgggttcatgtagtggagcgttttgtgcctagtttctgtggatcagatgcaatgagttgcatatctgtttgattcgctgatgagttttgcgtagttgcgttgtaaattttgcttgagtatttctacctgcttaatttcatgcacagcttgctgggtctaaatggcatctatcgtttgatacttttaattgtagaacgaggataagttcaccttcactccccatgatccacggtcagcgatgaagctcaatgttgatttccggagcatcaaaggtaatttcatttggtctatttatagttgggtacagtgggagtactatgaccgtcccagtggtttagtaaataacaaactgaccaattcgtgattgccatttgtcagaccaggctccatatttcttatatctgattccttttgtggataatttgaaatatgttttctgcaaaggcattaattaacgggaaatcaagataatatatagctattctaaggtagaccatgcatagtaaaacagatggattgatttgatgcttgtgaccaacttgtctgatgtcaactttgtactttctgtgcacatgcacttctgattcaggccacaagttcaacaaagtagatggtagcaaaccagctccaccattactgaatctttcaaaagactctgacaaggtataggcaattctaccttaaactttatcttgttgaatttctattcatgatctacatttgtttctgtcattgagaaaaattgaaatttctatgtgttttttctttagggtggaggctacatgtttgagtttgacaatgttactaaccgcgacctatctcgtgactttgtaggtaaagtgaatggaacctaaaatagcttcttttatttcagtttgatgtcaaatgtaggttatgaaagttagaaataacagtattttgttatttgcctgagtattgattattgtgtaagcatcaagtgggaaattgtccacttagtgtaaaccaatccaccagctgagtcctttttaccgattgacttgaagattctgaatttgagtccaacagtacatttataccctgacacagcatacaaataaccaatggctttctcttttcagctaaagttttaggtaagcaacaaggtacgataccgcctaaaccaaatgtgccccctgaaaattcagttacttcaactggtgaagaacagcttagtgctgcagaaatgcaacgtcggatgaaattgctgcaagaagataggtaatgtgattatgtggaacatcactattgtattttttagttacagcaacatgatgtagttatgataatccagtgcaaggccagtggttacttgttttttgcaaaaatatgatctcagatgaaacttcccttaaaactcttatgcgtctataatgtaaaaaaatttgccaacactataatggacaattcaaaatgtaagctatccactgaaaatctcaaattgtatgcggaacacagacagtaatatccaggcttaggaatataaccttggcaacagccttgagcgggaataactaaacaagtatttggtttattcagattttgttaggttaaggcagcattagatttttcatgtcttaactgcatctattggtctgtttcatgagctttgctgcaattaaacggtagatacctgccagattggcaaaacgaaataatagagataatatatgccttctatccagtttattttatattgaattatagttggcttgaaatctgtggcattggaatagcattgtgcatccatttccatttaatggcttttgcttgtcatctgatgttagtgtgatataaatatatatatttttgatttcttctttttgagaacatggttatgcagctatattgattaagttttactatatggatgaaattgtagttctcatatatcttacaagagaaagtgatgcaaaattatgcaaactgtcgcacccacaaaaatttacatggtgtattacaatcttgagcttttttttgggtcttcacagtgaattgcagaagttacatatgaagtttgttcttggcaatattctgcaagaatctgaattttgggcaacaagaaaggtaaaattcactcactcaagcaaaatatgtttcttcctgatatgcttgtttaatttattctcatgaaactatcatgtctttatgaacttttacagaatttacttgaggacgaagcaaataaaggatcaaaacaaaggccaggtttcaaaagtgccatgctagctgatgttaggccatcggctgatggtcgggtacgttatttattttgtgtaaattatggtttattatgttctagtctgttgtatcttatcttgccagacattcactttggtgatagctggtgatattgatgttatttctttctttttcctactcctctcacagacaaataaggttacttttagtctcactaccgagataattcatcaggtacgttcatttgactttgatgattctttaggacaggccatcttagtattgttttactgtttcctcaactgttgtaggtgcagttctatgctataagaaataagttatatctacagatctactttgtgggatggaatttcagaattactagaatctttctcattgcacaatagactctacacctatttggcagggctccaactcctgtattcttgcatatattgattcaagctaaaacaaagtggttcaagcttcttagcttttatatctaaacaggcttgcaatttgctgtatttttagtccccatatagaatggtttgatccctacttaagccattttttattcatgaaactatatgattttgttgtctggagtatacatccagcatgtcagctagatcaggccaaagggcttgtacggttgtaccacttgaaagcattcttgcatccatgcctaggcttacaagtctgtaatgctcctaaatcagggctttgtctaggtcattgggcttggctatgtttgctcaatataatacttgcttatgtttggcatgcattatataatgggtatgacttcaaattgttgaacaattcaaatgttctgaatataccttaatgt

SEQ ID NO: 50368 - DNA, 6340 bp, Oryza sativa
tcctgcagccctttttatccaataacaacttcagttctttataataaggtatattatcagtcccagacttttctgcaccattacgtaatttatgtgtagcatttggatggtaatcagtatcagtagattactgggtcacaataaatttggttcctatagtgattttgtcaatgtagttttcctttcctagagtgaaaggaaaattttgcccattaattatgagcggtaagttaactaaatattaagtctggcactcagaagaaaaaaagggttcccaaagtgaacagtttcaattgtggattcaggtggtagcagcatggttatctgttcactgttgcgaatttatttgtaaaagtaaatgcaacatcatgagaaattcatcatagcctagtttttatgtttgttttggctgtacaacagctctttttgttttttctgcatattgcactgaattctgtaagaaaaaaaatattactgaaagcagactaagtaattttatacttcattcatctgaaaatataaggcttattttgagttgatacatgaaatcaagtagggtatgaaactgaggaagagaagataaaatgactactctattgctacttaaatgaaatatctttgaaacaggatagggaatgttaatgagatgttctgagaaatgtaggagaatatgtaaaggcaaataaggaaaaccaccaataacttccaatgcatgccttatattttgcaacaaattttgaaaaattctgccttataaaaagaaacaaaaggggaatgcagtcatgtgggtggaatagctgtacaaccaagactaagccttgaactatatttgcaagattaagaattcagtgtttatgtttttgtacttctgtggcaggttcaaagaattaaggatgcaatgacccagatatatcaaaagttgcaggtaatctccatcacaattgcctctttatcttcttcgagttcatcatgtggagtaccttagtttttaccttttgagcatgagttactgataagatgatagctagctggaattgctcttccttaaactatagtttccctcaaacatgttacagaaatgggtttgtattgaaattgacttcaaactttcttatgatgttatggaactgtaccttgttttggtgatgaaattctcactggacccctattcatatgcataacttccacctgcaggatataaaggaatcagcacaacctgatgtgagacacgaaatatctcaactagtaaagcccatgacccaggttcttatctatatccttttttgtcccatttccaattttccatatgcaaaatagatttatttcagcttcattatgacgactcaatcatgctactgtactgcatgagtttccacattcttttcgagctaccctttgtttagcatttctttatgctcattgtgttgcagcttatctgtattagcattgcttgacagttgatattttaactactactacctattaactgttcagcggtgctcacttgctgtctttgtacacgtatcagcatgtcttctttcatttgcatattgatgatcttcttcaactgctgaaatgccatcaatctggttatatttactttccaggctttggatgctgccttcaaccatgacttggagcagcagcaaaaatcatcgaaatccgggaataagcccaatgggttttaactttagccgagaagactagcttcggcgacggattagggattgatttactgctagagcaagagggctacttgcagttctggaggggttacctccttgagccttgattctcatgtatatttacctgagctttatagtggtgggcataacgtgcttactaaacgccccaatttttcagtgcctgattcattccaggcatactctgggatggtttgtgttcatcacagttccaggtagaaccaaaattttgtgtacactttggaaagaaggaaaaaaaatgagcacgcgttgatgctgcgttccttacccgtcattctgcattgttcgtgcaagttgtagacgacaattttgatatggtcgagtttatgcatggacaatggttcactcttgctgtgttgcaagcttgcagtatggcaaacagaatgaaactgcaggattgttgctagttttctggtgaccgctggttaaagcatgtaacgttcaccgtgagcaaaaggcatctccgaccggagcgatctgcagtccacgggaagaaggcccaaagagaaaaccaaaagaaatggaaaaagaaggccgaaaaaaacgaaatgaaaaggaaaaaaaaaataattgcacgcccagtgggactcgaacccacaatcgcctgattagaagtcagacgccttatccattaggccatgggcgctttgttgctgtggggtccagctttaactaaatgtaagaattcgttcttctgttcctttgcttcgacagagagataatttggagtatgaattaatcatctaatgtctaaaagcaattaacatgatatgaattaatgagagaagaaaaaataatattaactaaggaagaatgaactatataggtatacaagatattataaaaaatgataaagatatattttaaaatattatgtgaattatgtgggatgatttaatatgcttgcataaaattctaaaatttaataaattatagaattataaataatatagcatgcttgcatgatgtttaagatgtaataattgttggtgaatgataatgtgacatctttgcatattgagttttaagattgagtgggttaaacgttatagtaagataggattagaaaactaacaagtgaggtggatcttgttttaaggaaaaatggaatttccttagtcaacgatagtgggcctgttcggtagcctattttcgcaactgtttgggctgtgccgcacaacccagccgttcggctgcagtggtctaggctgtgttgcatagcccagtcgttcggttgtggaaacggctgcaacccactccccgcaaaaaaaaagttggtttctcgcgaaaaaaaagaaagtacctatacatctttcgaaagatttttataatcgtatcacacagatttttaatctttatattaaaatctgatagatataataaaaagcaaaaagcaattaagaaacaccataatggacactaaattaccatatcctcaagaaaaagaccaaatcaaatataaaatttaaaatttacatgcgaagattcaaaaattacagtgtaacttacaaaagttatagtgtaagtttcataaattacactgtaacttacaagaaaatgcactgtaagtttgagttagaaaatcgagtgagagataagaaaaaaatctttcgagtgagatatagcgaaatccaaaaaaaatgacgcccctcttctagttcccatctcccagtcctatcgcgtagcccacactccaccctatcgcgccttctcttccatcgccacggcccacactctgccgagcgcgtctcgatcccctccgccttctctcccgtcctcctcctgccgagccacgccgtgccttcccgatctcctccacgttctctcccatcctcatccctccgagccgtgccgtgccttccggtcgcgcccgacgccaccccttcccatccccttccttttttcctctcaccactcccgatatgatcgattaaatccaataggatgtgaagttcatcttgattcagctgtgggggttgaggggaggggaagctcgacagtcggctggagttaacctcattagggtgtggttgttgaggggatagagtgcagccaagggaaacatcccgtcgggcaagacccacgctgtgtcgctggcgacgtcttctcccccagatccgtccaggtccggcagttaggaggtaagaatcatctcccttttgtgatttttgatcttgcatttttaggggtatttgtgtatggcaccattcgccatgtcaactcggccgaagggcaccttgtgcaggcatacgaactgctgatttgattcttggacatttgtaggaccgcaaccagaagcgctggcacataacctgagacgatatggcaccacggagcggttggcacttgtaaggtcacaagagcgacttgtacgtaggaatcctcaatctgaacaaacgatttccctccgccggtcgacatcgtcatggtctccacctgaagccgcatgatacaatctgcgtacaactcctgcacggcagaactaactcaaggcaagcattgctttctcatattagttatcagtgcgaaaaatgttttgcatacctgcaacttgatgttagtactgtgtttaagatctcaaaaactcctaagttggactacatgtaatgcaaaattacacatagatggctggtggtcgcacctattgggacaaagccctcacaaagatattcctcgacttatgcattgctgagaagacaaagcgcaatcacaacaagaagggtcgtaccaacataggttggcagaatttatatcgcaatttcagagaacaatcaggcaagaactatgacagtaaacagcttcaaaacaaatttagcacctttaagagacaatacaagctatggaagagcctaaagaataagagcggaggtgggtgggacaacaattctagcaccataaggtgcgatgatgattggtgggaagaccgtattgaggtaactacatgtgaatattgattttactacaaaactaatattgagtttttgttattgtctcgtcaaacttacattgtccatatctgacttgtaggagaatagggatgccagacagttccgtggaaagccgcttgaacatgaggatgagctgactactcattttggttgcatggacaccgaagaaggtacaatgttgtgcgtaggtggtattggcaagagaacaccaagcagtggaagcgatgacaaccttactccgatgtctaacgacaatgtcggcttgtctagtgctggccgtgtggcttaaagggcagggaaggagcaggtggttgaccgcccaccacccaagaagagtaaaaatatggagtactatgtagggtgcgtatcagagagtatgctcgaaagaagcaggaatgaaagcagtgtgctcaggggagagcaagatgagataaaagaattgctgcaacttgtagaagaggatggtgtggctcaaggatctgagttgtatttcatagctactgacctatttaggtcagctgcacgatgggcagcttttaggtgtatttaccctgcagagaatcgtaaagcatggctccgatggacttgggacaatgctaggaaaaagtgataccagtccatgcttagttgtcgcacacggtgtttgattgtatatacccatcgccaacacgacgtggcattatgtaatcggttgtttgaccttggcatactcttatgttatgcattatgaccttatttgctttgctactttatcatataaatttgtatcagtcggctagtcatttcatatagatctacttgtcctttctttattcttttttttacttgaaaattgaataaccatgttgcatcctcacctactgtagaacaatggaaaaatgcactacactgattttgtacatgcatacattttgtaacggaaaaagtacgaattaccccgctgaactatcgcagtcgactgaattacccccgaactcagaaaccagacatagctcaccttaaactattaataccgaacgaattacccccctcgacactgttcaaagtggttttggcttgagcttgcacacgtggtgctaacgtggcaatccagtcagaaaaagactccttgggcccacttgtcatatctctccctccccctctctctcctaggtccctctctctctctgcccggcccctctctctccctctcagataggcggctgcagccggcggacgggctcgggcatgcagctgtggacggcggcacggggggaggacgcggcagcggcgggtggcgccctctcgtgctccgtgtcaacagcgatgggggcggcagcacagcgcgggaggacgcggcggcggcgggcaacgccctgtcgagctccgtgtcaacggcgccgcgtccacccccgatggctgcggctgtgtctgcaccatgacgtgcgcgttaacggctcctcgttgtcgaactccatcccctcaaatgggtcaacgccgtcgtagacgacggcccgcgccacatacgccgccgccgccgccgaccttgccgagccgttcccggcggcgtcagcctccatctccgcagcgtagtcgacgttgtcgttgtcgttgtcggcggcggcggtggcggcggcggtggtccgacgagggggtggaggaggtgggggcatggtggggggggggggg

SEQ ID NO: 50369 - DNA, 1852 bp, Oryza sativa
aaggcgacgatccgatggagcacgaggagcggcagctggttctcgatcatgagcatgtcgcggcggacgtacgggaacacgtacagctcgccgtggcggctgaacacggggtcgttcgccgcgtagcctccgcccacgccctcgccgtcaccgtcgccctgcgccgcctcggccgccgcgcgcatcacctcgagcaggaagcacccatccaagaccatcatcttcaagaacccgtcgcggtcgtccctccacttggtggcgcccagcccctggtacgcgtcctgcagctccaccaccacctcctccatcgacgccacgaggctacccagccgcagccgccgcccatcgccgccgccgccgccgcggcggagcaggtgcaggagcgccctctccttgtgctcctcggccggccggagctcggggacgccgtggtggaaggggccgagcgacaccagctgcggtgcgccgtaggaggtgcgatgcttgatgtacgccggcacgcggtacaccgactgcctccgccaccgcctcgcctcctcctccgatgggttgccgccggcgtcgagcaggtgctcgacgtgggacacccattggctcgtcgtcttcaccctctgctgctcctcgccttccatttggtgagatttcttgatgttgcttgtcgcgtcaaaggttgggggaaattttgagtaataatatactactactctaaatcccccgcaaaaaaaaaaatatactactctaaatcgagattacagagcaaacaatattttttaggcaccgtccagccattgctactgccataacgtggtctactttgtcactcgaacaacaaaaaattcatttactttcggcaatgttcgacaagtcaaaatttaaaaggggcttaatgacttgttaatacatacggtcattgtgtatgtgagaaagtacaacattacatcgctgtcctcgtatctacagggaagtggccatttgggtccactcccatgcaatgttttcactttcgttttccaccgaaattttgaaattttggaactattctttttgcacgagtcacttatactttcatcatccccctcttcaactcaattaggtacaaaggaccccccacaagtccactactcaatttttcttctaacttcctccccacacatccagttttcactcattacttttctcgtttgctcaatttctcatgacccgtgtgagcctccacaccgtggtggtatcatgggaaccatagaacaaggatgcagcatgacgctcgctccctggggcagttatctatcagccatgattccaatttcgaacagcacaacaacaacctggtccaacatgtttcaggccctgaagactccaaagtccaaagcagcaaactgatactcctgtaccatgtaagagagttccatctctcatggcagacgttcgagagggtggagcgctaggccgctgctgccgctcatcgctggtgggtcagggatcattgacacgaagctcagtaccatcactactacaaaacatcaaatagataccgctattacagatgctagagtaggtaaaaccggtacctatagctcctttccctatccatgcgtctatcaacccgccaaaatccaaagaatcagcacctttatcctcaaataggtgccagtttttaaaaagaaccggcacctattactggtgtcagagaaagatgccggtttttattgaaaatccggcaccttttagtatccatcccatcggaatagtaggcgtagggcccacctaagaaccggcatctttgtggttaaagaaataggtgccggttttttttaaaaaaaccgacaccgaggcgagccacacggggagcccc

SEQ ID NO: 50370 - DNA, 14653 bp, Oryza sativa
agaggcagcagtggcgggcgacgccctcccctctgccagatccggtgggaggggaggcagaggcagcagcggcggggctcatcatcctcctcgcccagccccttctcctatgcaacttcgtaccacttcggcggcggtacgatctgatttcgtctctccttttttcttgcctacaacttgttgaatttgcatgcaaaattttagagagacctgataatttactggtatgtgttgaactgaaccggttgaactatttctgttgataaatttggggagactattaacgaccaaatttggtaagatatgaaccaagttcgatattggaatcgaagcggattcggcaaagattcgaagaacagagtatgcatcggctgcgaaggcatcggctggagtatgcatcggctgagatggattggataggggatggttgatgcagccgatagagccaatacagccgattccgatggggatggctccgaagctgtttctagaatcgatcaacgtgattcacaaggattgccgcgatggagataaagctctcagaaaagcaattgtatctattaattaggatattttgttagagatatatctgggcaaagtctgcggtaaagacttatggtatattagagccttttagagataagagtcgtgtccgacaaggacatgttttgtatctcaggtataaatatgacccgaacccaatgtaatcgataacatcagttcaataacacttttggcacatcgccacccttttttactttcattctattttgacgagttcttgctttcgggttgagctgcatcgattcgatcttcaactagaggtaaacttgtaatggcggtttgcgttctcgggatcagtgcttccatctttatgatactctaatcttatttatgtaattcgtcaagttatcatatatactttataatctctgttaattgcgttatataacttgccatcggctggtttttactactagaaagtagccgatagagttagatcttgttattaatctagattatattgtgtatctaccatctcttagagattttcattatcttgcttagatcttacagttatctttatgcttaatgctgcatcggttgagttcgatctattaagttatatctataattgtgatatctagcctgttttatgattatcaatagagatagtatcggagttttagccgatgctaactgctttagctattcttatctcatatgcttgcttgtcatgctaaatctgccctttatattaagatcttgttgcactaaagttatattaggcttcttgtttgatatatcttgcttgttttgatatcttggtatagagtggtatcgaagtattagccgatacatgctagatctatttgattggctatgctataaactaatatataatcttcgctttaatatatatttcggcttaagtgatttatactgtctcggcatggtgaccgatctatcccaatcacttagtttaagtatataccgaagtaaagactatatgttgttaatatctacagtcgatcgagtagatttggttttatcttattcattcattgctgccgatcgattcaaacatgacatcagctcaaagatatataaatgatatgtcatcggcaactagccgatcggctatcgtttatggatttaactgcggtttttcttgtctttactcttgttgattgcaggatcaaatcaacaggcactctcacgaatctaaaagcaagattttggacatgcataggagttaagcagatctttcaggccagtgtgtgtttttcgcatcaatagagacctggtaatttttttggagggctcatcttgttcctattcttgttctgaattggtgtgttcttgattgttcgaggtgaaagggagctgctcacctcgatgaatcgagccgatgcatcgagccagcttttttttttattcctcaaaccttaaaggtgccggttctaaaacctaaaaaactgacatctttacctatatagatgccggctctagaactagcattgatgaccgaagtcatcagtgccgcctccgtggtgccggttgggaaaaccggcacctagggggttcctaactggcaccgattagggtttctgtagtagtgcaagttattcaccatgtcatcggtctgcagccaaacgcatgttgattagcagctaaatcgaatattcgagtttattatatcatcgcaatagcatggtatggccgtcgacgcggtaacacaccgcttcagggcattgccaagaacggaaactaactttttagggagcttctttgaaacacgtgattgacaaaggaggattatgaaaaactaactttttagggagcttctttgaaacacgtgattgacaaaggaggattatgaaaaacgtaagattttgaaagaaatgcgagtgcaaaacacaggaaaaatataaatatatgaatggtcgtttgaatagatcgtaggaaaaccataggaaccacagaaaacacattggattttctaagaggtttaagctcttgataccttccttcaaaatatctttaggattttcgaaggacggtatataattcaatcctttgtttggaaagaccttgtaaggaaattttcaaaaggggccttagcttttacttatgcttcatcatgattctctaacagtttagcattcggatgtggtgttatgatctgacgttgatgttctaaatgcggtgtagcgtaaaggacgttggtgttccaatttgttgtcgcattgggagcgaggtctggtgcgagggtctagtactcttgttagacggtcaaacactttcgtatgctagggctgatgagcaaagggggtttgtagattttgtaagctactaattcgtaatgagctaagcctataaatcaccctaatacggaatttgggattaactaactgttgtttaaagtgttagtgatatgccctagagacaatcatagagatgattgtatcacatactatgtttacatatttgtccgacattgttccttgaaatagataactccttattggttaatgaatatgtgattctttcatgagactctttatgttgtttgttgctatttcgaaaggatccctgatcaaaaatcatatgtggaacaaatatgtttagatgatcagcacatgtattaattgatgatcatgtctcatggatcatggtatagagataccaaattaataatatagacacatgttagtgaacatgttgttggatagacccaacatgagacactgcaagagccatatgtgttgtgttatcagtgatctcatttagtgttggtattgaatccttagacctgagattatcatggttcccaacatatgtagtagcttacttagggactgctaagcgctactccgtaattgggtagttataaaagtagttttcggttatgctacgaaatatgtagtgggatatgaataatgaagatgggatttgcccctcctatggagagatatctctaggcccctcgatgttgtagattatggaagtgcatggccatgccaaaggtgattgaggagtcgatcacaagttatataatctatcaacaggttcgagtgaatgattgagctattagaggacggcacatatctagccttgagcttaatcgatatcgtgaggcaaaggggttcatacaagtatacactagaggttcagccgatatgatctttatgtatgcccggtgggtcaatacgttctgctaggggccgctgttgacgcgtggaccgaaaaggagttttcgggttacagccgagtatatatgaacctacagggtcgcacgcttaatgggccggaataaggggattggatagagatccaatatgagcttaattcggataaggatccaaataggagtcctacgggccttggaggcccgagtgatggatcctatatattcgtgaggggtgtgaccggcggaggtattgcatcacttgagaaaccctagccgtcacttccctacccgagcaaaaccctagccgcgcgcgagtgctagcacatctgtgcgtggcattccgtccctgtacgtgtggataccggtagaggcgccgctggtttgcggtgctgatcgagtgggagtatggcgaggagaacgtacgaggaggagaaggtcgagccggtgcgatcgactacttcctctacatcgacgcgcactacttcgtgagagttccttcgacttctcagcgtcttcttccgctgcgcaacgcgtcgagtggtaacgatctatgatataatacttgcatcgttcctggtttacgcgatagaaaattttgatttatgctatcgtagcctatgcgtatcccaacagtggtatttgagccgccttgtatagtttatgatctagatcattgcatataattgatacgcggatgtagtagatgagatctattatattgtatatgagttcttaggtgatcggaacatgagatgaaccgatagctgcatgggttgatgagatcaatcggtatgtgtgttggtgacttcactggaatatctagtactcaccaaggccgagcgcgattgtgttcatcggatagttcgatgtccactggaaccgcatgccaatgagaaaaatgagccaatgagattgactcggtctcggcataatttgattacgtcgttaaggttttcacatggcgaatcgtagatgagatctagcgggaccaccgtgtgcgttgccccttagatttcgcttggggtttttatatctatcttactttattgctgttatatatttgatatgacatggtaggatagactccctcagaaaaattaagtgtaatttatgctcttccaataattgcacctattacggttgtgatcataagtgatgggtttgccatagccaagtgtcactttttatcatgataaaataggatagatgtcggacatctatatgcggagattattggtttacttgacaaggttatcaaaacggttttggaccttggggcataggttgggttggacatggagatgtcactccaatagcacaagagtcacatatgatgtgattgcaaggtgttgcttacctattttgatagttgtctagctgtgatgccaaagctcactagacactaacaaaataaggatcttgactcactatgatactggagggaattttgtttcacaatacatagtgggagtatcttttgttaaattgtttaatgaaaggttaactgtaaacatggtgctgattttgcatacatatatttctattatagatcatggcagctcttgcaccatccagttttaacttgcggtctattcttgagaaagagaagttgactggaacaaacttcatggactggtatcgcaacctgagaattgttctcaagcaagagcacaaagagtttgtgcttacagagccttttccagctaacttgcccaacaatgctcctgctgctcaacgtagggagcatgaaaagcgatgcaatgattatcttgatataagctgtctcatgcttgctactatgtcccctgagcttcaaaggtaatatgaggcattggatgctcatacgataatcacgggactacgtaacatgtttgaggaccaagcaagagctgagaggtgttaatacctcaaagtccttgtttgcgtgtaggcttgcagaaggtaatccagtgagcccacatgtgatcaaaatgattggttacaccgagagtctggataagcttggctttccccttagccgagagctagctactgatttgattctccagtcgctccctcccagctttgagccgttcataatgaatttcaacatgaacaatctgaacaggaccttggcagaattgcatcggatgctaaagactgctgaggaaagcattaagaaaaactccaaccatgtgatggttatgcataagcgcaagcccaacaacaagaagagtggacacatgttagtgaacatgttgttggatagacccaacatgagacactgcaagagacatatatgttgtgtcatcagtgatctcatttagtgttggtgatgaatccttagacctgagattatcatgattcccaacatatgtagtagcttacttagggactgctaaacgctactccataattgggtagttataaaagtagttttcgggtatgctatgaaacatgtagtgggatatgaataatgaagatgggatttgcccctctgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaaaatctaagcagcggaaaataagataaacggcgcagacggctccactccacaagcagcttgaccaaggctacacctaatcctccactccatcagcttcactgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaatttaataaaacagttaagtaataattaacaatattaatccaacgctatacaacataccctgttgtataggcccaaccattctgaacaaccaccctggctgcgcagttctatctccaaaccaggaatgtaccattccaaaccaggagctaatcaaattattaccaattaaagcatcttttactatgatgagaagtgtgagactaatcacgaaagacattgttagacccacccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttatacaacataatccactgcagcgcaccttcctggatcataatcacccccttataaacaaggcatggactccccagcgacccccgtgggcttatctctgccacttctcagtctggtgccccgcaatgaaccatgctatacaaaagataaagccgttgcccatgctggcttgtggttggcacgattaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcaattaagccatcatgaaataatagtgaatcataagttatcccaatagtgtgctaatgtttctaagcagggctaagcaattatttctaatatctagttgaaccaatataaataaagctcaactagtcaaattatagtaacccaaggtatcaaggaataaagtaatcaagaacaaaagggctataacaatgaataggttaattccacccaatgacattcgaaaataaatgcaatagttgaatagaaataatagctttaaataggatcaacatgctcaaagggttgtttgggatctgtgtgacttgccttgttggccttggaactcttcaaactcttctccggcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagaagatttattgcgtcagcgggctagggtttcggtggaccgggcgcacgggcggcggttcacgcgaacggactgccgagatcgatccaatccaaaacggacggccgagatcgaacggtccacgaccggctcacggcggacgaccctgatgacgtcagcggtgacgtcaccgacagcggcggcggctcggcggagcgaacggctcgggcggcgcacgctcgccggcgaacggcggcactaggacgcaaacggagggcaccaacgggtagcggacggcacggcgaactcaccggcgaccaaagcgacggcggaagaccaacggacggcgacgacgacgaagaagaagcggcggcgctcttcggcttgacgacggcgacgacgctccggcgatcttcggcgacggcgaaggggcggacgaggacggcgacgacttggcgaccacgacggcggtcttcccgagcgacggcgacgaccgagacggcggcggcgcacggctggagcgacggcggcgacggcggcgctaggttgcacggcgctagggctcttccggcgacgagaggcgaaggcgagggtggcgacgggtagaggagacaccggggaagcttttaaaggggctcggaggcggtggcaaaggcccacggcggccggcgatgagaaggaaagttcgtggcttgaaggaaggaggccgatccgaatcgaactcgattccacgaacttccaaaacgttttagccgaagcttccaaagaagaaaaggtagaggagatcccgaggatcatttcccctcttttgattcggccagagaaggaaaggagcggccgaatttggaaaggaacggcggcggcggcgcgctagggtttcggccggaggaagacgacgggcctgacaggtggaccccacctgtcagcggccgaacgcgcgcgcgcgcggcggctgcggactgggccggactgggccgaggagagagagaagagaggttttgggccgactttcggcccaaagccaaaagaagactttttaaaacctttttcaatttaaattatttcttaaatgcaattccatttattaaaaatactttcttagctcaaaaaaatcccagaaaaatctaggaattatagaattaagcaaagtatttaatgaaattttatctggccccattttatattggaatttattaattaaaattagatcttcttttctaggcttttaaaattaattctaaaaattccaattaaacaacaatttatatattttaaattttcagggtgtgacaccctcctatggagagatatctctgggcccctcgatgttgtagattatggaagtgcatgaccatgccaaaggtgattgaggagtcaatcacaagttatataatctatcaacaggttcgagtgaatgattgagctattagaggatggcacatatctagccttgagcttaatcgatattgtgaggcaaaggggttcatacaagtatatactagaggttcagccgatatgatctttatgtatgcccgatgggtcaatacgttttgctaggggccgctgttgacgcgtggaccgaaaatgagttttcggggtacagccgagtatatatgaacctacagggtcacacgcttaatgggccggaataaggggattggatagagatccaatatgagcttaattcggataaggatccgaataggagtcctacaggccttggaggcccgagtgatggatcctatatattcatgaggggtgtgaccggcggaggtattgcatcacgtgagcaaccctagccgtcacttgcctccccgagcaaaaccctagccgtgcgtgagtgctagcacatctgcgcgtggcgttccgttcctgtacgtgtggataccggtagaggcgccgctggtttgcggtgctgatcggcgtgggagtacggcgaggagaacgcacgaggaggagaaggtcgagccggtgcgatcgactacttactctacatcgacgcgcgctacttcgcgagagttccttcgacttctcagcgtcttctttcgctgcgcagcgcgtcgagtggtaacgatctatgatataatacttgcatggttcctggtttacgcgatagaaaattttgatttatgctatcgtagcctacgcgtatcccaacataacgctgttgcacttggttttgcttgaaccagagtggaagtaatcatactagtggtgcgagcagcatcgtaggtgaggacactagtttaatctcgaaggggtcatcgggatgttgacggtcgttatagaccaatttcgaccgtcaatatatctagaataaaggagaactagcaattcttgcatgcatatttgtttaagaataatctatttccacttgtttggaactttatttgtatatatgagatcttcacataaatggagaaggaataatggaaataacagtcagggaagcagttccggccaattagacgtgagtaaaaggatcagagggcccacaagtcagatgaaaccgtcctaaaatgagccaaatccatcctaactgtcataagggtccaccaggcagtctcctagccaaagcagaggtccagaggtggggcccagggttcggccgaaccaccactggcgccaaccatcttagccttccacgtggacgtccctgatcactccctaatgacggttgcagggcatttcctacaattccaaccgccacaaccgtcattggcagcctataaatgggcatcaccttgtccattccaaagtgcaccatgaaggatcaaatctaagaagctctctagtttatttacattgttctagtactagtggagtagtaatagaatatttttcttagttcttcatgtcttcaggagattttgggtatggctctagtagctttgttattcttttgtaagactttgctcattaatgaaatattcttctttatatagtttcggtcttttacttcactcatataattattggagtgccgactttagttcatatttgtctcgtaataattatgtaggtagctaactggagatatgcaatggtgttggtttaatgttcatttatatgattgctctatgtcacatgcagagatgtagagtaatatttagtaatataagcatggtgcttagattattagataccattaaatggttttatatgccacgggtctctagaggtaggctgctgatggtgacagctcaatacgggtataatactaagagaatttcctggtgtggttactcctccatattcattaccggttggatggccatgacaggatgtcgtaatgaactcggcaagtaagggtggtttctcaatacaccaggagggtatagttagaggatattggctgcatgattgtatactagcaagtgcggactaaaatgactatatactataagtacataaattattcttttcttattctttctccacttagcctaaattatattttaatgagagtagtctagtgagttccttctgtgtgtcaacttactctacccttgaattaattaacccctgcattagactttgatctatacaagtgatataaattattatcatagtattctcttatcatatcttcccttataattaaataaatacgatacattggaatactcccgggtgaaatgctaccacagtatatccgtacgcttacggattgtatatgtaaccgtaaagtacaccgagaatattttggcaccattgctaggaattatatttctagtcatgttgttaaaaaatatcaacaagggaccccaggagagagagccgtcgtcgtgggatctggcaaccgccacctcgctcgtgtcggccttccccagcaccgccatccccaggagagagagttgtcgttgaggtatccgacgaccgccacctcgaagggagccgccgctgctgctgtcggccaagggagccgccactgctacaaggagaggaggagcaggaggaggcgagagggggcaagagggaaggggaccgatacgagtggaggaggatcaaggagttgagaaagcggggtgagatgcgatcggataaggatgtcgacccgctcgggtttatttaatgggtgccggtttttttcagaaccagtacctatatttatataactaggaaggtagcccgcgcattcgcgcgggcatgtatcgcacgggtatttacgtggattcgtattttttaaaaaacttatagtgacagaatgtatatcaactggatgacacctatcacactttaaaagtactatttctctataaattttcttcaacggtgttgcttggataattgtttcaacctatctgttagctttaaactatacaatatttaatttataccggtaagaaatcaattataatctttttcattatcttgaaaggagattgacttaattagtttaaaacaaatgtcgaacaaattaagtgtatattaaaaataaggtgctctatttttaaacaactcctagaaaattattattactaataaatttgttttatttgtgccatcaagttacccctccttctaattggttcatacatgctcacacaatttgttatatacttacatatatatttgaataaagaggagtgatctaaatatcttgtttccttattatatatgtgatctatagtatttatttaaatacgtattcaacataagtcctaaagtttaaatgttgtaatagcaaatataaattttgaaccaactacttgctttcattgtgcagattatataccgcggcgctaggttattttaatctcaattaagttgggcggctataaatattggacccactgatttaagtaaaaagggatggattttattagcgtcacatggtagcatgagggcgttttaaggattggcatgtggcagcgtgagagcgttttaagaaagtttaatggacttgtagtattcaaccattaatataaaacaaaattattaaattatctaatattattaaattattaaattatggtccttcatccaataattcaataatataatccgggttaccaaattttgtaatatttattaagagaaagcggactaatctaatgatgtaacatattgcgtgtttttatagtatagaaaatcttattttaaaatgacggtctaattttttctactgatgtgcatacatattttaagggtgttatagtttttttactcgtgcatacgtacgtatgtttgtattgttttttagtaaacagtatctaaaggttttttttatagtttttcttctcgtacttacatacgtgtgtttggtttttaagtgaacagtacgttatctttttttcatcataagtacttacgctagtttttactcatatgcacgtgatactaagaggaaggaaatagatctaatctaacggtctaaaattatgggtccaccaatttaaatgaaaatcaacggtgagattataaaatgccatgtggcgacttaagagcgtttctaggaacgccacatggcggtttaggagcgtttataggaagattaatggacttttagtatataatagatagatagatagatagaagatagaagatagatagatagataggtgttagttcttttaaaaaatcaacacctatattggtactggtttttctctggaaccgacacctataatataagtataggtgtcggttcttttaaaaaaccgtcacatatagtatttgtaccggttttacatgtagaactagcacttacagtgtttaaatgtgtcggttctttattttttttcagcgtgtgaaggtgggaaaagatccataggtgctggttttaaatgaaccggcacctataagactggtccctttaaaggtttttttaagtagtgcaagttttcttttaaattttttttcttctactgaattaattagaccattcattttaaaatactagttaaatttatttatgaaatatttaacattatagttgagtagataattcgctgtaataatcagttcgataatctaaacagaacacggcctagtgtacttacgtaatggagcagtaagcaaactaagccgacggttgcagaggtggacaaccactttgacactaattttgttagtactaacaactactagtagtacaggttcatctctgcagagtcaggaccaatctgagtacctggttggtaccggtaccggacaaaaatctggttggaatctctagccagctagagtacgtacaatttagaactttccgttcctacttcctacgcgatctagcgatggttggaaaagccaagtgttagctgtctttgatcccatgtgtccgctagtttttgcgacagagaagaacagagcctaggggattcagaaatcagaccaattaatatggctcacagtcacagtctcgcggaccaaaatctagtgatttggatgtatccccactccccagctggcgttggacaaggcagaaaatgttaaaattattttatcttatacgagacgagaattgctactatcaaataaacagatttggagtaaagctatccccatattcgcatcctcttccagcttcccccttgtcaaattttctccactagtcttgagtcggatgcacctgtatattagactcaaagtgatatgcttgtccttcctctcgacaatagatgtgttcggtggagatttttggcttgtggtcagctacggaatgggagagaatggacaacagagagtagggaggttggcctgctccgtttaagcctttagcacaatatgacatagctgctcaacttgggctcgtttctaagggcgtgtgcaa

SEQ ID NO: 50371 - DNA, 1960 bp, Oryza sativa
  unsure (1)..(1960): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgagcggaacgaggagaagggggtgtggtttgttaaggagtttgataaccaacatacgcacgaacttgcaaatcctgaccatgttgcttttttaggagttcatcatgtgatgagtgattttaagaaagcccaagcggtcgagcttcgcatgagtggccttaggccctttcaaatcatggaggttatggagaataaccatgatgagttagatgaggttggttttgtgatgaaggacctttataatttctttacacggtacgagatgaagaatatcaagggtcatgatgctgaagatgtgttgaaatatcgggcgtcttaggaatgtgttttgggcagattctgaatcacgtttagactatgctgcttttggtggtgttgttattttcgatagcacttaccatgtgaacaagtacaatcttcctttcattcctttcataggagttaactaccacataagtacaacaatttttgggtgcggaattctatcaaatgagtatgtcaactcttactgttggctccttgagacttttttggaggcaatgcgtcaagtgcatccaaaatcattgattaccgatggcgacctagcaatggcgaaggctatcagtaaggtaatgccgggtgcttaccatagattgtgtacttggcatatagaggagaatatgagtcgtcaccttcgtaagccaaaactcgacgagctaagaaaattaatttatgagaatatggatgaggacaagttcgagagacgttgggctgattttaaggagaatggaggcacgggaaatggacaatggatcgctctgatgtaccgactaagggagaagtgggcagctgcctatacatattggaaatacttgttgggtatgcacagcaaccaatgtagtgagtcactgaactcaaagcttcacacccttctaaagagaaacatgtcactaatgtgcttagtcaaacatgttaagttgtgcatacaacgcctgcataagaaggaggctcagttggacgctaagtctaccaattcggtccctttttgtagaatagacgccgacccattggagaaagacgttgcccgtatatacactgcagtcgtgttcaagacaatccgtgcacagatacggctaattgcaggacttgaagtcatcagtgggactaatcaagatggttcgtcattgtatgctgttggtttgaaggacgataatgaggtgtgggatgaagtgagggttacttttaaaggccaggctttggaaggtgtggaatgtcattgtcggaagatggagtgcgaagacatcccttgctcacatatttttgttgtactcaagttccttggttttgacaccatctctcgttgttgtgtcgtggataggtggacaatgggagcaaaggcgacatttaggtcagacaggaatgccgatcctaatgtgtggtctgaacacatggttcgttaccgtagcctccgaaatctgggtagtgatgctttcttcgaggccgctaggaactctagcagacagaaaaggcgatggatttcttaaaggggattttggataaaggatcgtcatccgatgagaacatcgtggctggagattttggtcctatgccaactcacttttcatctagtaaccagccattagagaagagagtacttgatcctgaagagattagggcaaaatgagctccatctaaga

SEQ ID NO: 50372 - DNA, 5237 bp, Oryza sativa
ctcctattattccgtttttaacacacgaggtttttaaaactaacagtaccgatatccgaaaacatggttttcacgtacgtactcgagttggtccgggccgagtcgatttgtaagaaaacaatttccggtcgatcatgttgcccaccgggccggtttttgaaaatcataaatttccagtcgatcgctcgtatattacaggggaacggattattttggacaaatacaaaattaagttgccgaccaggtcattttttaaaaatcataaatttccggccgatcgctcgtatattatagcggaacagattattttggacaaataaaaaattaagtcgccgaccaggtcggttttttaaaaagaatggatttctggccgatcgctcttatattacagcggaacggattattttggacgaataagaaatcatgtcaccgaccgtccggatcgggcctgtttttgaaaatcataaattttcagttgatcgcttgtatattacagcgtaacggattatggattattttggacgaataaaaaatcatgtcgccgaccgtccggaccgggcctgtttttgaaaatcataaatttctggtcgatcgctcatatattacagcggaacggattattttggacgaataaaaaatcatgttgccgaccgtctggaccgggcctgtttttgaaattcataaattttcggtcgatcgctcgtatattatagcgaaacggattattttggacgaataaaaaatcatatcgccgaccatccagatcgcatggaatatatcggatccgattgttttggacaaataaaatcttgtcggaacttatcgaacttcctgcgttttaaatacacgaggttttttaaacaaatactagcgatgtaggtagcagaagtctaacataatttccgttctctaaccgaattgatttgtttcgaattatctgttatttattcctgccgaattatatgttattttttagacctaattgatctcctattattacataccgagcttaatccacatgtaacatatacatacatacatatatacatacatacatatatatatatatatatatatatatatatatatatatatatatatatatatatatatatatatatatatatatatataggagacagttctcggtttgttcacatgttctggacaaaaattacgaaataaataacaagatgaggccaaattacgagccgccgacggggagcaaacgaaaacaatttcatgcagcgacgacgggcacaagccaacataagaaaaaacgggtacgtctttttacatacaacattcactttcagctcttgtatacatcagttgtcgaaatcttagactcctcaagccaaagttgcaataggtctaaggcgcaacgataattacagcacatatgattagattattaacgaatatagtctctcccctgattttactgtgtgcctcttttaagctctggctagtctctggagcaattgtatagaggatgtagcagccacacagagtacacagcacggcaagatatcccaaaaaatatacttgtacaactccataaaaaaaaagagaatggcacctaatttatatacctgtcctactccatacaactattttatatacttgtcatactccatacaaaaaacgaacagaatggcacctaatttttgagaagacagtgatattaatccaaagcaacatatccatgttatatattcagcatgctaaaaatttagtaattacatgacatccacatgccattagggcatataactttttgtctcgactttttgccaaaaaaaaaaaaaactaaaagcctatgggagcaatgggatgaagcaatgtacctgcggggagtgttaggcgcagccgtagatggtctgccggcctgaccaacccctgcttcgacgtggtggatttgagatccagaggcgtttgtggcgggaagctgacaatggcactggcgacgccctgcagtagcaaagattcatgtgtgctgatgtattgggatatatattattgattagtgagaattagttaggatttctgagaatcataacgaagcaattatcatacaagtaattatcatagccatattatgatgagaatttatatagattgcataacaaaaacaaagtgtaagattcgtgtcgaagatctggcattaacaaataggggtcatcgctgacttaagtataaaataatttatctacaaccaattaaggaaatcaggatttcttatatttttatccaaactcatggtgttctccacaaatctaaagaggtaaaacttagatgtagcatattcagagaggctcaatgttttcatatgtgtttccgttggtgacctagtttagttttagactgtctaaaaatgaagatctaatcctggtcactgtcagggtatacacagatgtctgaaagcacaggttccatgatatgtaatctcctacaacaaagaaaatgatttactctgtaatataagaaaccaactttcagatactggttataatgggttgcatgcctgttcttccaagattacaagtttaaatttcagccaacaatgtgcggagatgatgtaaactcaatggcactacagcacttcattagcacctactgtttgttaattttgttaatactacaacaattcaaactcttagaaacggttatactgctttctgagcctatcttttttactgtctgaaatatggtgctggcctcatgagcaatgaaataggaaacatgcagtgcatatttatgttgaatccggaaatgttggcctcatgattaaagaagtaaaatagcagggctacgccacacacagacacactgtgaccatctaccttagaaacacaatcatgcatgatattccatccagacaatcttaattatatttgttgaatcttcaacccaattgagatcttatgaattatactgaatatatgttagaattgattggaaatttcaatataattaccacgcctcgacgaccgatctatattagccactatatgttcagaatttcacactttcaaactttcaaaccaaagtgagggatgtggtcatgggtgaaggtggcacaaacctgacagtactatgttgccctcgaagacctcactcatgttgctcccctcaaactcctcaacctcactgaatcctgcacataagaatgaacattgaacaaattatagagagggccatatagactgccagaacagtgatggaggacatcacttcaacatgtcagacgagtaacatgccagagcaggattaattatttcctttgatttctaattgatttctagcaggattaattgatctctaggtttggtaatgtgcaatcatatatatgagcacttgcataaattttcacatggactaaactcttattatcttttctgttaattagggaactctagtttgctctccacatgccatgtacgaggtaatactccatctaagtctacgtcaaaaggaagctatcgagggttcaggtcttggcaacttgctaaagattgacaacatacatattgaccgaaacttgtgcaatgagattgcaagaagctatgacaaggagaagaaagcattcaatattaatggtactttcgtaacgatgacactcgatgatgttgattgtttgcttggactgccatcaaaaagagatgacatatttgaggcaccaaaaatcaataaaccagaattgttcaacctgtaaaaaaggaaggccaaacaacaattactttacaagcattacgggaagcaataatcaactccttgagctacgatgaccacttcattcaaagatttattcttttctcaattggatccttcatatgtcctacaactcaaagatatgtgcgctcagaatatctcaatctcgtcgacgacgttgacaacatgagggaactaaactggtctagtctaacactaaatcagttactgaaaggcatattaaaatttagagagaagacaacaaacattgaggggaacgtatgcctcttacaggttcgtttcaaaattgagtttctttacaaaattgtcatgaacatattttcatagcaatactaattatcttatgtacaaatgctttgcagatttggtattgggaaaaagtgcgaatagataaattggctgcacaatatatcattctggtcgtcaaaggccactaattcagtactgggacaaaaaaaaaaaagaatttcttacctttttggacaagggaaggtaactatctcatttttaatactatgtactaactatatcaactgtctgtaaaatctctaatacacctttttcactaaaaataggttgtcgacgacattacgggaactatacattgcaatgaaatccccgatgaaaaagcgcaggacaatgactcagaaacacgtagcaatgaagattttcaaggcacttctgaagaggtatatattatggggttttaatacgaactctatttaacaaaatatgtttgacatccttttctcacttgtgctattcaggtacactctataacatccactgaacaatcagccgacatcactttacaagaaaggttacaagaaagcatccaaactttacaagataatttcaacgatttcacaaaggatttttggccacgtatgcgatcattgatactagattgcatggaaaatgattcaaaatgcccagagcgaaaagatagtacgcatgtgtttgaggtaaagatcatatgctagactgttaatcattattacttacgtaacaccgctaaaaaaaaggttgacgctattgcaggatgttgaacaagaacaaattgatcccagggagcatgtatcaaatcataacgaagagtcctatataaatcaaaatgtaaacatgacttgtgaaacgaaggtaaactgaattttatttctctcactaacgttactacaacttatcataatactaacgtgcactttattacctaacaggacaatagtaactagagcaatcaaagcaggaagatgcttacaggtcctacaggaagaacatacaaaccaactaatcggactgacttcatctacgaaacaagaggtaaaaagaaggacataatcaaaacccaagcacagacaaagaaaacaataggtactatgctatttcatagttgcatatgctcatgtcaatggtactaactttactccttttcaagcgcaaacgaataaagaagcttacatgccagacacaggcgaattacggggtgaaaagaagaggaaaca

SEQ ID NO: 50373 - DNA, 2346 bp, Oryza sativa
aagcctactattcttttataactatatttgttatataactgaactaacctcaaattcaggtcatggatgcatacatcctatgcctccgctataaagagaaaggaatcaggggagatggcaaggccttcctagagatggccatgaaaacaggtctactaaatgtagagggagcgcatgtcgaagcaagcaaacctcgagataaacgatggattagagatatggcacgcgactatctagcatttgacatggtaatacttattcaagctatctatgtaatggctaattcaatttatgactctatctatgtaatggctaattcaatttatgactctatcttagtgttgaacaatgaacatatgcagattttcctcccaattaatattaaagatacacactggtacctagccgttcttaacgccaagcgatgtgaggtgcaaatactagattcgctcgcaaagccaatcagtaaagatcgacctgatctaaggcgtgtggtaagcaatacacttccacttgtataattcaaattggttttgctatgttttaaccgtaccaacgttgcacaaaactttccagctgctagctattgagaggggattacacgggacagagaatcagcacccacagttaaaacacgattggcctgatttcaatattaccgaatgggagtacaacaaagtccaaaacttgccaaagcaaggagacgggtgggtgactcaaactcttccacatgatattcacattattcaattacgcaaacatgttagcctaacgactaaattcttgtagcttctcgtgtggcctgtacacccttaagttcatggagcattggagcggatcttatctcccagaaattcaactacaggcaactacaacaacctctattcatattttgcaccagtgcttcccaatacaaaaaaccatttaaaatgcactccctttgcattatgcagaaggaagtgaaaacatttcgacaggacttagccggaattttgatcaactccgaactgaacaacattaaagatcgtccactgctaccaaccacgacataaatggattatctgtcaaacatttaccacaattaccttactatgctctcttacccttattaaataatttagatactacttgggtatttgatggatcccaaacattgatgcctttttgagataatattcataattcatatttcaatccatttgagaaggagcggtatatgaaaccttacgcttcgggatgactcagcgcagtcagctatcgacgtcaccgacgtgcgtatgctacaatgtcgcacctgaacaccgataaccccttcgccggcatacggatccccttcgcgcatgccaccgtcttgcaaactgaccctgctcccaaccattcaatcaaataatcaatatacaatacaatggattcaagaacaaacaacctttatctgcaaaatcataacagtagtggttggtatattaagatgctgcttaggtgagcactataatgaaggctgaagcaacagagtaaatgagtaatctcgcattagaagatgatactctttaccaacttctcttcgttgtctttctgataccgtataactgaatattggtaagaaaagtatggtaagattggaggattcagaatgtacctgaagctcggctgtctcctctcgattcctcgcatagtatctgaacactaaagatggaaaattgtaaattaaccaaaaaaaactgcaattcaagacaatagaattggtgaattgtgattaatatgacacagttagtagtactcctattaactaatagagtatcgcttacactgggttaaatcggttgccaagggcatgttcacacttcagagaagggggcggctaggtcgatggcgacagaggtggagtggagaagggtgcgtcggtccatggggaggagaacgtggcggtggtggcgcggggaggcgacgcggcgaagaggactcatcgcgcgccggcggaggcgggtggaggggcggctacgtcacgcgactcgctagacaagagggcgggggaggaggacagcgacggtgggggctcacaagccggcgcggagacgcgggcggaggcgaaggcggcgagggcgacaaggaagggcttcgacggagggaagccgccaatatcgggggaggcggacgtcgacagaggggcgctggcggtggagaaggcggcgaggaagggcgagtgcggcgagggagcagagaaggcgacggcgctggagggggaggagacgccaggacaggcgacggaggcggcgagggagatggacggcggcggaagcggggatgggggggaatggcgacgggaagtggtgaaatggcgacgatgcg

SEQ ID NO: 50374 - DNA, 4513 bp, Oryza sativa
tacccgttgtaacgcacgggtattttagtttacccgttgcaacgtacgggtataatttggagtagtaatgaaaaaaaatacagtgatattatgtttcctgatataatcttggagtatatctagaggacactgtaataattcgccatgatcaaaaagatcaatgaagcacggcttcctcttcaaaaaattttcctactaattattacgacaaacctaagcaaaatcgaattccaatctaactcgacatggccgcaccttcgccgtcgtccggcgatcgggcgcccacccgggagacggcgtcgacgcagcgcctcaccatcacgccgtactcctccttctccggcctcagctccggcaagcccgtcatctccggtctcttcagcctcggcggccacctctgggacatcctcttcttccccggcggctactacagtggcagcccctacgccgccgtcttcctccgcctcgtctccagcgaccacagggagcagtccgcgtgctcgtcgacttcaccctcgtctaccgccgcggcgggatgaccggcggcggcgaggacgacggctcgtacacgcgctgcgggtaccatgtgttcggcccgggtccagccaccgtaggccgcggctgcttcggcttcccggagttcatcctgcagcacgacctcgccgcgtcgggggtgttgctccgcggcgaccgcctcgtggtcgagtgcgccgtgctcctcgccgccgacgccgacgaggtgctgcggcggggcccgcggccgctcgacgacgagctgcggcgcggcctccgccgcatgctggaggacggcacgggcgccgacgtcacgttcgtcgtccgcggggagcggttccgcgcgcaccgctgcgtgctcgccgcgcgttcgcccgtgttgctggcggagctccacgggccggcggcgcgcgccatgggggagacacaggacaccgacgatgccaccaccaccatcaccatcgatgacatggagcccgacgcgttcgccgccatgctgcgcttcgcctacgacgataccctgccggagctgcccgggaacagcgagagggacgccaccggcgtgcacatggcgcagcacctgctcgccgcggcggacctgtacaggatggacgcgctgagccaggcgtgccaggacaggctggcccggtgcgtcacgccggccacggcggccgacacgtacgcgctggccgacaggctcggcctccggctgctcaaggcggccgtcgtccgggacgtcgccgccaccggcgcgcgcggcatcgaggccgtcaagaacagcgaggggttccggcggctcgcggcggccgacgcggcgaccgcagaggagatggtgaggaaggtgatggccgccgcgtcggcgcatgtcaagagggaggaggtgtccacggtgagctccatggagatgatcttggggtcccttggtgtggccgtgttcgctgggattgctttggctgcacttaattttgggccattcagaccaataaaatgaaggaaagattgtcgatttttcatatcccttctttttattaagctactaattaagcacctaaaacataacatgcaagcattgtatttattcgtactcctaaaacctacatgcaagcatgctacattaacccattaagcacacaaaactcaatatgcaagcatatagtaattatatctacaatctattttattataaaactaaacatacacatgctaattcattattgacaaatcattttcataatatttcaaactaaatcatttcatcatttctccaatatctaacatatatcccgcagaaaagcacgaggatcatctagtatatatgtatggagttaggatatatgatccgcgggcatcatatagtatatatgtatggagttgggatgatccaataaacaattgtttgtgttttcgaatgaacagtagaaatttttgtagaggtggagggatttgaatggcaaatttggagtgtgaatttgggaacacgattttcattcgagaaacgattgatctgacgttgcaattggattttaaggcctgatttttttattgcttatatttgaatagaggactactccctctgttccaaaaaaaaggcaaaccatgggtttctgtgtccaactttgactgtccgtcttatatgattttttttataattcgtattttcattgctgttagatgataaaacatgattaatattttatgcgtgacttgtctttttaattttttttataattttttcaaataagacggacagtcaaacgtttggcacggaaactagggtttgtcttttttttggatggagggagtagaagcttaggctgtgtatagatataggggtgaatgaaaagttttggcgtgtcacatcggatatacggacacatttgaagtattaaacgtagactaataacaaaacaaattatagattacgcctgtaaaccgcgagacgaatttattaagcctaattaatctgtcattagcaaatgtttactgtagcaccacattgtcaaatcatggagcaattaggcttaaaagattcatctcgcaatttacacgcaatctgtgtaattagttattttttcgtttatatttaatactccatgcatgtgtccaaacattcgatgtggcaggttgaaaacttttgctaggggatctaaagaggcccttagaatgaagattcaagatttggtttgaaaagtttaattccttctttttaatgattggttgatactgaaccataaaaatttgtgttacatagtctagtatgaatgtcttttcagaatcaccaaaaataggtttgctacaattctgctgaggcgagggataaatttctagacatcacaaaatttctaattaagcttccgtgtgcgccttcagttttttttttcaccataggtctttcctttagagaagtgcaagggacgtgctcatgttcactagcattaatccgttcgtttccactaaaaaggttaataaaattttggatatttgtggcacgctttttaaattgctaaacggtgcgttttgtacgaaaactttctatataaatgttgctctgaaatatcagattaatctattttttaagtttgtaatgattaaaactgaattaatcatacgttaataccacctcgttttgcgtcaaacacttaatcttcatttttatctttatgttcaggagaaaaagagcacctccagatattcttcatctttgttttagaaccaaaattgtgcataagcacacatttatgaatttgtacaaattcctattccaaccgcaaacatgaaaagcaatgtccaagatcaaaatgagggcaacaaaatcgtgacaaaccaagcgcatttcagcacaaaattgatcattcttgccagttgccagtgcaacagaaacaatagcagcattatattcgctagaattgatatggatccaagtttcttatcaagcacataacgacaggagaataatttaggtctaatcatcaattccatccgtttcaggttacaagacattttgactttggtcaaagttaaactgctttaagtttgaccaagtttgtaaaaaaaatagtaactttttcaacccaaaataaatttattatgaaaatgtattcaattattgatttgatgaaactaatttagtattataaatattactatatttatctataaacttagttaaacttaaaacagtttaactttgataaaagttaaaacgtcttgtattctcaaaccagaggagtaataagtatcttttggaggggttgggaacggaaccagatcgatctacgtcaaagggacgtccaacgcgcgcgcgccgttcattttctatcgaatggtgccgagagagcggagagaacctagcctcgctttcggtccactgtaatagaatcggtccactaacaggtaagcgagaaatagctgagaacgctgcagcagcagttggaaaaagtacacccaagatccatcaacttgttatcaagttacaaaatcgtccctcgaccgcaaaaacagatatatgacatcccttaacttacaaaaccatttacttttaagtctctcggtggttttgaatccggttttatccaccgtgacgattgaatcagtgtgggccccacatgtcagatgccacatcatcacccctctcttcctcctctctctcacttctctcctcagtcatggcgggcggcccgacgctgccgcggccggggctagtagcccagcggcgaggaggaggaagcggcgacggcgccgccactgcaagggatctcaccgtgagttcgtgtgggaggagaaggggcgcagcgaagaggcggaggaagagctccttcatggacagcggcagggagagctcaccgtcggcgaggcacgggaggtcgcggggaaggaagcgggacctgacggcgtcggagtcggcggcggcgcggaagtcacggcagaccacggcgaggtgagggagagcaccgccacgaggagctcctccggaaggcgcgcgatctcgcagcggccgcct

SEQ ID NO: 50375 - DNA, 4914 bp, Oryza sativa
ccaccgcgaggggaggggatcccggcgacggcgagccagggaagtccgcgtccgcgtcagccgcggggggaggggatccaagcgacggcgagccaggaaagtccacgtccgcgtccgccgcgaggggaggagctagatcccagcgacggcgagccgggaaaagtcagagagagagagaggggaggggagagaagaggggggagagatgacgtggcatcctgacatgtggggcccacgttgactcagccgccacgtcggataaaaccataatcaaaaccacaaaaggacctattgtgaccgattttaattagttgagggatgtcggatatctggttttacgatttgaggatgttttttaactcgatgacaagttcggggaccttcggtgtacttttttccgcagcagtttcaccggccggtcgagggccgcagcggtggctctcctatatgacgctgacgccgaatcccgagcagtttcacaaggtgctcttgatatgccagcatggcccatggctgcaacctcaaccttgtcagtcgcctccggcaagtcgatcggcaaccaggtctacaacgtcgagtggaccaatagcacctcgtactacttcaactcgacctcctgccccgccacccatcagcatcctgccactcgagcacatgactgcctggccgatggtcgactgtcacgtctcgactcaaatcccacgagtcttgcatcattgcatcattatgtcaagtctgatattcttctcaagggaaattgaagtagtcaagtttctgcagtgattactatcctgacccaacaatgtgctttaatttcctattgaacaaatgcagtgatgcagtccaaaatttcttcactggttcagtaacttaatacagctctgccatgacttgtgtctttcgatctgtttcccagagatgcatgcagcagcatgcatgcgacgagcttatttgagttggatggtgttctaacttctaagtgtggcaggcgccggctcactgcttcactaatgagaatagtaaacatagcgtgaaactgctcgggccacgtagtcagcgccggacgtgggtgccgccgccgacgaaattaagccaccgccgcgtcctcggatggcggtgtgaggattttggcaggaaacaatcgtacgtttcagtgcgttgcttacgcgctaatatatggtgagaatagccctcactgtggcgattacagaagtccacgagatcggcaacaaccgcgccaactcgggagagaaaccagtatgcgataacaaatgtaaaggaagagataaaatctaatcatatcttattacaactaaaccgatcattatcgcatgcatggagatagaaatagactcaactaacaccctctctcaatcataaccttgctaggttaagattggctttaaacttctcggttaggttaagattggctttaaacttctccagaagattagttgacaatggtttagtaaatccattagcaacttgatcaccggaagaaacaaaatcaatttccaacaatttctgacttaccctttctctgacaaagtgatagtcaacctctatgtgctttgttcttgcatgaaacactggattaacagataaatattttgcaccaagattgtcacaccaaattttacctgcacggggacttttaatccctaactcagcaagcagtctgcacccacataatttctgctattgcattagctatcgccttatactcagactcagtactagaccttgacactgtggtttgtttcctagcattccatgacactagctagatttgagccaataaatatagcaaacccacctgttgaccttctgtcatctatactgccagcccaatctgcatcagaaaatccactgaccaatgtagaccctgacttatgtatattcaagcccatcttagtacattgttttatatatctcaggattcttttaacagctgcccaatgtactgttgtgggggtatgaaggaactgacaggttttgttaacagagaaggctatatcaggtctagtgagttaaatattgcaaagcaccaactatacttctatattgtgtagcattatttggacccaaaggagacccttcatgaacagacattttttcacttactgacaaaggagtagctgctggtttgcaatttatcatgcctactttctttagtaaatcagtagcatacttatcttgtgtcaaaataataccattatgtatcttgcttacctcaataccaagaaaagtagtgtagttctccaggatctttcaaggcaaaatatgtctttagatcctgaagtaaagctgcagttgccctctctgatgaactggctacaattatatcatcaatataaacaagaacaaagatagtgaactcccatttattcaggaagaacaaggaagtgtctgcctttggttcactgaacccaagttcaatcaatttctgactcagtctagcaaaccaggctcttggggcttgttttagtccatacaaagatttatcaagtttgcatatatagtgtggtttggtgacatcctcaaaccctggaggttgttgcatatacacctcctcttctaaatacccatgaagaaacgcattctgaacatccagttgtctaagactccatcctctagacacggcatattatcctaattgtggctgcttttatgtcacgcccagaaatttagcccaaatttccagactattttgtgtattaaatccctgtccaggaccagccagggtacacaaaacgacaagtaataaacagctccaaacgtaaataaagcataaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcggacgtgcaaggggatacaaggaggggtttgtggctatttgcataaaggcggttgtaaaacattttatttagcaaacagtaaaactgttgagtaattaaagtaacattaaaatctccactgatcaacgctacaccacgttgaacaggcccaaccaacccacctgtactacagtgcattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggtaagcactgtaagtcttccagggtttcccgtgaaccggtccttaattgccatgggtgcgactcacaaaaccatgcacccacagcccaccattcagtcgcattttagttggataattatgaccatgtaacatggccagatgtctcgagcacgcggctcaacaagatactagaatgtctaatactgcaattatcccatcgactgagctagtggtaattaagcatggctaagcatatagttctagctaggtcacataagtaacacgagctagtcaatttatcacccaagtttgacaaaggatagatatcaagtaaacatggcacaagcgagcagataggaaaaccctgatcccatgtaattagcaaaacatgcatatttatttgtaaacggtaaaacatttataaattgggatcaacatgctcaaggagaatgtgtgacttgccttgcttcttcactttgatcttccgaactcttttcctcgcgaccgcggacttccgaaacgacggaaactacacgctggcacgcaaaacgaggaaaaactctaataaaaaccaaggaaacagtacataaaaagtaaacaaacatgtagagcttaattttagatgaattttgcaatttgaatggctcaattcggagttcgaatgaattagatatgaattttagaagttttgagccatttaaatggatttctataattaaactcgatttattgcgcaattattaaatattttctcaaaggaaatgttattcgctgacgtcagcaaggggcgccggcgccgacaggcgggcccaacacgtcagcgggtcaaggaggtgcgggcttggaccgggtccaccaaaagagcgggccccacgcgtcagcgggcaaaaggatctagcccaccgtggaccgagtccacggtagaggtgcaaggcggaggggagggttggctcgccgaccaacccgaccagacggcggcgcgcggccggatgaccaccggcggcgacacaggcggcgacgcggcgcggcgcgacggcgacacgcatgcggcggccggcgggcaaagagagaaaaagaaagggaggggaggaggagggagatgctcaccgacgcgggaaggacgacgacgacaatggtgatggcggcgtcggcccgacgagcgagggggcgaccggggagcggcgaaaacgagcggaggaggcgaagagggaggcggcggagctcaccgaggggcatggcggcgaaggaggcggctgatggggctcgagcagagggaggcggcagcatcccacggggcgaagacgacggggtattcg

SEQ ID NO: 50376 - DNA, 7056 bp, Oryza sativa
cggcggcagcggccggctgaaggcggtgtgtggcggtagtggctcggcctcgcgatgggaaggtggttccggcggtggaggagggagatggagtggatgccggggtgcggcgaggcactgtgatgctataggtggcggcggcgcagcgcggcagcgacgggagcggcggtggcgggcggctggagatcgccggcgagcggcggcgaaggggatcggcgtggagagctcggtagagggcgtggggtactcgggaaaacggggaaaaaggaagaggagtccacggggattgattttatagctcaagggggcgaggagagggccggggagcggcggatttcgaggggaagtggggcggcgtcgtgggggagagagagacgcgggaggcggcgacgtgccggattttgcggggagagtggggggaaacggcgcggacgtgggcggcgaggtcccacggacaagcgcgcgcgcggggggtggaggaggtgggcggaaacggcggcgacgttggacggctcgggcggccatggcggttgctggcccgagctggaggttgggggtgaccccgacaggtggggcccacctgtcggcggctcgggaagaggaggaggatgagggaggcgaagcggacttgcgcgaggagggggcaagccgggccgacggcccaaagagaagggaggaggggaaaaggagggcggctgggcccgagaggatggagagggagaagatcttgggccgaaagcggcccaagacaaagaggggaaaattttatttgttttctttttattttaattgatgcaatgatctttgtgctattaaaactatttctcgagctccgaaaattcacggaaaattccggagagtacattagggcacaaagaatattgcaaaatattcccggccaatgatttttaagggaaaattttaattctcccattatttcacttgattaaattgatttaacttttatttaatttctagaaaatgcattatttaatgatttttaatcccgaacgaaaatcggggcgttacattttactaccggactaaaggtatcctcataatgtataccatacctttgtttgaatcccttagctactagacgagctttgtatctatctagtgaaccgtcagcctttcttttaattttatacacccatttgcaccccgatgacattgttcctctctgaggtggaactaggtgccaagtgttattcttaactaatgcttcatattctgcatccatggctaatctccagtttttatcctttagagcctctagatgatcactaggttcacctgaactagtaaagcaggaatatttaattgtgccatcggtatataccttttccttgcaaatgccgctttgtagccttgttctgggatggacctgttgtggttcctgaatctccaactgttgaaaatgaggcagtatagtgtcggcatcgggattaatacctgtgacatcaagatcgtcagtatcaatgtcattggtgtcaggtgtttcaatatctgttgcaggactgcccgacgtcccatcacccgtcgctgtgcctgactgctgcccccttgtctcccgatgcgacggtgacccctgcaaaacaatgcgatcagcagcaggcgaatgctggtgtggcgacatggcagtactggactggcggacaggagacgcgtcaggcgtgcgcgcaggggagcgatgcacagatctgtcagggcgggcgcagggatcatcatgggagtcagcgccagttggatcttctgtggccgtttgatctgttgcagcatcttgaggcaaattgtgagacatattaggcagattagcaagtggattagcccatgaatggaattcctgttcatccccactaataatattaggtgccaagagagataattcagactgaaaacgagctcctgcattagcatcgagttcggagaagggaaacaccgtttcgtcaaagacaacgtcacgggaaatatatacacggcctgaggatatatcaagacacttgaaacctttgtgcatgttgctaaaaccgagaaaggcgcatctagtagagcggaattgcaacttgtgtttattatagggacgaaggttttgccaacatgcacaaccaaaaatccgtagggccgaataatctggtttttgatgaaataatttttccaagggggtagtattaactctgctagggactcgattaattagataggtggctgcctgaaaggcttcatcccaaaatttcaatggcatagaggcatgagatagtaaggagagacctacctcaactatgtgtctatgttttctttcagcagacccattttgttggtgtgtgtgaggacatgacacatgatgaactatgccaattttcgaaaaaaaaagaatttagggtttggtactcccgtccccagtcagtttgcatggctagaattttcttgtcaaacagccgttctaccataacctgaaactcctgaaacttttcaaagacttgagacttatgctgtagcatatagatccaagtaaatttactaaaatcatcaatgaaactaacatagtacttctttctccctagagactctggagcaggaccccatacattagagaagacaagctctagggggtgttgggagacactagatgaaacaggaaatggtaactgatgactctttgcttgctgacaagcattacaaactgactcatttgacacatctaaacatgggagattatttttattgaccacctgtctaaccactgacgaggagggatgacctagacgactgtgccatcgatggaaggagatcttggtggcattgcaagcatacttcaaggatggcttgggaaggggatagagcctgcaatgtgatcttcctttaaggagcgttttcttggtggctagatccttaagacaaaaaataatcacgatgtagttcaagaaatgcagagttatcctcaactagacgatgaatagatataagatttttctgagcttgaggaacatatagcacatttttaagatgaatgttgtgactattaggggtatgaacaacagtattgccaacatggcttatatccatacctgctccgctggcggtgtgaatctgctcattcccattgtacttgtctttcaccgtgagtttttccaactcaccggtgatgtgatctgtagcgccggtgtcgatgtaccagttggtgtcgatgccatgggaggagctcgccgccgcagctgctgcaacatgtttgttatcaggaacatagtcttcatcatacctataccagcaatctgtggcagtgtggcctcgcttgaagcagacttggcatgttggtcggcgatctgcagctcctggtgctcgtccacgcccgcgacctccggcattgttgccgcgcccgcaaccgcctaggggagcacctccgctgctgccgcggctgaagttgccgccaccgcaacctcctccattgccgccacctccacggcttgcaaagttgacgacgttctcctgggttcctcggtagagtgccatgcgaccctcgaagttaacaatctgagagtataattctcccatggtcattggttcggggcgcgcactcattgctgagatgacctcgctgtagccctcgccaaggccggcaatgatgtgcatgatcatctcttcttcttcaacaggtcgcccggtgcttgccgccatctcgtcaccaagcgccatcatatttcccttcttggtgttggtgagcgcatagtacgtgttgatcgctcgcgctctggtgtgggtggagtacatctaatcaattgttgtccatgcttcagccgccgttgtgcaccttgcgacttgcatgagcacatctcttgaaagagatgtgaggaggaagcctaggacttgttgatccacggcttcccaatcttcaaatgccggattcgccttcttctccgtcttgccatcaactgtgacggcgatctcggcgtctagcttctttcctgcgccagtcaggttcccctgtagacgcgcgccgtgaattgcagcatagacctgcaccttccaaagtgcatggttggtttttccaagcttctcactcaccaagcttccctggagaggattggcgctactggtggtgtaggaggaggacgccatcgagtaacatcgctagattagattggatcaggctctgataccatgtgaggattttggcaggaaacaatcgcatgtttcgatcagtgcgttgcttacgcgttaatatatggtgagaatagccctcaccgtggcgattaaagaagtccacgagatcggcaacaaccgcgccaactcgggagagaaaccagcatgtgataacaaatataaaggaagagataatatctaatcctatcttatcacaactaaactgatcattatcacatgcatggagatagaaacagactcaactaatcaactaacaggcggtggggctgcggctgtgagatgcagaagcattagcggcgtcgccgattcctccggtttagcaggctgattttattggagtgggccgaaagtgaggctgtctcgcttcactctgtactctctgctcgcttggcacctttagatagcaaatgaacggcgggcgtgcgttgtatgtccctctggcgtagatcgctctatgtcagacgatctggttccgtcgggaacccctcccctccgcatgcaaaatggaccaatagattaacacatgattaattaagtattaactataaaaaataaaaattagattaatatgattttttaaagtaacttttctatataaaccttttgcaaaacatataccgtttagtaatttaaaaagcgtgcatgtggaaaatgaagaagatgagttgagaacttatggtcgcatcttctttggtcatctaatctacaatgaatctggacgaagggttgtctagattcgttgtattaggagtggtcacaggttgccttattttgggacggagggagtactcctaagttaagtatttatttttattatgtagtattagcacgttagattggttaatgtatgatttcgtgatactctaggctgtaagcctctaccacaatatctggtgtaacataacacgtgtgatttgtgcaacttcaaccgtaccagtcaagctttcctaaaatttacttcaaaaatgtcaggtataagtttccaaggcgctcatcagattacaataatcatccacatttttgtcctctgctacctcttccacttcatgttatcatcctcattttccccaaaagaaatacaaacacaatgtgttacagatatgattttcacaggtaaggtccatgcttcccttgaccctattccacgacctagtatctagtgacctttgtccttagtaaaacggctttagtttcccttgtacttttcctctccattttgtattctttaatgatataatggtatccagtttaattgatctccatatcatgaaaggccagtcaagccatcaacctccatgcctctatcatcagtggtgcattcactggggaagccagcatctaagcatgaggggagcaacttgacaagtgatcataacaattagaaaatatagtaaaaaatatcaaattttaaggcttcccaaaggtaatatatcgtatatcaacataaaaaaacattatcataagaatgataatttatcatccttcagaaggtagtaggaggtatcacattttctagtgtaaaacttattatctacaagtaagtactaggtaactcgaggtagcaaaattttactataaaaaaataggtaccttctcaaggacctatttttttagatttactgttcactttcagcaatacgggttctagggagacatatcacaagtgatgataatattatctgagttaaatgtctagataaatagataaacaatcagataaaaaaaactagatcaaggcaaatgagcaacatccaggcaaatgagcaacaatatatccatcttgcaagtattgactaataatttagaaagagtaaaatacaaggccggtccttaaagttggagcgaagtgtcacttaggtccacaattttgaaaaatcgacattatgctccatgatcttgtttaagtgactcgttgaggtccaaaggacctctgaccgggttgactgtcttacgtggcggtccagcgtggaaacatatttgtattttgcacccctccccctctttgctttcccgtgtccgatccaatcacttcttcgtgtggtgcacacaggaacgcgtgaccgggttgacaggcttacgtggcggtccagcacgcgcacctgcgggactcacctcatctccaccacgccgcgcctcgtacccctccggcagccactcgctggcgttgcgtagcgcctagaggaatcgagctcgcggacggtacccgatgtaatcggcgcctctgtcccgagcgcgacgtagacgaccgacctcgctagctgcttgtcgagccaccgcatcatgtccgagcggtcgcggtcgtcgccagtgtcgggcggcagcaagatgccagcgggcacgacgggcttgtggtagagctcgttaaggaggctgcagagctgggtgccctcgacatcggggcagctgcagtagacgatgaggtggcaccgctgaggcgttaagctggtaggcagcggcaaacggcgcagcgaggccgtcggcgaggaagacggcgaatggcgcagcgaggccatcgaacgccatcttgaggagctctaccttctccggtgggacatcggccgtcgactcggcgcactccggcaaggcagcaagccatcaacggccacactaaggccgtggacgtcaccgtgccaggcggcggcgcgcacaccggtggatgtcgtcccagctgcggctggatctagcgccagcgactaggcggagctcggcatccatcactccggcggcgaggcatcgccccgcgaatctgccgccgacgacccgcaggaagggagaccggcaaatctggccatcggtgaggcgcggcgccaccggcacactagctgcaaagacgctgtccgtggcggcggcggcaaattggagagacggtggatggagttgtagcaggagtaggat

SEQ ID NO: 50377 - DNA, 2485 bp, Oryza sativa
agtcacttaaacaagatcacagatcctaattttgatttttcaagatcatggacctaagtgacacctcgctccaactttaaggattggccgtgtattttactcatttagaaattatgtagaggtacattacagcatggaaggtttagttcatggttgaacagtataccatagccatatcaaattttacacttgacattctgggcctgtttagcaagcctgctacggcaactgcgccgcgtgcgtgcggcactgttggtgccggctgcgccacagccgcgaaccagcagctgaacatggccactaggtgataaaaagatgattattatgtgaaaaagagaagagggggtgggggtgggggagggttgttattggcctggggaggcctgggttcctccagatcccctggcttcgcctctgctgcattgggtacgaagagaacatcctgagacttttttttgacgggaaacagcaggagaggctcctactgcgctatattaaatatatataaaaagaaggttacaatatttacaaataacatcctgagacttcttggttcgtccaaatcatgaggggtttctaatagccgcacgtgagtcatatgacccataagcataaagaatgaatgcatgatgaccgcatataatatcatgactgattagattagagagagaaattctcagggccatctccagaaatctggggcccctaaataaaatgataattggggccgtaaattttggaaatttcatatatctaatatcatataaacatggcatacttttagtcaactatataactttaatattagcatccatcatgaaaagaacaattgatggcatcggcaatattagcatcattaccttcatcggcaatattaccatcatgagtttcatgaccttcttcggcaatgttagcagcatgaccttcatcggcaatattatcgacatcaccttcatcaatatttgcctctactgcatcaccttgggcaacattaacctcgacctcttctacatcaccaccatgaccgtcagcaacagtagcatcctgagtttctcttacaacaaagctatcaaaagcacccttttgagattctgcttcatctagtcagtgaatcatattttctattgctggaagacatgatgaggaattgaagcaattgaggaaacaaaaacttccttttataaacaaaagaaaagacatatcacatatgtatttgattcaataatcaatccaaccaatcaatcattcaagaatcaaaatacttttacagactaataacagagatgagatgacagtctagttcgtcaaattacttgatgatgcagagatgaatagatgatccaggcaggccccagccggcagctgctagctcggcagcggcacttgcctcggcgtggtcactgcctcaccgctggtcacgcccttgcggcctcagcctcgccctcgtcctcgctgaatttttggaaatttccaaaagttcctttctgaatttccaaaattgatatgaccaacaaatttgctctctggtgatttcggaatttttagaaaatcacagtagaaatttccgaaagtttatttatctggtgatttttggatttcttttcgaaaatattttcagaatttccaacatgctaatttgcccagttttctactatgctcatgctgaattttttacactttttggaaacttgcgaaaacactatagcaacttctgaaaatcacggtagaaatttctgaaagttaattttgctctctggtgattttcgggcagatatgagggtgtggccaaaaataggccccatccctagggatggcaacgagtcaggtcaggcacgggcagagcaaatccatacccagcccgagacccatgtgcccatgcacgacccacacccgtaaagtctatcgggcaaaaccccgtgaccgtgcccatgcctgtcaaccacaggcatgcccaacgagtacccactgtgcccgtgagccgttgcctcatgcccaccgctgcgactcacgagcgtactctcctccaacctccatcccacttcctcctcgcctcgccatctccgcgtcgcggtccagatccctccggcgagcaccgcatccatgcactgcctccacgcggggagcctcgtatacgggcggcagcaacacgggctcctcctcaatggtagcttgttcccgtccctccaccgctcctcctccacctccgtcgctggtcatggcatcgcagagcaccacagcggctgcatgtgacgaggacgaggatgatgactatgccaattccgccttcccgcatcagtgccactgccggcctccgctgtgggtatgggggtaggagaggggaatggggaattaggttagggtttattagttgagtatatatgtgtccctagttaacgagccaaatgagccaagagaaagggtgtgagaattaagagatggctaggtaggcaaaaattagctaatacataggtaccgggtcgggcat

SEQ ID NO: 50378 - DNA, 857 bp, Oryza sativa
gctgaaaacaacacacacacagaaaataggctgaagaggaaatctgtagctcctgaccttgagatgagaatgtaaccggctgcttcatttattccttggattctttactatctgcctttgggcctattgtgcaaactttcttgacatattgtcatatttagaggcaattcaacacgatagcttacaggaccagctatagtaaaatgtctgaactgaacattattaagtcaaaattttctcggtctgttgaacatctgaaaagtagtagttttatgttcatcttcaagtccctgcatgactggtaatgtttcatactacacttttgtgcgttccactctggagttgccaattctagtgtaggaaagtaaatgtagtacgtgtgaaagatgatttaagaaagaaagtagtgcaacgtgtaattgcagggtaaaggcaagtgacgagagaacagcagtgactgtagattgtaggcagtggcactgatcagagtttctatgatttttttttttttttgaaatctgaagtgtgattgtactagtagcatgctttgttgcttttctgattctgaattaagtgctgcgcaatcgttttaaatgaacgtaaaaacatccgtattagtaatggtttatcgctttatcataaaatgttgcattgagtctatctataaaataaaatgtagcattgagtctatctataaaaaaaaaacatttggccgttcaataggatatgatgatatgatcatggctaccattaatacaaccattgttcacatcaagatcaagttgtacaagtgctggaatctaattcagccgtctgctatagtactgacttcaaatggccgcaaaatgtatatatat

SEQ ID NO: 50379 - DNA, 9172 bp, Oryza sativa
gacgcctcccccagtcaacatgttgatgaagatgaagtagacattgatgaatagtgagtagtcgcgccttgcactccccaaaaacctgatcgcccacctgtccgtgcaaacgtcgtacctgtccgtgcaaacgtcatagcagtgtgtggtttcgaaggcttactctcctaatacgtgtgcacacactcgtcaggatgggattaccgtagcagcaacaacattggaagtggatgaaacgtgtgtgtctcttctcccattctcattttataggagaaatgaaagatgaagagtaaaagagtcatggaataggaagatgaatagagtaactaattgtcatcaactatcctccactacacaaccatcaaccaaccatcaattaggagtaattgatattggttaccaattcattaatcaaatggattaattctcaaaacttttcatcccattgatatcccataagagaatgaatacacataaatttctagcatagtgagccttggaatttatttgatttaattggatcaattacccaattaaatctaacacatattaggcaactatgatcagatgcaaccatggaacatgtagattgaataaaaataatatcactatcatatattgttaggactttggtactccaaatgaatactgcaaacacaaatccagcattactgaatgactaaatatccagtgtttttcaggcagtttgataacaatggttgatacacaaatcaacacagtggttgatacacaaatcagtgcaaaagcctattgcatataaatttgtcgctagcaagccagacccttgagcgaacaaagatgttctgaccaaattcttatcattcaccaaattttgataatgcaacttggcaagaatgtattgaaagcaatgagatactctggtaacccataaaaaagatgctcgcatagtgaaccacactgtaaattaaatgaaaatcctgtataaccgagcaattgacgatatttatttactagttgatccataaacaactcctacaacatagatgagaatttctctctatagtctaatcggccatgattttacatacattccttatgttttcattcttcatgcttgtgactcacctgctgtcggtgaaatggaaaccagggtacccatttatctggcaaaaggatcattatcaaataaatagcatgctcagaatatctttaaaaataaaaaggtaaccctagagtgacgtagctaggggcccactctggtgggtcccgggcccacctaagttttcatatatgggattctccctagctgaggaggaatactgcgtgtatgactcaaatctctgagcataaaagtagcttgggacctggcttgggtcccaagcataccccaaatgcgtcttaagaatatagcctatggtctgcctcggacctggccctgtcctaggtcccagtctcaccttagtccttgtaggttctacggtcctcggcaaaaggggcgtagaaatctgcaagatttatatcttaagagaacaagctaaggtatgcttcgggcccggcctactcttgggccccgggctcaccttagttcgcatgagtcacgcactactcgaggatgatgagtgccaagacatacaaagcataaaggtgtaaactgaggtttgcctcaggcccggccttgtttcgggccccgagctcaccttggtccttatagggctcactccctctgcctagaggagcatcgagacgtacaaatcttggaatattccttcaccaacgacatcttcgagaaactcatccgaggattgccaaacttgccgggaagttgggcgtgctccatagccagctgtgaggcagtatgccccgccataattgaaacaggatcatgggggatccccaactagtctgaagttgaaaggacgtggacaagacaccagcgctgagtcacctaggactagtgacgccttggacacgcgtcacacatgcctcgcaccacttgatttatccaagcaagtggagaagcaacggtggcactgtttcgggcaagtcgggtctcgtcaggcccaccacgcaccacgtggcgagcacactggtgagatcctaactgtctcagatggagcccggggtaatatgaatcgcaagactcaaagggtttcttgaagactgtgttagggaaccagccggcgacaataagacagctgataagacaagactaatagtagattggtaataatgtgagcccctccttggactataaaaggaaggggaccatatacagatgaaagggttggattcttttagatcagtactcttgctttgtagcctgaaaaggtctccattgtacttagctgatctagagaagacaacgaacaccaacatagagtagggtattacacctctgggtggcctgaacctgtataaactcctgtctccctctctgtgcagggtagtcgggccccgtgaacccttcctgattgcagatagtccgtgcctctcaccgcaaaccccctggttggatctttactctcggggaggggtctccactccccgctgtctgagggactaccccctcgacacctgcgctggtagaaaccctacatattccgacaaactgataatatttcttaggatgttgtaaaaaaatgttcttaatggtgagaaggtacgtgcttgttctcttgttacctaatgcacctatgctgatagaggcatggaagttggtcgctcgactggcctttcatgatatggagatcaattaaactggataccattatatctttcgagaatacaaactggagaggaaaaatacagggaaaactaaagactttttagttaagagttaggacaaaggtcactaaataatggctcgaggaatagggtcaaagggaagcaggacgccacctgtgaacatcatatctgtagcacggcgtgtttatatttctttcagggataatgaggatgatgacatgaagaggaagagatagaggaggacaagaaaatacggatgattattgtaatctggagagcaccttggaactttataccttcacattttcttaagtaaatttcacgaaagcttggctgatactgttcaagttgcacaaaatcacacgtgttatgttacgctagatattgtggtgctagagcaaaatttgacagtacactaggttgggataaccattttacaaaggtttagggtgtacatagtcactgctacctatgacgggcaatgaacaggagcctatcaaagataactatagtcatctttcacaggtgtaaagctcgcacatgtcactgatgacccctcattggtgacgagtttggttgtggctcgtcacagatgtcctatgccagaccacaaatacagcccatcaaagataagtagtcatcgatgatgggtgtggctaggcggaaaagctattgggcgcgcgcgttccgggagtgcctaactaactattttagactctaactaactaaattagttttagataatgacggtaattaagataaaatttttctttttttggaagatttttttactaacagattgaaaacttttgacttaagatttaaactttgaattcaaattttgaaaattttcaactctaaatttaaatttgtaagacaaaatttgaaaactttcaacttagattttaaaactttcactcgagatttaaaaactttcaacttgagattgaaaattttcaagtccatatttgaaaattttcaagttgagatttgaaaactttcaacttgatattgaaaattttcaagttcagatttgaaaactttcaactctagatttgaaactttcttcagattgaaaaactttcaagttaagacttgaaaactttcaactctaatatttttgaaaacacgtgtcctaacaattaaaaaaataaggaaaaacacgaaaaaatagcgaaaaagatggaaaaataaaaggaaaacacgaaaaaaatagcgaaaaaaactgcgtgggaccgccagctggcgtgcgcgccagttccgtaactagcgcactcgcgccagttagcatgccctgtggctaggaggccatacctttgctatggggtgtatttcggcttgttacaagtgagtgcctcagtgatgggccactgggctctgtcacccggttctatattagtggcctagaatgtcacaaaatcacacattaactaatctgacgtgctactacattataatgcaaaaaatgcttaacttagatggctatcactctgatcaggtgaccaaagaactagcaaatttgagatatgaccaatatagtacatgttagatgattaaggccctgtgtagttcccacataaaaattttacatcatgtcacatcgaatgtttgaacacctgtatgaagtattaaatataggccaaaaataattaattgcacagattgcgactaatttgcgagacgaatcttttaagcctaattgctccataatttgacaatgtggtgctacagtaaacatttactaatgacggattaattaggcttaataaattcgtttcgcggtttactgacggattttgtaattagttttttttattagtgtctgaacactccatgcgacaccctatataatacctgatatgacacgcatatttgcaactcaaatatttccatctctatcaaaatttctattgttttttaaaaaacaaacaattaattgtcacctagatcatcccaactctataaacatgacaatcttccttcatttcactatcttggctatgcttgggtctgattttgataacaattttgttaaagttccttcggtgggggcaactggtggtatcttgattgcatggagaagcaagcttggatccattagttccggtagggttgattcacatagtgcctcagtccagttctgtcccaagataggggtcatggtgattgaattgtgtttacaggccacaagatgagatgagacgattcttttccttcatgatctttggggtattctgttgcattctttgggtcctaggctaaatcgcaggagatttaatcttgtttataaggatgcacagaagaataatgattgtttacacccaaatttggcacctaggattaaaataggaaagattgccaaaatttgtaagtctaccggtttcctccgagtgggccggtctgaccgccgtgtgttgagcggtcagaccgccggttgagggccagtcagaccggcggtgtgtggccggtttgaccggcaggtccgaatccgattgtgtttcgtcgggtctcgaggtttccttgctcgggaaggaatgtttcgggtttcctttggtttctaccccgagttggacgtggaggagggcctgtagagggcaagaccaacccctatataagggacatggccggttcattgtaaaaaaccaatctacaatcaatcaatcgaatcattttttcatattgcttttagttttctcttagtttgtccatctttgtcggtttgcgccataaaccgtccgccgctgctgcgagagtgcgacatctctttgtaggtttgtcctgaaaaccttccgttttgcccacgagacaggtagttatttagaaatcggctccgctagccggtttagttatcaaaacccatctaggtttagctctttgctagatcgaggtggttggcgactctaggatcaccgcaaggcttaaggtgctgcgatcgtgcttgtcaacttgtcaaaaaagttgccaacacgatttttggcaactccgctggggaggagatccgttcatcgtcaactcaatttcgacttcgtcatgacgaagccgccatccaagacggaggtggagccatcaatatgataccggtcacattggatgacttcgaaggagaagaccgcaaagctatggaggagtacatcaacgagctcacacgggaggcgttgatgagggcaagcactaggactcgtcaaggcgtgatcatcaagcccgggccacgtcctaagctcgctcctgatttggtaagcaatgatgaggtatcacaatctatccaacaacaagtagcatctacaatagattcatctatgattgcttttaaagataagttagatgcaacttttgagggtaaatttgatgagtttttaagggttaaattcggccctcttatggccgattacatgtcaaaggataaggcctctaccactgctaaccaacctcctatagatcaaacgggtagtagaaccaatggagcgacgcacacggccggtcagaccgcaacatagccgtcggtccgaccggccagacagccggtcagaacgggtactaccccggcggtcagaccgggactcaggctggtccgaccacgcctctggatgccggtcagaccgggccctgggccggtcagaccgacgcaattattccgatacagggaatagatccaatgactaatgctagttatttgtatcatcttagaacatttgatcctcctatatctactactgcaaataatccccaagttcccccacatgttcctaatgcttataatgacgttactagggggtatcctcctgatactagacaaagccaatataatcatattgcgccacaaacacaacctattaggccaccaaatccaccgccaaatcaacaagggcctaataatatggaggatataattagtgagattattaggaattgaaactaggaatcgtgctagggtttacaaaaagccgtatcctgattattatgataatgtgccgtttccccgtaattatagagttcccgaattcaccaagtttagtggtgaggatagtaagaccacatgggagcatgtaggttaatttttggcgcaatgtggtgaggctaatagtgatccttttaaattgcgcttgtttactttatctttgtccggtaatgcttttacatggtttacttctttaccggcaaattctattcatacttgggctcaattagaagaaaaatttcatgattatttctatactggagaaactgagcttaggttatgtgatttaacatcggttaagcaaaagtataatgagcctgtcattgattatattaagagatttagggatgttagaaaccgatgttatagcttgaatataactgatagagatttggctggtcttgcttttaatggtttaattgctcctcttagagaaagactagatggccaactgtcacaccctgaaaattcaaaatatataaattgttgtttaaatggaatttttagaatttattttttaaaagtcttgaagagaagatctaattttaattaataaattccaatataaaatgggcccagataaaatttcattaaatactttgcttaattctataattcctagatttttctgggatttatttgagctaaggaagtatttttaataaatggaattacatttaagaaataatttaaattgaaaaaggttttaaaaagtcttcttttgggcccaaaacccttctctctctcctcggcccagtccggcccagtccgccgccgcgcgcgcgcgccctcgctcgctgacaggtgggggttcgtcttccccgagccgccgtcgcccggccgaaccctagcgcgccgccgccgccgttcccttccaaatccggccgctcctttccttctccggccgaatcaaaagaggggaaatgatccccgagatctcctctaccttttctcctttggaaacatcggctaaatcggtttggaaatcgttggattcgagttcgaatcggatcggcttttctctctccgagctcgagctttccatctcgtcgccggccgccgtgggccttcgccgccgcctcctagcccctttataagcttccccggtgtctcctctacccgccgccaccctcgccttcgcctcccctcgtccgttgcgccctagcgccgtgtagcttcgagccgccgtcgccgccgtcgctccagccgtgcgccgccgccgttccagacgtcgccgtcgctcgggaaaaccgccgtcgtggtcgccaagtcgtcgccgtcctcgtccgctgcttcgccacagtcggagaccgccggagcatcgtcgccgtcgtcaaaccgaagaccgccgccgtttcaacctcgtcgccgtcgccgtccgttggtcttccgctgctcttttggtcaccggtgagttcgccgcgtcgcgctctacccgttggtgccctccgttcgtgccgaagcgccgccgttcgccagcgagcgtgcgccgtccgagccgtctgagccgccgagccgccgccgccggtggtgacgtcatcgtcgacgtcatcgtcgccctctcccgtgagccggtcgtggaccgttcgatctcggccgtccgttttggatcaagtcgatctcggccgtccgttcgcgtgaaccgccgccgtgcgcccggtccaccaaaaccctagcccgctgacgcaataatcctccttttccttttcaaaaataattcattattgcgtcataattcaattaaaatctatataagtgttttaatccgatttaatcttcaaaaattcataactaattcatcttagctccgatttagttggttcaagtctctaaatttttctaaaattgagatctacatgttaaaaatatccacatgtactgttcaagcttgtttatgtgttgttttggtgtttttgctcttttctgtttagattccgtcgtttccggagagtccgttttcgccggagaagagtttgaagagttccaaggccagcaaggcaagtcacacagatcccaaacaaccctttgagcatgttgatcccgtttaaagctactgtttctattcaaatattgcatttattttcaaatgtcattgggtgggtttaacctattctttgttatagccctttttgttcttgattactttattccttgataccttgggttattataatttgactagttgagctttatttatattggttcaactagatattagatataattgcttagccctgcttagaaacattagctcactattgggataacttaagattcactattacttaatgatggcttaatgatagttcacgatggtcaatcgtgattggttaattaattaatgtgccaactaaaacctgataatggtgggttgtgagcacatggttttgatggtcgtgctcatgacaattaaggacccgttcacgagtttcggttgtgaaacattaaccgtgccaaccacaagccagcgtgggcaacggctttatcttt

SEQ ID NO: 50380 - DNA, 19858 bp, Oryza sativa
cacacttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatatggtttaattacttaactgttttactaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagctttggtcaagctgcctgtggagtggagccgtctgcgccgtttatcttattttccgctgcttagatctttattgtttgagaggaactatctacctctgtaatgacattttatacgcttattaattagagtaataattgtactctattatcaatttgttattatgtgcctcggctgattcctggacgagggttcacacacatgtaagcgtttggaattttggatagaaattccgggcgtgacaccaacaatttcttgatgttagtcaacttatgcaaagggctctggctcaagaaagccgggttaaggataataaaaaacttgttagatcatatgacaaaaagcctaatgttaatgtgattgattaccctgaggctagtgatagtgaggaggaaggtgatcatgatatatatgttgccgaatggtcatggactaataaaaacaagccttttgtttgctctaacctaatgccgactcctcgcaaagatcggcaaagtgaggttaaatatagttttgatgtggccaagtgtgacaaaatctttgattatcttttacaagaaaaacaaattatattacctaaaggccatgtcataccatctcaagaagagttgaaacgtcgagcatattgtaaatggcatgattctcattctcattctactaatgattgcaatgtgtttcgacgacaggttcaatcggccatagatgaaggacgattgaagttcaccgatggctccaagatgaagcttgatcatgatccttttctggtgaacacaattaatttcaatgataagaaggtgttgattcggccggagtaagccgaatctactaagggaaaaggagtggtcattggcgaaccaaggcctaagacgatagtgccaaagaagccggaggttggcatttggaaggagaataagagtggagcttcaacttctaaagcccctaggaagaccaaaatgacttttgatatgcttttggagaagtatgagaagcaaggtggtgagagggttcacaacaaaggaaaaagaccaagatcacctcctagggaacaatttggtcattcaccaagacggtcgcattcacctccatatcatcatccacaagacatgtcatggggttcttatccaatgcagccgccgggttatccttatccttattacatgccatggggggcaacgccgccaatgttcaatcatatgcctccaatgcaattcaaccaagggtggggaggatcaagaaggccaattcatgagcgtttgtcttcaccaaataatggccggttttatggcaggaaccgggccaatgaagaaaggagggaaggaaagcgcatcaaggtggaggcaaggacttcagaagtaattaccatcaaagtggggtctcatgatgtgccaataccttctggagatggaattggagtatcttcaaacaaaaaatccgaagccgaaaccagctcctcgcagtcggccggtctgaccaagccttctggccggtccgaccgcagccatgcggccggtctgaccgggccatcaggccggtctgaccgccgacccgacagcggtccgaccgacgcctcaggccagtctgaccgttcgccaagtgtcgatctgaccggcgcatctggtcggtctgaccggtggtctacggccggtctaaccgggctccagcgccggtttaacaggagaattgcaaagggcgatgtgagggcttcatcgttttcaaacaaaattattaggggacattatttacctcctggaacagagccgaatcctagatggatgcctaaggatttgacggctactcaaaagagaaggttgcaacgtcttcgggctcaagaaataagagagaaaaaggctgaagaacaaagagataaaagattcaatgagttgcgaccaccaccggtatggaggcataaatccatagagaaggaaaagccggttgatgtagaagagaaggagaaacaatcggttgataaaagtgaatcatctccaaaagaagacatggatatcaacatggtttgtatgttgcctatggagttttgtgctatggatgaagccgaggttgctcaactttcattaggtcctaaagatgcggtttttgagaagcccgatgaatcaaaccgtcatatgaagcctctctatctcaaaggccatgttgatgggaagccggtctctaggatgctagtggatggaggtgccaccgtgaatttgatgccgtactcattattcaagaaattggggcgtgaggatgatgagttgaagaagaccaacatgattctcaatggcttcaatggtgaaccaacggaggcaaagggtatcttttcggcggagctcaccgtgggaaacaagacgctaccaaccgctttcttcatcgtcgatgtgcaaggtaactacaatgttattttgagtcgttgttggattcatgccaattgttgtgtgccttctaccttgcatcaatgtttaattcaatgggacggcaatgatgttgaaattgtgcaagcggatacatcgaccgaggttgcaatggccgatgctacttttgagtggcgtcatgggaatatccaatgcttgtcggggagggatctttctagctatgattttattagtatctccgatggcaaatttgtacctatctctgtaaagccggctagtgtagcacggctaagccatataaatttgtataatgagtaaagaggctaatttagagtggttacaaaagagggtgcaagaatatcggtctacaaagaacgatattggtgaaaccattgaagattttgatgaagtagagaagtttggaaaagggtttacatcggccgatccttgggaagaagtagatataggtgatggaactaaaccaaggccgacttttgtaaacaaaaacatgagagcctattataaggttaaggtatcgagctacttaaagagtatgttgattgctttgcatgggagtaccatgagatgccgggtcttagccgtgagcttgttgagcatcggcttccaattaaaccgggttttaggccttataagcaaccacctcgtcgttttaatcctttgctatatgaccgagtcaaagaggagattgatcggttgttgaaggtggggtttattaggccatgtcgttatgcggagtgggtttctagcatagtcccggtggagaagaaggggagtggtaagattagagtttgcatagatttttgagatttaaataaagccactcccaaagatgagtatcctatgcctatagccgacatgatgattaatgatgcctcgggtcataaggtgattagctttctagatggtaatgccggctacaataaaatctttatggcggaagaggatatgtacaagacggcttttaggtgtccgggatttgttggtttgtttgagtgggttgtcatgacttttgggttgaagaacgccggtgcaacgtatcaaagggcaatgaatttgatcttccatgatttgctaggcattatcttagagatctacattgatgatattgttgtcaaatcggatggtatggagggatacatagccgatttgaggttagcttttgagaggatatgatttggcttatgaaccattgaaatctatgaaaggccaaattgtatgtgattttatagtggaccatcatatagatattgcttatgagggagaagttggcttagttgaagttataccttggaagatttattttgatggttcttcttgcaaagaaggtcaaggcataggggtagttttgttttcacctaatagcatgtgttatgaagcatcggttcgtttggagtattattgtacaaataatcaagccgaatacaatgctttattgttcggcttacaagttatggagatggttggagctaaatacgtggaggcttttggtgattcggaattgatggtgcaacaagtcgccggagtctacaaatgcttggacagatcactaaataggtaccttgattcatgtttagatattattgccaattttgataattttgctattagacatattgctaggcatgataattctagagcaaataatttggcacaacaagcatctggctataatgtgaagaagggattatttctgatattagaagagccggtgcttgattttaaatctttgtgcgaaattggcaaaactggagaccaggggcggtctgaccggcattgctcggccagtctgaccggtgaccaggggcagtctgaccggccgcatgccgccggtctgaccggcgactctgagcggtctgaacggccctgtgtggccagtctgaccggttctgggcagagcgctggggggcacgtttcaatcaatatagtggccgaattaactgtgaattcggacatttgtgcccaggaagcagaaggagattggagaattcttttgattcgatatttgaaaaatcccacacttaaggttgatcggaaaattctgcggcaagcgttcaaatacacattgcttgatgaggatttataccgccgaaatatagatggtgtcttgttgaagtgcttagatgaagatcaatctaaagtggctatgggagaggtacatgaaggaatttgtggaactcatcaatcggcccacaagatgaattgattgcttaggagagcggagttctattggccgaagatgattgatgattgcttcaaatattatagaggatgtgaagcttgtcaacggttcggcaatgttcaattggcgcctgccgccgtgttgaaccccataatcaaaccatggccattccgatgatgagctttggatttcattggtcaaatttatccttcgtcatcaaaggggcataggttcgtgctagttgctacggattacttcaccaagtgagccgaagccacttcaccaagtgggccgaagccgtgcctttgaagaatatgactcatacggaggtaattgactttattttgaagtatattattcatagattcggtattccgcaaacaataactacggaccaaggtgcttcttttatgtctaaggaagtgaagagttttaccgaatcttatggtattaaattgttgagttcttctacttactacgctcaggctaatggacaagccgagtcgagtaataagacattgttgaagttagtgaaaaagaagattgaggaacacccaaagaggtggcatgaggtgctttctgaagcattgtgggcgcataggatatctaaacatggtgctactaaagtcactccttttgagttggtttatggtcaagaagccattttaccggtggaggtaaatcttggttctcttcgttatatcaagcaaaatgatttgtcaagtgaagattacaagacgttgatgggagataatcttgatgaagtcatcgacaagcgcttgaaggcattggaagagatagagaaagagaagaagagggtggccaaggcgtacaacaagagggtgaaagcaaagttgtttcaagttggagacttggtttggaagacaattttgcctttgggtactcggtccaaggagttcggtaagtggtctcctagttgggagggtccttatcgagtgtgcggcattgttcgagggaacgcatattttttggagacacttcaaggggagcattttcagcgagcaatcaacgggaaatatttgaagaaatacttcccgagcgtttggcaagacgcttaggaggtactatggccggtaattggattatcgtcctaagaccaaaacatgttctatgcttttagattcacgttgttcatcaaaaaggcaggggggcatgtgtttaaacccaaatttggcacctaggattaaaataggaaagattgccaaaatttggaagtctaccggtttcctccgagtgggccggtctgaccgccgtgtgttgggcggtcagaccgccggttgagggccggtcagaccggcggtgtgtggccagtctgaccggcaggtccgagtccgattgtgttttgtcgggtctcgaggtttccttgctcgggaaggcatgtttcgggtttcgtttggtttctacctcaagttggacgtggaggagggcctgtagagggcaagaccaacccctatataagggacatgaccggttcattgtaaaaaaccaatctacaatcaatcaatcgaatcgttttttcgtattgcttttagttttctcttagtttgtccatctttgtcggtttgcgccgtaaaccgtctgccgacgctgcgagagtgcgacatctctttgtaggtttgtcctgaaaacctttcgttttgcccacgagatgggtagttatctagaaatcggctccgctagccgattttgttatcaaaacccatctaggtttagctctttgctagatcgaggtggttggcgactctaggatcaccgcaaggcttaaggtgctgcgatcgtgcttgtcaacttgtcaaaaaagttgccaacaatgataatctcaacagggccatgatagggacgtttaggtagtcaaggaaatccccttgcatgttagaaattatacttggtcaaataatagggactctcttactcttgtcaaattggatagaatgatcttttgctcagtagaatgggagtcacattttcctaatcatgtcctacatattgctgcaacagaggattaggatcatcgccctttgctgctagccatctacaacatttggtatctcctaaccaaagtacttttataaaaggttgatttatccaagataacgtcatgcttgtgcaacaaacggcaaagttcttgcaatctcaaaaggagccaagaattgctctcaaattttacacgtgtaaagcctttcactctgcttttcggccatttttacttgaagtcttgcataggatttagccaagtttagcgggatgttttaagtaggttgttggctaggttttctactcaggtactcttaaatgtactcacaacgtgtcaatttctcaccggcatgggcttcagcaaggagatctcgtgtccttgatgctcttcatcttggtaacgactaggtttctcacatgttgtgtcagacggtcccatgccccttgctcctgaatatgtaagacgtttaattgggccttcaaagcccattaggagtctgatgacgagaaacgcggcggcctgggagttcggcttagttccagtacaggtccaaaacgcttttaggtttagggcgtgccagttagtttgatccgatcaccaacaagaataaacaagaaaatcaatcaaattagaatacgatagccgatcagccagtaagtcgatgacatatcgtgtgaacctagccgatgcgatctgaccgaatcggctgtgaggtgtaagatgaatgaaattaagtaaacctaaaatatgttccatattttgatgataatattttataaaaacaataattctaaattaataatatgaaaaaagaagtttacgagaatttaagattaatatatgataccatcacatactaaattttcaaatgaatgtatactaagttatccttagcatactagtttgtcatataaaagataaaaattacacatacatctaggctcataagaagcttgagctcgggccgacaaagctcgtgaacttgcgcatgggcttgggctcggctcattaagagctcgatttgagctcgaatccagtccgaaacgagccaagctcgagtagcgcacaagcctcgagcttttttgacagccataattgtagtgttgttagtagtattaatgtagtatgttgtatcgtttcatgtggactcttaggtttgtagaacttggtgggataggatgaggacctagtaggacaaatcattgtagtttttagtatattttattttttaaagtctagtttagttagttattatcttatttgataattgttgttgacctgttctgctcctgcttaagtgataacaaatgtttgaaccttttgcagttttgaagcattatgcttcgacaagataattggggtaagtggagatctggaagatagttgaagaccatggagagcaggtaatagtgcgtgaaccatggggactatgtcatagatgcaaatcgatcaaaacatgcaccaaattccatatatatagtttagaaacacgctattgttctttgtttggtatatttgctttgacactcgattattgcagcccaatgagagtgttgattgagaatctttagcttttccttttttacttcgaaacaccatcatatttcaaatttaccttattagataaggtgcaatggtagcagcaaaaaaaaaaaagctcatgtcatcacatttgcacacctcatgtatctatgatgtcagtctaatggcgaatccttaattgccacttgtaagagtggcaaatagttaaaatatatgtactattttttacacaacctagcatcttcaacactttcgatgcaacattggtcaagtgatggcaatctgtctacagcatttaacagaacaacatggtctgccaattttccatggttctatttcattacaacatagttcatccggaatagtagtattgctatggacaacacattagggtgccaaagcaacaagaatcgattcaagaccattagaaagtcaaaaaaacagttaggagagaaaaaaatcaagtaattaagtacgactagtgtggtacaaacatgatcaatggtgatagctcctacattgaacaaacaaaccatgcgagcgttaaatgcaacgtgagacaaatattagtaagagagcaaggacaagtttgggagcttcctgtagctatagctactcccgaaatctcgagctccctaaatagttcagacttagtgtttatagaatcgagaaaataaaatagtagcagaggctggataacataggcagcactcaaataggttgtctatctgagctactctacggcatggaaaacacgatagataactagaacatgattaattaagtaccaactattgtaaacatgacaaattgttttatttttttaaaataaacttctatacagaaaatgtttggaaaaaaatcatcgtagtagtttagttagtgtgttcacgataaccgaggaagtagccaattagagaatctcatcaaatgatgccttagcttctctagatttttcaccaaatggatactcactagctacttagaatctctatctccaccaaatagatggcatagataaaataagaataacagcactccaaaatatagtcggcacttaggtacttagacaagtacgataagaacaaatgtagcattgctaaattattcaattaaaatagatgagtaaaccaactcataaagttatcaaagatttattatagctagtgagcttgagccttaaacgaggaaacatatttagacaaaattcttcatcatattgcatttatgcctcttggcaagaacttgttgaatgcaaggagtagatcaggatacccatcaaaaaggatcttcacacgttcaataacagtatgagtgttaatcctgcataaccaaagtttcaataaaacttgttatccacatacaactagtaacacatgagaatttcttgctccaatctatccagtcatgattttgtaagcaaccaccctatgttaatgcctattactcacctgcccctggagaaatcaatcatggtgtgtatgaatgcatggaacttctcagggtgacgcaaaaatttattcttgatggtaagaatgtaattcattgcatcttctgtcgtcaacttatgcaccttcaccgatgtacgcatggaagtttgtggcttaatggaccttcaatgataagaagataaatcaaatatagtaccattaatactcgagaatacaaattgataaagaaaaaaacaggaaaaataactagagccttttactaagaacaaaggtcaccgggaagctgagttgaagaatgatgttaatggatgtggaacctaccggtcaatatatttagtacaaaataaatcctacataacatgcatttgaaagaaatttaaaaggtatagtgccaacacaacaccatgcatatttagttatgattttctcagttcaatcctaccagcgattatttcttctctctttgatttgggagggacgagatggttacaggtagggacggacctaggttttgcggagatctgggccggcacatggcatgtttgggccaagaccaccattgggtctgttcggttcagctgggctgtggctgcacagccacagcgctgcagctctcctagcataatcttgcttcctgagtcctgtagctacagcgcttccgaactcacccattatatggtgaaagtttgctggacctaatgggctttgtttcctaggcttcgggcaatggcatgtgtgtcttgaggcttggtctgcccttaacacaggtggagcaggagcccaaaccaagcccaaaaactagattcgccactagacctgggacatgaacctcaacaaatctagtcgacgacttggattgatacccaattaataacaatttgtaatgtaaattttatattataaccatatgacacgtgaaagagtgaaaaggtactagccagcccacactattccaacccaatagcctttagcccataaagtccaactactaccaactctcctctgccctaatttgtctctcacagtcagcctactcccccatcccacaccgcgccgcctcccctcacgccgcctccattcctccccaacctcatctcctccatcctccccctcatgccatccgctttcctcccaaacctcaacttcaccataatgtgctcccattcccctcaaattcaaaatgtatctcaaacaacaaaggcgtacaagagatagtcgtagagcaaatgaaggctagaaagtaatggtgaccatggtggagactagagaacaagatgaccattctaagaagaaggatttacatcatgcaaattaaaacccaaaagattttcaaacactaaatcagcaattcttcactcaatttcacaactaagacgaacaaagagtaaaacaagaagaggataacaagggatcgtagggattgatcggtctgactactcaccgtttgaaccccatggttgtgcctgccctttgatatggtctctctctccaatgatggtaatactcaatgaagacctactagactagctcaccctttatttgttaaggttgggcaagggaaggaatgtatatatccattggtaggatgtgtgctgacataggaaattgaagattttgaggggttttctagtctttacacacttagcttagataaatggcattaccaaaaaccggggtagccaaacaaccaagatttgccaaccaacatattttttaaacaactacacaaagttttctataacccgtaatctacacaatcgcaatatgtcccaaaggggtatggatagataagcaatcagagtcatagcccagaactagcacttccaacatagttggaatatttagtagcatgcttcaaattttaaaggatatgagatgggtgaaaactatcatcatgatagttgtttacaacctcttttgtcattttgatacatggttatcatagacctctaactctaatccatatcaagttgtaagggataattgttccgcctatggatattacatttagtatatgtgttgtatatggccatatgttcttttagtgaaccatattaactttttattctcatttggtagtcattgctggagccatgaattgttgttcgtaacaatctagcctctagttagttcttttatggcaattcactagttgggaaagtttggaattgatcatgctcgttatgtgctacaaatacttagatctcaacgatgattcatggagaaatgatcacccaaagtccataaccatatgtaatatcgatatagcattgtaggttgaaagaaccttgatgtcacctaagagtggtgaataggcgtttaaagcttttacgtaaatgaggaagctagactttttggatattccaaactattttcggatatttccatattatttttggatattctgaaaatctcagatttacgagcaagctagtaaagcaagcaaaaaagtgtagtggtacaagtaaggaaatgattgcacaaacaacaagtaaactactagcagcatcatcaattagctaagatagatgagtgcgcgagatatatcaccaggattcttgtaagacgatatgctcccgaagttcaaatacttgaggggattctactctccgttgaggagctcataatgagccaggtcttttccaaccctatccttgtgaggttgcacaaatgtactcctccttccactaaaggtatctcttcccattcagaggtgagatctgaccttcacaaacttctcccggccaaccacaagtagatcggtggctcgggagcgacacctagccgcctaggagttctcaacctccaagagtaacaaatgaagcaaagaactcccggagatgatgcaagtgctcacaaatcttcatgaagtcaacaacaagcactcacacaaactcaaatccacaactctcacacacacaccaaatccaaatcgaacacgggtgagaggggaaacaagaaagcaaggcacaaaagtgctagagagagagcaagccaagggcacaaatgattggaatggaaccagcagccctcacaagtgaggggagggggctatttatagccacagcccagattctgcccgttatgcacaataattgagattttcggacatgtccgaaaattccagctcagcaccaacagcaaagtcaacgaaggatttttcagacattccgaaaacttttcggacaagtccgaaaatttctagtaccaacaacatcgttctggatgttctcagaaaagtccgaaaataactttcggacaagtccgaaaatatacagaagcgaaattgactctactgatgattttcggaaaatccgaaaatcagtttcggacaagtccgaaaatatacagaaccacttttgccttcgcagtctttttcggaaagtctgaaaatcactttcggacatatccgaaaatttccagaagcgacaatctggttctgtgtgttttcggaaagtccgaaaatgagtttcggaaaactccgaaaaaatccagaacacaccaaactgaggagaaacaccttttaaaaatagattttgagcactttgatcactcctcgtatgtcaatgcatcatccctcttaatagtgcggccttcctattaactcaaggaaacgaaaacgtacaaaataccatttgctcatttgccgcatcacatcacatcaacgtattccgcgggatatgcattacgctaactcattattgaggacataacaaccttcacatttgcttaaataaaaatattagtcctctctaatcgcattgtaattaatcaccaaaatcattaggggcctagatgcactttcacaactcacttgtagtttcatatttagtatgttactttggtatagagtgaggggaagctccggaaggagtgcctcgaaatatcggagttccttcgagaattttatggaggagtgttggagtgtcagtattcttggaacggagttccggagaaaaccaggattgtcggccttcttctctcgcttatatctcggcggatactttctttattcaagtaagtgttcaagtttctttatgttctttaattaatttatttaattgagatatattctcatcggtgcgggttcattgcttagtgtgcaattaagtgctctattactagaactctggataaagaaagaagttcctgcgcaaggttagagtagtaattaataacttaggcgtggtgtctaggttaaaaattaccttcgtctgttgtgtgctcaacggaaaatgaggtaagcggcatgtggtgatagccttgtccgtccttcatattcctccaccatcgggtacatcataaagctcaaggccaaactaatcctggcagaccaggggagggacggtgcccgaagcattcaatagagttgtacctttaacttaattaattaattaaaagatataggaatcctctctagccaatttatactaagttgttgtccttggatcgaatcttgatagttgattatacacacattgtaaggggaagtgctacaacggtattccatgccctggccatggcttcttcgagcctagtctagccatgttcctccccttgttgagcctccggcggctatcgtcgccgaccccccgagtccaccgctggttgccatttttctgacccagtcatctgaccaacattggtgatgcatgtggatgccttttccttttctctttatttctttgtttggattgtccgattggatttcaatcggatttatggacaaaaattttcatggacgatgaaagcaaattgaatcggactttcctttttttttgttttaattttttcatcgttattacggacgacagaaatgttttcactttttaagtagtagagatacactttgataccatattgttcaacccaaaagcttaagctgatgagaaaaggtggacaattcactttatattccaacactccctcatgcgatgtcacaccctgtagttctcctcccaagcctaaaatttaatttataaatgaccctaagaaaatgccggtgcaaatcaagagaaaaccctaagaaagtaatacaaataataatcgaatctggcatgtggaatttttagtggaattttcagagccctagaaataatttttagtcactaacaggatttttagtggaattttcagagccctagaaataattttaaccaattaaaattgagcaaacaatattttaattccagggaaaatccttttcttcctttttctttttctttttcccccttttcttttcgagtgggccgccggcccattctccttcctcctctcccctccgctgggccggccgaaggccaaggcccagctaggccggccgcctccctcctcctacccgggacgccgacaggtgggccccacctgtcgggcccatctcctacctcgcgcccgcgccgccgcgcccgcaaccgccgccgcgcccacgcctccgcctcctccgggccacgtcggtcacgcccgcgcatgcgccgcacctcccgcgcccactcccctctctctcccgcccgcgcccgcgcccgagatggccgggattcgattttcgaatcctgcctctctctctcctctcccactcccccacgttggccggcggaatctcgcccctaccggccacgttcgagactcccctctcctatttaagctccgccgtcgccccctctctctttttccccatttcgccgaactccctcgtgctccccatcgctcccacgccgtgcacccacccgccaccgcctttcccgccgctccggccgccgctagccgccgctaggctcgccgccgcaccgcgccgtcgccgccgtcgggttcgcaaggacgaactccaccccgtccgcccttcctccgtcgggattcatcgccggaattcgcatcccctcgcgctccggtgagttctacctctaccgccgccttcggccgtggatgccggccgccgtggttcatctccctctctctaatctctctctcctccttccttagggcaccccgaagcccgtccgccggttgccgtcgtcctcccgtggcttgccgtcgccgttcgccgtcgtcttcctccgcgccggccaccctcggtgaggcttcctctcccctctattcccctccctctccttcctagccgccgcttagcgccgccgccttcgcgtcgcctttgcgccgtcgccggcaacgcgttcgcgcgcgcgcgccatcgccatcgccgtggccggtcggccggccttgagccgagccgagccgggtcgccgccgcccgtccgatcaaccccgggggcgatctgggccgtcggtcccgtggaccggcagtggaccacccacgtggtcccggtccacggtggaccaccctcccttgagccgctgccgagtagggcccgcttgccggcgcaccttttccctctctcccgagccgctgaccggtgggccccgcatgtcggcgccgcgcccccccttgatgacgtcagccctgggaattattgcgcaataaatgatttaaggactttttttatagtaataaacacagtgaatcttctaaaattcataactaattcatctgtgctccgtttaagcccattcaagtctcagtaaatcaagaaaaatgtgtagaatccattaaaaatggttttgttctctgtttcagtagtcttatagcctgtttgcaatgtttgccttgtatgtcgctagattccggttcttccgacgctccggtgtacttcgagatagtcgccgaggtttctccagcagcagagcaaggcaagtcatgcttgtcacttgaacatgttgatcctatattgcaaatgctctattgtttttcttcaaatattgcattgttttataatgttactatggggtgtttacctattgttacagccatgccatttttgataccatgctcctttgttagcttgggttataacatgaatagattttggactaggaattgcttagccatgcttagttccactagcacacaatggggaaagctcactaaaatatagactttaggttcaattggtaaggttggtttagtaccaccgttttggtgttggtcaattaaaatgaatcacatggtgggctgtgggtgcatggttctgctagtcgcacccatggcagttaaggaccggttcgcgggatgccctggaagaacttatcatacttaccacaagccagcatgggcaacggctgggcttgtagtgtagctttcctctagctgacgcatccaggcaagggtgggcgtgatggagcggggcgggccctgcgacggcctctgtcgcttctggattcacctaggcacgagaggggactgcccgctgctttgcaaggagtgggggtgaaacctgaggtgtggtgtgcttggttagagggggttatgcgaagggtcctgtcacggcctctttccggtatgtcgtggtggcatgtcggcgcacggaaacgtgttatggggctgtgtcttgtgggtatagttgtacacctctgatcagagtaaaactattcgaatagccgtgcccgcggttatgggcggtcaaccagattcaccgtgattagtcttaccctagtttagtctaatgaaattggatagtataggtggatggttgggcctgttgcaacgtgggatagcgttggacagcggatgatcaatattaattaattattgcaactgtttaattctttcaacttctgtttataaatgcttgctttatgcaaatgaaccactctagctctcctttgataatttcctgcatcatacccctattccggtatgacttgctgagtacagtgggtagtactcagtcttgctctattttttccccaaccccagagtacgagtatgtgtcagatggaggtttctccgaggagtaggcttcgtccgtgccgtcgaggatgcctgtggagtggtgttcccgctgcagttctagtcaaggcttagctcctgttgtctttcgtttttccgctgcatttatgtaagacttttatgatgtttgtaagacgtgaatctgaatgtcaacattgtcatttgtataccccggccggtcctggacggggattttaatgcacattctgcttggaattctattcgggaatttctgggcatgacatgcgaggccctttcaagcctccaacgtgggatagaagtgggctgcaattttttatttaattgcacgccagccagaattcgaacttgagacctttagctctgataacatattggatagtataggagggagagagatatactgcgtagcgtggatacattgtatcgagccttaggggccgatatatatagaagtacaaaggagaagagataagaaatgattacagatatggaatgaatccaaataaatcaatcctatcctaatataagtctagctgccatatactctaacacctatcttgaattgtcaaaatctgaaaaattttagaattttagttaccatgctaaaatattggtactgtcaatacctaggcaaattttgatattgttaattttttggtaagttgtgtgtgatgattggcatgttttgttagccaaaatactattgaaagtgctatcaattttgtaaggcatattttgacatcaaaccaaaataacccttaattataaaaattgtaaaattattcagtccgaagtaaaaagatcagtactaaaacattaacaataataagtgacacaaacgttcactgttcaaataagagtgctctatggctccgttcggcagtacaagttcccaactcctctttctcgtttttcacgcgcacgcttttcaaactgctaaacagtgtgtttttttaaaagtttctatacgaaagttgcttaaaaaatcatattaatccattttaaaaaaaatagctaaaacttaattaatcacgcgctaaaccactgcttcgttttgcgtgtcggagagtgaccctcactcccgaacagagcctatatacttttatgtaatatactatttaaagtgctctatactcttatgtaatagtcaattcatagtatactattaatatctggtcccacctatcatacataaattacatcttggaatccgtactgcaccgctacttttctatctctttctttatctatacctaataaaaaaattcgtaaggcttccgtgaggtttttttcgtccgtcggcggtttcctgccaaaatacgttttaatccgcttaatagtcggtcggaaattttccaatctactccaaaaccttgcttaatatatgatatgtatcagtcatgtatccatcaatcacaagtagcttgcccgcctggttggtggagagaaaattttcaatttgcccaccagggttcgattcccatcatctctcctttttatacacggctatattgctccgaataagtctactgtgcctcccacatctcattacttcacctttcctaggctgtattgctcggaataagtctacgatgcctcccatatctcaaatcattgctcggaataagtctactttgcctcccacagctcaaatcctactcagaataagtctacttttccctcccacttttaaatttgaaaattaaacataattatatttttcttttcatcatctgcaaaacacgacgacatattagagtccgcgccatctatttgcacctctttcttcaacagatagtgataaatcttataatgaaccagattttaatttgaaaattaaacataattatttttttcttttcatcatctacaaaacatgacatattagagtccgcactatctatcgtccacacatgagccgtgaaaatgattcgtctccacgcaagtccgtgttcgattttagaaattatatcaagcgcttaccatgaatccgatggctaaaaaatcagaagtttttgcacctctttcttcaaaagatatttagtgattctgaaatcttataatgaaccattttttaatttgaaaattaaacatatttttttttcttt

SEQ ID NO: 50381 - DNA, 2333 bp, Oryza sativa
gggcgtgggcgcgcggctcgggcgcacctcggcccgctacggcaccacgacgacgttcacggggcccgtcaggaagtggcgcaaggactgggtgcccgtcgccgccgccgccgccgcggcggcggcggcggcgtcggccgcctcctccacggcgggggccggatcccgcgggaacaatctcgtgctcttcaagtggaccccgatgaacggcgccaacggcaacgggggcggaggagacggagaccaggcggcggcggcggccgccgccgcggaggaggagaaggccacgaaacggcggcggtacgtgccggtgaggactctcgatttgattcttgggatttgtgctttctcggtatattccttgggccatcgagggttcgatttggtgtccggattggatctttgcttgcttgtgtaggtcctggcagcttagatgattggataattctggatcttggttgatgcgagctcttgtggaatattaattgaattgacgcttttgaattgacggtttgaaaagaattagggttcgtatgtttgaaaaacgattatgaacatcaggtccccaaatatgttggagaattgtattttggctaactcaaggaaaataattgtttgttaggagtctagtaactgtacatttgtagcgttttggtgtaattaggttagtgcttaggatatccctggttataactatagattgtttcattacgtacagtaatttcgaactagttggtgattagtgcagtaagcattatggtgggggtgctatcaaacaggatagctaatgttcttggttaatgagaacagatctgggctgcaccctcaaggctgcaactataattgggactattcatagtactatcgttgacataattcttcatgatttccagttgttccttttacactacagtccgatgaagtgtatgcgatgcattgaagtgcgcgggacttaattacagcagcaagaaactcagcattaaactatctaagtaacaagtaaactactaaactactgacatcagctcatgaaacaaagatccaaaaacagcagtataaattgaaaatattctatttacggtaaaaatccataagcacttattgtaaatttcatagatactgtaaattttggaatttttatgtgaatttcaaaatagactaacataatcatggaaagaactgtaaaactacaaattatttgttagataaattacagcgtaaatccatcatatatacaatgtaatccaaccaagagggaccagtataagtctagaagaactccggttaccaattatttccacaatcttgtccattcaactttatcactgcttaataatgaccatattaaatatttattcatctcagtgggaaagctggtggattatcataggctcatagcatataattggaaaaattggtagagtatcatagatcctgatagcataactggtgaataggtcctgatcatgcacactgctttctcatggtctagactcctcatggttagatagatggtcatgctcctcccttgtggacggtggggcagcagccagcaggcagaggcatgcagctcaacaaaagggttgcagacttggcaatcaaaacaattgtagcacacatgcacggtaaatcagcacgaatctaaagaaaatcccaagggacaacaaaggccttgtttagttcccaaaaacttctcccaaaaacctcacatcgaatctttggacacatatatggagcattaaatatagataaaaagaaaaactaattgcacagtttgcatgtaaattgcgagacgaaccttttgagcttaattaggccatgattagccataagtgctacagtaacccacatgtgctaatgacggattaattaggctcaaaagattcgtctcgcggttttcaggtgagttatgaaattagttttttcattcgtgtccgaaaaccccttctgacatccggttgtgacacccaaaaattttcatttcaccaactaaacaggccaaaactactgcaattaagctatatctgtgtcgacacgaatatggcaaaccactttaattaatgggctgcgggctgccactgagtgaaaagaagtggaacagtttaccatccttctgaataggtgttgcatcaggtttagtcttggatgttcatttgtatacttgcaggcttacttcttaaaacttacaacagtcgtttgctagttttttcattctattgtattctagtgccaatattactaagttcactatattctagtactcatcatgaaaagctcttggattctataggctcactcgtgttcgtgtgctgaaatttcctcataagttggtt

SEQ ID NO: 50382 - DNA, 3600 bp, Oryza sativa
  unsure (1)..(3600): unsure at all n locations
aactgacctataattttgcgattttccattaaaataatattatttccaaaaaaaactcacttcttctgggacttagacccagtgagcctatgtgggtgcgccccaatcaggtggagcacccagtgggcccatgtaggtgcgccccaattaggtggggcacgacggaccctaaggttatcctcccacttccttaaatagatcctaggtcatctcctgtctccttaaatagtaagtaccacctctttaggatttctcggattctatttagatgattttgtttaaattaaagtttagtcatagctacttgcttgcagcgcacatgtcgactagaccgcttgtatgttcggcttcaaaacctcaacttatcgtgtgtattcaattgtgttcatcttcggaacccaacttatcgtgtgtattcaattcctatttgtaatatcaaattgtttttattttgttcttacttgtttcttcgatttgcttgtaagaataaagttgatctgcaccggcaagatccaaaactcatagatcgacacgcccgtctgttcgtcttcggaacccaacttatcgtgtgtattcaattcctatttgcaatatcagattgtttttattttgttctagcttgtttattcgatttgcttgtgagaataagattaatctacaccggcaagatcaataactcatcgagctatttacaatatcatattgtttttattttgttcttgtttgtttcgtaggaataaggttgatctgcaccgataaggtgtatcgatcgcaaagacgcaacactaacatcttgtatggttgtatcaggttgtcaacgtttctttcaaatcatagttatctttcaacttatcgaaagatcgagctcaaggtttatcacatgatgaaacggttcgatagatcatcgaatggacggttgatccatttatttcctgtagggcataaaatcagtccgagcaaacaattgttttatgcaagtaaggagagagaaatttgactacaaattgccatttcaggcgtacacatggacatggctttttttttattacacagtgatggctggatatgcctggatcaatagaaagggacggagtctgcactaaattatatcaaacagaaaggtaaaaagaagacgctcatcacagcaaaatggcatttcgtattacaaatatccttgaaacaagtaacctatggatcggcttatccaactaaaacgggaaaattgttgatcggttgatacattagtgcaaaactgtgtctgccatgcccttcgaagttccaaagaaccgtaatgttttcatgcaagtgcgaagcacttgtctggctgcctagaaaaatccctgaaggacaagtcgatatctaacttaatctgacttgtcagatttctcctccggctcctcttcaattggaccaccttcagtgacaccaacttccgcaggacggagaacacgatcatgtagcatgtagcccacctaaaaaagaaaagaaattgttaccagtactatcaaggtagcagcattggaggactgaagatattggtgcacaagtagaaatctgggctggttgtccagggaatcactttggatcattcccattaggaatttctggggtttcgattgccttggtaatatttcatctttaaacagatcaaagtgtcaccaggagctgtgggggcatcaggacaagataaaaatgtataattgaaatacgcaatggttccctggtaaccaaacttgtcctaaactaagagtataatatgcattgactagcattagctctgtaaaccttgcccgtatgtactcctagtaatagaggtagtttcctaacaggtgccatcttttagcagaaagaagcataccggcagacaaaatcccaacagaaaatgaataaaggagctacaaatgtgagccatgtttaaataatagaataacagaaagcaaccggctattaaaaatcctcatctaccttgagttatttactacacatacctccatacatatacttatgcagttttaaggatagactatccacttaatgttattctgatggtgtaatattggaagtaaccttgcttagtattaaaaatacagacttttaagtcattcttaggctgttgcagtgtactttcctcattgttatcttaactaatgatatgcacatgaaacaatttattatcatctctgtatttcatctcattctgcagcctagacaaactctatcaagtgatttgatcgacataactataatagaatgtgatatacaaataggcaactttaaaccaacaaacattgaggttaagtaccggacttgaatgagctcttatttcagaagagaaagggggtaaaaaccctataccaaaattatcggaagagcataccttcacaacagccgcaacagttcctgatggttttgaaggatcaggaatttggaaaagcgcagcatgcttatttggatcaaatttctcattaagtggatcaaacttttccactccaaacttcttgaagacctgcacacattaaatgttattgcctttttgctgcataaagatgtaaatttgtgtaaacacgcaagcaacaggatcaaaataagtttgaatgcatgttaccaacaaaagatatgataatgtctaaatcattggcagcatataatcattaagacagggaccataattccaattcacagttgttacgaccaatgcatggaaagttgttgaaatacctccccaagttgcttttcggtcatctcaacaccctctaatagggtgtttagtagcttcactgcttcagcagattcattagatgtatctatctttgagaagctctcctttacaacagatgatgccctagataaattgtctgcaacatctaacaagctcttggaaaagccctacagggatgaatagacgtgagctcatttccaaagtaaaacaagattctaaaaaaatcaatgaccagagcagtagaaatacagacctggtactggcatagcttctattgcaattatcatgattcgacgcttatgttcatcgcaaatgacagtatctcacatcatcatgcaatagcatgcagcaaaacattatatccattcaatgtacttataacattcgttcaatccattaagaattatcgaacaaaattctatcatattactcacagangactagcttattgatacagagtcctaccatattgacaaggatacaagagtcattcatgtaatcatgaagtcaagaaagaatgcaagattcagttatagatacctactccatcctaccatgattagaattagggagcacaagatatcgttgatgaaccctagctatgagatagcatatcgtcggtatcacagagagacacatatatggatttacattgtgaagcattcagatatagagctgcttattattaactccatcctctgtctgtttatttgctgccttatcatcttgctggggagcagaagatgaaaacccaaacctttgaaaggttgaagttgagtacagcctcggctgattcagcagaggcaaggcctgagcgtagaaaaaagggaaaaattatccaacagtccggaagatgaaaaacaagaccaaacaagaatacc

SEQ ID NO: 50383 - DNA, 1312 bp, Oryza sativa
tttccacgcacaggatacccgaacaaaaaaaaaagcaacttaatcgacggatgcatctctaaaaccctaatctcgcaccaagattagcaaccccacgacggcttaacccttcgaaaaaaaagcacgacgacacacacacacacatcgctccatccgactcagacgagggaatcgaaacccccacccccaccttgatcgaagagcagggcggggccaagtgccgccccgccgaagcgccgagcagcgccgccgcttccgcctgccgcctcgccgccgcggccgaggccacgccctgcctcgagatacgcgcgaggagacgcgccgccgcagccatctctctgtctctctctctctctcctctactctccttattcggtcgtcggcggcggagaagagaagggaaagaagaagaagaagagaagagaagaaaatcggaggcgaagatttcgcggcggcgaagggtctggaagggttttgggggaaaagctggagtggggatatttgtggacaaagaccgttctacccttagtaggtttaacgtgttctggcaatgaaggcaagggtagttgtgtccgtttcgtttcctcttcgttgacatgtgcttgtcgtgcaagaagggaaagcgtgtggtttatactcctgtgctccaattcaaatggtaaaatctaaatcgaaatgcctctctatttagtcttaactagaaaaaatatccatgcattataacgggtaaaagttattttaatcttattattatttactgtgaaatacactatcagaattcgcttggatatatatattttttaggaaatcatgtaagttagcatacaagttgttttgaaagatttcttatacgaccttatgtatttctaaaagtgaacaacttgaaatccgactcaaatacggatctgcatttccaaaagaaaatgaaatgtattttccaatacggttaaaaactgacttatacacggatgacgtaccaaagtattggctaaaacatcttcaatttttataataagtagagatagaagatgtcacatacatcagataagtactactatacatctatagacatgcatatcttctttgttattatgtcatacatatctttttttccttcttataaaagttttcttaaattacttatctgatccataatctgattgtaccattgtgttcgttataattaaatctttgtaacaagatcttacatgaatatttttatgataaaaatatttatatttgtaaattacttttattatatatgtaagttacttttatcatatatataaaaaagggggatccactagtctag

SEQ ID NO: 50384 - DNA, 832 bp, Oryza sativa
tgacccgccggcgatgagaggcggcggcggcctggcgctccacccgctcgacgtctgccaccggagcctgctccatggctcgccgccaaggccgtgccatacggggaggcgagaggagttcgtgccgtcggcgacggagctcgaccaggcgggcgtccggttccgtcccagccggacgcgcagcctccacgacatcagcttccgccacggcgcgctccgcatcccgcgcctcgccgtggacgacacgacggagcacaagctgttcagcctgatggcattcgagcagctgcacggcgccggcgccaacgaggtgacggcgtacgtgttcttcatggacaacgtgatcaagtccggcgacgacgcgcggctgctgggcgcgagcggcgtggtgtccaacgggctgggcagcgacgaggcggtggcggagatgttcaaccggctggcgagcgaggcggagctggaccggcggagcgcgctgcacggcgtgcacggggaggtgaacgcgtacagggagaagcggtggaaccagtggcgcgccagcctcgtccgcaaccacgccggcaacccgtgggcgatcgtctcgctcgtcgtcgccttcgtgctcctcgtcctcaccgtcttgcagaccgtgtacaccgtgctgccctactaccaggagcaggcggcagccggcgaggctgctctccgcgaactctgacggcatgatctagtgggaaatcgatcagtgtgtttttagcttaattagccttgctgttcccttgattttgttgaaattgataaaatggagaaacaatcggagaagagaagagacgattgagctcggagcgaatta

SEQ ID NO: 50385 - DNA, 869 bp, Oryza sativa
taacacgtactcctatttcattagagatacatgcctctcgtattcataatcgtatgatcaagtcttctatttagagtacaaacatatacaattaaatgtgtaacagagtagaatggaatggagtgtataacgtgctatgtgcgagataggtgaacgagtgacgtgtgtcctatgacacccctttttgctttctttaggcttattttatatatatatatatatgtatatatatatatatatatatatatatatatagtaaatttgtttggtgctccatggtgcccgggcaccattgttgaaattgagtatatacccaattcaaatgagtatgaatctttttcaattacttaggtattaacattaaccactttactaactagttcaaagcaagttcaaaagtttgaactgaatttgaacttgtttttgttagattttgattctaggtatatagcatccatacatatatttagttaggtatgtaatcatggattgtgaaataaagttaaatttgagttgttttgttgataggtataggtatgaatcgaattattataactaggtatatactcataatttgaaaattttgaaaaatttgagtgattttttgcatttgataccatggtgcccgggcaccatggtgccccatatgagtgtcctatatatatatatatatgtatatatatacatatacacatatatgtatacatatacacatatacatatatatacatatatacatatatatacatatatacatatatatacatatatacatatatatatatacatatatatatatatatatatatatatataggctttgacggggaatattgatgattggatactttttacatcgaatattaatg

SEQ ID NO: 50386 - DNA, 11952 bp, Oryza sativa
ggtgatatgggaccgggagtatcatgactagaggcttaaggcagacacaatcgcccacgtggcctggcaccttcggggacgtcgggcccgagggtgaggtgtccgccctcctcctgatttcccccgagggggggggggggtcgggttgcgcttgccctggccccgagggccggggcaccccgaccccctttaggaagtctgcgccacgtatatgggataagtgagcacagctgtgctcacctaacagcatttattgcagtctggtcaagcgtgtcacgctgcatgcagtgcagcacggcgcgtccctttatccggtctgtgaccagtcacagaccggtcagatcacgggttaggtggcgactggcggtctgacacacgccatgccccatcccgtcaagacgaaagcctctagtcactcgtctcaagccggcgttaagcgtgttatctcttagagatgacacgttagacccggtcgatatatgccaggcttcatcttaaccattacaggcaagatgttgtgtgaagaagggcaaacatgcacgttgccaagattacacgcggtggacaagaacgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagaggggggttgattctttcccagattatgagcttagaacgggggagaagtcagctgaaacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcatctggcgcgccaggtagggggctcagcgtgtgctttcagagctctcagactcttccgtgtgccccaagtttttcttgttcagcctaatggccgagcaaggaaaaacgcacgacctctcgccgagtgtgagcggcgacgacggggagccgaatccacgccgtcgagctcgtactcctccaccccctccgcgccaaagccctaagcagggggaggcgcttgagagggtcgacaagtccgcagcgtcaccggccgcaggtgatgcaggagaacggcgagacggggagcgtcgcctcctcgtctacggcgacggcagcacgcctcagggtgcgcttcaagctgctggcgcgctcctacgacacccgcctgtcgtccatgacccggagtctccagcccaacgatggctggaagacgtggccaacttggtcatgacggcacagcagcgcctgggtgctggtggacggtccgccaccaccaccaagacctccggcgccgctaccaccggctccgtgtcatcaaggcggagggcgcggcgagcggcggcggctgcacgtcattcggctgccactccctcgtctacaccgtcgactcgggaggatcagcatggggagccggatgcccgcctcaacatcgggcgccggtgtaatagccggcgtactccccgtgcaacggagggagcctcctcgtccagagtgtcaccccgacatggacgtgaagatcagccctccgtgcccccggccggtggtgttggctgtagagcctttgtggcgagtcttcggaacgtccgttggcccccaaggttccggcccaccatcaccgagaagtacgatgggagcgtcaaccccaccgagtttctccaggtctatacgaccgggattgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagtggcagcttcggccgcccccggatccgccgctcagacagggcggcgtgataggaggaggaagaagaggtcggaccgttccggcgacgagggtcatgtcctcgccgtcgagggcgctccgcgggccacccgaaaggggaggcctgcgagcgacaaaaagaaagaggccggaactcccggcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggtggttccatccggcaaacggcgaggtgaggccaagcagaaggcccccgttgttgacatcgatgatggtgatgatgacctaggtttccaagaacctggggccaccattgccaccgtcgatggaggagcgtgtgctcacgtctctcgccggagcttcaaggctatgaaacgagagcttctggccatggcccctacccatgaggcgatgcgtcgggcgcggtggtcggaggtcgctctcactttcgaccagactgaccacccaccgtgcattgcccggggagggcaggttgcgatggtggtttcccccaccatctgcaacgtgaagttgggacgtgtcctcatagacggaggagcggctctcaacatcctttcccccgcggcctttgatgctatcaaggccccggggatggtgctccagccgtctcaaccgatcatcggtgtgacgccggggcacacgtggccattaggtcacattgacctaccggtcaccttcggtggacccgccaacttccgcacggagcgggtgagcttcgatgtggcggacctcagtctgccctacaacgcggtcctagggagacccgcgttggtgaagttcatggcggcggtccactacgcctacctccagatgaagatgccgggccccggtggccccatctctgtccgtggcgaccttaaagtcgcgcttgcttgcattgagcagcgcgcggaccgcctcgctgctgcgtccaagcccgagggtggtgacgagaggcttggcccttctgcccccaccgccccgaggcagcggatggccacttgcgacgaggtcccggtcaaggaggttgccttgggcgacggcccatccaagaccacacggatcggtggttttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaagccccggaacgtcaagctttcatccgcgaggaggtggctagacttttggaggccgggttcattcgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagtcaaataggacgtaatgttgaggcgtatgtcgatgacttggttgtaaaaacgcgcaaccaagagaccttactttcagatctagcggaaacttttgagaatctccgctccgcccgcataaaactgaaccccgataagtgtgtgtttggtgtacctgcgggtaagcttctcgggttcttggtctctgcccgaggcattgaggccaaccccgagaagattcgagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatcttagctctcctccggttctagtcgccccggagccaaatgagtccctgctactttacttagcggcgaccccccaagtagttagtgcagcgttggttgtggagcgcgatgaggacaatcctcattctgcgcacccccgctctgtgccgacttggcccgggagcaggcagggaggagaggcccccgagtcgaacggtggccccaggcccccgacgaccggagtcggccctccacccgcttgtcaaacggcgctgggtgcccccgaccctcaggaaggccccgaggccactgagggaaggctgcacttaaagccctttggccccgaggctaaccctgtgctgactcgacccgggaaagagcagggagaagaggcccccgagccgaacggaggccagaggcccctgacgaccggagttggccctttgcccgcttgtccgacgatgccaggagtccccgacccccaggacggccccgaggccactgtgggagggccgctcctgtcatcctccgaccccgaggtcatcagcgcagaagacgagtgcgccccgaggggccacttggacgaagaacgccccgggggtacggcccctaacgaggaggatcggccccgccgaaaggtgcagcggcctgtctactttgttagtgaggccctccgggacgccaagacccgatacccacaggcccagaagatgctttacgctattctgatggcctcaaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggccagcgcgaacccctcacagctgcctcacgccgcccactgggtgatgcaattcgacggttctctgtctcttcagggcgccggtgcaggggtcacgttgacctctccgaacggagacgtcctcagatatttggtccgtctcgactttcgagcgactaacaatatggcagagtacgagggactccttgccggactcagagtggcggctggactggggatccgccgcctcttggtattaggcgactcccagctagtcgttaaccaggtctgtaaggagtaccggtgctctgacccacagatggacgcctacgtacgccaagtgcggcgtatggagcgccattttgacgggatagagcttcggcatgtgcccagacgggataatatgattgccgatgaactctcaaggctcgcgtcctcgcgagcccagaccccaccaggcgcctttgaagaaaggcttacccagccgtcggcgcgacccgaccccttaggggagacggatgcgcctgaccggcacccgaggcccgtcggagtccaggcctcgggacccgaagagagcgttccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaatggaatcctcctgaagtgcattcctcaggaacaaggcgttgagcttcttgctgacatccatgagggcgagtgcggagcccattctgcctcgcgcaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgagctcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgccaaacccatggaacatcgaacaccttcgtcgcttctacccctgaaggggggggtcgggtgtcaggttttggctcgggctaaccccgcaccccccctcgggtgtgcggggttagccgggggctaccacacatgcatatatattcctttcagcatttcaatagaagcagtttcaatttcctaaaggttgtgtctgtgccgttttttccttttgaagaatcttgacttgaaataatgtcactcgtgctcaaccttgccctcgggggctcggttcggtcggctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgcggatctccccaggcactagccccgacccgagccattcgaggaccgggacttgggcgcgagcccttattccaagctaagtcgcaaaaggaccatggcacagatcatcctcaactcatatatatagcaaaataaaactaacacaaaaatttttcatcatttctcattgcagattaagttaaaattgtacaaaaaagaggcatgaaggccttagaagaaagaacaagaaaaaagataagagtggcgggggcctgggggctcattcatatgcgcccgggtcgccggcctcgtcgccaccgccgtcctcgctgctggtgtcgccttcctcgtcggagctgggggcgaacgcaagccgaggggccgagccctcgaagccgttgacgatgtggtcagcagcatccccgacccgcgcgcgcgcctcgtcctcggtcccgggagggaactcctccagcgccatccatggggagaagttgggatcccgggcctggtaactcgccagcacgagttcgaccgccccccgggcgaggtccctcgaggatgccttaatggtcttctcgagctcctcggggagtcgctcgagaacccaagccatcctgttgaggtgcggagcgaggccttccagattggtggggggcaccgtcgtctggcctccccagaggcctgcttgccgaccggcgcgcttcatgcgggagaccgcgtcccaaagcatgccgggcccaatctcgcccgccaagcgaagggcctcggcctccccggtggaggagtccagcgcgcgctgcatgtcagcgacggtgtgttcggcagccgcgaggcgagcggctaagtcgctttcgcccgcagccgccccaccgatgcgcgcccccgcggccagctctttctcccgtgcctcgaggttagcaacccgctgctccagcgcggctctctcggcgcggacgctttcaaggttgcggcgcgcctgctcctcttgcgccgcctcgcggagggagaggctgtccgccagccgtcgcgtcgtggcctcggcctcctcgagagcccgctcccgctcggcgagtgcatcctcgcgaaggcggagcgcggactcctcctcggcgcaggcggcctcgtgcgccgccagcgtcgcctcccggagagcagtggtggcctcgcggtccatcaagcccctctccacggcgccggcatgttcttccagcgccatggcacgggcctcaagggcctcctcgcgccgccgggacgccgcttcggcttccgttgcccgccgctctcgcgcagcggcggagtcgagaaccccttgggcggcgtcgagcttgctcttcagctccgcctcccagcttgcgtgctgaagacggagggtgtcttgcgcctcgaccatcgcggtggtggcgacgagggcggcctctcgctcctcctccacctcccgggcgatctccgccagcgccgccttgcgggcttcgagctccgagatgtggcggcggtgggccttacggcccacctccaccatggcgtccaccgagcgccgcccctcctcgacacgcgcccatgcggcctcgagctccgctcgttccgctcgcaaggcctccacctgggcgctaaatccatctagcaccgcggtgtttgcggcggccaaggcctgcataatgggctcggcgctcactggggcgacgagagaagaggagaaaagccgccttggagaaaaggcgacgcggcttggccccccggaggatgcgctgggctcggggatgtcccccgggcccgtttggtcctgggcgtcgcccggtgaggtaggcccaggcgacgcgcccgcggcctcgtcgcgagccgcctcggaggatgtcgcctgagggccgcccgagggagtgggcccgagtgacgcgccagcagcagctgccgcttcagcctggcgagcccgggcggcctcctcctgggcagcttcttcggcttggcgagcccgggcggcctcctcccgagcagcctcctccgcttggcgaacccgggcggcctcccgggcggcctcttcagcttcccgaaggcgggctgcggcttcacgccggtcagactcccgcctccgctcctctgcggccgctggatcttcgacctcggactggccggacttggggcggcgggaggaatgcgacgggacatcgctgaagcagaagaaaaaaccaaaagacgaacaaaatgagtaagaaaaaacttctctttgggagaaaggtggtcgcaatgagaatgagacgaacctgcgagggggtcggttgaatgaccaccttggaggggaaattaggtttccccgggctggttccgtctcccccatcttgcggagccgcttcttcttgcgctccccctcgggctgtgacgtcggcgcagccccctccgggcgccgaccgctggtacgcactgccccgccccctcggggaggagatgggggaggtgttcctcccagcttcctcttccccggggcgtcggcagggcggctgctccccgagcccccgacgcggggcccagaagcacgaccccctcctggggcagattttttccccgggcggctctcgcccgcgccgtcgtggcccttaggggctctctcctctgaggccccgacccccagcataatggttagaatggagacgcggtcgggatcgatgcagagggggaggatctcctgaggaaggcgagacgcctccgcggagctaagattcagcaccctttggactacgatcttgaagtcctcaggagcccaatcccatctggctccctggtgggtccgcatgtagtcttcaggcccagtgtactcccaggcgctccgggcgcgccgttggagcggcgcaatccgccgacggaggtaatcgccgtacaccatggccccggtgagcccctgggatcgcaggcccgccaggcggtcgaggacggcgtcgtactcctcccccagatctaccggcgcccgccagctggagacctgcgccgggggctggctcggaagtcggaggcgcgcttcgtcggcgaggggggtgtagaaccagtcgctcttccagtcgtcccacttcttgcggaggacgcaggggatgtagcggttcaacaccggcccccgcggctggaagtagcagccgccaaccaccgatggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcacaatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggtagagaaagagttagagctcaggcagcgaaggcaagaggaacaaaggcgaaaggaagggagcaaatccttttctcgatgcttttatacccttgccatcgctgggcctggctcctcgtttctcgcgcccactacctcgctccctcgtatctcgctatcttgctccctcgtttcccgtgcccacgcttccactaatcccattcgcccgcttacggcgcttgaagtggatatgcggttgtggcaatcgaaacggattgtatcgtgcgcgcgttaattacgctcgccaaccgaagcggcgttaccgtatctccgggcgagacaaatctgctcacccagattcgcgcgctgctcaagtgatgtggcagtcttgaatagaccgcccattatggacaaccaaagttaccaataccaatgtgcatggactgggaccgttggggattttgcccaactatgcagaccggtcccacctgtcaccaggctttaggagtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggggg

SEQ ID NO: 50387 - DNA, 2707 bp, Oryza sativa
caactccactccagacctaactcctagagctaaacttaggagttgagctgtaccaaacatgcccataatataacaaagtgggcacttcaactctactctatttcctcgataaaatcatatcttactgttgaccgttgattactccgagtgcagagtgtttttatggggaaaaaacgagcggggcatgtaacctccataaataagtccatatgggtgggtcacaattatctcgtgtatgggttacacattttgaaatttactcccgaaatttgtgatatattcctgatcattcaaacttcctggaaagatttatacatctttgaccttttttaccccttttagtttccgttgttttctacacatcagatgcactctttctataaccccatgagctcacaagttatgattatgacagtccattaaaaagagcaaacgagataatagcaatttagagaaacagacaacattttctcattaactaccactgtgcaacaacaaagcatgcagttacaagtttgattatatgcagaactgcactagggtgatgaatcaccatgtgggcgagcaacatgcagatgtatcaatgagaaggatttttcccttcccaataaatagttgtcaaaatcattgcaacatctgatactgcctctacaagtaagaggtcagacaaaaaaccgggtaaacagatttcttacccttttttcccatgtacagcgccaccaattgtacaacagctgcaaagagatgaggaactgatgaaaatatgttagcaccaggaaagccaatccatgactccattctcatctttcaatcgtgttccctcaagcagcatcagcagcaaatccaggagagaagcatggctgtctttctttcatcagataaataaaccttagaatttcctgccacatcaaaaggagagctcggagctccgagggccaactggatcatggagaaacagctcttccacttgttaatctctcaccagctgaacagagatatatgtgacagcaaaagcctttgcttcatccttctggcattgagggtctatgattggtttcctggccgaccgggacttgaagaaaaggattccagcggtcaaagatgatgcgacctccccgtccaattctagcttgccaccggaatggtggagcagtagtaccactatcaataggtggatctagtggtggcctgataccagccatcttcagcttatcagggtcaattggtcttgtaaatagcattactggctcctcaggatcccgcatttcaggaacctgttaaatcatgatccaaatataaacatgacaaataaaaaattagatgagttgccatgtgaacctaaattttagtttcactatccaacaactatctagagcaacagaaattgtgcctagcaagcccatcaatttctggctgttctttcagacaaatttgggaattaggggtgaaagaagtcaaaatagataggaaaatgctcaaaaggttttctgaaccatatttttatgagaattgaaaatggtaacaaatgaatatttgaactatcagagtattagaggcggaatcattagagcagaaacatgctggctgctcgaactggtaatttagaccagaaacaccaagtcataatttgctatttcatgcggttgaccgagcaactaataagataaattcatatacacactatatataactcatagccacggatattatggaataaattcatacaaccacatgtatcattttataattatgacttaaggtgcatttagttgtaaggatgttacttggattcccagtaatcatggggtaatcctagttgattcccatgtttagttgaatcacctggaatgttaattaagaatataggattctaatacaactaagattctggtaatatgtggtattaggatcccttttgaaacaggtagcttggattactccccatcccctagcagaatcttatcattttctttctcacatgtgcatgctataatgttacattcccagtatctaattctcacactaaggattacaggggatgttaagtttcccattaatcttgctttcctgtaactaaaccgcacccttattatgtttgctatactaaacaaatactcaaaaggtagcagacatataatatgtctaaaagaaaatgtccataactacaagcagatagcctgttggtttgccccatgcatgggctggcagtagatagtgggttccaaccctagtccgataggtatttctgtggaatttaccaagcaaagccgtgcaaattccaagaaggttgtgccggttgctgggtttaacagggcatggcctagtcgctgtgtacaggcttttcactgttaggccagtgtaattattggcaatgttctccatatgaatttggtaaatcaaggaaatggtcaccaaagagcaaaatcatttccaccaccaattacgattagcctcactgtttctggttccagttctaacgaatttttattccgatcgattcagttggtagaataaggaaacagtagttggtggatcaggaatttctgctaccattttcatccctattgggaagagttgactaggaatgtattggttagttatctttgtgccttcaatagctccaaaagaagtgactgtatactcatcagtagaagtgctggttacacttagtatatgttgtgtggggtgttggggggggggggtggca

SEQ ID NO: 50388 - DNA, 5087 bp, Oryza sativa
atatttggtagtgccaaaatcttggtaagtattacacatgtttggattgttaccaatgtgaagccaaaatttgatgatacagataagaaagttctagagaataatgccaaattgttcaaaggccttaccaacaatttggatttagtacaaacattcactagtactattcaaactaccaataaattgttatggcacatgttggcatcaatccaaaatggcccctagtcttataggaatttttttcccaagcatataggccgtaccaaaaaggtttacaaatactccctagaaataataaactttaagatgtgcaacaaatcccgggccatacagatcacatcaaagaataaacttatttagctgaacacataatctgatgggagctttcaggatttgccactacattgtaattcaagtatgtcactctgtgtcagtgatgtggattttggtgtgacatgtttgtgaggaagtggcaagttcctctttgtgctttccaacaagacagaatctggagatttgcatgtgatgaaaaacaagaataaaatcaacatcgtgtagccacaatgaattatccatctactacttgaacacataagggcattatgcactatcatactcacaagcaatcatcttcattttgttcgtttcttaaatatgtacactaatctactgcagaaaaaacgagggaacctacatattaagagtaatgaaaattaaacacttgcaaaattgcacttctacacttagatgccgaagccatgtatcactctttttagactaagcagggagttatgctcggaaatgtatgagatcatgtgatgaaaacgtaagtcataaattagcatttttctttccaaaatcaaccaatacttactagcaacatcctgttacacacctaccagaactttcattttgtttgttattcttcaacatgtaaattcaaattaattgctagtgcattaaatggtagaaaggaccaaaggacagaaggcatttcatatagtttaataaagcattatctaccttgtatctcatctggatacgtcgaaggtgaacctcacactccatagtctcacgttttctctcttccctctgcgaagaggatgagtgcacggtttagtatttctcatgccaaaattggcattatttaatgcatttgcataccttaatcaatgcgcccattagtgccttagcctgctctagattgcgccggacctgtattggggttttaaaacataaaaataagcaaatttaaatatcagtgtacatagacaacaagtgcatatttcagatacacaccatgttgcaagcactacagaacataaaatatgatggttatgattaagatcgtgcactacacaagaacacaaaggcaccatgacaagcaaaaaaacagagaggcaaacatactgcactattcatatcaagacattaagagttatcaataattggtccttctctgctttcttgacagtcaagaagtttgctattcaagaggacagcaaaacattcgatatttaaggataagcttgattgcttgaatgtatttgcagtctaagctagtgatagtcaaccaaatatggatcttctctagaaatacaattaagaaatatagaaatatgatgttaagataatatgatcaacccctggcacatttaggttttgatctgaggctatcctggtctgcgggacccaacacaagtattcatcctttccaatgaaaaatagagaacaacaaatacagctaagacaatgtcaaaatacttgtgtaataattagaaccatagtttcaatcaagcctgtgtatatttgtgtccaaaaaggaaaatatctaaagagttcaaaaaactacatatgttttgacaaaactattgaaaacaacgtatttaagcccaccatatcacaagaatacatatttaaacaatactataacataacagcagatttaacaatgaatttatcacaaaactatagatttgtgaatttacgtttctggcactattgtactgatggaacatttaaaattatagtttgcaataactaaagccatagtgacaaattaatgttagtatgtagttctgcaacattgtgttttaaatttatatttttctgacaactgtcaaatagctgtaatgttgtaaaatttactctatctagaaagatgcacaagtcagagacttcaacaagaaaaggataacaacatgccataaaatccttggataaagaagaaatgcctatacatacgcaattccaaaaaccaaacatatgcatatttccataattatagcggctgctccttgaaaacccaactattgctgttacacttaccacacggagtttgtcgaatgattggacactattttctcgtctttgcatctgaaaaaataaatgaacataagtacacaaagaaatataggcacacgaagatattatcactcctgtgctttcttgatgactcaaaattgtccaggagtagctattgtcaaactagtttcctgtgactcaccctccttgtgtgaagacgataagccttctcccttggtctgaacacattgtatggatttgtgtcattaactggcggaggcggcttcaccaaaagaagaaaaaaacagttactctaaacagttgtgtgatcaagaaagcaaacatataaacagcggtagttttgtggtaattttctacctgaccacagttaatgaaagaaaaagtccattttactcccccaaactagtttctagtttctagtttggggtgggggttcaaatgagccaaaacctagtttaggggcttaggtgataaaatgcaatagttcgggggagtaaaatggacttttttttttctttaatgaaatatgaaacagaataataactcaagaatgtgagccaactcataaatagtgaatttaacttgcttttgaacttttccgcaactaacgaaattcttgaaactaagacctgtcattgggcagagaagcacttgagtaataataaacaaacaccacatgtttatccaattactttctttcatttttgtagacctttgtccccagtttgttcatttgaaaatgcaaacatattataagcataagccatgatgctaggagcaccttgcaggccctactatcatttttggggcaattgctcatttgaccctgttttgaagtctaactaccaatctgaccctactttttctagtttgcttatttgaccccgtttttcaaaatcgaagatgaagattgaccctactctgtgaagtcaagataacagtgttaactaagggcaaatagtcccttttgcccttgcttattttgaccctgttatggcagatagaccagcgcgctgctccctttctctgcacaccactgccgtcgcggcctcctcacctagtgccagccgagagggatgaggttgggagtgaatggatagggttgggtcctcaagggtattttggtcagtttgaatagtaatttgatttttttttctttttactaaatatatataaccctaacggtgtaatggaaatagggtaagacggtacctttgttattgaaaagtggggtcaaatgaactaactagaaaaggtagggttacattggtagttaggctctgaaaaggggttaaataagcaattgtcccttcattttttttatggtacagtttatcatatttttcactatactaaaggaaaaaaattttaaaagtagtccatcgtcccaaaagctttccatttctcctggcgaggagaaaaacagaaactgaacccagtggtcacagaagatcttgaatcctccatgattggtgaaagccatgaggaatctgttggaaaggacctgttaagatggagaaggggaagccttccaagttgaagataattactgtcaacaaaaccgccatctgccgtccaagcttcctgctagaaagctttccagtcaccataaaagtcactatccctactggaatcatccactagaggcttccttggtagagtagcaaatgtcccgtgacttatccttgtatggaagagatctggttagcaagatgggagactgggaaatggaactttgacaagcctgatggtttagttaggtcaaccctgcacctcacacagcctgctgtttcgaccatgtgcagcagcactaacacagcccgacctagttagcagcctagttattatgatttggtccagattgggctggtaggttgctcttcaaactttgaaggaacccatcaacaacagcaaaagggattttactctagagaaccactttgatcttttcaaaacttgtagtcacaaaatctgtcaattcagtaaaattgattgtattttgcgcctactgctttaaaaagagcttagataatatctacaaacatactacagtagttgacaaaaaaagttcatattatatttaaaaagtaactgcaataacaaacacagaccaaatattgtgcacaacgataagctcagatctaaatctgtacatcaataagaagtgtgtgaaacataaagatagaaaggacaatacaaggacctaagctaacctgcaaacgtcgcaaaataggcttttgccaccgctctctctgataaaggaaaaacgaatcagtacatacaatgaataatattcatatatatcaaaaaaaacatattgctattgatgacaacagaacaatctcaaatttggttttgaaaaaatataacatgttatcctgtagaaagagacagttcataatgttgtctagaaaaggaagatgcacatgtcatatgataagaatcaaaaacatataccatgttctaaagatggaatatacctttgatttccagtagttatatacagcctggaacacagcataacgaacagacaagtactgcaaagcctggataaagaaacaccttgtaaagagcaaattatagataactagcaaagtatccatgccttgcaatgtatttcaaaatatatatctaaatttcttgacttggaaattgtatttgtcaaacataatttgcaagcaaacatccaataataaaccaagccacacacacaaagatatatttatccagccttagaagatcccacaacaaaagggggatcc

SEQ ID NO: 50389 - DNA, 2169 bp, Oryza sativa
cagcagtgacattctgattaaccaacccggttctccaaacaggtgtgatgcacaaaaaaaaaataggaaggccttaaagtcacatccttctagagcaaggtttattccaattggaaaggtcctctccccagacctgaccagattggtgtagaatatattcccctttttttttctacggttagttaattatcaatttgttacatctctagtacttactacattagcagatctgcttatctgataagctctgttcaggtgttttgagactacatctctagtacgttctatggtaggagatctggtaagatagaaagtactaaagatgtaggctccaaaaggaacgaaaaatcatcaaatctaacaaaagcatccttctacagaccttctgtatctattcctccatcccaaatataaggacttctagtgtttgaactttgtccacaaatataaggatttctaaagtactatggacttccctgcatcaaccacccctcatgtaattctcacccaaccttacccccaactaccctcatttaatgaggggcatcatagtgttttcccttcatcattaatatctccaaaaaaaaggcttgaagtccttatattttggaatggagggagtacatcttagagacttttactgtcaagtccacttcttctctaaattcttaatgcatctttcaggaaggtataaattaagccacttctgttggcgactctacaaaagacaaatacatctggagtcgcatgggtaaaaaagaataaagctgtcatggcattaaaagaagaagaaaatgatttgtttatttggaaaagataatagaaaatcacaaaacattcagaaatgaaaagtgtgtactttatgaagaggtaggcagattgataacaagaaaatatttagtctactgattgaactaaacttttacattgttccagatttaacaaactctattgtaatttatatgctactcactcttgtgttgctccattctgagtgctatcaattgttccttttacttttcaatgacacagcacatatacctttttatccctttttgtgccttgatggtaattggtgaagagttcaaatgtttttggaagtcatgtgactcaaatcaaactgataaacaagaaactcgccaactcaaccaagaactgcaaactacaagtgaccatgaaatttctctatgaaatattacctccatggcagaatcaagctgcagaataactggtattggtcctaaaaaggtgggggttatgatgcctgctctttctcgagctttgtggtccaatgtttccagtttgaataggaggacctccaacctgtaatgtgtattcttattagtaatgtagcaaataataccttctattcagttactacaaatgatataaggcaattattttcatgtcaagattattttactatatactagagagaatgattggcatgtgtggcatggtatagaaatgacatgcaacttttggttacaaaaaaaaaaaaactttgtcatcacttgacattttctttccacccaacattctctccctcaccactcccatttgtaggacgattagtggatggtagaaaagatggtgtacactgtatttaagtataagattgccactctcataacttattttgatgagcaatttattccttacttttcagggttcagatttttccgctcattgttatagtcttcaagccaatcttcatcttcattgtccaaatcatattcaacaaactcaccaatctcagccctggctgcaagcagtaatttctctaagaaatgcaaccactgaagatatattcaatttttatttccatttcaattattgcggtaacaagaaataaacctcctctggcacgtatgtaggatgttggctgtgcaaaggtacgagtatagtccctttcgtatgtatcaacatcatcatactgtggtgtaggtatttcttgcacattcttcttgctggatgttggatgtgcctgcaaagaaaagaagtgtttatatctgccaaactgtaaaataaggatatcatattatgatcatgcctgtcatcaagcaaactgaactatggccaaccaactagtttattctgatcttatttttttagtgcagcatctattataaaatttctcattataattaataaactctgctaggaatt

SEQ ID NO: 50390 - DNA, 5654 bp, Oryza sativa
agtggatcccccatgattagcaggctgatcaaatttattaaccagcacccccaattattccatttctgcgcacaaaaatgaattagcaagcaactcaattgtggagtactggcagtgaaccactccaccaaaacagcaaagaaagataacgcaacactccgtgcattacctcgccatcagccgcgggctccggctgggagtgccgcagcaccggcggcgcagcccgaagcgctagcgtggtctcatcgtcctcaagctcacgcgcggacttgacgatggggagcttcttgtgaatgtcgagcgggcgcggcctgaaggagagcctactcatggccgcaacttcatcagcgaggcctcaatggagagccttcccttcccgcggggggcacgggagagcgcccgcgcgggacgagccccccgcactacgccgaaccccgtgggcgagggggtgaggggtggtcgagggcacggccgcgggcggcgcggggagcgggcgggagcggaggaggcggcggagatggcggagaggggattccggggcggtggggtggccggaacgggcggattggggagctagggttagggtttcgggggtggaggacgtgccctagggtttgaaacggggagatggagggaagaagcgggggatgaagcagcgagagagaaagagtcgaggggaaggggaaggacagagaggcttggttcggttgacggcgtattccacgagtacgtttccctcgtgtggttacgtatccgtctcaacggtccatatcctatggacacataggcttcccatgtatgcgaactatcaaataaaattctaaaataaattggacgcatactttcaatagtattacacctacatgtgaaatcttatcttcaaatttattatattttagccgtagcaaaaacgacaaaattctgatagaattttacccttaaaactattagaattttgttgatacggctaaaatataatgaatttgaatatgaaatatgtgtaaaaaatatatattttgtagaatttttcgtgatactttctaattggtgtgcacgggaagatatgttcccctttccagacaggtggtgaaaatccttttcgcgtgttattttggttacatttggtttgggggagtttgagaatgctaatggaagcataggagattagagcattttaatctttgaagaacatgggaatttgagagagattgaaatgggaaattgatcgaactcccatcgattccatcccaaccgttcatcataaattatgataataatttcttatctcaaaacccacaaccgaacaaataacataaattcccttttaaacatcccctattatttctctctagcaactaaataaggaattgacagcatgtttggttagggggaattgttaacagggatggaactttgagaggtacaacctactgtttggttggtggatgtggaagcttgtgagggatttgagaaggagtttaaagagcaaactcccaattgggtaagggcatgtaatttctagggaatttcttttctaagtatgacgagataaatctgagctttacatcatcacttaaaattcaattatcatccatactacccatgattctcatctctactaccaaataaaagactgggaataaaaaaatgaaactcccataactcactcctctaaaacttccaatcccctttcattctcttggcaaacaaaccatgggactaaaaattaaattctgatattaattctctttgtcaacttccatagttatttttcatgcccttcctgatcgttgccatacaagctgaaacttggatattgacaggaagaaatccaaataaccccatgagcttacaccctagagttttatatgagcatacccccaaaatgaaaccaatcccaacattttggatttcctttttttttttgaaaaatcggctccaacagttcccctctacagatatgcaaaaatttaatttgcaactccatatttctcgctcttcacaagctggatgtggtttctcactcccaatccgtcgatctaagggtgttagacatgtgcaggaggggatcagggactcgcaacgcacggaaagaggccaccgatcacaccatacgcgaggaggacagtgaaccaatgattctcttggtatgggatggacctatttttttattactgggagttaacatttatttatcttcttacagggatgaatctattcacacctaaaaatctgattacggattcaagaatataattttgggatgtatttttgggctttcttttggcaattatctagaccattgactcttgaactaccttatttgatctaataactcttctttttaactcataaaattttattgtatattaagcagtgtacattggaagcgaagaacattccctaaaacatcaccatgcaaaaaattaacaacagcaaacattaaggaccatatttctgaaagaaggtaaagagattgaatggtggaagcaaactctcatactatctgatacaacagtagtggatacaatcatcgggggcccatggcattgctgcgatgattgcacccaagggcctcttcaaacatgattcccgcttgacctgccagcaatccctccgactgcctccacagatttggcactaattgaggtttggggttgagtcgtagatatgttggtggcttcaccgaactcaaccgatgattgccatggaggtcaacgtcaaatctaaggaacactatcagcattcctgctgaccaaaatcttaagcttttgaaatagaaatcatatattttacattttccctgtttttgttttcatacatgaaggccttgctatcgttccatgtggagaatgccccccttatggcacggtttagtctgttattttcttttgtcagaatggattcggaccgccacttctctaaaagcatggttcttacctccctctctcccccctccttcagggtcgtccattcggtgggtgatcccttgctctcaccttcggattttgatagttctgatgatatggcgaattgcagttatcttggtgaattgacttacatgagagtcgaccatgtagacaaactgcttataccaccaataaaataaaagttatataccaagagcggatgtttactcattgactattctttttaagccatatgtgacaattttatgttctccttaatattgcgtcgtggcccaatgagtgcgttggcatgacaaaaatgttgagtcacatgttgtgcgggcaaaaccacttcgcaaaaccctagagggtcatttggaccaaatgagaaagttcaaggaacttaatacccactttaacagttcatgatgatacatgcctccaagataaacgtttagggggtatatggactttttccatattgatatgtatcgatgttgtaaatttgcttccaccgctaactaagggcctattctaagctttaactccaaacgacagcttcctcgttttctgttagcatgcttccaaactactaaacaaagtattttatgaaaaaaaaattatatatagaagtttttaaaataatcaaataaatctatttttattttataatacttaactaattatgtgctaattagctttctcctttcgcgtacactgaaaatctccctccatcgtcaataaacaaacacatcctaaataattgaagttgtgtaagaataaaacatatatataacagttaataagaagtaggttacttgaactattatatgtttctttttttaaaaaaagaagaaataacgtactcagcgcataattcaatttgaatatctggctacaaaacacaagcattttaaactctaatgaaacaacatgttatcgtacaaacaaatctaaccctcagaatataataacaaaaccatttccttaaaactaaacatttttggtgaacttagtactactaataaagttggatatcatagcattcacaaaataacttcatcctccatttcacattataagatgttttgggttttgaatagattctttcatagatccatgtatatgcttcacatatgtgtctaaatgtatatggatgttagtaaatctagacaagagatgaagagataaaaatgtcttataatatgaaacggagaaaataatacttagttaacaatgcgtctcattttgcatgcaacttataagctccctaactcagtttcgaactaagcctaagccaagagcatttacaacgctccactcttgcatgtggccttaagtatccacctcagagccgagcgatcatcttagtggcaaaagtggtcttacccaccttcatgtgccttacagaagacacaacgccctggccccaaaaggactaggatgagaggggagagaggtggctggtgacatagatgaagaaggacgcatgacttagctagatcgacgatatcagctcctagatcgaagtgaccatgatggattgatgactagacctggtggattaaggcaaccgcacctgattgagggacccaataaccacctgggattggaaagagagagcttcatgattgtgagttgcaaggggagagatggtggtggtagtgactgaggatgctgaggagatgacgtcgttgatatttggttgtggaagaggtgagggcaacacccggggatcatggaacggtaaaaggtgaatacgaataaagagaatatgatgaaggggtaagttgctccataaaatggatcattacaaaccaacatgatgttccgatatgttttttttttcaagttcttataactacctatatatctgtacctgcttaccaagtttatcatcagcataatctaatctttctttgtatgcagctagtatacgctttagatcaccgcaactacggcccacaagaccattcaattccaaccgggataagtctatttttcctccctcaactcatggccgtgtatgaatagcatccctcaaccgcaaaatcgggtataacccatcccccaactctgaaaaccattgcaaatcaactccccgggcggttttggaggtggttttgtcctacgtggcacctttgaccctattgacttactgagtcagcagggggccatatgtcagtgacaaggataaaagaaaaaggtggggcccactgtcaaccacacttatcttcttctctacgcccttctctcgctcctccggccgatcccggcggtgatgtgccaccccaccccgccgccagtcgtcgaggctgcgccccgctcttgctcggccgcccttcagcgccacgctccgctccgcctcctcctccccacccccatcccaccctatcgcctccaccgctgccgccatccccctcctcagatccagagcggaggagggcgaacgagatgagggagctggccggcaacccttggacgtggagtggcttctcactgcaggtggaccagcgcagcccgtcttcgccgctgcgtccatgtgcatgacggcctcccccctaggcttcgccgcctacactagtgcgtgccatatgggtttgcaaatatttgcaaatcgattggggattctctggtgacggtgttttgcgtgctttggcagagtgatttagtgctgatcataagcatcatagtatcatacacgcttgaaaaatcatgatacagtcgaccaaattgctgatcgat

SEQ ID NO: 50391 - DNA, 832 bp, Oryza sativa
attttctgattgatactattgttggggtacctggctatctgcagctttgttgatggataaccattgatcttgcattgttttatatccgactgcttgcttcctggagccgtttgtagatgtaactggagatggaattttgcagcaattggtcttgccactgccgtctcacgtgctgccccagccaagtctcccccgaggccggccgcacgaatcacgctatgccgcgggccgccgccggcaatccatgtgcactgatgtgcagacataggtgcaggaggaggaggggaaagagcggcggggagaagttgtcgtacatgacggtggtacgggcggcgctgctcctcctcgtggcactcagcgcactctcgctgctcgccgcggggtctcggaacgaccgccatgccggcctcggtctcgccacgcttctgcccatccacagctgtccccggcaagcctcccccagcaacatcgtcgcggtggctaggcactgtgatggcggcgagctcctagccgtcaggatcggccggaggagcgagaaaagggtagaagaagaagtgtggttgacagtgggcccaccgtttttcttttatcagtcactgacaggtgggtcccacctgctgactcagccagtcaacagagtcaaagatgccatgtaggacaaaaccgcctccaaaaccgcccggagagttgatttgcaatggttttcagagttgggggatgggttatacccggttttgcggttgagggatgctattcatacacggccatgagttgagggagagaatgtggacttattccattccaaccagacaacgaagggcccacggcgcag

SEQ ID NO: 50392 - DNA, 10611 bp, Oryza sativa
cgaccaagacgaacccaatttgactgccgctgacctgtgggccccacaaccaccccataaataaagcaacacaacaacgacgccgtaacgaaggagcagcagttgcagcagcagcagtgtcttcttgcagagaaagaaggaaggaacacgaaggaaggaaggcggcgacgtcgagatggtggtgctggtggtcgccacgacgtccgacgccgcgtcggccactccggccgccgcgttcctcgccatgcccggctggacccccggcccctccatcccggtacgaatgcctcgccctcgccctcgccaccgccttcttccctgcctaactcttcgcgcggccggcgcaggacggcgtggagagcttcgcgaacggcgcgggggtgcggctgctgcggcacgcgcgcgggatcgtggaggaggacgacctggacctgcggtgggaggccgccacgggggagcgcgtctccgaggtggtcctcctcagccgccacaccgccgtctccaaccgacccgcgctcaccgtccaccccatcggcgtcccgcacctcagggacggcgtggacgtgccgccgcagggcgggcgccccgggtgggccgcgccgcccaacccgcggatcgggccctggctccgcctgctccgccggatcgccgccgaccgcggcctcgtgccggagtttgaggtgattactttacttgtgttttttttttaattttgcttttttaatttcctttgtggaattggggatcgcggttgtttgcattggttgattgattgattggttctcgtttctgcagattacgctggagggcactcaccatgggccagtgaccaacacgccgacgctgtttgttgagattggtacgaaattctccacaccttttctttctggggtttaatccactgtgtttacttaattattgctcgacagccagacatatctcacaaattagattattcatagtgatttctggataatgttttgtaacttcatcttagttgatcaacttaagttcattaagtttattctttgttttttctgttcccctgattcatttttggacaggacagtttatctgtaagttgcataggctaggaattaatgcctgcaccccgtcattgatgaacgttgtattgaatcctaaaattatagggtgagatcttggattttatactgacggccgaaaggtcctctttgttctgacaccccaaagtatgaactagttcaatggttctcttcctgaatctactatatttgaaatgctatccagcagttccctgaataaaaataatataaataagtatgatatttataatagtagaaagagaaaataatcttcaaattgattcttcaggcacacagatagtttgaagtacaagtaattatgtcctctctctcaaaagaagtaatgttgtcctgtaaatgaacagtttgaatgataggtcacataaaaggatatatctgggcaacttgcgaaagaaatgtgaaaatacaattcagatgacaataaatttcaggtgatattgcacatatagcaatagtacataaacatcaacgatttgatacttaactcattatatcatgaaccattgagttatcactttttctattgttaaacaatatattttccttgcatgcccacgtgacattgatcaccaaatacgtttaacaaatttatttctttaacttgtgtgttgtaggaagcactgaagaatactggggtagacaggatgctgctgacgcagtcgctctggttagttttcccgtttgtgttccatttcagcatctgggcgtggacaatgtagatgtttgtatggtctaccatgattttcatgttctttttccttagatatctggaattggttccaactttatggtgatattattgttcattttgcatctttgtgatgctaaggaaaggacatgcatttctgatccttagtgtcctctgtgattttgagttcgtgaacacattgtatttatggtgaaaaacacaatggaactcagtcttataatacttgcagctgctatggaaaggacttggtcttggagaagaagaatctgttggaaattggcatgggtatgtttgcatcccctctcttgctctccctctctattttcgtgtgctttactatgaaaactatcaggtggagtttacccagtacaacccccccatacatcaaacatctttagaaactgttgtcctgagtggcaaatagaccgtgtttgtaccaataggtgtgtctctcgagcacttagctcttatttgctatggaagacaagcaattgttctttttctttcattcttttcatgccattgatctcagatatagacatctagtccaatgtcgatttccatactagtccaatggaaagtaagcataattttagtacatgcgaagaactctcgttatattttccaataattagcatatttgataatccaccacaactgatattattccctggaaggtaggagaccaatgtatcaccgtttaatgctaaaagaactaatttttggcacttttttgatagtataatgcacacaccgaacgctttgagattgtttctgttagaatcaaaatcagctctctgttgagaactatacataaaatcactcgcccaagcatgctcccagcatgggtactcttgactatcttgcttgtatatgtttttttaagtgaactgtttatctattataatgatggtttttgctatgaatttgagctgcattaagtctgctatattttcatgtaatgcaggaatggtgaaaaagtccttctaggcataggaggtggtcattatgctcctcgtcatatggatattgtaacgtaagcgccattttctttcattgattatgacacaactttcttagcaggatctaagagcattgatttaagggagtatatttcttcaatttttgaaagcattttcgtcaatgttatatcttgaaaatgtttcaggaaagatggtgtatgggtgggccacttgctctctgggtattctttgccaatggaggaaccgaagcagatgaatggtaaaaatgtggctgacgttggcggtatgtggaagcattccattaaagtttcatatgaagcaacaaaagcggctttcccaggaggagagattattgcacatattgatcaaaagtaagatggcttaatctatagctaacttgtgttccattagaatacactatcttttaatgaacattattctatttcatgttttgggtacacattatttaaaaattggccatcctgattcatcagtaaagattacaaaacaaccatttcaaattttgccttgacggtacacatatataattgtatccagcaatctagaaaatcatcaaatgcatcagttgagggcattcttatcactggaattttataaattgacatttcagtaaaaaggggcttccttctaagggtatggacttcttcaattgtctgactgttctgttatgttccatctgtctgcttctctgattaaaacatttgaattctaatcatcatatctgctgatagtatgcattcttttgagaaatttggcagaattttttcatttcatttttattttgcacgttgctaaataaaatcttgtttagctgcagagcacacatgcatagtgtttatcatagtaggttcaactaaaatatgcagtgtatggttgcatccaatcatttcaaacgatgcatcatgcattgatttgaattttggatagaatatgaaaattgtggtttgtacgatagaaaacttacatataaataattgatactgctgcaaaaaaatcaattaatcataagacaagtctacttacggatatttaattacatgcaaacagtgttctaacaccaccagatcaaggaagcttgcaagtagtccactaatccatatagttggcccttttacttggctaacctatttatgtgactgatttgcagtaacctgaattagtgatagagaactgctcctttgtttggttgttctaaccaaaattttgtttctatttcaggagcttcaaaggatggcaaaagaacgcaattacaagttacttgcaggagttgaacatcagggtaggaaaaccaaatgatttcttttaagaagacataacaccggggtagcagtactcttttggtgttattgctaggtaattagtatgtgtatgctaaagacctcgcctccacggccctgagataataaaattaatattttgagccctgaactcgtgagttatattgcctgtgcttccatactgctgagttttgatctctgcaccgcatgagcatcacatattcacatacgtatgttcttccatcctgagaagtcatttttgtttgttagcatcttgtattgaattgtgtggattttttacctacattagccctgtggttttggttgagggcaccctatcgaagaagggtacctataccgttcacccactgtatacgaccgttctctctagtctttctgaaaaggttttgaaatcttgtgggctctgggctcccgtggaggagaaggctctcataatttccaccttgaaattttgatgagttcttgaggcgttcttgctaccaaccttgaaagagaagtgctacgactcaacttatttgcttatgtgataatgttttgtccagctgaattcttcgtgcttctcacctcattatatttttcttcgcgattgaaaagaaggttagtataatcaccacatagtaggcatctggaagaagcttcatgtttcttttgaataattggggtcaaagaattgagtatggtagtgttttgttggagctctagcttattcgacatgactgccgtactaatgaacggcctcttttagggcattaggagtgcgtcgcaaaaatataccgttcctcgtgtgataactcagctcaagaacaccaggaacattgttagctacatgctccatggtgcatatccctttgagtggatcctactagtctttttttatactctcactttttctctcctctctcactcctctatcccttctccaccagtcgaaccgaacaaagcgaggcactggaagtcgatgcggcggaggaagcgaggcggcgaccggagtgcggcagggcccgggcggcgacggcgctgggcggtggggcggacggaggcggcgccggtgggcagtccgagcggcaaccccaccaccaccctgatcttcgtcactctcccacgacggggaccaccccttctttgctccgacgaccggcggctctcctcccaggccggcaacgcggatctggcggtacaggatgacctcggagcggccggcgagctctgggcggcacggcggtgacaacagctcgatggtgccgccctccttgtccccctcgactgccgacgcctctcctatcctctctccacaacggatctgggaggcgacgacgacgacgacagagggcttggcggctcgtcggttgcagacggcgacggcaggctaggcggctcgtcggcaagaggcgacgtcgacggtgggctaggcggcgcgcgcttgagggcgactgcgggcacgggaaggagggcgacgccactcgctccacagcgcggaagcaacgctgtgcctagcctcacgcgccctctttttcgcccaagaaccggtggccttatttggacacaagaacctcattttggtgggtccggaagcaaaggcggtatgtgtcctccatctttgccgacgtgggatggcaagggagaatgccatctcagtgtactgggaaagcccttctgtttcgtccttttggggagaatatacaaaaatttcatgtatcattgcattcagagtgaaatccatgttctgggcttttactccaatactttgagaattagactcccaataaaaaaagttaaatccatgaccataagttttacatgcatgggcaactttcttttccatttagcttgatgctggtgtgggtcctaaaatccatatatcctaattttgtttgcaaggctataaccattgtggtatttattatcttattgcaatattgtgttatactaattgtagtatctactatatcctcataaaaactattttgtaaactaaggaacaatagcttcttcttcttcttcttttctttttgtgagcatcctttgcctttgcttcccttctggtgttactgcattaatatttggtatctgcactgttcggtcaaattatttccgctacttacatttatgagttgatatatatatatcatcagaaagtgatgatagattgaaagatattctgaaaggacatgtaaggcacaagccaaatgtgaagctcttgcatcatatctcaaactaactcctgcaaaattccccgtggaactggtgcaacgtaatcttgaatatttgcccgtattggtgtacatataaaactgggtatctattatatggctgcattagaatactccgttggcattatgttcctttcaggttctataaagggaactaagcaacaagaagctcccctgggagatagaggctcaggttagctgtattgtaaatttcagaaaattgcaactatagagacactctgttattgcagcaaactgaaataggtcactaatgttgcagcaaactgatagttttgtcactacgttgcagttttctaaaatttactctttcataaatgataaatctaaagaatgatttccgttttgcttcttctgtcatgaacttctgcattgcctgtgcgggcgcaacaatctatcgtcatgtctgttggcagcaataatttctaaatgaccacttgttattgctacgtgttattcatcaacccatacaactggcaagcagtgattaatatgcgatgtaatgcgctttatttgtcatgaccctgttgcccccatttttattcgcacactgcttttcacgttaactgctggaaaagaaatttatacaaattcatattcatgaatatgcaccattttggattctaaaacaaattaaggacatgagtacattgttggagttctaattacatgatcttaagctttagtctataaacaatcaccttttgcttatgcggaaaaataattgatctactgacctgagttagaagccattaccgttcttctttcttcttcttccagagatgcctcacgaaccccttccagtgcctagatcgattgggcgattaattagggtttgagattagagagagagagagagtttggtcgtctgcctctttccttctctttctttatataggcgacactggtggggctcgggggttatctcaattagtttaggattctgttttctgtaccgatcacataaaaaacaaatttatctcttagtttgtttcttgtcaggataaggaaaccgatggtttagatcctctcctaacccttatcgacacaagtcgacaaaatcaaccaacattctccccttgattttgagacttacttacgagtttattaaataaaatagctccccaaggcaatgtgtcttcaacaacattatgcgtcactgagacaacaagacctatagctcactatagtactcaaataaactcaagcttaacttagtgggtgttgattgaaaaatttagtccccctcatccaggatctcagtaaggctctaatttacatatatacctggccagaacataatcttaattaatcttatttttatgagccttaagagtatggatccattagcaaatgcttagcttaataattcgatcctgggacatgtctttcacaaccatatcaatgtgttaggcagaaaacacacaatatgttgctactagaatagaaaactgtgtttaattagtgcacaactctcactaaaatcacatcctaagggacaagatatatactgccaaacttaatgaagagcgattgctagagcctgccaccatagtaatatagtagagcatgcaagttagcagatagtacacagatattcaagtagatagtactacatacttattgtcagttcacagagcaatgtattactaaatagtacagcatgattcatgccaaaaagaacaaaatatgagctgtacgtgcaccaaggcacaagcaccaatgcactttaattatcagcactataatgtatcatgttctatttggtaaaataacggacatgacccgtttctcatatgaatttaaaaaattaaactagtaaagtttctcttaatagagtgaacaaataagacattattgcaattgctgtgaaactaagtgtgaggtctccaacaacacttcactttcatcttcactccatcagttactctgagtgttcactcccctctttgctaccgtttggacggtgcgagtttcctgtaatgagttagaaacatgcacatcggcattgagtcaaactcactaagtattaagggaaaattcatcacaagggatttatttaatttcatttatacctttcttgactaaccacgctgtgaagcgtgtgcaatttctctgccaatgtccatctgacgcacagaagtggcagtagggacttgtacttaaaggaacagctgaagtggaggccttgatcccttcttgcttctgctcaccctctggctcactattcttattagaggattccccttgatagacctttttgcctttatcaaaggcattagtgaggttgagccggtctttaatcttctgcttttcagctttctggcgctcttcctcttccacggagtgtaagatcaattcttgtatggtccactcctctttctgagtattatattttgttttgaatggatcatagttaggaccaagagatctcatgatgatgtgcactaaaaatccatcagatattttcatatccatggatctgagttgatttgccatatgagtcatctcaaggatgtgcttccttataccacttttgccattgtaatgactagtgatcatctcatttacaagcatattggcatgagtgtcaggtgcaaattcaaaactttcttcaatgtttgccagatacatcttaatgtcattatagtcaatgattcctccaataacttctggagagatggcacccttgacataaattaagcacattctgttggacttctcccagttggctaacttcttattgtaggcccacatgagattatcatattcttcctcaattatattgagttcttcggccagttgaggttcctagggaggatcctctcttatggctaagtcataatccaacatggctaagttaataagcacattatttctccattcaacattcaacgtaatttgatccatcacgaagctgaatagccttaagttgtcctaatgctgaaaaattaattattaattaaacattagtaatgcaattaatttccattggcttaattaatcacatacaaataaatcttaattttcataatcaaacaccatagggtagaaaagattatgaaatggcagagaataatgaattactgaaaattaatatcctaaatcaaattaccaaaatcaggtagatatgatatagggcataatgctattagtaaatgacatgaaattaaagtccttagccatatcaccgttgggcagaaatggtaaaggaattaagcttagtaacaaattagagatcattgatcatatcaccgtaaggcacgagtgacggaggaattaatgcactagtggcataagtaaaattctaagtcatatcaccgtaaaggccaaaatgacaaagaaaatgaaaataatgattgacgatacttagatgtttccttaattacatcaccgttgggcagaaataattaaggaaataacaatcttaatgaaatcatctttctttctagataaacttcccgttggttccattaatctagaaataaattactcagtattgcaactgatcttaaataataagcattgccaattgcataaagttaatttacattggcttaatcgatcatatgcaaaataaacttaaaatttcatagtcaaagcaccattggtcataaataattatgaataatcttaaaattaattcctcaattatatcaccgtttggtagaaaataactaaggaataaaaaattataattgacacgcaattataataaagtgggttaaatataacttcacatcttaatgctttctagtcgaatttctcgttggttccattcgactataaataattaatatactaaggaaatgaccatcataatgatgttgacatgaaatcataaatactttctagttaaatttccattcaactagaaataaattaagtggcttaaggaaataataatcttaataaatattgacatgaaattatattaacattggtcaaatataatatcatatcattaatttctttctagccaaacttcccgttggttccatttaactagaaataattttctaagtgatcaaataattgaccataattttccagaaattttaaaatagctaagaaagctcataaatgaatttatggaaataaataaaacattaaatggcgggcttaaatataataatgcggccaatatttccttagccggcccataaaaaaggctaaaatcaggataaaatttagctaataaagatataacacattatgagaaattaaattcgtgggcttaataaattaacaataaaggcccactcttatcgaaaatccggcccaaaa

SEQ ID NO: 50393 - DNA, 1369 bp, Oryza sativa
agccacttgtaatttcactgtgctgttcctgtactttctccacagtggagttcatacgttgatgctatgctgcattttcttgctctgcatatgcctgttaacttttgcatctttaacatatatgcgcagtccagtatgtgactaaattggatgggtgcctgtgtgtttttgcagacgtggaattaactgatacgaagactgttgctgaagcaattgcaaggtccaagaaaggttacaaattatgtttcaacgtgttttttttggtagtaacacttctgtatttatgctgatgaaatattattagctgcagaaccaccttcaagttctatttctgatgataccaatcatgagaggttggtaaaagtggcccgcatgactgagatagaggatctacaagctccacggagcctcccatacgcaccactttgtataaaggtaaaaaatatttcatggcttcatcgtagatcgatgaatcggaataatatattttaacttgtagattatcatctcttatttgtcttattaggatcctcgagaatattttgattcccaacaagcaaatgctctgagatctttaggtggcaacaatgatggaagacatgctcgtaattgcaggctgagtacagatgatgcatttgatcatttgttgggccaaatatcttctataaaagttaatgggttgaactatccggttattcagtctgatgtggctcttaaggtaaatgattttacacagtacactaatatggatatttaattatgttaagccatctttgtggagtaggccatatctccctgaaataggcaacctccttaagctggtacattattgctaatagtctactacctcagtgaaaaaagtgatgtttcaggatgcagtcaaacatcatactttgcatattgggcatttttttactatgcattttataagtattgtacaataatttgattgttctaaaatttataattcattggtcaaagtcatgttttgtaaactaccaatgtcatgggtagtggccgagaggttgaggccctagtgtccctagggaacggttcccttgtcttacggtagctcacttggatagtctagactggatccttccctccatctatataaggatggattgtatcgttattctaattaagcaatgaatcagaattagtctcccccaaccctaagtccctctctcatccctttcagccgtcgccgcctagctatcctcccagtggtatttaccctctatgccctaacccataacaaccaatgtcccaaaagcacttttgtggcttaggaaattattgctaaacataattgttggatactaagatcaaggggaaatatagaacaagggtttagaaactagtttga

SEQ ID NO: 50394 - DNA, 955 bp, Oryza sativa
tccgtgctggaactacagataagcacttggttgattaactacaagactgacaagtactgggataaggttgcagcagaatacaacagtgcaacccccggagctcggagaagggaagtgaagcatttgaagaaccgctggcagaggatgatcaataaggtggcacatttcaatgattgttggtgccgggtcatggcaaaatatcctagtggccagtcagagggcatgcaacagatggacaaaacttggctgatgtataataaggaagcacatgtgatgtatctcgaagaagcgaagcataagttcacctttggccattgctggaacgctgtttgggaccaacccaagtggaaagaatacatctcttctttctccgcaaaaagagtgatgcgatctgagtccggtggttacgtgtcatcttcggaagactctgaagatatgcaagaaggaaaatgcttagtggatcctctggacatgcttcccaagaaccatgaagatatgacagaagtccagccgtctgtctcaaatcaaaagaagcaattagaactattgacagctgatgcgtcgtggcctattgaatttcagcttgggaggcaccaattgatgactggaacatcaaaattgaacgaacatcagcagggggtggcagtgagggatgaaatgcttgaaaaagaatcgggcccacaagattttgaggtgctagacaatgagagagtggcaagggaagatgaacctaaaaaagaaacacagcctcatcaaggtttcaaggcgcgaaaggtcaatcggaaacgtaaaggcaaggcatcatcttcttcatgtgaggtgcaggaagacatcaaacatgcattatatcttcagaccatgcttaacaatgatcgtgagaaaatgtcagaggtacagctccgcctctcgaaagagcagcttgaattggccagaataaagcaggatgaagcgaatg

SEQ ID NO: 50395 - DNA, 2206 bp, Oryza sativa
  unsure (1)..(2206): unsure at all n locations
tcatgtaaaatggattggctactaccatagaaggtgctaaagtttgtcaaaattccaggagcgtttctcaaccttgtggctctgctttctcatgttataatgtgctaagcagctgcattgcagttcaagatgtattattttatacacaatatttggaaatgtgagaattgccactaatcttaagtttctcttaagcatgttctttaaatacagcggtatcaccgcttagttaccaaagacaagaataacaaacttttttttgaacggaaaacaacacaagatagtgccttttcattgaataaagcaggagaaaatacaacccctaagggtaaagagagaaaaggtgttacacgtaaaatatacactatacagggtgcgggatgaactcacgtaaacgtttggcccctgccagagcccaaaggctaacctcctctttgattttcgttagcagggagctcgttgccatctctttatggtcaaagatcctccgattcctctctttccagatctcccagacaactaacacggtgagggatataagtcccttcttcagaatgtcgggcgtgtttgccatgttctcccaccgctgctgcaccgagtaggcttcttcccaatggcccggttccaaatatagaccaaacaacctgacaatagaacttgctgcacaaattatatctcatctttctattttgtttgatattagttttccatttctaaattaatgggtaagaggaagaaaccaaagccgggagttcattttttgtttactctttttttctatatatagtntaagtgataatgttgacacttcttaccgacatgtactataaagtgattatanaatctatcgattgacttccatgcatgactatctttgtacttaatattactcaaactggtcagaagtatgctttgctttagatgctctcagcagctcttgcatagtcatattatttgcttttctttgagtactattcaatgctatcctataatcatctgtaagctacataactctttaatgaatggcagggcgccgcgaagcgcgcctaaagtcgtgcttcttaatttcatgttacatagccatacataaaattaaattgatcaatgatcctggaaaaaaggattaattgagcaattatactgcacagcttttgcggtccatttaatgtaactctatattggcaatttggcatattggcaatttagcatattgatcgataccagtatcatgcaatggctccgttttatgctgtgtgtatgcatcatgcatatatgcagttagaccccccctagaaaggtcgaaaatgctgatggctaacctggtgatatgataaacacactaatatacatgatgcatcaaagaaagtgcaaactttacccctcgttgatttactggcacatttgttatgtcatggcagtcatgctcatgttacattgcggtatagtgttanagtgtacatggctaccggtcaggctgaaatagagggacgtagaaatcgtgtcagacagatcgtggatcatggatggatgatggatggcagaagcagaacacatcaccgaccggtcaaatgcacgccgagatcacttagccagttgggctctaaacagacctaccacccatgaaggtccaataaacaacctaggactgaacctttagagcccgtgacccactagttgggccaaaacattttttagcccatgtaaatgtccttgtcataagggcgattaggtcaattcccgagtaaacaaaaaccatagagttgcaaacatggggctttaaaactataaatagaacccaagtggtttgtatcagggcatccaattttgtttttaataaatcaatatacatcccacatagttaagtgataacttgcccttcagcagatttgtttgtcaatcgacaacaattaccaagttttggtagaatatgataaatgtgtttgctaaaatttgacaatgctaaaatatggtaatcttaatagtagcaataaactaaataagtcctgtatctacatacacatccacaataatattgtttatttcttataaatgatccatatgttaggtagcagagcctaaagactactataaagaatacttttataatatgtaagacccactctattataaacttttataaactagcaaaatattgttttatatctttgcaataaacatgacacttgcaaactaataaaagagcttt

SEQ ID NO: 50396 - DNA, 1417 bp, Oryza sativa
atagatctactaagccctcggtgaataattcaatcacaagtaaataattgagtaaaatgaagtcacctttttattgtcaaagttttactttggatcacacttaaaccaatcttttcattttagaccggataactttgcctatagtatttggcttggatcaccccactctctttactattcatgtatagatatgagcagcatataaaaggggaagttcaccattataccgaaaccgatttgattgaggttatttatgggtgtttgaagaagttaaggatgatccaaacttaaaaaaaattgataaaattttctgatcatccaaactaaaaaatatacaaaactatctgattctaaagtgaaagattgatttgagggtggtccaaagtaaaacttaggcccaaatcacaatccactcgcaataatttgatccagtgatcacttgggcctcatttctctcatgggccgtgaaagaggtttcaaggcccatgacgcacacctaagattgaccagttcaactaacgtttgctaaatttaagcggaagccgttgaaaagccaaggaagcaaaaaccacccgtttgtggcgcgcggtgatccataaacagtaggggcctcccttcgggagccccctttcctcgcgtcgtccccttcgcggagcctccccttcgggggcgcgctccattgttttttcccttccaacccaatcctattatgacattacgatgcctatccccattgctttctttttcttcttccccttcttcttggcggcttcttcccatgcaacggcttcttcccatgccacggcttcggtggtcccacaaactcgaggtaattcatggtactcccttcattttatattataataaattttatcttttttattaaataatccattttggtaaacttataaaagaatataaaaatattttctacaaaacaaacatatataatcatagtatatctaatggtggtggtgttgtatatgttgctaattgtttatgtaaacttgattatatctaactgatcagaaaaaaaagtttaagccactaattatatcacaaacacggagtaattgattcttgcatgcaagaaatgggacgtgtaatggtgggtgatcgaaatgttattatagggttctatataaactgtggatcggagaaggaggagcagatagggagcatcaagtggatacaggatgaggggttcatcgccgtcggcaacatgtccgccgtcgacaagccgaacatcctgccgctgctcgccaccgtgcgctacttccccgacgcgacggcgaggaagtactgctaccagctccccgtcgtcaaggggtcgcggtacctcgtccggaagaccctacttttacgccgggttggacggcgccgaggttccgccggtgttcgaccagatcgtcgacgg

SEQ ID NO: 50397 - DNA, 1787 bp, Oryza sativa
gagactcatttccatcatactaacttttctgaatttggaaaggcattttgagggcaatcagttaagtggaccaatcagcccatcgctgggaacactcaccaatctcaaggagctgtaagtatcctaaccctctttttgttgcatgtccaaacagctgataactcttagtacttgcctcatgcatttgctcctgcgaaagacagatacctgaacaacaacaatctcacggccagataccagagagcctgaaaaacaaacctgaacttgacatgaggtatgattggggaacaaagtcttcacattttggatccattttatatgctgatggtattgcttttgcataaaaaaaaaatatatatatatatatatacaggactgaggggaacaaacttaattgaggctggaaaggaaggaatatctgagatgatcatttccaatctaatgttacatttatgtacagaaagatacagtttgatggatgaagggagaagagcgaaggcttcaaaaactgtaggatgatattcatgtttaatgctgtatgtgagttgaaagattgatgtgatatttagcatcatccttttgatccattttgtgttattagtatttgttgtacatgctgcattagatggcattagtgtaggataattgttaggtcaaagaagcagttcataatctaaccaatctaaacgccaaaagttgtaccatgttccatcaaaacttaattaggacagaaacatgcagtagccagacacataaacagcagatactccaaatctgtcagctaataaactcccgagtgtcgaattggcagtaattgtggacacaccaattacaaacaacataagagtggcaaattgttccttctcccaacatagatatgggctacatgatagatgctctgcaaactagcagagtaacagattaagtgcctaatggtaatactaacagatgaggcctaaacctacccaaaatgcaatttttcgtctgccgatgtgttagtagtgccgtctttgttgatgtcacttggttacctcatttccatcatcaacagtagctcggataatatgcacctggacaaaaatcaattttcaaggattattcacattattcatatataaaacatgcttaagttacaggtacaaatttattcagacatattgttcagttcagtaaaaattaataccttgaaggttgtaggcttgaccaactgaaatactgtcgcatctccatccaacaatccatggtccaaagcaaagccagcccagccaccacttaggccattcttgtaggcaaggtaattggtatcaaattgctcgtctttctcatccaacaaagtgacaatggcatcatgttttggcaggtaagtctcgcagaaatgcctcggtaagcccttttgatcatgccaccaaacaagtattagtaccacatgacaacagttccccttaaagaagggttgcagggatgggaatgtgatagtgcagtactcaccaaccaaaatcctcggaccacatgtgaatgtagcattggcttcacgaaggagggaaattcagggtcaagttgtgattccagttcctctgcttttcttgctgcctcgagcctagcttccatggaaattgatccacgggttgccaagtagatactgtcaattgcttttcgtggagacctgcagaagaaatcggacaacgggatgtagttttgcaccttttgctacttagtgggaggcaatacaggttcatacgctcatgtggtaatgttattgttatcacataatgacataccttttcatc

SEQ ID NO: 50398 - DNA, 886 bp, Oryza sativa
aaaatttgtcgacaaatgtataggtggtcccatgtgatatatttggtccgatataaagtgtggtcgcgtacggtaacagtgagaagggaatttttctactacgtactacatccgtcccaaaataagtacagccgtagatatccgtgcccaacatttaaccgtccgtcttatttaaaaaatttgtgaaaaatttaaaaatatttaatcacacataaaatactattcatgttttatcatctagtaacaataaaatactaatcataaaatttttttaaataagacgaacggttaaacgttgaacgtgaataatgtaaaactacacttattttaggacggaggtagtaaaaagatgggtatgcaacttgagtacgtgcttgacataactgtgatgcagtccaagaacttgatcgcgaaggaccgagatcctctgagaagaccgtgactttgatccattatcagtcgtccgatctacagtatctggtgaatagtaaatcaaagcagtagtttttacttttttactgtgtctacagtaaaaaaactgcagagcaatgttttgcactgtaacaccagattcattttactatgtttatcttccgttcgcttccaaagtcagaggagccggatccgattggcgaatgctgccaacgatcctgacgttgttgacctgacctggcacgacaatgcaaatccagtacagctgctgtttcagatgattgacgacaagccgattgcctttcccttatctgaaaaaatttggtcagatcagatgagtcatgaaatggatggatgcatagaggtcggaactgttggatttgtctgacgctgaacgcgatcgatcgatcgatcgagtgatctctcgaaaatgatgccccgtacacgtaggact

SEQ ID NO: 50399 - DNA, 2305 bp, Oryza sativa
acgtgaaaacacacccctagaatggcgatgaggacgaagctgatgtggagtttgatggcgacggagccatcgccgtcaagcacgcaaacttatctagctgcgactcctgatgttcctggccgtgatcgagctcctgcgttcttgcttaatttgagtggtcggatcggctactgagctggtgcggcggcggcggctaatcggcgcatgaggatcgcggtgacgggcgcgacggggtacctcggcagccgcctgtgcggtgcgctggccgacgccggccacgccgtgcgcgcgttcgcgctccgctcggcgggcggcggcggcggcggcggcgacgtcgaggccggcctgctcccggcgtccgtcgagctggcgtacggcgacgtcgccgacgtggagtccctcgccgccgccttcgacaggtgcgacgccgtcttccacgtcgccgccgccgtcgaggcgtggctgcccgatccctccatcttcatcacggtacgtgtacaatcttttaaaaagaaaagaggattttaaaaagaaactcgcgaaagttttcaagcaattccgaaaaatatatgctctataaaattgatttggtcatttggtgttaaaaaaatgggcatttaatcatatcctcggacgtgttatgattatcaggtcaatgtgggagggctcgagaatgttttgaaagctgccaggaggacaccaacagtaaagaaaatagtttatacgtcatcattctttgccattggcccaactgatggatatgttgcagatgagacacaggtaccatatttatattggagttctccttaattagctccctcagttttcaaatccttcggtctagaaaatctgccatttcttgtgtgagatgtccagactgagcatgctaaaaaaaattgtgcaaaatatgatgatatgtatacttcaaattcctttcgtgaaagaaaaacatttttgcagagtaacaataagttgctgatattgcagatgcatcaaaggaaaaacattttggcacggaggtatgagaaatcaaaggttctttgcagaccagatcgcattgcaggcagcagcagaggggatgccaatcaccatcgtctatccaggattcatgtatgtcctggaaaacttacagcaggaaatcttgtttctcgcatcgtaagacaatttctctactcctagttattcatcctgcatatatggtatatctgaatgacccaaaaaaaaagaacttgttcctgaaataattaacagccatgaatcatgatcagaaacttgaacatcactggctcttaatttgcagttgatcgagaggttcaatgggcgtttacctggttacgtcgggcatggccatgatcgagaatcattctgccatgtcgacgatgttgttgctggacatgtagcagcaatggagaaaggcagagaaggtgaaagatacctcctcaccggagagaacacgtcgctggttcagatcttcgacatggcctccaggatcacgaacacaaaggcgcccagattccacgtacccctctggttcctgaaatttacgggtggatttcagttcttgtttcaagaatcaccgggaagctcccgttcatcagctaccctgtatgtctctttctgtgctccttttatttccagtacttacttaggttcagagtttgtttttgcagggtctagttagattcagagtttgcacattggtgatgatgatgatgtattgatgtggttacttagatttcagttcttgttgggttttgcaggcagtgcgtgttcttaggcatcaatgggcatactcatgtgagaaggccaagaaggagctagggtacagtcctaggagcttgactgaaggtctatcagagacgctcttatggctcaaggacagcgaaatgatcagattttagtgttctacatttcactcatgtaaacatatcagcattgctgtaactgcataaatagttaaatcaaagaaaacatgtggtttgaaatttgaagatgaatgcgtgcaccaaacagggccaaatttcttcttagatggtcaaatttgttcctgctgatcactgatcagacttgagactcgagaggcaaaagcagatcatatttgggcccggcccacaagtgacttgggcccgcttgcttgtgggttgactaggggtactactggacaggctggtggctggcctcgccggaaggcttggaagcccgcgttgactagtggcggtggattggcggcggcggcggcgactcgacgatgggcggcggcatgagggtggtggtgacgggcgcgacggggtacctcggcggccgc

SEQ ID NO: 50400 - DNA, 764 bp, Oryza sativa
cctgaaagatagccatgaccagaagaaatttaaactgttgtgattcttgcagttaattgaacggtttaattggcgcctacctggttacataggagatgggtatgatagggaatcgttttgccatgttgacgacgttgttaatgggcacatagcagcaatggagaagggcagaccgggggaaagatatctccttactggagaaaacttatcattcaaacagattttcgatatggctgctaacattacaaatacgaaggcacccctattccatgtacctctctggttgattgaaatatatgggtggatttcagtttttatttctcacatcactggaaatctcccacttatcagttaccctgtatgtccagtattcttccttatttaagtttaccatctccagataggtcatgctgttgtgcttactagattctcaatgtggattgcagacagtacgtgttcttagacatcaatgggcatattcatgtgataaagccaagagggagctgggctacagtccaagaaacttaactgaaggtctatcagagatgctcttatggctcaaggatgaaaaattgatcaagttttagcactcaccccttgtgctaacttgtgctgcattccacaccatgtaaactgagatctgatttaaacctattaactgtaagatgtacatgtttggtgtggtgttaatgttgtatcatatcagtaataacttgagatgtaacatggtagtactggttccatggaagaaaggaaaaacatgt

SEQ ID NO: 50401 - DNA, 3007 bp, Oryza sativa
  unsure (1)..(3007): unsure at all n locations
cggcatgccaaatccattgttcttaagcccgggagcttgtatagtttttatttttggggtgatgtctcttgtcataagaacagaaagaacagaaaaaagttaaagttctactaaggttgctccaaaacagcgtaatgtgatgaacctagtctctaacgcctttcttccattttccttttatacagaggtctctgatcagaattttgctgatgatgaggcggaggttgatgcagaatcaagcaaagcatgcaagagaaggaagttaagaagtgctcttacacggaattaccaagtaatttctcaggattttaattagcttattctgttgcaaatattgagatgaagacagcacactaaaaaaaaaatcagagtatcagtagcactgacatggtttgttctatatatgcaggttgttccatctgacaaactgtttgcttccacaaaagctgatggaaggaaagatgctccaaagtaaggcatgcaagagtggatctggttgaatatgcagtcaatgagaactggatgagttagtattggcgatttagtagtatagttcttgaactctgtagagtctgtcttggtagaagaataataggatcgatcactcacaacatggtagatttattgtttgatcatattgttgtaatggttttttttgtgtgtgttgctgtgttctggcaactgtttgtttgccatgtgagtaatatgtttatgtttgccacaagatgagaatgatgcaaagcccatcattccttttgccataattccattggacatacatgtactcccatcatgatattgagaatgaaagatcaccaattttgcagaatgatatccaacatctgtaaaatgaccatatataattgtgttcatggtgtgtaaagtgcaaattttgagaagtactgaattactgatgatacatgttcttacttccctgtgcaaaccaacattcagcgctgtgtacaggtatgatggtacgcatatttgccactcctggccaccgtcctcgcaagagtttaccaaagaccccgatgaggggaaaccaaagaggcaaagaggaggaaaaccggagaaagaaaacgagagttgagtggaggttcgctatgaagaggggggaaatcgccggtggcggcgagctcgtggtgctattcgtcacttgtagaagaggaggggaaggaactgctgcccgggaaggaagttagaggagaggaagacgaagaagaatggatgctgatatgtgggtctcgtatgaaacgagttacttcctccgtttcacaatgtaggtcattctagcatttttcacattcatatttatgtgaatgaatctagatagatatatatatctagactcattgatatcaatatgaatatggaaaatgctagaatgacttacattgtgaaacggagagagtatgttaggaaaccacatttaaaaatcgctagggagttgaattataatggttttacaggttgagatgttaaaatatgagctggttataagtggtattgttgttgaggaatatgaattagattgagcctataataaagggagtcaaatcggacttattcctttgtagaaagcccttgattgggctgatcccctgggtcggcccagcatggcgccttgaactagcaccttctttgtctttacgggcataagcttctagcagctacagtttctcacataatctccaactctcttaagggtgtgttcgctgctgatggataggaacatatcacctaagcacgaaaaatgaagcagtccattaccgcgtgattaattagatactccctccgtataggaaaaaaacgtcgttctagccataacctcgtttgcgattttaacgacattctgaaccgcagcaggctatgtggacggaataacccttgtctgttcgatagccgctcccgcaattaatccgcagcacgcccgcgcttgcctcgtttaattccttaagcgtagcatgcaggcatgcagcacgccgctgaaacctggctgtcacgctcgccgccgccgcatgcgtcgcgctcgccgggcctgctcttgtcgctctcgccgctgccgccgccgcttgcgtcccgctcgccggccgcgctcttgtcacgctcgccgccgtagctctcgtcgcaatcgccaccgccgcngcatgcattgtgctcgccggccccgatctcgtcgcttgcgtcgcgctcaccggccgtgctctctcacgctcgacgccgccgccgccgctcgcattgtgctcaagatgcttgacgagaagcgcgaacgtgagctcactcccaggaaggatgatgccaaagaaatggtaagataacacaacttaataatcgcattacaaggatgtctctattaattgagtgcggaacctaactagcttcattctaaatgttcaatgcagcaagagtagccttggttcatctaggaaagatggttgacaaactgatctgcaacaactcttgtatctttcttgcctagtttcccattcttgcttctagccaacaaagcttgataaacttgttttctcacttcttcggtcatgtctttccttccttcgatggtttacttcaacgagagccatgacatgttctagcaaaaggaagaaaatcaagttcattgatagtacaaatagccatggcatgttctagcaaaatctaattgtatcaaaaagaagttggcttaccagcaaggtgttgtacataatcgaaatcgactgcaccaaattcatttagtggcaagttcaaatcaaaaccagttaaaaaaaatggaaaacaatgatatgagaaacgatatagagaagaagagatagcacagttgccgtacaaacatgcccaagagaagaaaaatcctgtcaaacagagaagaaaagtaccattgccgtgctccaacggaggctcgttcagatcaaaggcaaactcgccatcgccatcttcggccatgtgtactgcaatagtgagaggaagctagctagaagcctagaactagaagatgagatggctcagtact

SEQ ID NO: 50402 - DNA, 1137 bp, Oryza sativa
catagtaaaccaatttcccaggaaaagatgtttattgtgtatgttaaattcctttctatagctggaaatattacaggtagaaaaaaaccctttgatgtcctcttctactgttctattctacgaaatctgaagaagcatagaagaatttatgtgcatagaagcatggaagctttgaagtttggtactacgtatggattctaatttagttaaaagaattcagcctgaagtagcatatatgatgcaaaccaaaagaataagaggtatatttttattttctgcaaatctatatatactggagaagatctaccatactaccacaggcaacatctgtccaaactccagatgagtaaatcgtgttcaaatcataccaggaaattactgcatgctaatagcagtgcactattgactcctacacaacgaattgttatccttaatttgcagcataagtggttagttttgtagatccgtacctgtgcatgaagccaaccagctacctatagctcactgctcgtattgtgggctgtggccgtaggtgagcgtcctccgcgtcggctgctagtgcaatcgatattcttgtagctcatatgtttgattgagttgattctctccttgctctctgcatctccgctcaagccaagcactgaaggagtaagaggggtactaaatctgtcaatctgagataggggatctgtttttccctgtactagaagaatccagactgcttattgatagagtgggctatggggctgtgacttttcatgggcttttagcgttctgtgtccccgaagtgtcgtacgtagggatcttttcatacgcacttcgtaatagtttcttcgtgtgtatagcagtgttgttttccaatcgattgagccactgatcatccgcaaagacgaagctatctccttcgtcgattcatccttcccgaacacctcatactcatggccataaaccggatgccccatcgggtgcggacctagttgtgttcatcgtttatgggcatgaatgctcttaaatgttgactgggcttctaagtgcaagaggcatttttgacatcaacaaaacgatgtaagtgtacaattttccttttttttatttctccagcaatacactggtgaatacgagtttgttcactttggg

SEQ ID NO: 50403 - DNA, 1226 bp, Oryza sativa
atcattctttgcattgttactgcattcgcgcgggctgaaatgctggatccaggggcttgcgggcaggcagtattttctcccgatccgtgagcaagcactggtccgatcaaaattgagtttctcccacaccccaccacggagaaccttgaatccgttgccagcatcattttgttcgtgattgtagagttgctcaacgaaaaaagcctccattgagcttatataatgcatgtgccgctcatctgtccaccctgacgacatcatgtccaggattcgattgccctgtcaaagaaaaagagacaaccattttatttttcagagttcaggtatttgttacaacgtcagataaaagagggcctgaactagtgaaattcatgtcaaaaatatcagagtagtgttgattgcatggcttaaagttatactccacgagcagagtaattatgtgtcttcactgccccatgggcggattatattactatttcgacaagacagacattttttgaacgattgcatgacaaattcagataaaccattaactgtacaagactaaccccttttactaaagaaaaagagctaatggcaataattcaaggaaccatgcattcggtatgacagaatcatgagcccaacaattgctacctgaaattaagaacaaaccccatggtaaaaagaaaaaactttctgttctaatacctgagcaatgccgcctgcagctggctccgccttgatcggtcgattgactgacacatcacccatttgattcttctcaatgaaccaaggaacccacaaggggaggaaaatccgaagaaattgccaaaaatcttctcgaaccgtatcagaaaccagcccaaaatttcctctcttgaaatatgtacagctacagagaagtagggggaggtctagggatctggaagcaaatcggcgaacaaaccaaagtaaatctcctcgcgaccggatgattacgaagagggaaaacaaaaaaaaacaaacaaacacggacaagatttcaacttcaagaaacaaacaagagaaacaaaaatcacacctctcgctcgatttcacccgcagatcgaacaacccgcctccctcgcagcgagaaagaagagagaacgcatccaagacttggtctgagcggctcgatctatggacagacaagaggagctgaagaagaggaggagagagagaagcaggagagagaggagaatggaattgcaacggaagaagcaaag

SEQ ID NO: 50404 - DNA, 1229 bp, Oryza sativa
ctacagactgagcacaaagcttcccagatagaactgcaccctccatcgaagccaaatatttctgctttgtgtagtcaccagctagatagaacccttcaatcggtgatctttgcagaggtcggcaaggttcacagtccgggatagtcttgtaaacagatctgtaacagtgagacagaaaagaaaggaacgtgagagaagtgtgcatccaactattagacctacctatgatatatcagatagggggcgctcttgcaaaatgtcctcaccttggtgtcttcacaacatgatacttcagatctttgctttactctgatcagcagcaatttcatcaggaaatagcttggctagctcttgcatagttgcttcgatgatttcagtgtcactccgtccaacccattcctctgcaggagcaaagaccaactccagcattgaacggtttggatcatagtattcctgtaaagagttcaaaacaaaaggaaagaaaaccgttcagtaggcatccatgtctttaatttcctgagctattatggtccataaaatctagactctagagccaagtgacatgttgcctaaatgaatctgaaataaaatatatctactttccaagtttaataattaatactggattccttctgtaacacatgcacttttgggccttttgttacagctactaaaataaatatcatgtgatgcttgaagatggtaaacccaagaacaaatacacaagagcaataatacatgacagatagttactatttcgtaacatataatgtctcctagttagtaccttgcaagttactgacatgtccgcataaacacttaaaagtgaactcctgaaagaaaagggaacaagatcaatacatgggacatatgatatttggtattaatcaagaatgtatacaaaatcaggatagaatgtgcccaatttgggcaatacaaatcgttttagttcataaaccagtcatagcacagagcaaatgcatgaggcagtgaaaggacagcaaaactgatgaggaattagaagagacacctgctgaaaagaaggtggtcatatgtgttcttcagttttctatcaaacctgaaatgttcaaaccaacagaaatactaatatgagtcataaggagaaccacaaactcgatgatgagtaatttccgacttggaaccaaataattcaaccaccaaccatatatgaacatttataacaggaactcccaccaacttctccagct

SEQ ID NO: 50405 - DNA, 1429 bp, Oryza sativa
ccaaagttattacttacaaaagatatgaagcccagtttcataccaatctccatcttcatccttccaagcagctatctgttcaaggcatttccccaaaaaaaaaaacaataatccacaaatgctactaacagtgaatatgagctattaagataaaggcaaccaaaaaaaaaagaatgaataccaaaaaaaattaaatgcaacataaaagcataagagtaaaacctttccacccaaaacatcccttgcctcaagcaatatgggtttatgaccagcatctgccagatattttgccgttgataaaccagctaatcctgaaaaaaaaatcaaagctaaaaactacaatgctaagaccacgatgtgactgctatcaaagttagatatatatgtaaattattcatctgtcaaatcctagaattatatcatacctgctccagcaatcacgacctgtaatggtttagtgggttgttcactgtttctgaaaaatgaagatagttgtccagcttccaaaaaggttattggttttctagtggagggcttggaaaggcctggcaaacaacctgcagaaaagccaatcaaatatattttcacaagagatggaatgtgaggcaataatagagtacaaaggttgaacctgtagagcaccgagcctccgacggaatctttttcctttattccttaagacaagagatttcactccaaagctcacatgctgactacttttcagtgcttggatgctgctacttgcgaagcacctatgagtaggaagttgtcccgcaaagatcttgcttggctggttccagttatgttcatagatgacaggcagccagtatccatgctgaagcaactcctaaaattatattcagatctgatttgacaaataagcacgcaagagcgtctgcaaaaacaagaggaaccattaaacacacaatacacaaaaccgtttgttatgaaagtcagccaagtatcactgtatcagtatgtaaatttatcaagtttgtcatcactatttgatgaaaaaaaaaaaacgagccaaagaaacagattctattctagtccagtcgtcaaatggaaacatagcatgacaataacaaactgatgccaaaaggaaaaaaagagcaggaccagctgttagttgttaaagctatgtggacagtggtaatattggtttactccctaatcttccgagtttctctatgtggctgcggccaatcaaacttttatagttggagagaaacatgaaaggaaaactgcatatgacccgcataatttggttagtgaagtaaatggattggaacagatcaagcatggcacaaaaagcatgaaaggctcaaatgatatcacactagggcagggcagctggagaggacctcgtttgcctcctcatgcaaaagtgggggttagcgcaaactgaactcacaaccatgcgccc

SEQ ID NO: 50406 - DNA, 717 bp, Oryza sativa
gaaaagatgtgctgctacgaagtaattatctgatgaacagtataatcactgtataagtaatgtttatcaaatgttcgcgtttgccatagcagagacagaaactgtgcgtgcatctgcacacgagagcatgcagtttctcagttctcacggtaatcggaggcgactgtttggtttcaggtgaccgtccgctcactaactggaggtttgaacggtggttggatcagcccaaattcaggtcttctcactgtaccagttcagtccaagctgccatcttcttaacacttcaagaagaaccaaccaaaacccacctcgctaacgccacttaaatctcctgtgatcttgtccatcagattgtctaatgcgtggtgagatcttcactgcaacatttggaatgaaaatgacgatgctgtagccgtgttcattatttcacattctgttccgggcgacagattttagctgaaggcatggatgaaccaggtgaacctttgcttgggctagagaatttcttcgacgaagatgttgatttggtaagtacatttgttaggatgtcgtggatttgaagcattctttgaaaaatgccgtgattcttgtggatatgtgacaggagaatctgcccctggaagacgtttttgagcagctgaatacgtttcagagtgggctcttatcagcagatgctgcagaacgcttgaagttgtttggtgcaaacagattggagga

SEQ ID NO: 50407 - DNA, 1011 bp, Oryza sativa
tattgttcgttggagcatggcaagaattggtcaaaaattgctatgagcatttcagctttcttttttttttctttcttttcttttttgcgattttcctcttaagatgtcatgctatttactcttgtaaatctgaatccatgcattggtgtctatgggcacttcaaatttcaagtttgctaatgtgtttgtttggtgacatactgacatgcattatacagtgttgcaattaagcccggcgaaaacgtgtagtaattatttgctctttttcatgcagttactgtcctcaatacgctcttcactatcctgaattctccggggcagctcaaaggttggcaggcaagtggtgaagcccttgtggccaatcatggcagggtatcacgtgctcaggatcatcagttactgcaatgtgagcctcatcatgaagcaaagtagtttactacttactcgaccaccttcttttttacttcttacaatattttctttgtgtttgatgttgtagcaaattaccaagcttggggctctccggtaatttggcgtacaatatgaataccatgggttcattgattgagatgtgagtatctgagattattcatatctgatcctgtcaagtgacaattcagttgataacagtcttaattgattttttaatgcagcgatatgagccaaaacaaccttggtggtggccaacagatacagtacaatcttcccactaataagcttgagaggctgtaagttcctcaaatgaagttgtggtttagaaagtacatcagcttttctggtgtctgtgtgctaagtggttattgtttgcagcaatctcgcaggaaaccagttcactggaaatttaccctactcgattttctcgatgtctaatcttaagtatttgtgagtatctttgcaaacatcaagttgattttgcttttaaatttgtataatttggtagagctaaatgttttctctttgtatgtgcagaaatctaaatcataaccaattgcaaggaaatataactgatgt

SEQ ID NO: 50408 - DNA, 1376 bp, Oryza sativa
ttttaagcaacaatgagtttttcatctaactttagtcgtccattttatttaaaaatatttataattagtatttttattattatgagatgatgaaatatgaatagtacctgtgacttatgtttttaatcttttttttaatttttttaattaagacagatgatcaaaattaagcacggaaaatcatggtagaagcactcgatattcgattccttgggacttcatattggagaacacggacacaagggcagtttccgccagcaatagattacctggatatcaaagttgactttgctgacagagagcctcatcgagttagcttatcacaaaagtccctttcgtcgggtaaccacagttcgcatccacttgtatctatcctgacgtccttcagttcgcaggataccaatatcgtcaattatttgcgtctgcgatgtaaacacgaaaaaggctgtagatttagccgatttgtttggacgaagtcttgaaggaagtgttctctgcggctatatttatgcaactcgttcacagtttagtggtcatgttttcgtttgggctactatactttgtgctctagtcaagttaataaacttatccactactcatctactggctagttgaccaccttcacgtagggtttcgtcaaaccattatacttggtcagaatcagaaactgtagtactcggtatgtactatcaatctgtactactcaagtatttaagaaagcatccgtacttcacattgtaagaagaaaaatactatgatcttcagcagaagaacatacaagaggataagactaaattccctttcaataggctaaattcctaattaaaatggctgcatatatccggttggatataaaggccaggtaaaaaatatccttctctaaaaaaacacatatgagaggatgaactcctactatacttacaaggaggcaacagatgatcaaaaacgtttttcgttattccttagaaaaagaaaaaaaagaaaaaacgatttgaaatggctcaatgctaattgagtacttgtctaatctctagagagtactccgtatataggtttacaagagtagtcatcaccagaaaataacttttggagggaaactctattgtactaaccagttcgcgttcacactgcacgctactcaaaccattcaatccgaccatctctgctccatggttaccccgggaagctctcgttgcggctccgccttcttgccgatgatcggcttggccgtggttccgtccgccacgtcccgtagcacgattgcaccggctccgatctccgctccgtcgccaatgtgcacattgccgagcacgctcgccccggcgccgatcagcacaccgtccccgaccttggggtgccggtcgccggactccttc

SEQ ID NO: 50409 - DNA, 1523 bp, Oryza sativa
gattttaatagctgtgagatttgtagtttctgaaacagatttatcaaagagccaacgaagaagaatgccggaccatctttgagtttcttcaagtgacaacggaacttcaccagcatagagcaaactcagtgccactgctaatgattccttcatcctgctctgagcattctcattttctatcttttttgcgatactacgaagaagatgaagacccttctgtctgatcacaaattttgactcattacaccttatcatggataataggaaagttgatagtgacatttgagccaatgccatgtcaccattctcagcagcccgagaagctgtcaaaagaagacttgagcaccagtcagggacagaaggagccaaagtcaagctctggtcttccaaaagagctcgcgccaccatggctccatgccacttgacagttctttcaggtgctttcagtgcagttgtgacagtatgtccatcactgtcaagttcttgaatacgagaacggtttaaatcagatgcaatagcccaattagcaagagcccaagtagcaaaagggtacagctacatgctccctctgcaaatcatcccagaggcctggagcagcagcagaacttagcttctccactagtggagaatcagtagcagtttcttgcatcaatattctactattcgaagctccaacaataccatcatccgagtgcccacctccaatgagtttatttctctagagaatcccaagacagtagtcccaccaagtaccttaatccctattccttttaatccactgtcaccatcatcactgttattatcatcatggtcatcaaaatgcatccccccttgctcaatgacttcgatggctgccgcaatatctcttgtatcagcatctgaaggcaataaaggctgaaatgatgaataatccgcattatcgcagttggaagtgatgatgtccataagtgcagcaacaagcatgctccttcctttagaatggtctgagacattgaatgaagagtattccgagttctgtattaacaggagggcaatatattaggtacaaacaactcatattgtgttaaagtccaaggaaaccagaactggaaaatctaaatggtttaatagacctacattgctagattaagatgcgcatgaaacataatactacatgtataggggaaaaaaagaagagataagctgaagaaaaagcactgccagcaagcaaaaaaagaaattgcctataggagagctgagatcaccaagccatcaaggaaaataaattatatttaccaactccaaggtcttgataatccattagacataactgcattattgcataactggcatgcaggtgcataacataactcattcccccatgagatcttttatcttaacatcaatagcatatattaagagtttgcaatctgaaaacctgaagggccaaaggttccatgctcacaaagacatgggatgaaaacataaaaatgccagaaacctcagagcacacgaggatgcaaattttgttttccacctataat

SEQ ID NO: 50410 - DNA, 723 bp, Oryza sativa
cggtgagcacgatgtcggcggcgcccctcgcggcgtccgtcgcgtcggagacggcgatgccgatgtcggccttcttcagcgccggcgcgtcgttcacgccgtcgccggtcatcccgcacacgtggccgccccccccttgaatcatcctcacgatctcgtacttgtgctccgggaacacgccggcgaacccgtccgccttctccacgagctcctccaccggaacagccgcgccgccgccgtcgccgtggcggccgaacagcgacgccgacgggtacatgttggtgcccatcccaagacggcgggcggtcttcttcgcgatggccaggtgatcgcctgcaatgatcaagaagcttcttggcgttgctccattgacgatcaagaagcagtacgatcatcgcgtgattataccggtgatcatcttcacgcagacgccaagatcaagcgctcggcggatggtgtcggcgctgtcgtgccgcggcgggtcgaacagcggcaggaggccgcagaacacccatggtccgcccatggccgtgcttcgatttccctggcacctccttcactcaagccatcagatcagatgaactcaaccatcagacagatattcattagcaacaagtaaactgaactgaactgaacttgatggtgctacgactacctggtaagcgacggcgagtgaacggaggcctctctctgcaaatctgtcgatgattagctgcacctttt

SEQ ID NO: 50411 - DNA, 10046 bp, Oryza sativa
agagcgccccgggggagagagagagagagagagagagagagagagagagctctcgggagagtgggccggggagggagagggagatgggccgagcgagtttcggcccatcgaccttgggggaggtaaactagactttgcggagggattttgatttagaaggaattggattcggagatgaactcgacgatagatcggggattgagatcatgagatggcacgggcactagacaacaagcaaggaaacaaatttcgcaattagggtttttaagagataattttcccgctaggcgccacgacggaacgggcgctacagaccaacccccctaacaagaatctcgtccccgagattcagcacctaagggagcagctccggaaactcggcgcggagaagatcttctcgttcccaggttgcttcatcttcagaatgattgctccattggactttgtagaacttgattgtcttccttcgagtctgacgttctgcttcttcaagaaccttgatcggtctttccttgtaggtcagattcttttccagctcgatattacctaggggaacttgctcttctggaactcgaagacatttctttaactgggatacgtggaacacgttgtgcacatctgcgagaccttcaggtagctcaagctgataagccacttcgccacgtctggcggttatgaggtaggggccgatgtagcggggtgctaacttgccggacatcccaaaccttctcattcctcggagtggtgatacccgtaggtacacatgatctcctttttcgaactcaaggtcacgcctccgattgtcagcgtaattcttctgacggttctgtgctgtcctcaaacgttctcgtatcagcttaacttgttcttctgctgacttgagtatgtcaggaccgaataccaaggcttcgcccacctcattccagcacaagggagtgcggcaccttcttccgaacattgcctcattcggcgacatctgaatgctggcctgataactgttgttgtatgagaactcggcatacggcaaacaacgatcccaagtgccttcgaaatccaaggcacatgctcgcagcatgtcttctaggatctggtttactctttctgtctgaccatcggtctgcgggtggtaggccgtactaaaattcagatcagttccgagtgcttcatgcaattgcttccagaaccttgaggtgaactgagtgcctcgatccgacactattttcttgggacagccaaatctacatacgacatgagtcatgtagagttctgctagtttctttccatcataggtggtcttcactggcacgaaatgtgctgacttcgtgagtcggtccacgattacccaaatggagtcgtatccgctgggggttcttggcaaaccggtgatgaaatccattccgatctcttcccatttccactcgggaatcggtaggggttgtagcagtccagctggcctttggtgttctgccttgactctttggcaaatgtcacacaaggctacgtattctgcgacatctcgcttcattccagcccaccaaaagtatgccttgatatcttggtacatcttcgtacttcctggatgaatggagtaagcggactcatgagcttcctttaggatgagatttcttaactccttcttggccggtacacagatgcgtggaccgcaccaaattgtgccttgatcgtctatggagaaattggtgtctttcttctcctgtattctttttattaattcttttatcccttcgtcgtctttctgagcctcccggatttgcgactctagggtaggctgtactgtcaagctggcagggacacctgactgcaccacggtcagccttaacttctccaattctctgcacaggtgatcttggtcaggccgtatttgagctatattgcaataggccttgcgacttagcgcatcagcgaccacgttggctttaccaggatgatagtggattccaagatcgtaatccttgattagttccaaccatcttctctgtctcatatttaactcggtctgagtgaagatatacttaagacttttgtgatcggtgtatacttcgcatctgttccctattaagtagtgcctccagatcttaagagcatgaatcacggctgccaactcgagatcatgggtggggtaattgacttcatgaggcctgagctgcctggatgcataggccacaacctttcgttcttgcattaggacacatcctaagccctgtcttgatgcatcacagaagatctcgaagtcttttcggatatctggcaaggtgagaactggggcagtggtcaatcttttcttcatttcttgaaagctgtcttcacaggctgtggaccattgaaatttcttttccttctttaacagctcggtcataggtctggctagcttagagaatccttcaatgaatcttcgataatatccagctaagccgaggaagctgcgaatctccgacacattcttgggcgggttccacgcaagtacagcttcaactttgctgggatctacttcgacaccgttggaggagatcacgtgaccaagaaaagctactcggtccaaccagaattcgcatttcgagaatttagcgaatagttgatgatctctgagcttttccattatcagcctcaggtgttcagcatgttcttcctcattcttagagtatatcaggatgtcatcgatgaataccactacaaactggtccaggtattccataaagattttgttcattaagttcatgaagaatgctggagcattggtgagtccgaaggacattactgtgaactcatatagaccataacgcgtcgagaaagcggtcttcggaatatcttcagatctgattttcagttggtggtaacctgacctcaagtcaatttttgagaagactcttgctcctttaagttgatcgaataagtcgtcaatccgaggcaacgggtacttgttctttatagttacttcattcagggctctatagtcaattaccattctctcagagccatcctttttcttaaccagaagcactggggctccccaaggggatgagctaggtcgcacataacctttactttccagttcttcgatttgtcttttaacttctgctaactcattagcggccattcggtagggtctttttgcaattggagctgtgcctggtgccagttctatggcgaactcaatctctcggtctggtggcattcttgttaattcttccggaaatacgtcgggatattcacagactatgggcaccgactccaaggaggtgacttgcaaacaggttaggatagaccgacttgcggtaggggtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagttaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcaaacaggactattgcgggtacggagttgacagagaacatacccatcacaacgtctggagcatcctgagcggtttcagcttgaatgtgattcacacgtcctcgaccaaagtggttggaagcacgagaaccttgtccacttgcttgagagctaggacgagactgagctgccgctggagtaggagttctggcagtgctgccattagcatgtcctgggctggtgttggtaggattctgaggacactgtctagcatagtgacccatctggttgcaccggaaacactgaactgctgacggtccctgtggtgacttgaaggaggtaacactgtttggcgcagtgttgccactaggggcacgctgctgtggcggaggtgccggacggttcatctgaggacgaggggcgtagcttgactggcggttagcctgagtgaccgactgatggtattgcatgggctgaccgtagcgagggcgaggtgcgcctcgggaagaatttccctgatggttagacttgcgtttcttgtattcttcggtggcctcttttctggcatcctcaagtagaagtgctttgttgatcatatgttgaaaagtggggaagtcatgagcaagcaactggagtctcattccaactgcgattcctttcaagaatttcctgatctttttcttatcggtgtctacttcctcaggggcgtaccgagccaacttgttgaactgacttaggtactcattgacactgctgtggccttgcttgagtctgttaaattcttctttcttcatgtcaatagtgctttcaggcacatgagctacacggaaagccgtagcgaactcatcccaagcaatgttagtgggttcaggatgtgcattgcagtaattctcccaccaatctgcggcaggtcctcttagctggtgagaggcgtagagcgtcttctcaacaggagtacactgcactaagttgagttttctatccacatctttcaaccaatcgtcagcctcgacgggctcgatggtctgagagaactctggtggacgtgacctcagaaagtctgtcagcttggatctattgttgcccacgtgagggtggccatttccatgcgcattatgctgaaagctggctatggctgtggttagaccttgcaagatctgtgtctgaactgccattatgtgttgcatgttgttttccacatgaggtggggaagggaggcgttcttctccagaattgtgactggcagtgcggtgagagcggtgagactgctccaactctgcttcacgggaaactgtgcgatgcgagcggctgctgcggcgaggttgctcaacctctgcgttgcgggaaacagtacggtgcgaacggttgctgtggtgagaatgctcattagctggttcgtgatttgcttctgcttcaactctaccatcttcaaaaccaaagcggactggtgcacgagctgtacgacgggggcggctagccatctaaactcccagaaaagggcggggtaagagtcagataagcacttaggagggcaaggagcaaagcaaatagcaactcagatagcacacactaggcataaactggattttttcaaatcgtaaaaacacctgatacaacgggtgtggacaagtcacagagctacgccgagcttgactgtgcgcacacctcctaggagaaccagactaccaaacaacacccacatcaaacacacacacgcactacctcgccacgactccaaaagagttggcggcggaacaaaagggcctaacacacggacggctgctgaagactgcctcctctactcctcgtcggcctggctgcctcctgtggtcggctcctcagtcgaagaaacgtcgatcggctggcgcgaagggaccggcgggacctgtcgagggccggcagcagcacgggccgctggcggtgggggagctgggtggcggaaacggaacacggtggaagaaccaacaacacgcttccgcgcagtgcggataaagcgtgggccacggcgggaggaagcgactggagtgtgtccgggggtgtaggaagggctaactgggtgtgggtagggggagtacactggtgagtacggcgcacgcgagctgggggagcgcgggccactgggagtgcgagcagagccgcgggagctgtgggaggacaggtggctggcgtggcagagacggcctgagtcccaagagatagtgtcaactgaggtgacaccctcctcggccagacgggcctccaaggcggcgtagcggcgggcaagggagcggtaagcctcaaggagtaggtcgtgctgagtggcctgagcctccgaaagctcgaccatgcgagtcagcactggctgagactcgctgtacggacaagggtatctggcgtctgcgtggccagaaggaagacgtggaagctgccggaaggcggagcctccgagacggtggccgtagtcgtgggccaggcggcgaagcgcagtccaggagaggtcctggtacgcgatctggagagtgggcctggccacagtgaagtggtgggggcgaaggccaactccgtgtatacctccacgagggtaaaggtacacagagagctcacagtgagggggaacacggtccacggagtaccccgtgtactcgggacacgagaagccaaggaaacgggcgaggtcacgaagctgggcgacgtggtgaccctcaccaaaaccgtgggaactgaaactggcgttcactgccatctacaattttgaaagaggaagaaaggatcagtaaccattttagaaacaaactattgaaaagaaagaagaagagagaaaccttagcttttcgcaagtagttttgaatctagtatccttagggtcgtcctaagcgtcgggtttcgccctagggccaagcctgtgctctgataccatctcttgtcacgccccgagctagtcccgaccggaactaacccgtgacgctccaaactaacctgttaatcgataccagtcccaggaaacagtgctggtatcacagggagacagaatatcacagcaacagaagtctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcgtagccggcttgctcctggaagaactcctcatcagcaggatctgcttcatcttcttcagcaactggggggggatatttatatagagcaagggtgagtacgggggtactcagcaagccatgggaattaagtgtttaatgcaagcttcaaggaaaggctgtttgtttttgcgattggttttatttgaactcttttctaaaagcaactaagtgagtgcttctcaaacgacacggatgaggcagtgcgtctcgtccggtcggagtatgtgcaatgtatcagtctttagattttgaaacaaggttggcacccggccaaaagctttttaaacggccacccgggccaacacctttcaaacggccacccgggccaacaacttttaaacggccacccgggcctagctgatcccatcagctgcaggttttccaaacatagaacccagtttctcaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgttccccggtccgcggttttggaaattcatttagttcacaagcaccgacccaagtgtcgggttttccaagtcttttgtaaaactccagttttacccaagttgttactcaaattttaagtttgaaggcgaccgtcgatattcgcacagagtgcacgattatcgaggcgcatctgggtggttacaaggggacatggtgtagcaattttcaacggaaggatcaattgcaacaagttaggtaggtccgccaatctgccttgcagacgggacaacagattaagtgtgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacggaacaactcaacaaacggcgaaaataaagccctattaatgacctctaagcgtgccattggatagatctcgagatttgggaaattttggaagttgaacggagtcaagcggagttatggttggaaagatattgaatttctaagattattggatttttggtctaaaggaaaaaggatttaattaaatccttttttggaaaaaggaaaaagaaatgatgaagggagggaatctagactttcctcggacggctagggcgcggcccaagggaaatggagcggaccggccaagctaaatgggccggccggcccaaggcggcccaagcgcgcgcgcgcgcgcgggagggaggagagagagggccggtggaccgggctcaccacgcgcggtcccgggtgggacccgcttgtcggcggctcggctcaccgtgagcggggtgcacgcggcgtgctagggtttggggaggggaggcgcggcgcatgcgcgcggctcgcggtgagggcggaggcggcgggcccacgtgcagcctcacggcttaccgcggaccacgcgcacggggagaaacggagggagcggctggccgggtcggcttatctggtcgcggccgaggtggcgccgacgtggcgcctacgtggcagccacgcgggtcggcggaaggtagacgaaggcccagccgaaacggacggcgggcggcggcggcgatcggcggagcgagccacggcgatacaagcgacagcgagtacaccgggtggttgcacgggacgcggggaggcgagccaacggctcggattcaccggagggagcttgacggcggcgaatcgcggcggcgacaaccggcggcgggaggagagggaaacggcgacgaggtcacgaggggccgattcccggcggtgggagcatctacgcggccacgggaactcgatgctagcgtcggatttggagggaacacgccgagggaggctggcgacgtgcgggtgctacggaactcgggcggcgacggcggcgagcacatggcgagcaacggcatcggtcggggcggcgccggccaactacgggaggtctactcgagctaaaaccgaagtctaagggggggagacggagcgaggagggagaacgaagcgaaacatcaccgcggaaaggagaggcgctgtgacgagaggccgacggcgcgggagtgatctctccggcctcgggccggggaagaggaagaagaggcgcggccggagtcctcttcggcgtccttgctcgtgccggctcctccgacacgcgcggcgacgatcggcgacggcgaaaacagagacggcagtggaggaggcgaaaatggggagggaaggagaaggggaggccgggggtttaaggaggcggcaatgtcggtttggggaaccgacttgcgcggtcaagagcgcgagctggcgctcggctagcggccaaattggcgacagggaggatgacgccggcggagaggtaaaggggaaaaaggaggggagaaagggggcttgcccctttgccggttcgggaaaaaagaagaagggagcggggcgacgcggcaaagggagggggcgctgcctccgtcccttggcggcttgcgcgcggagtggcggggccgggtgatgacgacggcgatgacggggggaacgtcttggagcggagcggcgacaccggcgacaggcgtgcgcagaggctgacggcggcggcgaccgggcggtcggccacgcgcgcgcggctcgcaacgggaaggcgcggcggatggtgcggcgcggctcggcacgcgcgctggctgcggggccgagcggctgcaggctgcaggcggcagggcagcgggaccgggcggcatccacgcgggcgcgcgcgagcaacggcccgcggggagcggcagcgagggatggggagacggagagcgaggggggggcgctcggg

SEQ ID NO: 50412 - DNA, 30551 bp, Oryza sativa
gagagagagagagagagagagagagagagctctcgggagagtgggccggggagggagagggagatgggccgagcgagtttcggcccatcgaccttgggggaggtaaactagactttgcggagggattttgatttagaaggaattggattcggagatgaactcgacgatagatcggggattgagatcatgagatggcacgggcactagacaacaagcaaggaaacaaatttcgcaattagggtttttaagagataattttcccgctaggcgccacgacggaacgggcgctacaacaacgacaaggaggaggagcagtgctgcctcctccctcgtttcgctcgccgtggcattatcgcacgtcttcttttgtacattaccaccggccgcgacatatccatccacagctactatatgtaggagtacgtactaaagattagacgaagcaagatcactatctagctagcactaggtgccacgaataaatagaagtgcatgacgatcggagagcgctgggcgcctagcaacagctcccgcagcaactcgggataaaaaccgactcgatcgctcatcgcgttggaaaccgactcgatcgggcaccctgcaccctgttgtcgagtttcaaaacgggcctcgcgcatatccgccgcgggcgcagacgccgccaatggagggtcccgcgcagatgtggcgcttctttttgctttttttttttcccgctgctgattaccgcaccgtgtagggggactcaacatttaaaactttcaacttaagattttttgaaatttttaactaagattaaaaaatttcaagtcaagatttaaaaacttttcaactcggatttaaaaactttcaatttagaaaattttcaactcggatttgaaaactttcaattcagacttgaaaactttcaactgaagatttgaaactttcaactcaaaattttaaaaaatcaagtcaaaatttgaaaacttaacacatgtttgaaaacttttaactcagaattaaaaattttcacattcgacttaaatttgaaaacttccgtctcaaaattcaaaacatttaagttaaatttaagaaactttcaactgaaattcaaaactctcaactcatatttgaaggcgaaagattgaatttgttaaatatcgtaaaacaaatcatgcgtgtgtgtggagaataaaataggaagcgatttcaaaaaaaaaaaagaagcaatatcaggtgtaacacgtttcttagttccctcagctttacgctaagtttgaattgcatcattcaaccgcaatatcaggtgtaacacgtttcttaacttgcaaaaccggtgtacttgaggtctcagggcaatatatcgcatggttttgcctgacgtggttaatgggacctacatgagccccacatatgtcatcgaccaactcttcttcctcatctctctcacattcttccctcttttccccatccctctttagggcaggtgctgctctctcgccgcacaaaagcgtcgtcatcctattgcacacacggaggtgcggaaggacctccagccaatgtatacattaatcatcgaatctgcatctatcccactatatcagtatcggccaattggttcattggtacagttctttctgtcatctttgttatagtctctaatgacatgaattaatacatagaatttatattagacttgtaaaaaggtagagtctattaacaaatttatattaggcatgaattaatgcaatttcaaattcaacttgtaaaggttgtaaaaaaataacaaattttgttacaacccgcagaagtcaaatttgaacttgcattttgtgaaatgatatattaattgcacatgaatctatcttgtcaatttttttaaaaaaaaaatcataactatttagttgacattcatggtcactgctgtagtagtacaacatactccctctgtctaaaaaaaatctaggattggatgtgacatatcctagtacaatgaatcaggacggactaggatatatcacattcagtcttaggtttattttttgtgggacggagggagtatatagtaacctcttaccgctttatgtgattcctgctgaaatatttggaagtccggacaaaatacagccttcttttttgccgggtcggccgaccactttcattaagatttgagggagaaaaataataaattgttacaaacgacaatactacgatgtcgtgccagttcgggaaagatccccggtccagctaagaacgaaagagaaagaaaagaaaatagccggggcaaatcctcgagacctatccaccgtgatcactcgccaaattgggaaaagatcccagccactctccatacagtaattgcagtgacctgcatatagcctagtggttacagtgacttgagtagtaccccaaaatcctgagttcaaatctccatatgagcaaatttcagattgggttgtttatggagctagattccctatttcaatggcagtatatatacagttggttgtagaggtcgggtaaaaaaaaaacccttctctaaaaaaaatacagcaatttcctctcttatatcctccgctagttgctccggtaacttggacacatgctgaaatattcttgcattacgttccttccaaatcaaccagcaaattagcatgaatgcactgtcgaaatccgacatgtagctcgtccgaaaacaacgtcttgttgcaagccaccaatcggccagagtattgacatcatccgccgggattgcgaagttagcattgcaccatcttcagagaaggatgtgtggtgcaagaagctttcaatagaaacaactgaggaggggcatcaacatcatcaactaccctctagctatatcatccttgtcagaatgatacatctttgtcagggatatttcattctgcacataatcacaatatctggttaacacatctttgtcagggatgaaaaagccttcgaaacttctgcatattgcttgcctttgcttgtaagatttcttttttgtgttcttattgtttctgaagagcgtgtttgtaaggaacatcccaatggcgtacaagatgaaagggatcttcaagggactcaaggtcatctctcagatctttggtcagtacaatagtacaatgttttgggcttttcatgctcctctgcatctaatctcctttcttgcttgctgacatctctcattttctactgacggtcttctttcttgcattctctgaatggtttttgcagtagtgaaggagcatgagatgcagattggtagtccgacagacgtgaagcatgtcgcgcacatcggttgggatggcctgacagggaatgcttctccaagctgggtaaatgtacctgaatttcagtgaaatgatacaatcatcttcttgtttcaaattgtctgatttctctcatctgttctttagatgaatgacatcagggcatcgtctgaacttctgtctttgggcaactttgcaccatctgcagggacctcttgggcttctcaaggtatggcaagaattacttgttcttcagagtggaagattttctgtgttggtgcgattgcttcatatgattgtggcttctttgggaaaggctttggtctgtcttatgagtggcatgtatggataagcatgcaaacttggcaagttactctagtttaatcctagaatcatgggcacgtctgcatgttcttgatctgggatccggagttgcagggaacactccgataaaacaaatccacacttctgatttcctaactaccagcagcatcttttgccaggcaatggattgtgtgtacacatgattactgaaccttttgaaagaaaacttgatgaatgataaaaacatgtaagcctctggtaatcctcttcaatcattatgtgattgatggttagaatcacgagaatcgaaatttattacgagttaagtaagtgtgaggaagttcagagaaaacaatgtttaaccaagaacaatacactgtatcatgcatagtttaatactgcaatacggagtgagctcgagacgtggtctagctaataaactagcagaaattttcttgttgaactcatatggcaggacaggattcggatttgataagaacatgatgtccattgtccactcatgcataaatagatccttcccaaggcacaaacaccgtagattagattcccattgtcacaaactgctgtctgacagacaacaaacaagcatgctaatggccacggaacgactgaaattttgcatgatcactcaacatattcagttaaacactgctgcaacaatgcagttcttggacagcatcagcaatcggccatgtcgatcctaatgtcttcttggcactcacatgctgatctgcttccactgttgggacagatttcgaccagcctcgagactcgtcgtccttcgccacgccgtcagagaacaccagcctgcagcagcaagaagcggcgccgcctcctgacataccacgcccgccggcggcgaggaagacgaggcggaagcggaggtccacgagcgactgcccggtgccttcttcttcttcttcggcgagacccagctgcgattccaccatggcgcctgcttccgacgccaatgcgtcgcaagatcaaaactgcaactctgcaacgtgaagtgcagcactgatcgaatttccgggtgtgctactgctacttgcgcagagagtgctgtacatcgttgtctgttcagtgctctctgctttgcgccaactgtacatgtaaatgggtttggagtttggagtgcagattaatcggcgatcgtacggagaaattggaatgtgatcgccgtttgtgtgtttgattgtgactaaccagagaagttaatttgatgttcaaggatagggatttcgatgagtaggccccaattgcctctgcactactctgtagtctgtcctgcctggccggattactgtcaggtgaccacatatttttctcttctagaaaaagagaagttttttttagtgaaaaaaaagttctcccaccaattttaagagttattgagaggtattacctctgcttttaaatttatgacattgttgatttttggatatttcatttgactatttgttttataaaaaaaagctactcatttcattctagaaaataaaccaaagatttaccttataaattgtttttttatgaagggtgtatgtaagtatcatttattttgtgttttaaactaaaattatcattattttattattaaagacactctaaatatgactaatatttttttatatttatattttttgaatgagatgaatgatcaaacgtcatattcaaaagtcaatagcgtcatacatttaaaaacacatggagtattatatcttctagcattatttttttttcgccgggcttctagcattaatttgcctgaaactaataaaagttacttgtgatgggatgaacaggggagtgactaaaaagaactaagacacttggaaaagcctgcaaaaacaatcatgttgccttctggataaactgatatcacaattgccagtgtggaatctcagcgccggctctccagcctccagccatgcgtattccctgacgctaaagaacaagttgagcaagccaaccagagactaagattcgttcaaacaatgcagtacaagattcctaccaatggtggacagtttttatatcagctccactgttttaatttatacacatggttaatatgcagttatgttccaagccccagcctagctatagtctctgcttgtctcttccggagccgatgaactgatgaacaccgagatgcttttggttggataagatgccgttcgtccctgaattctctgaatccgtcctacttctggtctgtttatagctggatcatcatttcggtttgttgccgagtgaaccaagaacagaaaggattttaggtgcacctttcgctctgacgctgatgaatgatgagtaggaggttgacattgtcacaggtctgccattgctgaattcttaagtttagtacgatccctgaaggtcaatatcaaatcggtgttaatgtgtgtagatggtactaagtttgttgcagtgatcattttcagaaattgtatagtacttgtgctgttccctaacccagctagccttgactgactgcaaaatattcttagctagagcagattcgtgtgccagatggttcctacctcgaaatatgtcttaaatagtacgttttgttcttcaatatctcagagtgatacctgattcagacttcgaaatatatcttaaatagtatattttgttcttaaatacctgattcagactctaggcaatttttactccatttcttgtacttgtactattccctaacgcagctagccttgactggctgcaaaatattcttagctagagaagattcttgtgccagataattccaacctccaaatgtatcctaaatagcagtatagtacattttgttcttcaatatctcaaagagtaatacctgattcatacttcgaaatatactacctccgttttttaagtacataacgctgttgactttttacatcatgtttgaccattcgttttattaaaaaaaattaactaaatattttttcttctgttgtggcttgatttatcacttaagtaccattaagcattacttataacttttaagatgtatacaaaattttcgaataagactaatggttaaatgttgtaacaaaagtcaacaacgtcgtatattaaaaaactgagggtatatcttaaaagtacattttttcttcaatatcaaaaagagtaatatatcttaatagcatttgatcggcctaatcctttggccaacccggcaacaaaagagtaatacctgattcatactgcaggcactttttactccatttctccactggtctttgtcacaaatgtcttgaaatggcaaggtaacctaaaagaactttttgataaatctttatactagtacttttacagctgccaagttgtcataaaaaagtttagtacattaaagtcagtactaaggattaaggaatatggataacagtcagacatgtcaagtggcattgtttaaagagcaaaacttatccacactatgaaaagagattttcctagcagagtcggagataggatcttcatggaaagaaaatagtctgcaagttactactaaatactaacataagtgtgaccttttctagacaactaatctgatgtataaagtataaacaactgggcctatacatatcatatatgattagtaaggcaacatgctatgctccatattctatcttcagagcaaggaatttcacatgaacttcgtgagaaccttttgccttaatcagttcatttccggtaggagacggaaaattttcagcgttctagaagagcccgaaaagaacatgttcaatatctccactcaatcttaatgaaatttggccggcctaatcgttcagccgacccgacaaaatagaacatggtcaatatgatgtttggaagtcttcaaaactaactatatacagtacaattggaaatgctcctgaaaattcaaaccagttaatgaattccattatttaaagaaacaaattcaaaccagttgaatgagaatcacatgcctacatcctatgtcctgtaaaatgctacagtttgtactacttagaagggatccatggatgtgcttagaattgtcaagaattcaaggtccactagatgctagctgcatccttgtgatggcacatgggaattttcttatgttgtgatataaataagctacctgctacccctgcaacatgtatatattctactgaactgaaattattcaagcagacaattggtacatgctgtttaggtattttgggaaggtcagagagatgccccttgtacttattctgactgaataagcagaggcaagtggcactttctggtcactaaaaaaagattagcttcttgtattaacaagtattacagcctgcttctacctagtgagcgatcacatcactgacgtttgcagaggtgcaagggcactcatttaactattgatagaatgtaaactgactgaactagttgattaatgattatacttagttattaaagtttgagaatttaacattgcacttaacactctgcaggtactaagttgctatcttctagtaatagatttacaggtcaatacctgtacttcagaagaatgaatgcagcgtgaaaatttactaagtattacgatgacataattaaggtatgcagtaacacatagataaatgactaccctgtcacatagataaatgaattgtactgaaagtttgcctaaacttggaaatttttaacaattgaatacttagaaagaactgaagctatgcgtacaaattaaatttcctcactggcgtatgcactagctagattatctcttcctacttgtttattgttctccaatagttgaatacttatttttctaagcgagtggtacgatcagacagctcaacagcatgataggaattaggtttctgatcatcagctgacacaagagagtgatatatgaacactatcgttgtatacgattaattaaactgaatactgacagtacacattaacagtacaatcaatcatccgaggtaatttatcaacatggagagagggaccaagcagagccctttcttcctcagctcattacattcatacaaggacttgtcgttgttgttatcaacactgactgtttcttgaagcacttcagccgccggctgtcgtgaactggcatcgacaaaatacttggcctgcaatgttaagtaaacttgtaaggaaacatacatggatacatataattgggttctgaacaaagaaagaaaatatagagaaactgtttcagaaacttaccagctgtgtgatgttgatatctttagcctccattgttgccattgacttcatatcaacattgttcaagttgctagttaactgtaaaacaacagatggtagctatgtaagaaatgcaggttatatatgtaatgttgttttgaacaacaagaagagatgaacagatgaacaggcatacaggcagaatcttttctaaccttaggggcagctgcagaagaacaggcagtgtcctgcaaggaatcatcgtcatcgtcgtcgtcacacatcatctccgacgtgatgaacgatgcgtcgtcataggaagtagcaaacgaagaagagaagccagaggagaagctgctgctgccagagatcactggttcctggcacatctcctggctgttgtacggtgatgccaagaagttcgcaatgtgcatcgcccagctgctctctccagctgacatggacgacgtctcagctgctgggctaatgcaagaagagtaatgagatgtgttgttctccatgtgtgattctttctagctcgacctgtctctctctctgaatttgtgcctagcaatatgcagcagtagcagtgtgtagctagagctggatgatggtgtgtttatatatagctgcaagaatgcagagaatggatatgatacacaagagaatgaactgtctgtcagagactgaggcaggccagcattggaaaaactaatgctagctctatgggaatcttctcgttgcaattgtttaattcttgcgatggagaattattctacagtagtatacaagtatgattattatggtgatgatggtttttatattgtgctggtgattaggccgaggcggttgggacatacaccatccaatgatccccagtgagagctccacttcacctactgctaattgcagcttctctcttaccaattcactgtactcttggccaattcttagccttaaatctgaactgaactgaatataatatataaaatgcaaattaaagctcctgcctttctttcagaagaaaatctatcggaactgaaaatgcagtacactaataatatattatctccatttgcatctaacttctacggatgaacagctagctacccctgttccagtactaagcttttgacgacttcgcgagtaataatggcgaaaagttgcatgtagtagtagtcttggcctcttcttagccttaaatcttaactgaactgaacataatactcccttaattccataattataaggcacgactaatttttaaagttgtttcataatataaggtatgcatgcatgcatgtcattaactagcacatcttttacactaaaatattattatttgaatcctccatcatcaaaatctctaattttattaggtgcatgcattctatttattaggttaatccaaactatgaggtgatgataattatttcttggtatttgtgttaagggtggttgtgtcttatattttggaatggaaggagtataacatacaaaaaagcattgctcttgccttatcttatgaaaagaaaatctgaactgaaaaatacaaatacagtgctaataatatatttccatttgcaatttctactgatgaacagctagctatcccagttgcagacttgcagtagtcctgagctttttttgacgaattccggagcaataatggcgaaaagttcccttgcaatggaggatgcagcagtagtactgaactactgaagagaagacgaatcaggattcagagggattaagatacgctgcattttctctagccgatccattctgatcatgccgggcgatcgggcgccaaagaccaaatcgggccgtggtccattgctcatatcaggcacgtaatcagagtcgtctctacctaatccgatcatgtggatgatcacaaatttcacacgaaatgacacgatcttaagcagagggacggccaatatgcatgcatgcatgcaaagaccgtatctcgcggaaaccatagtttaactagatttttatctctgaaacaactcaagcaagcttttctgaggtgtgatagatgatgatacggcggtgtgatgaactgataatatatacaatctgcatatgcttgcatggtttgcttaacaaaggattaatccatgcagctagtagcatgcaactgttataatgcagccaataacaataagcaagtggtcaaatcaaaaaattcaaaaaccaaaatcgaactgaaaattaaatcacatcgaccattacagacaagtgtgtacagctcatcactctgttctgtgtgaggtgtcatgtgggcaatgcagggggtggggcccacatgtcagtcaatgaggtaggcatcgctcctaggtgacgtcatctcgcgcgtatctatcggatcctgagttagttggtcgcgcgcggcgcgcaatccagacagatgaacggctggccgggtcaatgcgtgaatacgtagttgatgattcgtataattaactccatcgtctaagtacctagctacagtagcctagtgttcatagccagtagctaccaatttaacaatcttgcagcacacccggcgtagcctcaaccattgattagagatttagaaaaactcagcgcgtgtgctcgtttttctcacaagcatatacatacacaacatttagttatatttagtgcaactggtggtgtctatcaagaaattagctgtacgtcatatatacctatcgatagcgaggagtccatcactttatcaattttaagatataccgctccagaatgcatgcacttatagatttaggtgtacgtgcgttcatatgggtgggtgtgcgcgtgttgtgtttctaaaaagaaataatcttattttggttaatttttgatgcagcctattagcatcaagccatgtgttgatcgatgaagcgctggctgacgttctcgtggacgaatggagattctagatctcagcgacaacgacatgacttgctaacgaacgcgcgacaacaaagaggatcatcgtggatatgccgatatggctcaactgctcaatatagaatttgctaaggccctgtttagttctaaaaactttttctcaaaaacatcacatcgaatctttgaaaatatgcatggagtattaaatgtagataaatttaaaaactaattacacagttagggaaaaaatcgcgagacgaatcttttgaatctaattagttcataattagccataagtgctacagtagcccacatgtattaatgacggattaattaggctcaaaagattattctcgctgtttctaggcaagttatgaaattagttttttcattcgtatccaaaaaccccttccgatatccggtcaaacgtccgatgtgacaaaaaaaggccctaagtaaaattgtttttgttagaaatgaaagaggtaggaagagagagattttatttatacccaacttagcgattttatatatatggtgatgggatggacaatagctagcttggtcgtccagtagttgagtcagcccaagacgaagtgtcgcatcatcgccaaccaaaactcatcagtcatcacggtaatgaatgtcaacttgccaagaaaagaaactcataaggaattaaaaaaatctacagttaagctaccagtgtgaattctcatttctcaaccccctgtgctcaacctatgcaagtggaactgtggaaggccttgtttagttgctattttttttttcaaaaacatcacatctaatctttggataccgtagaacattaaatatagataaaataaaaaactaattgtacagtttgcatgaaaaatcgcgagacgaatcttttaagcctaattagtccatgattagtcataagtactacagtaacccacatatgctaatggtggattaattaggcttaataaattcgtctcgcggtttctaggcgagttatgaaatttgttttctcattcgtgtcaaaaactccttccgatattcggtcaaatgtccgatgtgacgcttaaaaattacttttttcgcgaactaaacaaggccgaaatatggatcctccgtcttgacgatcactataagaatactttctggggttcgcatcaaatgctacagatacaaacgccaccaatgcagtttcagtccacagttaaatttccctggtaaaaaaaagggttgggaaaaaaaatcaaggattcaaaaaagaagaaaaaaagtatatatatcacgttttgacaatcttttattatcgatgtttcactttgaaccaccttttaattaactattatttttattttggacatgataattttacctttgtgatatttagacaatctacatcaattttgtcatacataaaaaaacggtctacatacatccgagggagtttattgacgagtaagagatggcgtacacaaggttgttcatatgcttgagaagagagtcaggtgatccaaagtaaaacatagataatattatctggcctaaaataaaaatattggttaaatgacagctcaaaacattaagaaaaacatcggtaacacaagatagctcaaagtaaaatatacattaagaaaaaagaatgggaacgcgggccaggtcacggcctcaaaccggcgagcccattcggatccccacggcccatgattggctaaagcccattaaatcctcgtagaaaaaaaggcccagtaaaccactcaccacgacactcccccccacttcgtcgtctccgcgcgccgccgccgccgccgccgtcgcgcggcgcaccaagccaccaatcctcccgccccccaccaccgcggcgccgagcccgcgcgcgcgcggggctgaaatggcgccgctgaagcccccgccgccgcggctcctcctcaacggcgtctcctgcatgcggaacgcgcaggcggtgctccgcgacatcaacgtcagcgtccacgacgggacggcgctggtgctcaccggcgccaacggctccggcaagagcaccttcctgcggatgctcgccggcttctcgcgcccctcggcgggggaggtcctctggaacggccacgacatcacctccccgggcgtgttccagcagtacaagcttcagctcaactggatgtcgctcaaggacgccgtcaaggagaagctcaccgtgctcgagaacgtgcagtggttcgagctcctcgaggggaagcacggcaagtcggccccggccatcgagctcatggggctcggcaggctcatgaacgagaaggcgaggatgctctccatgggccagaggaagaggctccagctcgccaggctgctcgccatcgatcgcccgatctggctcctggacgagccgtccgtcgcgctggatgccgagggtgtcaagctgctggagtacatcatagcggagcaccgcaagaagggtgggatcgtgttcgtcgccacgcatttgcccatcgagattgaggatgccatgtcgctccggctcccgcaacggttccctcggaggaaaactttggttgatcttgtgcgttgatgtggggtcaagaattcagctgtatgattctaattcatctccattcatatgaaatccgttggaacaacttcttgatggttcagttttgtgacactttctttcggaaattaacaatgcactcaccatttgaatatgtatgccggttcctttttgctaacataacatacattgaatttggtgcattcacatgtatatgctggtggtgggttattctgttccctaatcaatgtagaaattgaagagtatttgatcatgagttgtgtattcactcgagaagtttcaagtggggggagatcaggtggaggaaatgctgaccaattttgtctgaaggaaatattgactgaatcaggtaacctattgctggtttaagagtaatttcgctgtacacattcaaattgaaacattcctgaatctcatgtattgactaatgtagattatgtacatatagttatgtttgtctgaaatttgtgtacaatggtacatcttacatatatttttgtttacaagcacaatagtttcaaatggcttactgttagttcatttttagggtctgtgctggctagtgcaatatacaactcaaccatgtctgatctacattaactaattattctgcctggtatacattttccggctggtgtttctccttcctatttgaatttttggacaaaaggcatgatggccctgcttttactgaaaacataacagctgtctttcctatttgaatttacttatttgtgtgcaattctcatgaatttaagttaggatgcccctgtagaattgagcaagtatgttggtttatctagaaatttgccatctaatggaagtctcaaatgtttggtatgaatatgaaaagatcctatcgtggtcttctgaatctctaacttatggcttgttacgaatatggcatcacattttgcacgcatgggtgtaatgatgtgcaatagtgttgtgttgttttatactctcattcactcattcctgctgtaaaagattctaacctgttgtgttcataaatataggcctcagatgttcttggggaagtagcttgctttgttgattttatgaacacttctgacctctgtatgccatatgctgaaattaaattttctgtgctctgtactgttttaaaactatttcaggtggcaatcttttgcgttatgtgtagcacattccattcttctacatttttctggcaacagtatcgaagttttccttttgtccttgtataattcattaattctattatgcttgtatacttctaacttataaacctaaactgatgttcacattgatttcagatgcaaagtatgatcaagcactattttgaacttgaagagtagactggatctttcacactgattttctcttcgctgtaatgtgaaatagaagatcattgcactaaccagtcacattcgccttaagttgaatatggaaagtaatgtgcagtagcaatctcgtatgtccatctatgactactcaaattctagttcctactctgaactttcatgtattagtatttacctgctagcttcaaatttctgcaagctactagctttattatcatcagtaatctatcattctgggcaaaccatcatatttttttcttagatgtacaaataatttctgcattattttgtatacggaaatatgtaagatcagtataaccattgtaagtgtttccattctccaaccatgttgttccctctagactaataaaaggtagattttcaagagagatatgcatatctccctctcttgcaatgttatctctttgtacagggaaaaacatatattatttgggagcaatagctaaaatgaagttaaaattttatttccacctgatactctttgagtaacatcatcttgctgatagcaagtcgaatggtctgggatagtttacattcagtatactaggctggtctgtgactctgtgttaactctggtactacacaggtgcaggctgtaacaagggagcactgaatgctccactaataagtccccagggaccattggaggtgctatctgaccccatgctggaagtagctggcccactattcaagacaaggtataaagccacttcccagtccagcaccaagccaccaatactacataaatgcgcactgttcttttgctgtattttgtttggttgttaccttctcttcaggcccaatctagaggatgctagcgtggaatatgtgcgcaatggatcacggtcgaaaattatctttatattgcaaacgatcaggtctagcccagatctgagataacttgttatttttttctaaatgaaaattactgatccgtggtggaattcaattaggatcttggccatctggttcaatacagttgtgttgaaatgctcatgttgtcatctgacataagattgtgattgccctctatcgcgttggtgaactttgttttctcttcactttataaatcccatgtttttcaattgcagagagaagcctccggtttgcattctacaagaaccaagaagggtggtaacttgttgaggtcaaacagaatatttaggatggtttgacacattacgtagcattaattgtcaaaatgctattctattaactaaagggctattggatgtgggaagactgagagtatagataaattgcctgaaataggtagaataactttatgaaaaaagtattggatgtggagacttgagagactggtatatccgtccactcattttcaaagatgatcttttggtttatcagtcctcttattttcaaagataattgttccattagttatctcttcatatcttaggagatatatttggtttgttcctgcaattactactgttttccagcacataaaccttagttatgtttaaatgtttaataattgtgatggaaggagaaagacaactaattgcattgagaaggaggcctgaagatccaaatatagacaagctctaacaggtttgcagcttactcccaagttcagcttactacttgtagcttcacatgtgtgtataaactacttgcattaaattgtcatcatggaagactaccactattaaactggaaaggtatgatatgccattcagataaagctcccaattaattggcagcttagctctttcttttccgagagctgaaacagtatttggagttatggatgggctggtttttattaaacactggagtagaaggaatatgacaatgatacctagagtatatttatgacattaaaactaatgtttgctagaattcaagcatcatgctgatttagctttaaaggatggcctaaaaggggaacttcttctctgtttgcctggttgtgcttaagagaatatgcatgggccaagtgcccaacccttataaatattgccaggtgaaattgttcaccatgcctgcctcttgtttgcactctttccttaaagactgttgtagttggccacatcaaacatttaatcacagattcaaatcctatatcattccttaaaggaacaaatataacgcacacacacacacaaggccttattaatacccatactaatgtgaaaaggtgcagtgaagtgcttgatttccccaaaagtctaggactgagacatggggcataagccataatgtagcgctgccagtacgtcctctctctagggcatactataataactgcttgcactcagatgtcaataccactctgctttaaggcctgatgtttacataattagtacatcataaaactttggaatcggcacttatacttcaacaagcacaataatacaaggccgagtcccacatgtcaatgtcaatgggcattattagtataatttgtatgacttggaaacagtgcttgcattcattcatcaggttgcttaaatgacaagcacttttaatcaaagttcattttaaaaacatatggtgctaagcttacatgatgttagtttttttttttgggtccttttttccatgtttgctacaatccttttgtgtacagtttcattttggcacaagcaagctagaggattctgtctatatacaaagtaagagaaacttgtaagtaaatattaagattaatacggttcctatttgtggggtccacaacggccatgttaggcagggaaggtagccacatctgctgtagtccatcataacgaaagaaagatgttcaccaatgatatggagatacttgtcatgtgttatatccacggattctccgatggaaaggaagatgctatgaagaaaacaaacgctagtttcactttctcgattaataattgtgctacatcatagactacttcaattcttgaaagaaagaaacttatccagtggagcaagttggttgctcctgaagattggatatcaccatcattatggtgtaattctgcggttggttagagatttctctttctaaaagtttgtcatgcctagtgtatcacagacttaagcaaatgctcatctggaattttcccttgatgcttggaaaaataatgggaccaactactttaagtttgcctgtaataaaccggaaaaatagagaaaacaaagtaacattagtacatgccagccaatttaaggagatgaaattgtttaatttaggttgttttaaattaacatttctaagttttagacaattgaaggaggcaagattgtgtataaataggttgctttatatagtagacagttctggaccctaggagtacatagattgtgttctttggtattcataggtaggtttgagagaattgaattcatagaacacgttttcagccctcaatgtggatatccatcgaaaccctgagagtggtctgtctaaattattcaaattatttgaagtacactaccgctaattatttctcttttttctcttcgaaaatgtccttatcaatcatacatgtaccagagcaaaattttaactcgggaaaaggaaattgcttaacagagataattatgatattgaagtgtggttgacaaatatatgaaaaattgaaaagaagaaagcgatgcatataggtattttaaccattaaaactttccttaaaagggggcactcactttctttatcataaacagttgcttattttccttgcactgtaccatgtacgtgaatacgttctttctcatgtgcatgagttactctgattgttttttttatatatatcaaagagtacgctgattgttacatttgtcaaaagaaacactctgcctttttttcctttgtgtaccttttttatatattacatgtatgcatgctgagtctgctgtatgggctacaggtagctcagctggtcatgcaaactactagctgagtcgattgtatatctagccaatcctctggattattactgaatactgattgatgggtactgacgtcaattagctagtatttacattccttgctcgggttcttccaggctccagcagctcacccatcagtttgcacttccgattttctctgcagaatgcaattttctgatgcatagatgcatagtcaatgatgttgctcatgtccgttatattggcttgtgtttttcgacagggatgttggaaagagttctgcataaatcgaaggaaaggagtggcccttactgagcaggaataaaggaaagggtacagtgaaaaacttatagcaaaacaccggcaatcacttctcagctcatacctaaacaggtatgcaagtcaattggttaccttttttagatgccttggtaatagtatttctttgcttactatattttcttggatttcagcatcagtttctccttaaagttgtggtactgttgacagaaaacacgaggcctgggagatctgcttaactccagtgcaggtccaaagctcgccttcgaatgtatgagcgtgccagttgatttgatcctgtaatcaacaagaaatagaagcaaagaaaccgcatttaaatctataaatgatagccgatcggctaggtgccgatgacatatcatttatctttgagccgatgtcatatatacatcgatcggcagtcattaataaataagaagggactaaatctactcgatcggctgcagatattgacaatatataatctttgtatcgatatatacttaaatcaagtgattggaatagatcggtcgccatgccgagacaatataaatcacttaaatcgaaatatatattaataatgagactatatacattcatagcatagccgatcaaatagatctagcctgtatcggctaatactccgataccactctatattaagatattaaagcaagtagaatatactagacaaaagcctaatatacttaaatgcagcaagatcttaacataaagggcagatttaacatgtcaatcaagcatataggataaaaagtagttaaatcaggtaagatcggctgaaactccgacactaccctaatcggcaaccagagtacatgctagagattgatattctaagcacgacttaagagatcaaattcggctgatgcagcattaagtatgaaaagaagaacaatatctagacaatcaagccgctggaagtttcatagagtggtagatatcttatataatctaggtcaacgtcgctatttaaccaaatcggctgccttctgttaacagatgttagccgattgtaggttagatgacgatattgtcgaagattatgtaagatatataataacttgacgaattacatagacaagattagagtatcataaagatggaagcactaatctcgagaacataattcatcataacaagttttacctcttgttgaagatcgaaaccgatgcagctcaacccgaaagcaagaactcgttgaaataaaattaaagcaaaaaggtggcgatgcgccgagattgtattgagcgtgtgtgttaaaagttacatagggctcgggtctatttatacccgaaaattacaagatatgtccataacggacatgacaactatctctaacaaactctaagataccataagtctttacggcagacttttgctcaagcatatctctaaggaaattacataaaacactctaattaatagacacaattgccttctcaggactctatccatgtgcggcaatcaccttgaagcacctcaattcaacccgatgtcatacatcaagtcgcattgtcggaatcggttgcatcggcttgcctagcctgactcagacccagctgatcctaatcgtagccgatctggactccagctgattcctgctctgtttccgaactcgatctccgcctccgactttgcttcgatctaatcttctttcccgatgccgaaattaccaaatttggttgtgaacaggtacaccaaaagaattcagtatagaaggtttcctgattcttgtcaaaggtagtcctataaggttatagacagctcagccatatctgcgcatgtggcctccagctttcatatggcttgttgagttttatccaaaccgtcgtaatgagatttgatggctcctaagaccttattagttattgtatacttgaaagtcgtctcacctaaaatttcaattttttccccttttcatttcagaaaaggaggcgatagctctagcattaaaaaaaaaaggaaatacgcccatgttaggacctgaaccaaagttaggtaggtagggtgcagccattgtttttagagaaaaatccctgaattttctcttgtttttactgtgacaaactgactgtaacatccacatcctttcacttcagcttgacaatttgatggagtacatactactatcccaattatgatcacaagaatgtcaagaaccactcctactagacatatgctgtgtttagttcacgctaaaattggaagtttggttgaaattggaacgatgtgacggaaaagttgaaagtttatgtgtgtaggaaaattttgatatgatggaaaatttagaagtttgaagaaatattttggaactaaacacggcgataccaacccatcgtagttgggtagctagcagttgactcctcataaatgaatatctgaaatacacacaccaaagtcacactcatactatttttttttctcttcttcccattttgtttgttctgcagggaagattagaagaaagcctaaaacaaagacctccctcctcctccggttcgacgggcgtggcgtagctgtacccggccccgccaatgtaaatgtgcgcttgtctagttcttcagcttgggtcaggaggacctcatggccatgggggccattgcttgcaacgcatgccccgagactgatgcaatgttgtgacagggagcgtggcaggcagcgtccgtccacgagatgagatgatgggggatcgaagcagaagcagaggagcagcatgcagtagtttttctggctggctgatcttgcaacaaattggtaagcactttcggctgggctgaggttctagatggtgtggtgtactggttctagtaccaccactaccacacctgctcaaccgcaaagctctttggattgtatcgccaacaaaatttgccacccaaaaagcagcttttctgcagatggtactactagctcgttgctgacttggagtgtagggtgctgtgcatgtatgcagatgcatgtcgtgctccatggggaagaagacggggttggttcttggttcttgttgcacggcaggcagcggcagattgaggtgagctggtgaggtgaccatcgtcgtaagggtaaggcttcccaaatgctaagctaaaagttcatttgatacagtattcaagtactctgtaccacatgaatttgccttggtgtcaattgtggatgtgcaaatttgctaaacaacaaattgaagtgttcaatcttgtaataataccagtactcactttctagtttctacttcaattcaattccttgcatttatgatagtagtccagaaagtgaggcatcattcagccattgatcatgagagatggccgttttgacctcttctaaccagttactcgtattaatgaattacagttacaggtcttacgcactggaagtctcattgttcaacttcaacctccatttcagaagccagtcaatgccccaatctcctgaatccttaactgcatagctattactactacactttgagcgagtcaggaggaggacgaaatgcacacacatactccatatggggaatgaattactccacaacacctcgcaatcagatcgatcatattcaacagatgaaaaaccgaggaaattaaatgagagtgaataatggtcaatgcactggctgctagtgaatcgtgatcgatcaatcgatggactgaccgagtcatcagttcatcacgtatgcatgctccgtgcagattgacctgcatatctgttacgagattggcaggcaaattaaggcagcagcagcagcagcaaccatatatggatcagaacttgaccatgtcgccctatagccagctactatagtagtactctagtataggagcagtagacatgtacatgtaattctacgtgatcttcctatatatcgatctctatgttaatgaaccactgtcaggcttgctggtgcacggaaagagaatagtgctgtagccaagccaacggcgccggtgccgtggactcgtggagcctgggtgacgaagagcttttttttttgccggctaatttttaagggcattttttggtgattgacaatggtgacattggcggcgaagccttatcagggttgggagtagtatatgataaattacagggaaccaactcccagactacacggactgtcatagtccgggagctgtgtcgtagtccgggagctgttccgtcgggtgtacaatttatcgtatactactcccaatcctaaaattttagtccttattttcttcttaaatgctgctctccacaagtcgcaagcacctcttgtgccatgtttagttccaaatttattcttactttcaactttttcatcatatcaaaggctatgtttagttcacaccaaaattagaagtttggttgaaattagaacaatgtgacggaaaagttgaaaatttgtgtgtgtaggaaagttttgatgtgatggaaaagttggaagtttgaaaaattattttgaaactaaacacgacctttcctacacacacaaacttctaacttttctatcacatcgttccaatttcaaccaaactttcaattttgatgtgaactaaacacagccttgctcccaatcgccaagttggcacgcacctggagagttttcacacgggagtacgaaaagagcgattttgtttggaagtttcatatgtggtccaccttttttgagtttaaattagattctctcttataggtgaaaatattttcatcccttaaatcctattagagaaggggatttatttttaaccgtctatcggtaatgctcagatgatgtatttaggatcgacgaacgacatgatgggtcgttcgcttgtttgctttacaagaatatacgttgaggtgaaatgaagtggaacgacttggttttattcagtctattggtatcataattcagacaattgtaaccatggttttgtttgggctctttaaaaattatatatataatcagttaccaatagatgcgacgaaaaagagagttgatgggaagtacaggctgtttttgattaaagccaaaacatgacctactaatagcttgttatcttgaatacatagtagacaaggttgttttggtttaaagccaaatcattagtatcgccaatgttcaatttggtagtttctatattctaataaaaaattttggttttttataccaaatacaattttatcttaccaaaaatctatcgtaacagaacgtatttaagttttgacactaccgatagtttgagagttttgtaaacctaacaggccctactagtagaagacgacgacggatctcttagaacgaaaacagtggcatgaagggcgccgatcgatccatccatcgattcgatatatgagcatatattgccaggtcgtcgtcaccccctgacaggtgggccccacaggcgcgtgagacacatccgcggcgcgtggggtgggcctgcacggcggcggtgggtggcggcattgggccggcgatgcgagggaggcatgaacgtagtaaatgcggccccctcccttctctcttccatcttctctctcgtctctgctggagctggagtggtggtggtgtccacctcacgcggtgttgctcagagaccattcaatggagagagagagagggacgccatggaaagcgcggctgatgagctcgatctccagctcatctcatgtgtgacgcatgggcatggcaatggctggcatggatggagtcgacgtacgttacgtacgtactcccgtctccaaccatccatccaccgttccgtccataccatcgacgatcgatgaccgatccgttcacttctgtctactggaggagtactactacatgtactccctccattttcatccttcttttcgcatagattcgtctcattgttggttcattagtcttaactaaaatttatatttaaattgtaatcttatgtaaactttgtatatttttctatgttagtaatttattttctagcaattgctttttaagtcactaataatatacttcatccatcccaaatataaaaagttttaattggattggacacatcctaataatacgaatttggacaaagagcttgtacagatttgtagtactatgatgttaccaaaacttcttatattttaggacggaataagtggatataaaagatttatttataaattattggttgctagttcatgattttcatggtttatcagccgtagatcatacgattagagtatattggtagcgacaaaaagagaggaaaatcgaagcatctctctgctgacatgagatcagctccacgctcctccaacatttgtggtatatacgtgtgctgcgtgcatcactaacaaaggaacaacgcgccctttaaacaaaaacagtaattttcaggtgtccttttaacgaataaaatgtactgattctatgagaatcctgtaaaatctatatgttcaaaagtaaacctgggatcgatcaagtcatcactagccccgtcatcatctcgatacctggaaggatgcaacagagaaatattggaattattatggtacgcgtgcagtttaggccaacactaaattaacttaagactgtacacataaactattgaacttttaactagtactacagaacagagaacagagaacacgaataaccagtatgtatatgatggtcggactatatgttaaaagaaacaagcagccgaattaagcattcatccatgtctggttgtgtttagttcagcgcaaagtttgtattttggttgaaattggagatgatgtgactgaaaagttacgtgtgtatgacatattgatgtgatggaaaaggactgaagtttggatccaaacaaactttagatctaaacgcagcctctgtacaaaagttgaagtttttttttacgcacatgtttaattttggctactactcctacgtaagatggatcggaaaccgtatgcaaaaggagacaaacgagtccaggttggcaacacacctaaaagatcataagtgacaacacgctaaagggaaaaatattaatggtttcctgaccttggtaggtgtatattattatgtgtttgatcatgcattattattatggtttctgtttcataaatggtggcatgttcgattgactttgctggtgtgttaactttgacactctctaaagtccaaatatgttttctggccggggtgcctgttgcctatttatttcattaatatggggtcctgtatagtactgaaccactgatgatgagccagagacagccagtgctaagctagctcaagaaaagcaaccttgtttttttgggacagctagcacgtactgttgggttgcaaattgaaaaaaaaaatgtttctgccatataatttacaatgtgaaattaattttagacagtttgtaattacacagttataactatatattaatttgttataagaagctttattttttggagacccctgttataattactttgaccctgctatatgaacaagatgtgtatactcccatgtaccacttaatatggaaccatctcatgtagtcacgctatatatatccaggaaacaattgatggtaattaattaatcctatcttaaatttgtagaagtcgtatctcgtcaacatcaaataatccgaaaggcagggacagctaatttgggatcaatatgtgctatcttatacgctaccatgtgttaacatctatctgtggactaaattaattacatgaacaaatactggatcctaaattaagaggttagtttctttttctcgtaataaatatatatggtcacccactggaacagtgatgttcctaatttgagtcagaaaatatatagaacagcttcatgttgacctagttaaatcatatatatcttgaattaaattataatcacacaatgaataacttataaaaaaacaacatatttattctttaaggaaacatacttagcatgacctagttaaatcatatatatatatatatatatatatatatagaattaaattataatcacacaatgaataacttagaaaaaacaacatattttttcttaattgcccatagaggctaaccagtaatctaattaagcacaccagttctttaattttacactatggccactactctatggcactctgattttatagtcttgttggcttgttgcccgcaaaaaaaaaaaaggatttcgaatgttagttttaagttaactttgagatttttcctatcttaacgttcagccttgcctattaaaacgtcaacaatacaaatatataagtttacaggaatcctaattcgcgcgtatgcgcgacttctccaagtcgcgagcgtgccacgtggcgggtcctcctacgaccgagtctgcgcgcttcttttttcttttttattttctttttttcggtaggcacaactgccgtgtttctttcttgtttttttcttcttctttttttgccgttaactaccacacacgtctaagagtaggagtcaatatttgaaaaaattcaattcaagatttagaaacttttaactcagatttggaaacttttaagtaaaaatttaaaaactttcaactcagatttgaaaactttcaattcaaacttgaaaactttcaactcggatttaaaaactttcaactcgatttgaaaacgttcaagtcggatttgaaaactttcaactcggacttgaaaactttcaactaaagatttgaaactttcaattcaaatttaaaaaaatcaagtcaagatttgaaaacttaactcaggtttgaaaacttttagctcaaatttaaaagctttcacctcaaaattcaaaatatttgataaaatttgaaaactttcatctcaaaattcaaaacattcaacttaaattttagaaacttttcaactcaaattcaaaactctcaactgatattgaaggtgaaggtgaatgtcacgccccgaaatagtcccgaccggaactagcccgtgacgctccaaattaacctgttaatcgataccagtcccaggaaacagtgctggtatcacagggagacagaatatcacagcaacagaggtctctttattatagagtaggagtacagtcatgttgggctacggacagatcccgagctcacaactgcattacaaaaggaaagcggaagcccggacttggaccaatcatcacaggcgcgacttgggaactaggccgaaaccctaaaactcatcgtagccggcttgctcctggaagaactcctcatcagcaggatccgcttcatcttcgtcagcaactggggggggattatttatatagagcaagggtgagtacgtgggtactcagcaagccaggggaaataagtgtttaatgcaggcttcaaggagaggctgttgtttttgcaattgattttatttgaactcccttttttttttctaaaaacgactaaatgagtgcttctcaaacgacacggatgagacagtgcgtctcgtccggtcggagtatgtgcaatgtatcagtctttagatttgaaacaagattggcacccggccaacagcttttcaagggccaacaacttttcaaacggccacccgggccaacaacttttcaaacggccacccaggcctagctgatcccgtcagctgctgatttttcaaacatcgaacccattttctcaacagcaatttcacaagcggtagtcaaacaaaactacgctaggaatcacctcacatccgcccatgaccgtgggcacggctgttcgaacagtttattaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagtgggaaaccgtacacccggtacgttccccggtacgcggttttggaaattcatttagttcgcaagcaccgacccaggtgtcgggttttccaagtcttttgtaaaactccagttttacccaaattgttactcagattttaagtttgaaggcgaccgtcgatactcgcactgagtgcacgaatatcgaggcgcaactgggtggttacaaggggacatggtatggcaattaacaatggaaggatcaaatgcaacaagtcaggtaggtccaccaatctgccttgcagatggggcaaaagattaagtgcggtcctatcaatgcataatatttttcaagcaatataattaaatttcaattataggctcaagatgttcaaaggtggcttgccttgctcgagatctggagcttgatcctcgaaatcctcgcactgcgggtcttcgggctctgaaactacacgcgaaacggaacaactcaacaaacagcgaaaataaagccctattaatgacctctaagcgtgccattagatagatctcgagatttgatgaattttggaagttgaacggagtcaaacggagttacggttgggaagatattgaatttctaagattattggatttttggtctaaaggaaaaaggatttaattaaatcctttttggaaaagaaaaagaaaaagaatgatgaactactgt

SEQ ID NO: 50413 - DNA, 914 bp, Oryza sativa
accacggtgatacgggcaaaagcgagcacaccgggctggttacacgagacgaggggagacgaaccaacggcttggatttgccgggggttgctcgacggcggcggattgcggcggcggcaaccggcggcgggagaagagggaaacggcaacgaggccacgagaggtcgattcccggcggtgagagcatctacgcggcttcgggaactcgacgctagcgtcggattgggcggaactacgccgagcgaggccggcgacgagcgggtgctacggagctcgggcggcgacggcggcgagcacacggcgagcgacggcaacggtcggggcggcgccggctaactacgggaaggctactcaagctactaccgaaagctaggggaaggagatggagcgaggaggaagaacggagagagacatcaccgagaagaggaggggcgctgtgatgagaggccgacggcgcgggagtaaactctccggcctcgggccagggaagaggaaggagagggtgcggccggagtcctcttccgcgtccttgctcgtgccagctcctccgacacgcgcaacgacgatcggcgacggcgaaacagagggcggcaatggcgcggaggcgaaaaatgagggagtttggagggggagggcttgggcttaaatggacggcaatgtcggtttgggagaggggaaccggcattgaacggtcaaggcgcgagctggcgctcggcgcttgcagccaaagcggcggcaggaggatgacgccggcgaggagaaaaaggggaaaaagagggggagaaaggggcttgcccctttgccgattcgggaaaaagagggggggagcgggagcatcgcggcagagggaggaggggcgcggcttcgtcccttggcggcttgcgcgcggagtggccggggccgggcgatgacga

SEQ ID NO: 50414 - DNA, 3650 bp, Oryza sativa
ggggggccgggggagagatgggccgagctggattcggcccatcgaacccgggggaggcaaactagacttttgcggaggaaattgattggaaggatttggattcggaattgaactcgacgatagatcggggattgagatcttgagatggcacagacactagacaacaagcaaagaaacaaatttcgcaattagggtttttaagagataattttcccgctaggcgccacgacggaacgggcgctacagtgaaggattgaatttataaaatatcaaaaaaaaaaatcattcgcgcgtgtggaaaagaaagaagcgattaaaaaaatctggaaaaaagaagcgatttaaaaaaggaaacaaaaaagtgacgttaaaataggagatcttaaaaaaaagaaacgcgtagggatgcagctggtgcgcgcgccggctcctttcccttgcgcgcacgcgcgctagcatcccccataagtttaacccataaattatatttgcttcgttcgtttctcaatggcttgttagtcataggtcaatcaatcagagtctagaaaaagaggtaattttttccattgttgagaagatattaggagatactatttttttagtgtgaaatttgatatctatactagctatctcggtataaaaattactttaaatgtaaaatttagatgcctcaatatatatacttttttaagaaccgtaaaatttctcatagaaaaaagcaatgaagacggacatgactctcattagtagtgttcttttttttttcctaatccactatatagtgtgccattatccattaatttcttttatctgttacaactttgattttgagggatttgcatactgttttgaaaggttgattgtggttatttctcacttgattagatgcatgagtttttaaaataattaatttcaagtagatacaatactcatgtatagatgatataattgtgtattattccctccatcctacgtatttttagtgtttaaaatttgttagcatttcttgagtattattttcctaacccacctaattaaccactgaaattatttctcactagtttgcatcgctgggcatgatatttcttattaaggatgtgtttagttcacattaaaattggaagtttggttgaaattgaaacgatgtgacggaaaaattaaaagtttaggtgtgtaggaaagttttgatgtgatagaaaagttggaagtttgaagaattattttgaaactaaacacggcataaagtgaactctcgggaggccgggggcatcgtgaaataaaaaagaaatgttggatatcagagaaggggctctcgtattgaaattttgttaagaggggtgagtttcgaatcgggatcggcgagcccatactttaagaggatatcttgaaataatttcaccgtaaccttaatttacgctaaaatccctaaacatatttatattcgtggacatggcgagtacatgccacgtttcttctgctagtaatttttcacataaatttttttttctcagcaagaaaggctggctatatactccagtgcagaaagagtgaaaaagactacaccaaacaagcatgaggcgtgtggaggcatgaaaacagtacgtacccagggcacagcagtgaaaacatcgatctcttcaccctgcatggtgtctccttaaaatctgatcgatcgactcccaaaaatataagtaaaatactcgagtcaaaatgcatcagtttgcatgcatagtgaaacagcagcaagctggtcttccacaggatactttttgacccattcctcctatacatgcatgtaattaatcacaaagttgcaaaaaatacaatactatgattgtgtatttgtgtgtactatatataaaacaaataaattaacctagtagtaactgatcagtatcgatcgagagtcaacaaaatatatgtagactacgacgatacgtgtgtgccttcctgttttcttttgttcttatctttgggccgcactatacgctgcatctatactaaacagtagtgaaaaatctacctctccaccactcaattattacgccggtctataataattcgttgtataaattacggggcaacagtgaattattcatgtgctcttgcgtgtaggattgccaaacaactgtttcatggtcagataaatgaaaaaaaagcgacaaattggtaacaataaggaaatgttaattaatttatgacatgtattactttcattaaaaatataatagtttctgactatacatgtatctcggaggtacataaccaaaaattcttagaggaagtataaaaaaaatgttttcttgttattggctacgaggtctcccaaaaatccaatgttgtacaaatactatattacatgtcaatttgaaattgtgttaataagtaaaaaaggacactccaatttctccatatcctcaattgaggaaatataaaaacaaaatttgtttaaaaaaatgtttcaggaagtataaaaaatgttttattgttcttggctatgaggtctcccaaaaatccagtgttgtacaaacactatattacatgtcaatttgacattgtgttaataaataataagtcaaaaaaggacactctaatttctccatatcctcaattgagggaatataaaaacaaaaattggaattgaaagttgaaaccatgcaccactagtctctctctctctctctctctctctctctccccttccatctctttctctcccctagcaattacactacgccttctccataaatgcgattgcaccctctcaacactccgcggcaataactccttcgcccccctctccacattctcttccacctgtgttccccttttcttctcctcttcttcttcctctcctcctcctgatcctgatcgagaagatctcaccttgatctcttgccgtgtgatctctagctctcgctagccctctgaaccttgcagtttgttgtttgcacccggtgaaacatcttcttttgtgcaggtaggagagacagcaaagcagagataagagttctatatttgcatgtagttcttgtcttggatctcactggctggctgtctcctctctgcagcaaggttcgttgggctagcttgtgtgctagatctgtttctacttgcgtttgcgttgcttggcaagcaagatatatatatatatatctatatctatctatctatcattctatctccctacatatttagagctagcactttgtgtgttctttgggtttgggacacactcatatacgcgtgttcatgagtggaaatggaaggagctgcaagggcaagaattagggtttgagatataggagtataatgatgatcccggcgaggcatatgccgtcgatgatcggccggaacggcgcagcgtacggatcctcatcggcactgtcactcagccaggtaaagaatttcttttgtcaggaatttgagctgaaaagaaattaatttcaaggggtggcctgctttccttttattttcttgaaaaatccaaagacttttgagcgttttgctgtgctagatttttaccttttgcgtcttctttctctttcttgtgtttgattaatttgaggtgttactacttgagatgaaaagctagaagaggggaaaaaaagcaatacattcagttctgaagtttctgaagataattagtc

SEQ ID NO: 50415 - DNA, 13683 bp, Oryza sativa
cttgttcttccaagctttttgggtctttgtgttgtggcactcttgaagaagaaacatatcgatctggctaccctttctttcttattcctctttgcaagcttgctttcacatcttctgcatataccaaagggaatcaaaaaaggagaaaagtttcttcacttagcttgtctcctcatcccttcctgatttaaagcaatcttccattttatccccaaatttttttctgtgtttttatgaagtatgaacacaccagatttttccttgcagaaatgagaaagttatcaatatgggttgtttttgttcatgcatacaattttttcttctatcttttccacaaaactttgaacttctccactttgtctagtatctatttaatgcatatgccatgtataaaacgcacggaataaataggtactactactgtaaaggcgtaatctgtggtaccaaattggtagctaagttttgctctttatgtagcacacgcatactaatcctcaattaattcgatctgctccaaaattcgcagccaaacttgctggataatcaccagttccagcaagcgttccagcatcagcagcagcagcatcatctccttgaccagatcccggcgacgacggcggagagcggcgacaacatgatccgcagccgtgcgtccgaccctctcggcggcgacgagttcgagagcaagtccggcagcgagaacgtcgacggcgtctccgtcgacgaccaggaccccaaccagcggccgcgcaagaagcgctaccaccgccacacccagcatcagatccaggagatggaagcgtaataacactcaactcatagctatttacttaattaattatgtgttcttgattccatatagtatatactttgtttgattgtcctagaaatgtgacatatttgagttcagttcagttttgccccagctagcttgttcttggaatgttattcatgggtgttctaattcagaaaattacgcatgaaatgctgtgttagtctactgaaatcaatgtgaggagatgagtacaaatggaacagctggttaattatactgtctttaattaatttcccatggactgatgtaagcttgcgtagaagtcaaattgatttctcttgcccgtccatttcccctggacgaactgcataaagttgactcgttgatcaaaaccgtttttgttcttttgcactctcccccaaacaaaacggaagacgaagcattcaagaacgtagtacgaattttgcgttcacacgttcaaccgaacttcaaaaatttccccttctaatttatttttcctggatgcattaattcgtacgtactattaacttactgatgactaatagaattaaattaatctcggttcatctgttctaaatctatctgatctgatcagattcttcaaggaatgtccacacccagatgataagcagcgcaaggagctgagccgggagctcggcctggagcctctccaagtgaagttctggttccagaacaagcgcacccaaatgaaggtgaaaaaacctaattaatcacccaaatagttgttgattctgctcatcattttcacctttctttcacctgtgttcgtagcagtacaattcttttttttaggaaacacatgtacgtgtaattaatcaggacgttgcaacctgcaagcgagtgcaaatgcaacggattctttggatttctggttgagaaaatttcggccggaaagaaggcgagcttgcgagatagagagaagagagagagcgtcgtcttcttcttcctcctcgtcgtcacaaccacttcatttaagcctctgacctagctcctgcaggacgcattcatggcgtattactataactggacaaggcttgcccacgcacccccatgtccgcttctgcattgcacactgccaaatgtggcagttgcaggcctacgcctccgtccgtcctccatagtcaaacccttcccctaccttgctgacctagctgcatacgtgtacagtgattggaattaacagtttgcacgaacgaacacactgtcatagtgtcatcgtcaatccgttgcaaagattttcgaagtttttagcttgaaatttgagtaaaaatggtgtgtgatttgatgtgttggggagagtgcagaaccagcatgagaggcacgagaactcgcagctgcggtcggataacgagaagctccgggccgagaacatgcggtacaaggaggccctgagcagcgcctcctgccccaactgcggcggccccgccgccctcggcgagatgtccttcgacgagcaccacctccgcatcgagaacgcccgcctccgcgaagaggtagttttcaccatatctgaacaatcgatcgatcatggtgacaccgccattgcatggatcgtcgcacgctgatcgtgtcgttgtgcttgtcagatcgataggatatcggcgatcgcggcgaagtacgtggggaagccaatggtgccgttcccggtgctgtcgaacccgatggcggcggcggcgtcgcgggcgccgctggacctccccgtggcgccgtacggcgtgccgggcgacatgttcggcggcggtggcgccggggagctgctgcgcggggtgcagtcggaggtcgacaagccgatgatcgtggagctcgccgtggcggcgatggaggagctggtccgcatggcgcagctggacgagccgctctggagcgtcgcgccgccgctcgacgccacggcggcggcgatggagacgctcagcgaggaggagtacgcgcgcatgttcccccgagggctcggccccaagcagtacgggctcaggtcggaggcgtcccgcgacagcgccgtcgtcatcatgacgcacgccaacctcgtcgagatcctcatggacgcggtaagctcttggttaattttctgtcagtcagtgcgctattcttgtctgaatgttttttagtttggtgatttttatgatcctgtttgattgttggggtctgaatttcgttcaaattttgagtgaattgcgcagaatcagtacgcggcagtgttctcgaacatcgtgtcgagggccatcacgctggaggtgctgtccaccggcgtcgcggggaactacaacggtgcattgcaagtggtatgtgttcatgcttgtcttaaaaattttgtctcctttctgaatcttctgtcatattcggtagtaccaaagaattcgaagtgtgtacatgttggtcactgaaatgggacaaaattgtgttggttttggccgttttctctgcagatgtcagtggagtttcaggtgccatcgccactggtgccaacgagagagagctacttcgtgagatactgcaagcagaacgcagacgggacatgggccgtcgtcgacgtctcgctggacagcctccgccctagccccgtcctcaaatgtcgccgccgtccgtcaggctgcctcatccaagaaatgcccaatggctactccaaggtgaccatcatcagctcatcatcatcatcatcacaaatcaaatctgaaattctgaattcaagatatattgctgttcagaaatcatggaaaactgatgaaattgttgtatgatcaggtgacgtgggtggagcatgtggaggtggacgacaggtcggtgcacaacatctacaagctgctggtgaactccgggctggcgttcggcgcgcggcggtgggtcggcacgctggaccgccagtgcgagcgcctcgccagcgtcatggccagcaacatccccaccagcgacatcggcggtaagtaattgatcgagcatgcagcgaatttcaccctttaatttgatccaaaacgaaattaaaattcagatatgttcaatcactaaaccacgcagtggatttaattgtgtttgttgaatgaatgaatataattgcagtgattacgagctcggaggggaggaagagcatgctgaagctgccggagaggatggtggtgagcttctgcggcggcgtgacggcgtcggtggcgcatcagtggacgacgctgtccggcagcggcgccgaggacgtccgcgtcatgacgaggaagagcgtcgacgaccccgggaggccccccggcatcgtcctcaacgccgccacctccttctggctccccgtccctcccaagcgcgtcttcgacttcctccgcgacgaatcctctcgcagtgaggtactccctctgttttatatcataagtcgcttttacgtcaaaaaaaaagtcgctttgttttttattcagatgaattttgtaaaaaaaaacatagtagcgcttttaatacaaagcaaacacattttatcacaatatattcaatattaaatttaataaaactaatttaatattttatatgctattaatttttttaaaattttatttaacttaataaagtttgactaggaaagaagtcaatacgacttataatattaaacagatagaatacctataaatccatgataaggttaacaagaatacaattacaaactcttagttcgcgaaaaaaattacaaaatcttaaactttgaaaataaatttattttcagtgggacatcctctccaatggcggtatcgttcaagaaatggcccacatcgccaatggccgggatcagggcaactgcgtctcacttcttcgcgtcaacgtaagcagcaattcatccaagatcaaaacgcaagatatatacgagcatgcgataatgcgcgatgtattgatcgatcccgtttcatgtacaaatatatattgcagagctcgaactcgaaccagagcaacatgctgatcctgcaggagagctgcacggacgcgtcggggtcgtacgtcatctacgcgccggtggacgtggttgcgatgaacgtcgtgctaaacggcggcgacccggactacgtcgcgctgctgccatcgggcttcgccatcctgcccgatgggccggcgcacgacggtggcgacggcgacggcggcgtcggcgtcggctccggcgggtcgctgctgacggtggcgttccagatactggtggactccgtcccgacggcgaagctctcgctggggtcggtggcgacggtgaacagcctcatcgcctgcacggtggagcgcatcaaggcggccgtctccggcgagagcaatccgcagtagcttcgtccttgaatcaaacaaaagcttcttgtgctttcaatttcaggtacaaatgcaccaaattacttcagaactcttgcgagattaattgcatcagttaatgagaggtatatctgtaaaatttctgatgagtttgatcatgtttgtgtgcaggagcagcaaaattttggagctttcatcagtgggaagtcaagaacgcacctcagactgtccttgccatgtggtgcccatatatagtttggattatttttcgctagtttttccgcaaattcgggaaatttcaaaaaaaatgtgtcaccactacgcaagggcggttggttcgggtattgacttcctcttcatgttcgcctctcggatgctgctaccttatgaatttagggttcttctggagtacaaaaaaaaccccttaatttgatctgtaatttctgttgttcagacttcccagtacctagctagctagtaggagttgcagaatagagatctgtgtccctgtcttatacttttagttctcttcagtgtttgatcagtgctgtttcaatccaaaattgtgtgtgctgtgcttgttattagttcttccttgctgcttcaatgaaggcgatgttaatttcagtttccagcagttgcagagttgtgtaagatgacttgcatttcattgccttcaacagtattctatcagaactgtcgcatatcccccaaaaaacagcacaatcaatttaatactccttgataaaatttatgccactcttattatttacatcactgattacccttcaaaagattacatatatacgacaatccctacatggaaatactcgagtgcttctgccataaccttcaccccatgaacaaacatttcagttcccagaaactatacggtctcatccaaagcaacttagctcgcctttagactgaataatgaactggataaactcataagagacgccacttggatcttcatgattcatgacattaccaccaaaagcctcggcagtcagcacagatgatgtccgcgagggaatcattgtatgaatccattgcactcatgaaagtacatcattccgtggggacgagatcgtcaaacgaaaaatcatggatcggtgcacctgcaaaacaagttgagttctggagtaactcgtgtgttcattttacaaaaggcttattaacggaaacacattttaatagttttctcaggatggcatttttcaaaacaacttgattcttaaatatatcacttacatatggagtttgttcctagcaaacatgtttgtgcggtaacaaacatgaaaggatgcttactccacatttaacaatataagtttgctaaaagagttttttacctttttgttcagctaacaggtagaacggaatgtgagctaccatctttgttcctccttcactccagttgacaataccaggaccatttccttgtgcggtggatggtcctagtacagataaacaaatggccggttcattcaatagacctaaatagtcacaagcacgttgccacactctcctgtccgaggttcgggaacgagcgacctgtacgaaagtaagttacaagctcaaacgatgaaaatgagtggtgacagtaatatatcaaaccttaatattcctcaaactggaaggattagggcctaccttggccaatgatacacgtgctcttggaagcaactcattatggaacgttgctagctttgctatggcagtcaccacaaagcagaggagcctagcttgagatgattttctagaagatgcacccataggatcaaatcctgtgtcctgacttaatcccaaacgacttcacaacaagagataagaggtcagtcaaaagagatgccatgcaagtttagaaaaaaaagactggtttaacagggcccacctggtagccagattttcatataacagcaactccaaattttcaaacagttcacgagctacatctttgcgattttttcctccagctccatgctcaccaatggcccaacacaaatgcaatgctaattcagtctgtgtaaataaatcacattcgatcagaaaactcagttgatgtggagaagagtattaatcatttaagataatcagaactaggataagagagcaggtgaaaattagcagtttggtgaacttataaaatcaaaatgtacttaaaacatatacttgcctttgcaggattatcatgagcctccccaagtctgtctgtaatgggcttctgtagaatggtttgaaattatagtgcaaaatttttagtggaaccagaaaaaggagatatttactttgttgcttaaatatgctacaacattcactctcagaaaaagaaatgctacaaacatggtatattggttcagagaattgacatgtatatgcatgtctagttatatgtatacccagtacctttagcagtgcaatgatgtcaggggagcgctggaatgcagccaatatgaaatctgaaagtcttttcctcacctacagcaattttattgcaaggaacttgtttgaagggtgatatagaattgtggaaataaccaaacataaatccccatacgaacatataccatccttttgtactgaaggtacatatgatgtgaagaaaattcgaaaacatgatttacttcttccattttgttcgttagacactccaatgtaatgtatacgttccacaaatttcaacttttaggatagctttagcaattaacaattttacttaaaaaaaactatataagccgtatatctaaatagatgggtgtatcatcaattgttttcttgaggaattgattcttaattgctgactaaaatttagtttcctatgcaagtaagcacttcggttcaatcatcaagtaagcacttcaatgatcttaccgtagtactgtagttactactccagtattagacgcagtattagacgcaatgggaaaaggacacccacttgcctacctcgaaggagtatactttgtcagggaacattgctgcatatcttgacataactacaggaatcagagcgcataggagtgctgaagtgacaaatagtagagggtcaaatcaacaatatgttggtcatcactcatcagtatgtatagcaattaacaaagataggcaacatacagtcgttaacgtcccgcaatgctgtagcaaaatataatgtaagaaaacgaggtgccattttcagtgactgtttcaatctgtccgattgtgggctattaactgctgcctgtaaggttgaagatatcgtaggagatgtccaatgttttgcctgaggaaaacatcagaaaatgagaagactagatcaaggcattcactgaagaacatggaacacatacttcaaggaactacttacagcaataccatcattctcatcttttagaagatcaaggaacatcgggtcagcaaggtctagaggaccactatcatccgaacctgcattgccaatggcatcttctatagcagaaccagtgtatgcttcatccattagtgcaagtagcatctgtacgatagaaaaagattagcaagcttattagttttgataggtgacatttcatttacagcttttaggtcaaatcattacggaaatcaacctcaggagcagcactcttctgtatagtagctatactactaccgatgagagttccagaacttctttccaccttttccaatgctaccactaacactgttttgttccatgagtaagcaatagaacaaatgacaccaattagtaaaaaaagcataatagtacaggataagcatcctcagtagcagcatgttatacacattacatgcatctcgcatgttggaagagatgtgccccagatgtcagcagtcagcacatgcaacagtttaataacactatcataataaacttggctaattagcttctaaaatcatgaagtttacagccttgcacaatctaaagaagctagaggaaaattctggaagtctggaatcagaaggcttacttggaagatccataagggacaggaagagaggaagaaaagatcctgctgacatcattaacggaagcacttctgagaacttcctctccaatctaaaacaaaggaaacccaagttagataggtcaaatcattgctggaaagaggtagaatgaacttcttcatatttacacagtaaaatatcagcaaatatgtgaggagttcatgagcaattaagatggcatacctctcaccatttgatgcaattagcttcagcaacaatggaaaaaactgcacatagacagcatcacgaaagcattgccaaatattaacatcattaaatagtaatttggaaagagaacaaaacagaaaagtcaaaaaagaaaggaggaaattggattgagatcttttcaagaagtatgcttgattcattggcccttgccagtagaagcctagagctacatttatgcaaaaaaaattctaactgacaatataaagaatggtagttgacataagatgtagatattttgataattctagtgctgtataacattatatggtatggcacctgtggaattaatgtgggaaaagagctcaggatctttgtcttattcgctatcaggaattcaagtgtacgttctgcgacaataggatcagcgaactccctatcatcaagaaagaatagccaagtgattgagggtaagcaggaaaataaaaataaacaatcgcatacccaatacatcaagaaaaattattacctacttaggcaagagcggaagaaggtcctcaagctaccatcagcatcatgcaggactgcctccccaaagtccaggaagaactgcagaatggtctgggtagggagcagtaatacagtatgtattattagacaggtttttcttcaaatatatgatgactaaaaatgtgtgtacattactaatcaaatctaaatgattctattcaccaacaattgtccacagagaatgattatatggggtcaaatggggatcataaggttaaccattaacattagagcaagctcgcccctaaagatgcaaacatttcacaaaactaccaaaacattgcaacgatatcgtcctccaacctaacatgtaagaataacaaccatttgcagccaagatgggggaaaaacttcacatcagtgaatcgaagcacagcttacgagtagcagcacgccgctggaggccacggattgggtcggcgcggcggcgcagcgctggaacagcttgctcatcacagggaacgcccgggccaccatctcgtcgctggcccccttggcctccttgcacatctcgcacaccctcctcaccttcacgccgcaaagcccacacgagtcaacaagccaaaacgtgagcacatcccaccccccctgattcgaagaccatggaaggggccagggttgcagagagatgcgcttacggattcgaggaggttggggtcggaggcggggtcggcggccgcggcggagtccctggatgcggcggaaagggagcggaggtggaagttgtagctgccatcgccggcggcgagctccggcgaagccatggccgtcgcctccgacgaacgagtgagtttacagatggggacgtatgatgggcctcagccgaattagagcccattaaactaggcccacgttgcactctgggccgttggataacacgtacgaaatgtaactcctatttaatctgagtcggcttctaaaaaaaaaaaaattaatctgagtcggtctcactgctgatttttcaccttttggtcctttaaaaaaacttattattcacgcagtgagaggtgtctgaataagtttagaaaaacttttggtcttttagaaaaacttaaggccattttggtttgaagctaaaatatgtgctatcaaattgtttggcactttgaatagtatatttttaggcctcttcactttgatgacattttcaatattaccaagttttgataaaattgtcaaaaaagtggctacatttagtttgctgccaaatttttgtaactatataagaaatcatgccaaaattttagcaactataccaaatttttggcattgccaaaatttggtaaggtttttttggtatcaaagtgaacaggcctttattaatgtttgatttactatcaaaatataccaatagcacaaaaaatttggtagtaccaatattttagtatggtaggaaaccaaacatacccttattctctttttggtccttaaaaaaactttttcatctttaaaaaactttttgagatctatttataaaatatttttttctaaaaggatcaaaatgtgaaaaattcagcagggagaggtgtctgtccctcccacagtcccactcccacctcccctcattgcctcgccgccgctcgccgtcgttatccaccggacaacgagcatcccctgacgagcgcagaaccgagctccggcgccgccgatctcggatgccaaggcgggctacaggtaggtgattttctttttgttccctaatcagttttttttcgatttaattatttcggcctatagtttcttattcgttttccatgttgatatttttcgccttcttttttttcagttttgcctctcccgattgctccgtctctcgagtcggtttccgattcgaacgcaggatgccaaattaaccgctaactccttcaaaatctgaactcgggaggcaagagaagaagagaatcaaacagagcgcctctggattttgattctcaacactacaagaggcatttttttttttgccggtggagtatatgaacggcaagcggaagagatcgggtggaaccatggagactcgtgccatcaagtgcaggacgatgcagcttctccatgaacttcaaataagtatgcttccccgtcctcaagtctttgatctaattcctatacagagattgttgattccgctgtttctagggttcatttcatatgtctgaagaagaaaaatctgttccttttttttcctgggtgagacgcctttttaatggaggggcggcggttgaaaaaaaaacaactctttttttttaataacctggttggttcttcacctaaactacactttttttttcttaaggtgctatctaaacagaaggcaattgttaactctcgtctggtctaagctcaaatattaactttattttagagtaaatttcacaaaactatacgttttgtggtctatgttgcagaaaactacacactttgatacttggcatttaagtacatatatttcggtagtgttgttttataaaaccacactatcaatgaataaatccaccgtgagatgacatggctgttccacctaaacgaggacgtggcatcctatgctattaattttttgcatgacctcctatgcttgtcagcgccggcgcggacggccgttccatatttccgcccatcgacgaccaccgaacaatatcgtgtagctctcaccgccttcggcctgcatctcgtcgtcatgtcagccacaagccagcgcctttcctctcactgctatcccctcgccgccgcgccacgaggttcctcgctaggcctcatcatctctcccggcggcccctcaccatcctctggtcatctctctccaatacatgctatgctcgagatctggagttagcaggcaactcgctggctacatgcctcttcgagtactgcggccccttgtgtctcattccagtactatggtggctctgccattctgctactaacaggtatagtttggttctttttttttggtccaaggaatcaatcaggtgcccatttcatagtgagttttctaaaaaatctagtgtgaatgagcaagttccaactgaaatttcacataggtttgtagttttttgcctcactgttgattgattttgttaaaaaaaacagttaattcatcaaatatggaggtttctaatgcctctgaaatgaaagtagtacaaaacatgggagctataaggggaggacagggaactagtattctaaattttacagtcagtccactattgtacttaatttcaggtagataaattacgcttcagtggaaaggatcactgagtctgaagtttgtggctataaccccttgagttaattgattgttccattcagcttgtagtactggaacttgacaagagaagcacagtagtttggctgtagatagtagtaggtggctcctttcatgtctgcaggaaagtgctcctaaaccaagcacaaccttcagttgtggtaagcacaatacagacctaaactcatggaactttgaaatgaaataaaaatggtataatgctccattagacatgttcacacatctagtttgatcaacaagtattcttaataaccagctcaacaaatagtgcaagaacaataaactcaaaacaaccatatagaaaggtgatcactgaccagaaaacaagtcacagaataaaatccttggtaacatatcgtgctgggattgtgtagcgcccgttccgtcgtggcgcctagcgggaaaattatctctgaaaaaccctaattgcgaaatttgtttcttcgcttgttgtctagtgtccgtgccatctcaagatctcaatccccgatctatcgtcgagttcaattccaaatccaaatccctccaaatcaaattcctccgcaaaagtctaatttgcctcccccggggtcgatgggccgaatcccgctcggcc

SEQ ID NO: 50416 - DNA, 2767 bp, Oryza sativa
ccatctctccctccctccccggctctccctctctctctccctctccccgctccccctccgttccgcccgcgcgccgcgcgcgcgtgcgcgtgagtcgcccgcgccgagcgccccttctccttgctctccttctccccatccctggcgagctccccgctcgcgaagacggcccccgcgcgccgttgttcgcgcgcgcgcccgcgtggttccccgcccgagccgtgtcgtctgcgccgtccgcgtcgcccggtcccgctaccctgccgcgcccacagccgcgcagccgctcggcccggcgagccagcgcgcgtgcccagccgcgccgcccgttgtatcccgcgcgcgcgtgccgagtggccgaccgcctggtcgccgccgccgtcaccctctaccgcgccagcccgcgcctgtcgcccgtgtcgtcgcgccgctccaaaccgccccgccgtcatcgccgtcgtcatcgcctcggccccgccactccgcgcgcaagccgccaagggacggaggcagagccctcctccctctgccgcgacgctcccgctccctcctccctttttcccaaagcggcaaggggcaagccccctttctctccctctttttccttttcctcttcctcgccggcgtcatccgcctctgtcgccgttttggccgcaagcgccgagcgccagctcgcgccttgaccgcccaaagtcggtttccaaaccgacattgccgccccctttaaacccaggcgccctcccttcctcttttcccctcccaatcttccctatttctcgcccgcgccattgccgtccctctcgccgaccgccgccgtcgcgtgtgtgccggaggagccggtgcgcactaggacgcggaaggggacttcgggcgcgtcctcttcttcctcttcctcggcccgaggccggagagattactcccgcgccgtcggcctctcgtcactgcgccccgacccgcacggtagtgcctccctccgttcttcctcctcgctccatcttccccccttagttttcggtggtagcacgagtagcctccccgtagctagccggcgccgccccgaccgttgccgtcgctcgccgtgtgctcgccgccgtcccgcccgagctcggaagcgccgctcgtcgccggcctcgctcggcgtagttccgcccaatccgacgctagcatcggattcccgtagccgcgtagatgctctcgccgccgggaattggcccctcgtgacctcgtcgccgttttccccttttcccgccgccggttgccgccgccgcgattcgccgccgtcaagctccctccggcgaatccgaaccgttggctcgtctcccctcgtcacgtgcaaccacccggtgtgctcgcttttgcctgtatcgccgtggttcgctccgccgctcgccgctgtcgaccaccgtccgttccggccggcgtcgtcgtctacctcccgccggcccgcgtgggagccacgtaggcgccacgtcggcaccagctcagccgaggtcgggacgggccgaccccggtcagcccctcccgtgcgcgcgttccaccgcgagccgtgaggctgcgcgtgggcccgccgcatccgcgtccaccgcgaaccgcgcgcgtgcaccgagtccttcccccaccctagcgccgcgccgcgtgctccctccgcacggtgagccgagccactgacaagcgggtcccacccgggaccgcacgcggtgagcccggtccaccggctctctctctcctccctcccgcgcgcgcgcgtcttgggccgctctaggccgccttcttgggccggccggcccgttaagctcggccgagccgccctttctctcgggccgcgccctagccgcccgagaaaagtctataatccctccctcttttcttttcttttctttttcttttccaaaaaggatttaattaaatccttttcctttagaccaaaaatccaataatcttagaaattcaatatcttcccatccgtaaatccgtttgacaccgttcaacttccaaaattcctcaaaactcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctgtatttgaaatttaattatgttgcttgaaaaatattatgcattgttaggatcgcacttaatctgttgtctcgtctgcaaggcagattggcggacctacctaatttgttgcatttgacccttccttcgttaattgttatatcatgaacccttgtaaccatctagttgcgtctcgatattcgtgcaccctgtgcgagtatcgacggacgccttcaaacttaatatctgaataacaacttgggtaaaacttgggttttacaaaatacttggaaaacccgacacctgggtcggtgcttgcgaactaaatgaatttccaaaaccgcggaccggggaacataccgggtgtacggtttcccactctcgcacttaaggaccgattccttggaatttcatccaaacataaggcaagtacgaccacatgggtggaatgggacacccctggctgagtaactagcttatcaggggagccttgatgccgagagacttgtggatttgccggggtggtgtcagggaggacccctaggcttcctggcacagtatggtctaggacctaacctgttgttggtctgggacccctctcgtcgg

SEQ ID NO: 50417 - DNA, 17278 bp, Oryza sativa
ccggctacgatgagttttagggtttcggcctagttcccaagtcgcgcctgtgatgtttggtccaagtcctggacttccgtttcccttttgtaatgcagttgtgagctcgggatctgttcgcagcccaacatgactgtacctctactctataataaagagacctctgttgctgtgatattctgtcttcctgtgataccagcactgtatcctgggactggtatcgattaacaggttaatttggagcgtcacgggctagttccggtcggggctagttcggggcgtgacagattggaaggcacatatgtgcgtatatttagttgcagcagttttagtgggccatgcgcatagaagtccagcttgtcccacgatgccacgtccttgtcctaggtggaacagccacatcatctcgcgtgtgaattcattcattgatagtgtagttttgtgaaactacactatcaaaatatatgtacttaagtgccaaatgtcaaagtgtgtgtagttttctgcaacttggaccacaaaacgtgtagttttgtgaaatttactctttattttaacgtaactccagggtctttgactctgtgctctcttcggtcttagtggttctagagtccatcctttcggagggccggctgtggtcgttagcggccgtcgcttcctttggggaattgttgggagcgtagagtggctctgccctctcccgctgtttggagtagagttaccgttgtatcgagttcttttttcctttccttccttgttttttttatctttgtttttcttccttccttggcataggccgatctggctgagtgcgtcgtgtaacaaaaactctattcttctaatatattgacgtgcaatccttttgtgcgttcgtggaaaaattaacctttattttggtttgttcaaattagcagttcttgtctgaattacattatcaaattcggaatctaatagttggtttttatctccagacgaattgggcacatctgcaaaaataattgacgcaccaccgcgacgaggtgatatttctactggcataatgcgagaactcccgctcgataaacttccagaggtatggattgctaagaatgttttgattactatcgttgaaacttctatgtcttcgtgtgcttggatcgtaggatttatttttcctcgagggattgattgtaggaatttggtggtgaacacatattaaacaacaaatcaacaatgtttgggcaaactatctaccactcaatgatcctgaattatcattgttacaacctttacagtactactagcagaacaaactgcatttctttgcaccacacatccttttatccggttgatttaaactagtcatcgtcttatctgagttgggtgaactattactgatcttcctgtgcagccatgtggtttgctcatgttgattcattaatactcactgttgagtgtaggcgtgtgtatttcagcccaatagggcccattccaccaatgtatatgtatagtagatgagaaaggaaatgaagtgaagcttctagaggaaaaatcacaaaactacatggtatcagagctgggtcaccggcgacctcgccgacgcgaaccctagtcggcggcggcgctgtgaccagagcggttctgcggcgacgtcgacagctgaggcggagcggcgacgtcggacagcggaggcggagcggcagtgtcgacggcggaggcggcgacggctgctgcagaggttctcgacgcgagcagcgtgaaggaggagcagggcgcacgctcgctggttgagctgcgcaaggatttggtgcagcacaagctgtagggagcacagcggctgagagacgcgcagctgttggatgtaggatcaacagagaaggatttggtgctattggctattgttgtccgttccagtggtggtgactttggtggtgctgttgctggtgctgctgctacttgagaaggtgaggatttggaggtgaagtggaagcttggtttgctgttgctgttgttctgatttggggaagaaactgtgtacgagagcttggcttgctgctgctgttgtgctgatttgggggaaactgaaaagtagtgctgctgggaggaagtagtgctactgctgctgttctgtttttggtgagaaactgaggagtagtgttgttactcctattaattgatttggctagtatcctagaagatttggttgatctgccatgggggaaattcaaggaattgagcaaatacttgagaaattggctgaagaagttgaagaaataaggggaagaattcagaaagtgaaggagaaaacaacagtgcttggcaactttgttaatctcgcacatcctatgcaggtacctaactcaacttggatattagactccggagcatctagacatgttacaggaatgtcgagtgagtttacatcatatactccatttcagtcatcatttaaagaaacaattcaaactgccgacggaactttacgacatgtgaggggagtgggaacagtcaaatgtactccatcaattacattgtcgtcagttttatatgctccctcttttcctgttaacctagtatccgtaagctcgttggttgatcatatggattgtcgaattactattgaccgagagaattgtctaattgaggagagaagaactggaagaaagcttggaaccggcgttaggcataatgggttgtggtatctggatagaagagggacggacaaagcactatgtagtgctttgttagctagcacaagtgaagaggaggctaaattgattctaaaacattgtcaattgggacatatgtcctttgatactatgtctaaggtatttcctgatgagatgagtaaggtggacaaaagcaaattaatgtgtgatgcatgcgagtatggaaaacatacacgaaccacatacataagcagaggacttcgaagcattttgccatttgtgttggttcactctgatgtatggacttctcctattgcttcggtaagtggagcaaagtactttgtcacctttattgattgccactcacgaatgacttggatatatctcatgagacacaagagtgaagtattgaaatgtttcaagaatttctatgcttgggttaggaatcaattaaacacttgtgttaaagttattaggagcgataatgggggagaatatgtgaatgatgaatttaggagttttctctcagcagaaggaatagtacatcaaacttcttgtgctgacacacctccacagaacggagtagctgagaggaaaaatcgacatattctggaggtaactcgttcactcatgtatacgatgaatgtaccaaagtttctatggagtgaggcagtcatgacagcaacatatctcatcaatcgcatgccatcacgaatacttgggatgaagactccatatgaaatggtgtttgggaagaatgaattcattgttcctccaaaagtgtttgggtgtacttgttttgtcagagatcatagaccatccgttggaaaattggatcctcgagccgtcaagtgtatttttataggttactcttctgggcaaaagggatataaatgttggagtccatctgagcggcgaacttttgttagtatggatgttacttttagagagtctgttccgttctatggagaaagaacagatttgagttccttgtttgttgatcttgacaatccaattattgatgaggatggacaagagggggagaatggatcatcaggtactgaagaagacacataatcaagaagcatgaaatttgtggttggctcaatcccatatcctgttagtgaacccattcatgagcaaaattggagaaggccatgtgaagaagaaaatctacaagtttatactaggaggaaaacaaggtctttggaggcgcaaacaatagggcaacatgagtctcctatggatgggatggagcagcaacaatcttcaattgttgctgaagtaggtgataaaccatctgatcagtgtgatactatacagatttcatcggatacggaaggagaggagtttgaaacagggggagaagaaactaatcttcctattgctataagaaagggggtaagaagcaatgcaggtaaacctccacaaaagtatggttttgaagctcaaggtgtgaatgatgatgagaataacatagccaattatgtctcttatgcttctttgtcatccacatataaggcctttgtgacatcactaaattcagtggaaattccaaatgattggagggaaaaaaagcaagacccaaggtggcatcaagctatgctagaggagctagaggctcttgaaaagaacaaaacatgggaccttgtaccattccctaaagggaagaaagtggttaactgtaaatgggtttatacagtaaagcaaaatcctgatggaaatgtggaaagatacaaggcaaggcttgtggctaagggatatagtcaaacatatggaattgattatgatgaaacttttgcaccagtagcaaagatgagcacggtaagaactcttatctcttgtgcagctaattttgattggccattgcatcagttagatgtcaagaatgcattcttacatggagatcttcaagaggaggtgtatatggaaattccacctggatttgctacctcacaaactgaaggtaaagtgttgagactgaaaaaatctttatatggccttaaacaatcaccaagagcatggtttgatcgctttagacgtgcaatgtgtggtatgggttataaacagtgcaatggagaccacacagttttctatcgccataatagaggtcttaaaactattcttgttgtgtatgttgatgacatgattatcactggagatgattgcttggagatatctaggttgaaacaaaatctaagcaaggagtttgaggtcaaagatctgggccaattaaaatattttttgggtattgaaattgcaagatctccttgaggaatagttctttcacagcgaaagtatgtattggatctgctcagtgatacaggtatgcttggatgtcggccagcttctacaccaattgaacaaaatcataagttatgtgctgaatctggagatccagttaataaagagagatatcaaagacttgtgggaaggttgatatatttgtgtcacacaagacctgatataacttatgctgtgagtgtggtgagccgatacatgcatgatcctagaagtggtcacatggatgttgtgtatagaattttgagatatttgaaggcaagcccaggtaaaggcatatggttcaagaagaatggacacctagatgtggagggatattgtgatgcagattggggcagttgtcttgatgatatgaggtcaacatcaggctactgtgtatttattggtggcaatttggtatcttggaggagcaagaaacaatcagttgtgtctcgctcgactgctgaggcggaatacaggtcaatgtcgatgagcttgagtgaattgttatggttgaaaaatcttttggctgaattgaagctgtcgacaagcacttccatgaagttgtggtgtgacaacaaatcagccataaatattgctaacaatccagtccagcatgatcgaacgaagcatgtggaaatagatcgcttctttattaaagagagaatggatgagggaaccttaaacttaggctttgtaaactctggtgaacaagtagctgatagtttaacgaaggcattaggtgctagagagtgcacttcttcgtgtagcaagatgggcatgatagatatttatcgcccatcttgagggggagtgttgagtgtaggcgtgtgtatttcagcccaatagggcccattccaccaatgtatatgtatagtagatgagaaaggaaatgaagtgaagcttctagaggaaaaatcacaaaactacactcactaggatatcataatgaaaaggagaaaaaaatgtttatgccactacccaatagtagagattagtgaatgcacacttttcatatgtaccataatttttgcaacctctcatatttgccactaacaagtaacaagtgcatggctttttggggcaaattcacacatggtaatggataagagattgtaaaagttagttgtgtatgtgagaagtgtgtccaagttattgacatacacaaattttttttgtttgattaaatacaatttctttgtctcgcttgttcttggcacagaaacttatggattctccttttgatcataacaatgcaatttaaggagcactaggtgtccacctagctggtatggttaggtgcagtgattcaaagggccctagttgtagcatatagcacaaaatgatcacaataatgcccgatgttgatagtggattctagtactctttatataaaatcaccagagttggtgtttagtagccaaatggcaattaaccatttggttcgtatttagtagtggccactatccactagtacagtttaaatatagatactaagcagctggttcttctatctgttccaagtttggttaaatgtcctgatgagtgttgattttgtatctcaaacatgtttttttccaggacatcttgcatcatgtatattctcttatgccattgaaagatgctgctcgtgctgcttgtgtgtcacatggatttctacgttgctggagacgctatccaatccttatattaaataacaaaacgataggtttgattaagagaaaactcagtttggatgacatggaaagctatgctgtcagtaaaattgaccatattattaagagccattctggcattggggtgaaagtgcttaaacttcaactgttcgcctgtccgaatataagtgcagctgttcttgacaaatggtttgtaaccgttatcaaacctgggatcgaagaactctccttggagatgtctttcattgaaaaaacggacagaatacaacttcccatgttccgttctatccaataaggcagagggatggacaattcagtcacttttcctctcctcctgtgcttttcatcctacggtgactcttggttgcaacataagcttgacaagcttgcatctatgtaaagtcgatatttgtggggaggagttagggcagttcctttccaattcattctctttggagcgattggtaatttctgaatgcagtgatatagtccagtttaaggtaccttgcctgatgcaacagctcaagtacctcgaggttacaaaatgtcaaatgctacaagtgatagagatagatgctcccaaactctccacttttatctatggggatgttggagttaaaatctctcttggagatccactgcaggtcaaggacatacgtctgatgggttacaatgaagccgacaccgtctgttatgctcgtaccaagcttccatccattttgccaaatattgaatcacttgtcgtgtcatctcctaatgaggtatgcattattgttttctttgtgccatccagttgctttataactacaattaattacatgctggtgatatgcatgtcacacgtgcacatgaaacacgactaaaattcctgaggcatctcttcttcttctctttcagatgaccagtacgccagtggtgcccagcaagttcctccacctcaagttcttggagatttatcttaaagaattatttgcctcacttcccagctatgatttcttttctctggtttctttcttggatgcttcccctgccttggagactttcatcttgcacgtatgccactttctcaatgttgcataccgcaaatcataaaagttcagttaatgcttgcagtttgggcctttgggggcttctactcttagcaaatttggcaggataattaattcggtatagttcgttgtagatatttttaatatagtttctcacaatatataatagatagtagaaatagtttagtacttaaatacgcactagtaagacaaccaaatagagaacatctgtggtgcttcacaagccaacagcagcaattcagtttgggcttttctcatgataaaatattttaagcttctataatcattattagtgactgtacttgatgaggagtatgtgaccaagttttaatgagtaactactactattcctatgcaggtagagcagcagttcgaaaggcatgattcgattcttgatggagaacctacggatttgaggcgaattctgcacgacggacatgccaacctccagaatgtgacgatcaccggcttcaattctacaaagagcatgattgagctaacaactcacattcttgagaatgcaccatcgctcaagtgcattacgctggatacagccaacttctctggcaagaaccatttggcgatgggcgaatgctctcctatgatgagaggagggatcttggaagcacgaagagctttcgaggcagccagaagacacatcgcggggaaaataccctcctttgtcgagtataagtttctggaaccctgcaggcattgtcattttgggtactgacacaatacatctcaagaagtccagatagcgtttcttcagaggagaaattcaagtgtagaaatctatattgacgctcaatcctttttgcttgttcgcaaaaaagaaaaatcgaatgtagaaatgtaaaaatgcacagcagtacagcacaaccaagtaaagaacaagtatggtattttgggggacattcttgcattcagaagccaagagcaatatttttgtgctagaattgtttttagtttagtgtcaaaagcagtagctttatctggttttattagtataacataaaagaaatgaaattagtgactaaaggtcatacagattacagagtagctgccatcgctcatcgctggttgcaatcgcaaagcttcgacaaagccatggccgtcgaccgtcgtatcgctgagttcgtctctgacgagtgagttactgggccgaatagagagcccattgaaaagcaaggcccacattgcattctggttatatcatagattttaaatagaaaatttttgcacagaacatattatataacggtttgaaaatgtgctgttggaaactttaaaacaagaaagttatagtttgaaagtaaagtttaaactcgtccaataagtattcaaagttattttggtagtcgagaattgtgatgttatttcattcttttattctattattactttcgttctaaaatattattattattttatttttattggatgataacatataaatacttctgtaactatttttttaataaaattttcaaataaaacgaagaaccaaacattaagtaaagaaaataaaaataaatttattttgtaacaaatgtactttctctgtttcacaatgtaagccattctagcattttccatatttatattgatactaattaatctagataaaaaaatattaattttatttagatttattagtattactataaatatgaaaaataaatgacttacgttttgaaacgggggagtaactgagaaagtagccatcgaactgtgagtctgaggtgtcctcaccaacttccttcatcatccccttcccatcgccgcggttctccacgctccactgcggtggactgcgccgcatgtagcgccggggagctccacagtccaccccggcccgcgcccgcgccctctcgagttcccacacgagctccgccgccgacggctctcgaggcaggcaggcaggcagcgccgccgatctcggttgccgccgtgtggagcgccccccgggattttcattctcagcagtacaagaggcggccggattcgccgccgtttgaggtaatctcgcgcgccggcgacgtccggatcgcctttcctggctggcgtctggagtatgtagactgcaagggggaatcggaagcggccgggcggagccatggagacccgtgccaccgagtgcaggacgatgcagctcctccgtgagcttcaaacaagtatatgcttcccccgccccctcagctttcgatccaccttcctatacagagatcgtcgttggattctaccgctatcgtttattgcatacttattactacctccatattttaatattttaatgtatgacgcagttgactttttatccaacgtttgaccattcgtcttatttaaaaaaattatgtaattattatttattttattgtgacttgattcatcatcaaatgttctttaagcatgacataaatatttttatatttgtacaaaaattttgaataaaacgaatggtcaaacgttggtcaaaaagttaacagcgtcatacattaaaaaatacggagggattatgttttagaagaaaaactgctcttaggctcctccttaacctgattggttcttcagctagcttataataaagtgcaatttagacaggggaatttttaactcttatctggtctagtgctcaaatcttcaccttattttggtttatgcaaattagtggttcttgtctgtaagccttgaattgcattagcaaattcattctctaaccttttgtttctatctctatctctagacaaattggacacatcttcaaagataatttacgctccacggcagcaagatgatatttatgcgggcataatgccagaactcccgctcgataaacttccggaggtatggattgctaataatgtcatagtctgttaactactacagtatcattgaaactgctatgttttggtgtgcttggattgtaatattttttttctcaaggggtagattgtaggaatcggtgttaaacaacaatgttttagcaaactatctcaatgaggtttcagaatgttgtgcataaattgaattcgaatgcactgttactttttaatgtttggctttctctgcacattgtctactactccatgctccaaaattatcattgttgtggtcttttcaaaactactagcagaacaattaactattaccagattacttctgtagcattagctaatttgttatctcccgatatgagctttacctatcatgaagatgacctgtgatgctattttttgtggattgatgacatataaggactaaggagtaccgtgtgttatgaagtttggttaaatgtcccaatgagaaaaatgtatatccacttataagtcttttggtaccgcatatagggaaatttaagaaaaagcacttgacctgttggccactgtccactagtaacaatttaagtatattttactaagcagctggtccttctgtttgttctaagtgaagtgtgcattgctagtactctctgaatgctgaattattcaaacatgtttttttccaggatatcttgcatcatgtatattctctaatgccattgaaagatgccgctcgtgctgcttgtgtgtcgcatggatttctacgttgctggagacgctatccaatccttgtattaaatagcaaaacaataggtttggctaagagaaaacttagtttgtatgcggaagatgtgccattgtatgagccagcgcttaaagtggatgacatggaaagctatgccatcagtaaaattgaccatattattaataaccactctggcattggggtcaaagtgtttaaacttcaactgtttgcctgtccgaacatagatgcagctgttcttgacaaatggtttgtacatgttatcaaagctgggatcaaagaactctccttggagatgtctttatgcaaaaaaaggacagaatacaacttcccatgttccattctatcaagtaaggcaggtggagggacaattcagtcacttttcctctcctcttgttcttttcatcctacagtggctctaggttgcaacataagcttgacaagcttacatttatatgaagttcatatttctggggaggagatagggcagttcctttccaattcattcgctttggagagattggtaatttctgattgcaatgacataatccagtttaaggtaccttgcctgatgcagcagctcaagtacctccaggtgacaaaatgtgaaatgctagaggtgatatcgatagatgctcccaaactctcctcttttatctatggggatgtcggaatacaaatctctcttggagatccactgcaagtcaaagacatacgtctgatgggttacaaccaacccaacacagtctgttttgctcgtactgagcttccatccattatgccaaatgttgaatcacttattgtgtcatctactgatgaggtatgcattattgttttctatgcactatccagttgctttgtaactacaattaattacaagctggtcatatgcatgtcataggtgcacatgaaacatatgattaatcctaagtcatctcttcttttctttcaaatgatcagtacaccaatggtgcccatcaagttcctccacctcaagttattggaaatttatcttgctgaattactggcttttcctcccaactatgatttcttttctctggtttctttcttggatggttcccctgccttggagactttcatcttgcatgtatgtcactttggcataaaaattcagttgatgcttgtagtttggggacttctgcaaatttggcaggataaattggtttagtttgctgtagttattcttcatatggtttctctcaacagattatagataggggctgaatcagcagtttagcacttaaatacgcactaaggcaaccaattagaaaagccctgtggtgcttcatgggtattattgcactagaagccaacagcaccaattcagtgtgggcttatcatgataaattgttttaagcttatatattcatcactagtgatcgcacttgctgaggaggatatgaccaaggtttactgagcaactattatcctttgcaggtaaagcagcgatgtgaaaggcgtgattcgattcttgatggagaacatacaaatttgaggcaaattctgcaccccagacatgccaacctccagaatgtgacaatcactggctttaactctacaaagagcatgattgagctaacaagtcacattcttgagaatgcaccatcgcttaagtgcattacgctggatacagccaacttctatgataagaaccttttgacgatgggtgaatgcttgcctatgaggaaaggaggaatcttggaagcacggaaagcttttgatgcagccaaaagatacatcgcggggaaagtaccggcgcatgttgagtataagtttctggaaccctgcaggaaatgtcatattgggtattgaaacaaaacggtagatctcaagataccgtctttttgggaaggagaaactgtgagataaaattggttgtgtagcagtatatcgccgaaatttagtgatttcgctactttctgtgaaaaggatgtgtttaagtgccaagacaagtaatttaactttatatagtttgtaattataaatgtataatataacataaatttgtggccagagttgtatggagtataaatgtataatataacagaaacccgcacttgtttcagttgtttggttcatccgttcatgtataagtttaccatgtcattgctaaacgctccactactgccgcctgccacagtttattagcattgtgtcacaagccagacttttacctactgtcacttgagtgcattgcactggatacagccaaattttatggtggttaccttctgaaaattggcaaatgtctgcgtatgagcaaagaagctctcatagaagcccataaagctcatgaggctgttagaagatgcattgaggaagaggccccctcatccgttaagttgaaggttcaggagccctgcagggaatgtaattcttattactgacatttttgactgtgcgaaagctccaagttgaatcagtagtccacatatgattatcatcttggctctgttttcagctttccttttggtaggtggtgttactgttagtcagtagttttttccttgctgtactggggatgaagtatatgtcaagctggtttccccagcggttgaagtagtatgtaaagaaagaaaagtagggccatttggcctttcctcttatgaaaatgattgtcatggagatgctatcagtacaagtgtagatggaggctgggaatctgggatcgcgattattgttaacggtccaaatttctaaagcctaaataatgcaaaactacctccaacgatgaaatgggactgctaagttatgctggaatcagatcagatatagtcaatgagactgctaagttttgaagacaaggatgattatttcaagaggtagttaatcaacgtttggaacctttttattcatatatgaagcacaagcaactaataatgtttagttacattcaagagctgattcagatattactttattacagaaaagaatacttagaacggctgacagataacttttcccattatcgaaagaacataaagaatacttgtacatgtttgaatgcagtgaaaatgggtgctcaagtgagaagtcattatactctgttctactttttgagagaaaaatcttggaaaactattacaaaaggaaatgtgagaagaagaatggcaagaagcaaaacaagaacccatggttcatctgagactgatcacttcagtgtacaggaatcatgccatggattcttaaggatggcttcaacttcagtatgaactcgacatgaatctaactggcatgaaaaacttcctatgttagagtttgtgtcgaatatgagtttaggacttggagttgtactaggtgtaggactagagtatgagtcggactttatcctaggatctctcataaatagagggacgtgcctgttgtaactgcatggcgacttagcatagcgagagggagcggttgccgacgtcgaccggccgtgagtcgttgtaactctgatacgttgtatatgctggatcggggaggagcgcccgtaatcagtgccccggagatgtaggctacggctgaactccgttaccaaatatcatgtctcagtgtcgtcatcgttttggatcttctatggcgttttcttccgcgtttagctaccgatgtcgattttggggctggttttataacaagtggtatcagagcctgcaggagatccatggtagaggtgcgagggaggtgctccacgccgcgacaactacacaggatgtccagggacggacatggacgcaaggtggagcacggcggcgatcaacgaaatttgatcggtggaatcggacacttcaggcggcggtctgaaccgtttgatggctgcaatcaacagggagatgaccagacgtggtgctcaggttgatggcggcggaagcgattggcgattcaatcggtgggtcggacacttcaggcgggtggctcgaactttctggtgagctactttcaacagggagatgtgaggcctcacgggggttgattgaagctggaggcgatcggcgttctcgatcggcggaatcaaacactctgggcagggtggctcgggcctttcgatgagctgcgttcgacggggagatggctagacgtggcactcgggtcgttcggtggttgggaagacggtatgcgacttgtcggcttcggctctcgactagattgatggtgttcaatcggaagtcagagcgggtggatccttggtactgttataggcacaagtcagatcgatgtcgtttgttgtcgatggaattgactggaggtgttggacaacagtgaaatttgtggtgggagtacgtgaagctcgtggagatcaggaccacggcggtgtgcgtgatttcacgttgaggccgagccggaggtgcagactagagcggtgttgttggtagctggcttgggaaaagccgtgttcgtgcaggactcagatctggaagggctgcaacataggacatggactcgggcacgtagtctgtttctattttggtcgtgattgtggcagcggagaagagtcaaggaggacaccatgtcggacacaggaagggaaaacgaagaggattccgtactggacacggatcggactcatattttccaagcaaaatcagcaaaggagagccacgggatcaaaccaaccaaagcaatgaagagatcggacatgatttcttgggcagtggtggtttaggcgacgaactgcgagcggtaggagcacggcttggtgtagttgtcgtgcaggtgccggcgagttcgacgcgggccagctccaggaggaggtggcggataccggcggaaggggtgggctgctcctgcgtcggggggcggctccgtgggcgtcggcatcctcaccagcgggaaacccacggcggcagcggtagcggcgttttcatcggcggtggtcccagggaggtggcgcaaggggagaccagctcctgtgcgtggcagcatcttctagacgggcagcggcgtcgggaaccgaagcggcatctttggtggcggcgcggaggagaggtgaggcgcggcggctctggtgctcgcagtcagcagggaggagcggcggtagcgaagcgtctttaggcgctgggtggcggcgcgcttgagccgaggatgaggcgagcagaaggagcgacaagggccgggatcgttctggtccttgtgtgttgactgggtcttaatcgagagaaaaaaaaaacgattttttttaagaaaaagaccggtcggtccgctggttaggctgttgatggttgagtctgctgtggctttgcacgtgaagaggctatgagctgcatggaacgttaattcattcgtgcattgatttggtcggtacaagattggtggacatgtgagggatggacacgtgtatgtccagtgcacatgcttggatcttgtgagcaatggcatatgcaaagaaggaaattgatgcatgcagcaagaaagtgacgtgttaagttttggtatgacttagtaaagacagtcttgagctggtgaaaactcccgggcaacagcgggtgaaaatcgttgagggcgtcaacgggctgtttggcagtacaggatatgtagcgcccgttctgtcgtggcgcctagcaggaaaactatctcttaaaaactctatttgcgaaatctgtttctttgcttgttgcctagtgtccgtgccatctcagatctcaatccctgatctatcgtcgagttcaatcccgaacccaatccttcccaaatcgatccctccgcaaaagtctattttgcctcccccggggtcgatgggccgaatctttctcggctcatctccccctccctccccggcgccctctctctctctcgcgctctccccctccgctctgcccgcgcgcgtgcgcgtgagccgctcgcgccgagcgccctcccttcccctcgctctccttctccccgcctccatccctggcgagctccctgcccgcgaaatcggccccgcgcggcgttgttcgcgcgcgcgcccgcgtggttgccgcccatgccgcgcctgcgccgttccgcgtgacccggccccgctgccctgccgcgcctg

SEQ ID NO: 50418 - DNA, 23956 bp, Oryza sativa
gaggcaagccctcttttctctccctcttttccttttcccctccccgccggcgtcatccgcctctgtcaccgttttggccgcgagcgctgagctccagctcgcgccttgaccgcccaaggtcggtttccaaaccgacatcgtcgtcctataaaccaaggcgccctcccatcgattccccccccccgtttcgcttgccgccaccgcgcctttgccgccgccttccgtgctctgtcccgcctccgccgttcatcgccaagcaccgggagagccggtgcgttcgtggacgcagaaggggacttcgggcgcgccctctccttcctcttccccggcccgaggccggagagattactcccgcgccgttggcctctcgtcactgcgcctcgtcccgcatggtagtgcatctccccgttctccctcctcgctccatctcctccccttagactcgggtagtagcacgagtagcctccccgtagctagccggcgccgccccgaccgttgccgccgctcgccgtgtgctcaccgccgtcgccgcccgagctcggaagcgccgctcgtcgccggcctcgctcggcgcagctccgcccaatccggcgcaagggacggattcccgtagccccgtagatgctctcgccgccaggaatcggcccctcgtgacctcgtcgccgtttccccttccctcgccgccggttgccgccgccgcaattcgccgccgtcaagctccctccggcgaatccgagccgttggctcgtctcccctcgtctcgtgcaaccacccggtgtgctcgcttttgcctgtatcgccgtggttcgctccgccgctcgccgctgtcgtccgccgtccgttccggccggcgtcgtcgtctacctcccgccggcccgcatggctgccacgtaggcgccacgtcggcgccacctcggccgcgaccggcagccgctccctccgttttcccccgtgcgcatggtccaccgcgagccgtgaggctgcgcgtgggcccgccgcatccgcgtcctccgcgaaccgcacgcgtgcaccgcgtctttcccccatcctagcgccacgccgcgtgctccctccgcacggtgagccgagtcgttgacaagcgggtcccacccgggaccacgcgggatggacccggtccaccggccctctctctcctcccctcccgcgcgcgcgtgccttgggccgccttgggccggccggcccatttagctcggccaagccgccccttttctctcgggccgcgccctagccgcccgagggaagtctaatttccctccctcttttcttttcttttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgttttgcgcgtagttttggagcccgaagacccgcagtgcgaggatttcgaggatcaagctcaagatctcgagcaaggcaagccacctttgaacatcttgagcctatatttgaatttaattatgttgcttgaaaaatattatgcattgataggatcgcacttgatctgcttgtcccgtctgcaaggcagattggcagacctacctaatttgttgcatctgatccttcctttgttaattgttataccatgttcccttatagccacccagtcacgcttcggtattcgtgcactctgtgcgagtatcgacggtcgccttcaaacttaaaatatgataaacatcttgggtaaaacttgggttttacaaaaggcttggaaaacccgacacctggggtcggtgcttgcgaactaaatgaatttccaaaaccgcggaccggggaacgtaccgggtgtacggtttcccgctcttgcacttaaggaccgttcccttggaatttcatccgaacataagacaagtacgaccacatgggtggaatgggacacccctggctgagtaactagcttatcaggggagccttgatgccgagagacatgtggattcgccggggtggtgttggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaactaactgttcgaacagccgtacccacggttatgggcggatgtgaggtgattcctagtgtagttttatttgactactgtttgtgaaattgctgttgtggaaaggagatcgatgtttggaaaatctgcagctgatgggatcagctaggcccgggtgaccgtttgaaagttgttggcccgggtggccgtttgaaagctgttggccgggtgccaatcttgatctattttaaagattgatacattgcacatactccgaccggacgaaacgcactgtctcaaccgtgtcgtttgagaagcactcacttagttgtttcagaaaagagttcaaataaaatcaattgcaaaacaacagcctttccttgaagccagcattaaacacttatttctccatggcttgctgagtactcccgtactcacccttgctctatataaatatcccccctcagttgctgaagaagatgaagcggatcctgctgatgaggagttcttccaggagcaagccagctacgatgagttttagggtttcggcctagttcccaagtcgcgcctgtgattgtttggtccaagtcctggcttccgctttccttttgtaatgcagttgtgagctcgggatctgtccgcagcccaacatgactgtacttctactctataataaagagacttctgttgctgtgatattctgtctccctgtgataccagcactgtttcctgggactggtatcgattaacaggttagtttggagcgtcacgggttagttccggtcgggactagctcggggcgtgacagttgtggtgtgacctccccgacgacctgctccgcgacgtcctgcagaggctccccgccctgggagaccgcctccgcttcgccgccgtgtgccgagcatggcgagccgccgagcgttcgcactacccgcgccccgccgtcccgtggctcgtggcccctggccactgcgtcagcctccacgacgccgccatccaccgcgtctgcagcctccacggcggcgccaccgacgtcgtctgccggggctcgttcgacaactggctggcgatggtgcccacgtcgtcgcctcctccctaccagcccttcctcctcaaccctttcaccatggcgaccgtgaagctgccgatgtggaccaacccagagaccatcaccaaggtcgtcatgtccgcatcccccgccgccgccgacggcgacggcggcggcggcatcacggtagctgcgatcgcccgcgccgacccgatcgaggttcgtggcgcggctaggcaagatcttcgtctgccacctcccggggaggaagaagaagaaacatcatcccgatgatgatgataatgcttggtcggacattagcagggtgttctacatccaagacatcgtgttcttggaagggaagctgtacgccgtcaccgaagcggaggagatcttcgccttcgacgacgcggacatcgagcactactcgcacttgcccagcgaccagtggcggtggacgcatgtcgacaagcaggcgccggcgtttggccgcaccgagttctacctggttgcctgccacacgatggggaaggttctagtagtttccagagacttcggcagagcccgcgtccccgacaccggtggcggccgcgccgcggcgcgctaccacacatctagattcaaggtgtacgtggtcgaggagcacgactcgagacgtggggatcctggcgaaagaagacgcggctgacgagaatccccaggctgcgtggccacgcgctcttcatcggcgacgcttcttgccaagcgttcgatgtcacgtcgtccggcgccggcggcaagatcaccgagaatcagatttggtacgtcgacgacgagaggaacatggtggtcaccgtcgccgccggtgatggtccggtgatcagctcctcctgggcattgcggtcggtgcaatcgtacgacatgcggaccagctgcttccgtagataccagcaaaaaccccataagccgtcgtcgccatgggagtgcatcatgctgcagctagcgctacctgggcgtcgaagccagcatggtgccaccgccggtgacggagttcggagccacgctgctgctatgggaggtcatcaacggcatgggagcaaccaaagagccaacctactattacagcgctagccgccgccgccgtcgtacgacgtcgacgacgaccacggaggccgatgatgatggcgccgccgactaccatgccgtaaccgtgagtgtcaacgttctcaaccgcgattgcttgcgtttcacgcaggtcgggtcgtcggtgcaggaggcgaagcagatggcggcatgggaggccgtcacgttcctacggagccgattccggagcgtgctcgacgacagcccgtggagctcaataccacattatcatagccacgtaagtgagatagagtacgacgaagattttgacgacgacttcgactacgctgatctctgaaattattgacttgtttgtatcaccaacaaatttgttcagagcgatattttcagtatttaatttttttttgtcaccagtaaaaatcatctgtgtcacaagttgcaaagtgcagagcatcacaaggataagtacgtattcagagaacagtaagcaaacaagatatacttaaaatcatccattgacaccaatacggaaaagaagtatgaggcttaacatgatcaacctgacgactgcaagccattacggcagacacgacacactgctaaactgaaccagaacctatactaatcaaaactgataattaagaacctatactaaaacccaagtgatatacgatctctctggacttagaatccgtggaccttgatgttgtccttgcggaccatgccggccttggcgaggaagtcggagacgctgttgcggtggtcgccctgcagctggatgatcttgccgagctccttgtcctccaccacgttgccgttgcagcagagctcccgcttgaggtcgcggagcaccttggcgtagttgtactcgccgccgatcccctgcacggtggtcagcgtcttccgcccattgcgctgctgcacgcggacgtgcacgtagtcgccgccggcgccgcggccgcggcggcgtcctccccctccgcgtccgcgaacgcgtcgaacgtccccgccggcaggccgaactcctccggcgccccggacatcaacttgctgccgctgttcccgccgccctccgccgcctgatcctcctcgccgcggcgggggacaaggtacttgttcttggacgccgcgcggcccttgacgtactttcccttcttgctcgccggctgcggcggcggcggcgctgggacgacggcgacggcgacggcgacggcctcctcctcctcgtcggacgacgaggcggcggcccacagcgcggacaactgcggcggcggcggcgacaccttggtgaccttgttgctgctcgccaacttcgacgacggcgacacggcggcagcggcgggtttcttggctctggggatcgttgcgctcgagatcgccggaggattcgtgttcttcgcgttcgttttttgcattgcacgaatcagggggcgcctcctcgcgtgtatttatgaggggacgcgaaaggttcaagccgaggagtccaagtcgtacgtggagtccacgtcggataagttgttagacgtggcgtgatctcggccgtccgacggcgcatctacggtccccactacccaggtcgcgagtagaatcctcctcgtacgccgctgccaaacttggctctcacggtttctatccgggtacgtcggcgacacggaactgacggaagtaccaaaattgcacgcgcagaaggaagattggtagccaaggaaatcatgtcggttgcaaattctgctaatgtttccttccaggttacggccacatacggtaaaaagtgtttacatggtactccatacatttcaggttacgagtcaaactattttaaattagactaattttatagaaaaaatataataatatttttaatccaagaaaaatatattatgaaaatttattcaattactatgctgttgttataaatattactatttttttctataaatttggttaaacttaaaatactttgactttgaccaaaatcaaaaacatcttgggcctattcaatttgatgtcattttcaaccttaccaaattttggtaaagttacaaaaaaaaatggctacatttagtttgctgctaaattttggtaactatataaaaaatcctgccaaaattttggtaagttgccaaaattttggcatccaaattttggtaaggttttttttgcatcaaagtgaacagttcccttataacttgaaacggaagaagtacaattgagtgacacgttttgcagagaaaatttaataacaggttagacgcatcaaataccaaccaagtaatctttaatttccagaatgatgcattcatagagagacaagattacttgaactgaaaaaacatcagcaacatatggggtcaagtactcgaggtaatgttcaacttcaaatacaaagaacaaaaacttcaccatccattcatttatctccagaaaaaaaaaatcagccaacgtggctgtaattattggcacagcaaaaggagccccaggtaaaaatctgtacacagattacagcttcaaggagggattttgactagggcttacaatacagcaagtgatattacattcctctgtgatgttccacaccatatgttgcagcttgcaacaaggcgtctctacatggctaacttataacagaactgcctataaggatgtctaggtaatgtgagaaagtttacacaaaacagcagaaaccaatgatgttacagtagtcaagcagaggagaagaagaccaaacagcaggctcataaagcccttccacccgtattcttggcaaatgatggaggatgaacaaatgaaagggcagcaaagtaatcgctctgaatacttaacaatgctgatagtcgataaattaccatgcacgaagttgtccacagaaacaattttcccttgttatcatctgagggctctcactcagatcaatgggtataaataattgtgttagttctgacctcctgaattctgataacatgcagtcttcaaagaactaatgtcttgggcaaaatcacaacatttgcaaccttggagtttctctgcattggtcttttgatgtctgatctgtacaattcctgtataacatcatggtgctgatctaatttggcaatcaactccttagatcccctggcctcatttaattggcggtgctaggccttgcgccttcatcatgcaatggtattttgggggtgctcttgcgcccacttgcatacaaagctcaatgaccgcaggtgcatgaccataatagtctctcccagcgtcgaccagaaccggtggatcatgaggtcgctggtgccaaacaatctttggaggaactaggtcatccacatcggctttcttccacttgtgtttaccacgccagccctcgaacttgaataccccacacattctggccttgtgccctgacagcccaacatgcacttcagagcaacgctcacacactttggatgggtaaaccaataggagttttgtcacacctaatctaagcctttcccatgcttctattgtcctctgacctatgaatctaagctcttctggcaaaaaagcagcaggtttttcatcattttctctgactattgcagatgacgtgccactcctatgccaaacttcatcaggtatatctgcacctgcctgatggcagagctcgagtaccgctgggacacgagggaaatcaaacctctggtcatgttttatctcatcctggaacgtgttttccaggtggaaggattcaacagggataaggatgtcattcaagcatcctggaccccatttatgcggctggttcttgatcatacgcttgaaaccatgacaggattgcatctcatgccctacagctccaatatgaacttcgggacaaaaccttcagtgagaatagaaacacaaggtgttagaaagattcaataatattttaggacaggaatcaagaaaatgatatcaaacatgcacatcagagagagctgctcttaacttggcatggcaagaaaagcaatcatggctatatgcaatcaaggtacacaataacaacggtaatctatagaagactggtaatcttgtaatgttgccccatttctggatgttctggaacatttttagtgcatgcctaaattgaagttgatctactacaaataaaacacttgtttagccatactatcttccccaagtgttaagacaaacagacaaatacataaaaattccacatttctcgcccttacttgcatgaatgtatgggaacaacttgaagcagcgtcgagacacctttggtgacaatctctctagccttgactacctcctccgctactggaatcatgcgcttgattggatactcctttgcccggttctttatcctcttgaggatcataggccgaagctgcttccagtccaccctcgaagagtacagcctctgattcataaccgagccacacagctccgagcaaatgtagcccccgactctccgccgcatcaacgccattgccacacacacgcacacacagcagagcacgcctgcaagttcaaatcttgcattagcgcaagaaacgaaccccacccaaccccatatcgacagaggatgtgaagaacaggtaaatcacgcagaagaacccatctctgatagcagctatcgattagaacaacgaatccatattgggtccgtgggaaatacttactgcacaggaaggggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagatattcgttaagaccctcactggcaagaccatcaccttggaggttgagttctccgatacgattgacaatgtgaaggctaagattcaggacaaggagggcatccctccggaccagcaacgccttatcttcgctggcaagcagcttgaggatgggcgtactctcgcggattataacatccagaaggagtccaccttgcaccttgtcctccgccttcgtggaggcatgcaaatattcgtgaagaccctcaccggcaagaccattaccctggaggtcgagtcctccgacacgatcgataatgtgaaggccaagatccaggacaaggagggaatcccaccagaccagcagcgtctcatctttgctgggaagcagctcgaggatggccgcacccttgcagactacaacatccaaaaggaatccaccctgcaccttgtcctgcgcctccggggcggtatgcagatctttgtgaagacccttactggcaagacgatcaccttggaggttgagtcctctgacacgatcgacaatgtgaaggccaagatccaggacaaggagggtattccaccagaccagcagcggctcatcttcgctggcaagcagcttgaggacggccgcacccttgctgactataacatccagaaggagtccaccttgcacttggtcctccgccttcgtggaggtatgcagatcttcgtgaagaccctcaccggcaagaccatcaccctggaggttgagtcgtctgacacgatcgacaatgtgaaggccaagatccaggacaaggagggtattccaccagaccagcagcgcctcatcttcgctggcaagcagcttgaggatggtcgcacccttgcagattacaacatccagaaggagtccaccctgcaccttgtcctgcgccttcgtggaggtatgcagatcttcgtgaagaccctcactggcaagaacatcactctggaggttgagtcctctgacaccatcgacaacgtgaaggccaagatccaggataaggagggcatccctccagaccagcagcgcctcatcttcgccggcaagcagctcgaggatggccgcacccttgccgactataacatccagaaggagtccaccctgcaccttgtcctgcgcctccgtggtggtctctgagcgtgtgctgtggtgcagcattggacttcattatacctatgccgctcgtctgtcatatcatcgtgtcatggttgtgttgtgttctggtttagagtccctaagttgtgttgatactattatccatactagtacaatttgcttcactgtgcatcggtaccaatcgatgatattatcattctacttctgttaatgtttctgagatgtttgatccgagatgagattctgtttgtgcattgctcacatggtcgtaaccggccactgttgcgcgtgcctgttgatcaatctgtttgcgcttgacggtttctgatgcttggaattggggtgtcgatgttggtttggttatctatcctggtatgtttgttgatttcatgcgcatttcagtctttacggcttctgatgcttggaattctaatggtgttggttgatttcacaattgggctggtgcggtttggtgcctaaaaaaaatgggagtacctatacatctttcgaaagattttgatgatcgtatcacacagattttgatgatcgtatcacacagatttttaatctttgaattaaaatccgatagatataataaaaagtaaaaagtaattaagaaacaccataatggacactaaattaccatatcctcgagaaaaagaccaaatccaataaaaaagaaaaagaccaaatccaatacaaaatttaaaatttacatgcgaagattcaaaaattacagtgtaacttacaaaagttacaatgtaagtttcataaattacactgtaacttacaagaaaatgcactgtaaatttaagtgagaaaatcgagtgagagataagaaaaaatctttcgagtgagatatagcaaaattgaaaaaaaattggtttgggcccaaaaatggttgagggcccattcggccattccccaatcccaaccatcgcgtcctactccagccgccgctgccacccacgtccgtcggcgccatggccgccgccaaggagctccttcgccggctccagcgaccagcgtccctgcgcggctgcagttcaactgtttttggtgtcgtcccctctgtcctatctctttctgcttcttctcttcagcctaaaaaatttggtcattcccttttgtctgctttccaatctgcaaaagcacataattttttcttcatctccattttttcttcttctccatttaatctttcttctatgctattgaatcataacggtacgtttaatttatccaatcaccttttttttcacactttgattttcatgtgctagatggataactgatggtggtatgactgaatttgattcttcagaaggcctttattggatttatggattgaagccaactttgtatagttcagttttctagcccttttgcatgaaaaatatatttgcagctgctcatttctactgccggttagtagaactgaatctaaatatattcagatttttgctcctggtgtgtttcgtgctcatattattggattgccaaaccctgccataaattcatgaattcatgaattgttgagtctcgggagatcaaaattgctccgaggagggagaaaagcgcgcgcgaatggcgctcctaatgggggcgaaacccaccgccccattatactcctccctgctccagtgctgcatcagctcctgcgcattccggcaaggcaagtccgtccacggcagggtcgccgccgcgtccgcctctcctccggacctgcacctgagcaccaagctcgtcatcttctacgcgcggttcggcgacgtcgccgccgcccgcaaggtgttcgatggaatgccgcacaggagcgtcgtgtcctggacggccatggtctccggctacgccaggaacgggcgcccgcgggaggcgctggagctgttcgcgctcatgcgcgcgtcgggcgcgcggccgaaccagttcacgtacgggagcgcggccagcgcgtgcgcgggggccgggtgcgccaggagcggggagcaggtgcacgcgtgcgctgccaaggggaggtttgcgggcgacatgttcgtgcagagcgccctcatggacatgcacctgaggtgcgggtccgtggaggatgcgcggcagctgttcgcggagatggggaagaaggatgtggtgtcctggaatgccctgatcagggggtttgtggaacgcgggcatgacggtgatgcgcttggattattctcttcaatgctgaaagaaggtatgccgtccctccttttgctttaacaatcttgagcatttttcctgtaatcatgctgcctattatgtcctagcatgaaattgcaaggtagtttttgctgatggtattggcactaaaattgaaagtgctttcttttttttacatcaaaataattgacagcgatgattcctgaccattacacgcttggaagtgctctaaaagcatgtggaatagtcggtgttgctgtcaatgttgagctaattcacagttgcatcatcaaattgggttactgggatgaaaaggttgtcatcggatcacttatcaactcttacgcaaaatgtcggagtatgagcagcgcaagagtgatatatgattccatctctgaaccagatctcgtgtcatcaaccgcactgatcagtgggtacaccatggatagaaactacagtgaagatgcaatggagctcttctgtaaaattcatcggaagggtttatggattgatggtgttctattaagctcagtgctttgcctttgtgcaagcgttgcttctgcaagatttgggacacaaattcatgcatatatgtgcaagaagcagcctatgggtgatattgcattggacaatgctctggttgatatgtatgcaaaggcaggagaattttcagatgccaagcgtgcttttgatgaaatgccctatcggaatgtgatttcttggacgtcacttattactgcctgtggaagaaacggttctggagaagatgctgtgactctttttaataggatggtggaagatggtgttaggccaaacgatgtgacattcctttctcttctatctgcatgtggtcattgtggtttgacaaacaaagggatggagtactttacttccatgatgagcaggtatggtattgatccaagagctgagcattacagctctgctattgaccttcttgctcgtggaggccagttagaagatgcatggaaacttgtccagaagacaaacttaaaacccaactcatcaatgctgggtgcaatgcttggagcctgtaaattgcatggaaacatgcttcttggagaaactgcagccaagaacctttttagtatagatcctgggagttctgtaaactatgctgttcttgcaaacatgtatgcagaatgtagtctatgggaggatgcacagaggacgagagaagtaatagatgaaacaacagatggaaaggaagttggtttcagtgtcatctgaatatgacagaaacttttccactgcaagaaatttgtatcacagtttttagccactgatagatgcatcagatgaacctcaaattctgggccactttgacaagccgcaacacacttcagagttcagactccagagttaaccaatttctgcctgttcagttaaacagtgaatagctcatgacctattgacctatcacaaattcacctgccatcatgttcgttcagtgtaagttttttgttcatctgacttctgtgggttactttccttgataaataattttctgaattgttactgtgctttaaatcttaattagtcccataattgtttaggactgtagatgtgtttttgcaagtcacataacgttgattagacagaataattatgggatattaacccttctcttttaaaagcaattttgatgtcctataagaatatcgtagaaaacatttattaagtattaactagactgtgagttgctgctgaacatgactaaaggggttggcattttttttcttatgtgcatgaacaagtcatgaggtaaaaattggagtactgtttaattcctatggaaaaggtcgaacttgtcaatgtccaccattgttgaacaacttcatggtcaaaactgtcctgcactcccttgctgtttgagtgaagcacacattttgagctaggtcaactaaaaatttctttacctgctgtgaatgtcttagacttgaattcttgaacaaccaaaagacatcacttttcagttactccaagagtaattgaatacattgcccaagccatgtggtagtgaacacttaaaccattgttatctcctgtggtgcaggattttgacaataggggtgaagatgtaatgatgcactagtagatagtatggaatattgatagagaaaattccatgattccattacaacagacagaaaaaaaaaacctgcattgattttttatagggcatctttaaatttcaaaatgtcaaattatgtatattttgaccagcaattaatcaaattaatataattaatatatatttaatgtgaaatttgtgcccatagattcatatttcaaagtgcgttcacaaaatattggctttatagctattaagaatataattctgagaaatcaatggccaatgtttaatcttgaatttttgttttcaaattaaaatatgccctataaagaccaatggaatctaaaaaaataaagaaaaataaagtttgacatgtattacatacaaaatttttaacactttgggattcttatctaagtgcacattgtatacgtacatgtaatcctatatatttggtgttttttcaagttttaggggtgcatctgtacccccacgcactatggtgtccaccattggttctgttcactactcctgacttgttttcaccttttttttattattattctctggagagctcagcggaaggttatcttgagcccagcagttatttattaacttaaaggctgcaactaatatctgaccaatggaccgattttctcagtatgatagggattcactgaaggtttacttacacaaactcttgcattttttattcaaacatagagaatctttttccataacttgcacatcatgttctcatctttcttagagtgtttatatgcttgatcaaacctaaattttgcttcaaaatgaagtatctgcacattgcctgagatgcttctgcacccgtttggcattcaataattagctagcagtgatcatgttgattctcttctaacttttctcccttgatttgcttcattgacacgagcacaactgtcatgcaacctttttttttctcaacttaatttcaaaggaagaagattgatttcatcaaacaatgggttgttgctttgatattatttactttaactgactggtgccagttaagaaattattatgggcagttcctttagtgttcagatgcaatcccaagagaaactagcagtgataatgtcatagcgaggcaaccatattatattccctggttcccttaaatactaacaaaacaggaaatggattgtttttctttcttttccactttgcatgaacatacacaatttcctctggaacaaacgacaacggataaactgatatattatctcatatctttgaatccttctgaacttctttaccagaataaattcaacccatataatatttaaaataaaaaattagaacagctagagagtattaccttttagcaacatgtcgtgacctattcatcaatacaagagcctgtattactcacaagtgcacaagccacgaaggatgaccaccaccaactaattatgcaatattaccaggtaatactatctagatgcctgatccaagacttgcgtattcttcaattgaagtacatgcacacaactcatagggcttgtaaaatctcgatctccaagtcttagaccatctgcttgttgcattaggaaaaataaaatgaagctgtgggaaatggtttatgtcacttgtttactatagtacaacctaagcaactgagctataaagcaggctgcaagttataatttgcctcaacaatcatagaaggcaactctttcatcataggcagtggttccacagtagtcatgcacaacatgccttacagactcctcttcggatttgtcctttctcttgtcctacagttctccttagtattatccaatccaccagggctaaacattggcttttaccaatacacatgtccaaaagcagaggtcattgttcgtgatgagatgaccaagatcatatcccgagttccaagtctcgcaggccctctacttcgcatgcatttccatgattgttttgtgaatgtatgcatactgcttaccatgctctgagctgttttgattttgaattgagtttatcctactaagctatgtgcctctatgtgttttgcagggttgcgatggctctatacttctggatagcacaccaggatcaccatctgagaaggaatcaataccaaacctcagtctgcgaggttttggcacaatagaccgtgtcaaagctaagctggagcaagcctgccctggagttgtgtcctgtgctgatatccttgctctggtagccagagatgttgtcttcttggtaagaactagcttccatgttcattaatcttagttcattctttagttagaaaagttagtatagtttggctaagtggtgagaattggctgttttaggccgacaatagtggaaaaccacacagtttgattttcaccatattctacgtggctattggatttcttgctgcttacagtaactagaactatagttgagaaaagtccctattcttcccttgtgcaacagaccaaagggcctcactgggaagttccaactgggcggagggatgggacaagatcagtgaaggatgatgctgtgaacaacctccctccccccttcttcgatgccacgcggaacttgtatcaattcttcatcccaaagggccttgacgcaaaggatcaggtggttctgctaggtatatactattcttcactaacttcaatgtttaatcttcatagactagctccctagatgatttatactgtacttactgaaagttgcaactctcggttctgttgcctgtgctccttttaaacactctgctgatcccgatatatcccagtagcattctccaataaaggtgatcacttatttaattactatacaacttgttaataaaggaaggtatcatatgcgcataccaagtcaacaaaatgggaagtacaaaactatgtggttcttagttctaatcacatggcacagtacagaaccaagccaggagaccaagaccactttatcctcaaacacagcatagctctttattcgagtggtcaaaacatcgtttcctgttcagcaccatactcatttgtgcacttgcaaaattcatggttttaaatagcgggttaagatatttagcgattgaccttctcaaacagctatagcgaacttaatggagctatagtggctaagactcttctcaaacagctatagccagagattcaaaaccatggcaaaattgcaatccaaacttgtttaattaccaagaactcatcacaaatgtgcatatgcaatttgagaagtgacacattgttcacaggtgggcacactcttggaacctcccattgttcatccttcgccagccggctgtacaacttcagcggcatgatgatggccgacccgacgctggacaagtactacgtgccgaggctgaagagcaagtgccagcccggcgacaagacgacgctggtggagatggacccggggagcttcaggacgttcgacaccagctactacaggcacatcgccaggggcagggcgctcttcacctccgacgagacgctcatgctcgaccctttcaccaggggctacatcctccgccaggccggcgtcgccggctacccggcggagttcttcgccgacttcgcggcgtccatggtgaagatggggaacatgcaggtgctcaccggcgcccagggggagatcaggaagcactgtgcctttgtgaattaggctgcaaatatatatacaaccgctgaactgcatttgtctgaagtgttagctgtttgatattccttggtatatgtagaattattgtgaaatatgttttgttatgcctttgtttgtattatgatgtacaatcaaagtaaactatttgcttcattcaaggaaataaaatgttgcgtaatgccttcggtgttacatgtttgataagtactgtgatgtaatgtaccgctatccagcaactgtatgattttgggtgttaagtgttactgattgaaatggagaaatcaaaaaacgaattgggctaattatgattctgcattatagcagtatcgacaagcaagaagtcatgtcggctgcagaagaaacttgaggccgaaatatgctcgctggccatttggtcagaaaagtttactttgtgaagtggatattcatggagtgaccctagccaggggggaagaagcataccaagtcattaagctagctccacatggtgtgtacatacggtggcatatctactcggtcaacttctcaaacttaagtctcgcttcttcatcactttccagccttgcgccatactatcaacatctgcagtaacaacagaacttttacatctacctgtatagtagtattaatttactggccttaattgaaatagaaacatgtatttgctagatttgaactgtctgaaaattttcacccaaaattgtacattgctaagcctaaaattatagtgctacgtgtaatttaagttcatttgaactacattttttttttgtaaatggttttgatttatgcttatccaagtttgaacattttttccggtaattttgtaatattaattgcaaatttatttcatgtttatgttagaaaaaatgttgtttaaacttttatctatgaaagaagagtcatttttaaataaataatagaggattgatgagagccattgaaatatatatcatccaagggtgagaaacccgctttaaatttttgaaaaatttagttgcccgaaatcttaacactccttattgcacacctccagtatttaatagaaattgagtgatatattttactgtcgggctctatttctctccacgtatgttaggcgagcgcacttagatcccaaatgatggaggcaactctcgggcaggttgggcggccatctgcactacgaattaccatcgatgtttgtaaactagttgatctttgaaaacactattagctgcaatgattgcaatttcgggacgaatttttggaaatttcggtaatttcgcccccaccagcaagcacatatatctcctgaaattttcagtttttttctcttttttttgtgaatttggtaaaagtttattcaaattcatccaaagtacatcaaattttcaaaaaaaaatcggcctaaaaataccgaaatttcggtgatttcggttctttagccccaccggcaaaagcccctgtttcaaaattgcaaaccctgattagccgtgccactagcttccatgtaatcaaacacaaatattttactaatatgaaatctattatattattaaagaaatagaaaaggaagcctccacgttcgctctcatggcctagaaattctcacattaatcgaagaaaaagaaaaggcagagtccatatagaaatataatttagaaatagttgaaattcggaattaaaaaataaggaatattagaagtggagactagagtccatatagaaatataatttagaaatagttgaaattcggaattaaaaaaataaggaatattagaagaggagactagagtccatacagaaatacaattaggaaataactgaaattcagaattaaaaaaggaatagaagtagagcatagagtccatatagaaataatataatttcgtaattaaaaataagaaatattagaagtacagtatagagtctatatagaaatacaattaggaaataatagaaattcggaattaaaaataaggaatattagaagtagagtatagagtccatataaaaatacaattaagaaaataatagaaattaggaattaaaaaatatggaatattagaagtagagtatagagtccatataggaatttaaaactaactaaaattcggaataaacataataaaattaaaagtagagtttagagttcgtataaaaatacaatttacaaataactaaaatttgaaattaaaaaaatatgggaagaagagtctaaagttaatataagattacaatttagaagtacctgaaattcgaaattaaaaattaaagaatattaaaagatgagtttaaagtccacatagaaatacaattataaataataaaagttcagaattaaaaataaataatattgaaagaagagcctagagtccatataggaatataatttacaaataactaaaatttgatattaaaaataattaataactaacacatatataaaatacaatatgaatattatacattagtagttttgtaaaggtagtacaaaatttaaaattatgtagtcattttaatatatttgaataatacattgagaaaacatatatgctattatatgacagaaaatataatgatgctagccgcgcaatatgcgtgggccaccatgctagttttcaaataaaataagtaggagattagagaaccaaaacacgaagaaaaccggccactgctaccccttttgttccttgctatctcctcaaagaatcgcccatgtacgcgcaacaaaagaaacccaaaaaccaacttgccatgcaacctctacgtatgtacacgcgtacacacctccttaacctctcccgaattccatcttctccggcgatgctttgccgcccatgctttgctgcaccaacgagctccatcccatcgtcgtcgaagctcgccggccgccgcacacgtatatataatacgccgccatgtcgtcgcagccgccgacggccaccgcgggcttcatcgccggcggccgcatccggcgcccgctgccgagggagcggccgcacctgacgcgctgcaccaagcttctctgctcgtggttcctctccctcctcctcgtcgccggcgtgctcctcttcgtcgtctacctcgtcgtccgcccccaccggccgcggttccacgtcgccgcgttcaccgccgccggcgtccagtccggcggcggcccggtggcgctctccggccagctgacgatccacaacccgaaccacgacctcgccttcttcttcggccgggtgtacatgtcggtgcagtaccgcggcgacggcgaggtggtcgtcgacgggaaggacctcaccggcgggccgctgtacgagccgccgaggggcacgtcggcggtcgggttcgagggcgtcgccgtgccggccggcgccgccacggacatgatggcgagggacgctgccgccgccgcggcgggcggcggcggcggcggcgtggcgttcacggtgaaggtccggtcgaggatacgggtgcgcgtggcgttctgggggtcgcactggcacccggtgcacgccacctgcgacgtcgtggtcgggcccgacggccagctgctgccggagttccagcagaagcgatgcggcatcgacttcttctagcttaatttagctagctacttagctactcctccgtcccattttaagtacaattatgagttttcatgctcaattttaatatttcgtcttatttgaaaaaaaatatgataattatttttttatgagataataaaacatgaataatactttattcataacttatgtttttaatttttttaaaaaaaattaaataagaagaatgattaaagttgagtgtggaaaattatggctgcacttcaaatgatacgaagggagtagaaattaaattttagcattagcatgtagaattatttacaataatggaacatgtggtaaatcgatgggtttttggaactatccattcctgacg

SEQ ID NO: 50419 - DNA, 7135 bp, Oryza sativa
  unsure (1)..(7135): unsure at all n locations
atgtaaaaagaaggctcagttgtgtctgaccaatgggcaagccccctcccagacatggcatgctatgctagccagaggctagagcccatcgcaagctaaatgaaaagtcaagtttgaattttcaaatttaattttgaagttgatttttaaatatgttcaacataattttttttcagtattagtttttaagttgttataaaaacacatatatacaaattttacctataaattaatttttattctctaataaactatgagggttatgctgttcagctgttgggcctttaaacaacatttacctttacgggatagtgctgaatagtgggccacatcctaaattcggtccattaggaccagacagcaacacgcattgcctacgtaccctcaaacaattcagataagcaggtaaacaaggctgcacataacacagattaattgctcataacagaggatatttgcaacattctcgtcgtacaactcctagttcctacttgacctaaggctctgggctgacctgaactttggctaaacaacggcatacatctgcactacaccaggcaaatgcatggggtgatgggagtaacatttatatgcatacacatctcgactgaaatgaagtttaacagctcccaaatgcttgatacaccatgttggggctcgatcatcagagcggttatccttggtcagaagcaccatcatacactgcctgaaatcttccaccggcgaaagctgcatgcaacccatctcaacagttcactgcagcataccatttttcaagcaattgcacatgaatagattggatgaggatataccagaactgcattgatttaataagtgaaatttcaacagcgaccttcttttgtcatgtaagagcatatagcaaaaagatgtgaggaatcaagttcctaatgagatatcatcatgattatatggacacaaactataacgcacaaacttattaagtgatccaaagcatgcaatcacagaacaagatattcatgattgccaatgggatcaaaatgtttcaattacaaattacaagcatgatctaaaacatcctaaagtgatgtagctgctaagattgcacatgaacatgtaagattctaatatgtacttccatataaagttactaacattgtaggctttggtttctgacattcatctgatcatatagtatggttccaaacttccaatacaggaaaacaaggaaacaagattctggtaataagaaaacatggactaaatcacagtgtgttcacactaccaaaatcacaaagataggatggagctgagtagcaatttatagaatcttaccagttttatctcatccaatctcgagtacaaacaagtgcctcgattgttctgatgtttaatgtactctggtgctttggaattactggtccactgctactgaatgctgcttcagattgaacagcagatgctggcatggctaagatgtcccgtgcaatagttgcaagtgttgggtacttagtactatgagtcatccaccagtttaaaatatcaaaatcatcctttctaggaactaaaccatcttcaaggtaatcatcaagctccgaagatagctgacgacttgcttgttcatggagatgctgatcccaatcttccaacgaatcattatcatctgcacacaaagcttcactgtttgaaacaacatcacttgcctgattcaaagaatggcagtattcattgaagagttcccggactgtttcacgtattacagataggtagcttgccgaatctgttccaaaagctcgtttcagacgaaactcaatgaaactgaatttgaatctagggtctagcacaacaggtatggccaaccacaaatatgaattttgccaatactcattgaatgcttcctgcatcaccatagccactgtagctatttctctgtgatcatttaatgcttcttcttgcaaaactgtcctgactttccatatctcgttaaaatatatatttgctgtcggagagctagggctggaaataacttcaatgacacgataaattgtcctcaaaatcttgcaaacggactcagcagtttttgtatcttctggggacaccctttcttcagaaggaaatgacttcttgaaatgcaaaagcacttcaagtctaaaataaagtttgtgccaccacttagcatcttcttgtggacactttagacccgtctgtgaaataacttccagaagctgctgctgggtcaatgacactaaaaaatccattactatgtcaccaacaagacgaagtatatctgcttgcactttgaaaacaatactgttaaggacatagtccacacaggcaacattgaatagcgtccctccaataggaaggcacttcttctctataagcatttcctttagcaatgaagtattggtgtcacccctaacttcaccaacagaagtcaagcttaaaagcttctgatcaagattccaatctctaatggcatccaatatgacattatatgatccgctctcagactctgggacacaggcttccatacaatgtatcatcctttccaaatcagcaggcgcggaccaaaacattccaaattttattattatcctatgaactttccagtcttcatcaatataatgtgctgtcaaacagaggtaatttactgttgtctcaggtccatcaggagtccagatgcttgctgacagagagacacgtcgggaaaaatgtgcaattttaccctttatattttccttttccttctgaaatagtgtcaagcaatgttcttccatagcattgcgagagactaaattgaccacagggttgagtttctttacaaatctcatcatttcttcgtgctccacaattgacaaaggataaccatgcaaagctatcatcccgactaggtctggatcagatgtttcctgaccagctggagtggtcacaaatgaggtcctctgtttcatcaggcttgtataatctggagtcggcacggaatgctctgctggtaccactcgaatgggcttaggggtcgagtcaccagagctacttgccctcagaagcttgctagagtattctgcgatctgaaccttcccatttgtcaaggcaggtgagagctcatcttgcaccctggacttcaaactaggcacgctagaaggataaaataaacccttctgatgaatttggccccctccacgtccacgtcgtcctgcacaggttataagatgtcgactcagatggcttctccccccgaacttattcgcactgaggcgcttctggcagtgaatgcaatctgcagcctggagtttcccctcaatatagacaggtgtaaactccttccacacctttgacgtgaatctgttaccgctgggtgttaccgagtttatatcactaagcgtctctgtaataacatcattgaccggatcgtggggtgaaactggatcgttctcattcaccaaaactgtgcatataaaatatggaaacgttatttatattcctgaggtaaatcgcctttataaaggaatatctacatctcaagatcctaaaccacaccaatgttaacttatctacactattgagtaatgaatgaacccagaataggcaagaatggtataccgcatgggaagtaggaatccttctgtcgcctctgcgccgcttcctccttgccagggcagattttctgatgccgccatagatggcttgtgccgttggaatctttgcagctgaggcgattatggcagtagagacactccgcaaactgaaccttcccattcagaaagatgggcttgtactcctcccaaaccttggaccttttcttgtgcctgtaccggaacgggctgtgcactccatcaaatgccacatccactttcatgctgttatcctcctcatgctcctctccaggaacaggatgctccatagtgttttggagtgaatcatgatccattcatgggcggatctaacatggggcatggggggttcagttcaacacccccaaactttttgggaacaaacaaacatcaaggttaagccaaatttctgcaacagaagctagggttaacgcaaattcgataaaaaaaaagagagagggagagatgggaaagaggatgtgctaaccaggatgcggcggaagcagcaggatgctcgctcgcgggatggatggggggatcggcgcaggcggcggcggcggcggcgaaggatgtggatgcggcggaagcagcaggacgagcggcagcgccgcctctgctcgctcgcggggcggatggggatcggcgcaggcggcggcggcggattgcctctctaaacccgaccggtgttcgaaccggtgaatgaatccaccgattcaccggttcaaccatcggttcaataataaaataataaaattatatattttattgagagaattttggtttaataatcaacataaaatatatatttgtttcgttttctaaaaccattatagcaactaacctaaatagtcaggtgcgcacgcatgtatgcaaatagaggtagcaacgagcccaactattttgattagaaaatttgagggttaggtctaaaatacgatgcgttcattttttatacatttttggtatgaaaatatttaagggttatgtaaggttgtgaaagaacccatgggccttgaccgtggggggttcaatccctacgccaccccaattttccttcggttatgtagtaaaccatctgggtttaaatgatttttctcaagtcagttatatcttcggactaggcattggttttggtttatttggttaaacccttggttcagttcgatttttacaactagactattgagatgccactctttttggatgaaattacaaaaaatgtcattgaagagtaaatctttacatattgccaatttagcatatgtaggacatgtcacattgccaatatggaggggcatgaaaatgacccatttgccttcgtgtatattgagtatgccgataaaatacacctatatacaaacatatatctaggtccaataggtttattgtacttcaaatatttttgttacaaatttatcccctcatatcttgttctcattactaaaatttttgcacgggataaatccatacaaaaaattgaaacatgacaaaaataaaggttcactgctgatattagtactaagtgagatatcagaggaaaaacttgctcctctttttcatactataagtcgttttgacttttttacaaactttttaagtttgatttaatttttaagaaaatttagtaatatataaaagactaaattagttttattaaatctagcatttagtatattttgatagtatgtttggtgttgaaaatgctactatatttttttcctacaaatttggttaaacttaaataagtttaactaagataaaaatcaaaacgacttataatataaaacaatataaaacagagagtatattggtagtacatatgttctttttgaaaattatttatgtatacatattttggtcgcaaaacacccagtccaccagtagaaagatggtgtatgtgacaacagcaaaactttgcatatgatactacatgagtcacatacagatgacaaaaatgttattcctaatgactgcacttgaagttttgaacacagtgctacatgtgacattccagctacaaaattttatatttgctgcgtgtcagctcattattccagaatccacctgtatacaccccaaggaacataaagatgtacacaaaaagaataatgaagaggaagtacagcattagccacttccaagttttggactgcacgaacctatacacaaaaaactatgtgcaacttagatcaaagttctcaattttgtcaccaaggattgcatgctctctagcttgtcattcaattgcctgatgtcttcggcgcatttctgatcctccacaccgctcgcctgggaaacgagggctgtacatttggccttggattctaagatttcgatttgtaatgaagcaactgttgattccagtaactctttcgttcctgcatctgtagttgagtgcagattaggagtcctaggagtacctatgctgccaaaactgttctgcctgctcaacttcctaggtgaaaaagtattgtcgattcctccgcttcctgggacatcacaatttcataagataatctaaaattgttttgagaaaatgaagtaggtaagcattttccaaaaaagaatcagttttaacagcataaattgtacgagggaatataaaaatacagtaacataaacaagaaagaaaagcaatggcatataaccaaataatagtgattgctgcataatttgctgaagcacaaagcatcagatcaaaataactcccaggtggcatttgttgacagtatacaccaaggcaaaaacccccgatgaaaaatttggagacagttttgtcttatctaggattgttttttcgacttgggcataaaaaaccgtaactagatctcctctttgcagcatttaatgacccaacaaaggagttagataaagaacactctatttcatattataaatcgtttaacttttttcatagtcaaacttctttaagtttgaccaagtttatagaaaaatataatagtattttcaacacaaaacaaacatattatcaaaatatattcaatgttagatttaatgaaactaatttgatatttgaaactaattttttctataaatttggtcaaacttaacaaagtttgactatagaaaaagtcaaacgacttataatacgaaacagaaggagtagctgatagcagtgtattactagtaaaaattcatagcaaaccaaaaaggagcaaaagaaggggaaaagtccaaaacacagggtagcatggcatctacaagaaaataaatcagggtacatgtagggaacacatacctaggttcctgagttgttctatagtcccctggccaagagacttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50420 - DNA, 2000 bp, Oryza sativa
ctgtgtattctgtcttcctgtgataccagcactgtttcctgggactggtatcgatcaacaggttaatttggagcgtcacgggctagttccggtcgggactagttcggggcgtgacaggatatatccaggatctgcgtggattgcatgatggcgatatatggaaactgcgtcactgaaggagaagagcaatcgctatggtggtaatttcttcgggtgattcaaggcaaccgtgaattttctcagattatcaggaattcagtctacagatgcggtaaagcgtggatgttggatttgctagctttgttcataagacgataaggaagaaaaggttctattcaagtctggtgagtttgatttatctatttggtgatgacgtcagttaacgggccatggattagatcaagtcaaatttaagacggtagatgaagttgaacttggttttcggggagtctatgatatgacagctaggaaggaattcaatttcgcttggcaagacgactgtggtgatatgagagaaggtggagcactgttgcaggtggagtcaagaggaggaagttacagggatagcagagtctcttgttacggtgagcctggtggaggcttattggggtagctcggtgtgagcggcgaaaaaggatcaactcaagtcttggtacatggaggttcgagcaagtaatgaattcaggttggcgtggcatattcgccaaggtggagtttgttagagtttgtgtcgaatatgtgtacgtagtcggttacagtttaggacttggagttgtactaagtgtaggactagagtatgagtcggattttatcctaggatctctcataaatagaggggcgtgcctgttgtaaccgcatggcgacttagcatagcgagagggagcggttgccgacgtcgaccggccgtgagtcgttgtaactctgatacgttgtatatgctggatcggggaggagcgcccgtaatcagtgccccggagatgtaggctacggctgaactccgttaccaaatatcatgtctcggtgtcgtcatcgttttggatcttctatggcgttttcttccgcgtttagctaccgatgtcgatttcggggctggttttataacattcgagccggataagtagcactgctttctattgatgaaaacttgcttgcacttatccatatttttttttgactgaaaaggtagagaggctctaccttataaccattgtattaatggtggtcaaaaaagatataacaaaaatacattcaagcagaaaggcaagaaaaagaagaggtagaaaagaaggaagaaagggattagagagaaccacaaacaaacagaaaaacaacatctatgctagtagagctgcccaactacatattggcggctgacattgtggtttaactcggtttttccataagtgtaggcagtccttgatttgatgcgtcacattagttacggagagttcttcttctctgaaggttctatgattgcgtgcttttcataagctgtgtgaacaggcagcgaagcatattggccatcccagtttaagttgagtcggtagaattcccaggacatgctcggtgaactgtagaatgtcagcactctgaattgcctgatcaaggaggttgagtttgttccagatttcagtggctaacttgcagcgtagaatgatgtgattagctgtttctatagccgggcaaaccgcacaatgtggatcagatgcccagcatttcttcaccctgttatcatttgtgtttagccttccccgaaaggctagccaaaggaagattttgcaggtgtttggtattgctttaatccagatgaagtgtgccgggcgccataggatgccatgatatgttattagctcatagtatgctgttgtcgtaaatccaaccgggctcagtgtacagcttctgttatctggtctttcaggatgtatctgctgggattgtaaagtcgtcataagcatatctaattcaagttgagcttgggtggagatcaccgggtggagatc

SEQ ID NO: 50421 - DNA, 16858 bp, Oryza sativa
ctcactacatattatgcaacatgtggttcaaaaattacatctggcattggcacattagcgccttgaacagattaagctgcatcccttggacagtaccgatttcatgtagttggtgtcaatagaagatttacctaaaccaatacaccttttgtcagctcatatgaggattccatgtagttgggcaggatgtaaatattcggaagagatggacatttcaaaaatctaaccagtttatcatggaaagcaatgagaagaaaaatacataacagcacaacttgatatgaagaataaaaaacaatgcccttcaaacattatcaatttaaatgtttagaaaacgtagaagttctgaagccttaagatcaacaaagttggattgggaaagaaaaatatttcccaatggtaattccaatactagattgaaggaaagaacatggcatacttaataaggaagttttcatgaatagcacaaagaactgacacatgagaatcaaatggtaatctatttgtagctcaaacaatgaaaatataagttctcctgcaaacttgtactggtgtgctatggagtgcaggtcagttgaataactaagcagtaacatggaagcattcttttttgccgggtcggccaaaggttggccgaccaatttcattaagattggggaggaaaacaaaggaatgttacagcgacattacaatgtcgcgctagtccgggagagatcccagacacatcgtgaacaaacgaaggagaaagagacaatacaacaacgattactcgccgaattgggagaagatcccagctaccctccacatcgcgatttcttcttttatatacatggaagcattcacatccattaaagtgcaaatcgtgttcaggagtcaagatggcaaaatagtttaaaatatttggagattatggaagctataccttcaagcatattactactgcattgttggttccaaaagctgggtcatatatcgatacatatcaagcaatccaacaatcatagttatgaatctgaaagttaaaaaccatacatatcttcatattactactttttcgtgagtagaacataaaacagctaaagacgtacctctcatattaacgcgttccatataatattaacctgagatctgaagggactccacaatgaactaatatgatgtaatggctattcttgtgagtgttctgtacaccagtaaatttcgttaagcaacataactataagaatgaaggattctagtacaccttgtatgtgtcagaaatatagcactggagcaagagaactgcaaaccttaatccaagtagcaaaacactgaacactcattgttttccacagttgttatgccatgactagccaaacactactaattcctcataagtgacaacctgccgaaaaaaccccaaaacaatagtgtgtaatctcaatgagaagttactatgaaatgacaataactgtggatcaaattagtatttgcaaactttgagaaaaaatgtcaaataatgatttaggatacctgtttggaagttcgctgcaacaattcccggtaatagagtgcaaacagtctaatctaaggcgctttggttcactgcataaatggatgaacaaaatgaagagcaagtcattgaggatagcacaagggaagagatttgtagcttgcagaggctgcaaccaagacatcaaggtcctaggagattcagaactgattttacaacctgtggtccaaaaattacgtctaccattgacacattagcattttgaacagataaagttgcatccaccagaaagtaccattttcatgcctctgtcagtagaagaagactgcctgaaccaatcacactttttgtgaggacatggggattccaaggagatgatatacagaactgaagtatcattgtaataatataatttgacattaacttccaacagtatgcatctaattgtaaaggaagaagattaatagtagtgaggcacttacaatgttaccattctgtcactagttaagcgagattgcaagtatgaagttgggcagcacgttaaatactgtgcatcctgatttagtggacataacaaaaaaaatgaattactttgacatggacatcagtgagaaggcaattaagtaaccgtacaactcaatatgaagaagccgacagaccggagttacagaggttcaattgcgcttcaagagtgtgctaggcacactagtttttcttctcttcttttgaccatcgtgtcgttcacttgtcttgccattgtacagtttgttcccttgtttgtaatattcatccagtgataagagggtggaatgtttccaaaaaatagataaaaaatacacaattttacttcaaatatcagtactgtacatgttcagaaattggagatgttctgaagttttaagataaaacaacatgaactaaaggaggaaaacattttccaacggtgtttactagatcgaccatcaaggaaacaaaatgacatacttaacaactcccaggaatggtataaattagcgtcacaggtggatcaaatagtagtctatttatagctcaaacatgaaaaataaatactcctgaaatctgttctgctttgctggaatatctggttagctaaatacctaagcagtaacacagaagcatacccatcttccgaaatgcaaatgttcaagactgcataccatttgagaacactgagagtatgggaactaaaaccttcaagcatgtaactgccagtttgccacactgttggtttccaaagctgtgccgctgccgcactatctagcaatccaataatcgtagttctgaatctgaaagtttggaaccatacgtcagttcatattactactttttcacaaggagaacataaaaatagttatacaactactgtttcatgagaacatgttgagcataatactagccagagtctgaagggactccatgatgcactgatatgatttgattgggttttcttgtgacggtccggtacgccattaaatttcactaagaaatggtaactaataaattaaacaatgttagaacaccttttatagtagcaaacgtaccactggagtgaaaaacaatatcagttgcagagcactggaatttaccatgttccaccattattatgccgtgatgatattttgatccataatgtatgtcagtgcaactagctgaacaccactggttcttcaggagtgatgaccaaaatataatacaaccgaagtattaagaagcctactggaactcacaaaagaacacctgcacaacaaactcccaaaacaatggtgagtaatctgattgcaacataactctgaaatggcattaactatggattaaattagtatttgaatcttatgagaaaaaaatctccaaaatgatttaagttacctgttctcactaattccactactaaagagtaaaaattggaaactggtcaacttagtgcatctgtttgatatagtgtttggaacatcttacagcacaagtgaatttacaggattatgcaactaaccatgaacattttttcacataacagaaatggtttacatcaactaaccataacgattccctaaatacactgatggtactgaaaaaccatgcaaccttaaagcataagattaagatatattcgtttttaatcaaaggcaagtgtacaacaacagcaacaattcatgacaggtgggatacctatatggcatattggcatctctttcttcagtatggattttaaaaatgtttgttgtgcatgcatggaaatggtacatcaggagtgaagttccattctacatctacttacataatatatgtacaggaagaggatattgcacaagatcaacagatgatgccatggaacttaggtatggggaacagggaagcatttgttacctttattagtctagtatgatttctgggatggttccctttagcttcctgcaccgctgtttgaacttctcgttccagctagctctgacatctagttcttgcagtgaactggggaggccacccttgggcagcgaccggatggatggacagccgatgatctctaatctcttgaggctggtaagtctatgtagccccgcagggaggcactgcagattagtgcatccccaaaaatggaggtcctggagggagatgagaagctgaagtgcctcctcttgctccttcgtgaaacgctccacctcgtcgttccatccaaggactagcttggtgagggaggaagagaggagtctgcagatgggcttcacgtggacacctgcgaagtcatccgtatgaagctcctgcagcttggaggaacactgaagaggagaaagctgctgctcttgtccgtcctgcagccccccgagtatgggatccaaaccagcaaagaatctgggtgttccaaagactcctaatacaaaattgaacgttgtgatgcaaagcaatgagaaacaattaagtagccacataacccgatataaagataagaataatacaatgatacttgtaacatgaataagtagtcctcctaacctgtacaacgctgcagcggaaaattatggtctgttcaataacatgaaagcattcatataatttgaagtgcaaatagtgtccaggactacttggcacttgaacacacattgagtctatggcagctatcaggcctgtttattgccacgctattcactttcaaagctgtgctagcgtactacagcgcacaactagcaagcaattcaaaagtcatacttatgaatctgaaagtttgggaaccacatatcagttcatatttctacttctctgcaaatggaacataaaacaattacaaaagtaccttccataagaacctattgagcataataatagactgaaatctgaagggactccatgatacactgacatgataagatggttattcttgtgaaggccctgttcaccattaaattatgttaagcaacaatagctatgactaatgctcaaaaccttgtatgggtggcaaaaattaaagccaaaagcaaatatcaaaacgctggaaattcatcgtaatcaaaacactgaggttgcaagtgggcagcttgttgaatactggcatccttatttagtggacagaacaaaaatcaaattacttttacatggaaagcaatgagaaggccattaagtaatcacataactcaatgttcagaaaatggagatgaggagaagaacattttccaacggtgtttactagatcgagcaaagaaaatgatatacacattttccaggaatggtataaaattagcaacacagggggatcaaatggtagtctatttatagtccaaacatgaaaaataagatctcctgacatatgttatgttgtgctctggaatgctctggtcaactcaaagcagtagcatcgaagcattgccatcatttgaaatgcaaatgttcaagactgcgtaccattcgagatgagactatgggagttataccttcaagcatgtaactgccacattgttggtttccaaagatgtgtttctgccacatctgtcttgcaatccaataatcagatctaaatctgaaagtttggaaccgtacatcagttcatattaatcttcataggaacatgttgagcagaatattagcctgagtctgaagggactccatgatggactaatgtgatttgatgctattattgtgatgccattaaatttctctaagaaatggtaagtaagaacttaaatgctgctagaacacattttatggtagcaaatatagagctggagcaaaaataaatgcaaaccttaatatcagttgcagaacactgcaaacttatcattttccacagttattaagccaataagccatgatggtattttgatccataatgtatgccaattcaactagctaaacaccactaaagtcttcaggagtgacgaccagaaatatgcacccaaagtattaagaagtctactggaactcacataagaacacctgcgcaacaaaccccaaaacaccggtgagtaatctgattgccacataactctgaaatggcattaactgtggattaaattagtatttgcaacttataagaaaatctcaaaaatgattttaaatatctattcttattacttccattactacggaggaaaaattggaaacatccattactaaagaggaaaaattagaaacaggtcgtcttagtgcatctgtttgataggaattaaaatatttgggacatctcactgcttaagtaaatttacaagattatgcaactatgtaataccattttttagataatggaaatagtttgcatcaactaattaaccataaccattccctaaatacacagcccgtaagaaaaacactatgctaccttgaagcataagatatattcatgtttaatcaaagacaagcttacaacaagcagcaacttgttcatgacagggatcagacctatatgacagctgtttcttatatatgggttttaaaaagttttctgggaatatctaggcaaggatatggtacatcaggagtcaagttccattcaacgtttacttacaagatctatgtacaggtagaggatatcacatgagatccacatgttggggaacagtgcatggatagattgtgaagttctacaaggctacaggaatgtacaacttgaaggcagtgccctgcatgacagattgcaaaaaacaaacatttaatcagattgtgtagtaagtactacatcaaaaccccaacagatgatgccatgggacttactaggtagagggaacaaggaagcatttgttacctttgttagtctagtatgatttttgggatggttccctttagcttcctgcaccgctgtttgagcttctcgttgttgcagtatccgacatctagttcttgcagtgaactggggaggccacccttgggcagcgaccggatggatggacagccgatgatctttaatctcttgaggctggtaagtctatgtagccccgcagggaggcactgcaacttactgcatctcaaaaattggaggtcccggagagaggtgaggagctgaagggcctcctcttgctccttcatgaagcgctccacctcgtcgttccatccaaggcgtagttcggtgagggaggaagagaggagcaagcagatgggcttcacgaggacacctgcgaagtcatccgtcctgagctcctgcagcttggaggaacactgaagaggaggaggaagctgctgctcttgtccgtcctgcagccccccgagtatgggatccaaaccagcaaagaatctgggtgttccaaagacatctaattcgctgagctgaccctgggtgaggagaggccacagaccctcgcatctcaaatcctccccacaatcatcgatgtgtagttctgtgaggaagttgaggtttgagatgaaatccagggtctgcacgccctccttacagccagcaatcttgaggcattgcagggaggacgggaaagggcagcctggggcctcgtaggcggagagaaacttggggcattttgtgatttgtagggcgtgtttggttgctgccctggcgagtatttgcctggcctggagctagccagagcagtaagtagtagtgtttggttgcttccctgaacggtgtctatgctccggcaagggtgccggactcaggccaccaaaaatgaacgcctgagtcaggcgtgggtatgtgtctaatcctcccccattgattcttcattgatatgactgttatcaacacttgtcaacatcttactcaagtaaacaaaatgtttatatataatatattcactcaggcgtaggttttcaaccaaacaacaaaacatcacacatgcctaatcaggcacaataaaacacagcttttctaccacacaggcatggatttttctcagacaagtcagtcaggtcaccaaccaaacaagcccgtagtctctggagggagcgcagggattggagcccccatcctcctgtctcatcctcgtggctggtgggaagagcaggacgagcaacatctaagataagctccgggcatctgtagagaattagttgttgtagagagttggagaggtgtgctgggaagatcagcatcccatcgtcatcttcttgatccatggctagctggggtaccactccctcttcctccaccagatcctctgctacttgctgctgctgaatagattcgactgcttgtgtatcctccagctcaacagcagttgtttgctgctgttctacagctatacacatccgtgtaatcttgttgcagttcataagatacaactctgagagctttgggagatgagagagaagctgtgacaatgctttcccacttccatggtagctagaaatagataggtactcaactggaacttgccacttatagtcactcaaactttctgacagatggaacacgacacttgaactatcaagtctgagtatcttcagtgaagtcaacatttgaaggtaacaccccgccaaaggtgggcaattattgatcatcaactcttgtagttgggttaaattatagaaagccagaatcttgtcatctaagccatttagatctgtctttcctacaatcctcaagctgtatgtgctcatgtagtgtaattttttcaaccttgtccctacatcctttatgtatacaaagcacaaggtttgcgtgtaaggcataggaggcattcttagttgtggacaattctcaatttcaacctctcttagcctaggaaacaaattctcatatccttctgatgggcaataagtacaatatgaaaatggtaattctattacctcattgcaattctttacgatgagcacttctataagtgagaacatcgggacttcttttgccgtccactttctcaaattaggcaacccgacaagttctagccttttcaagttctgaaagctttgtcctgtgttgcagctaacaaattgatcttcaccaagtccgtttaccaaacacacctcccctatcggcggtaagtttttccatgttacattggaaagatgaagagtctccaaggatttcacagagagctctgcacctagccatgatgggcaagtagatcctccatgttcaatgatgaatagctctttgaggttgttacatggtcgaaggttctcaagtacttgatcttctttgtcaggatacctacttgcttggcatttgtcccaacttaatgccaacttcagtaagtggttcttatcaaaaagttttgcttctgccgctgcttcttttgtgtctattctctcaaggttataaataccaagtcttcttagctccatcaaatgacctagttgctttagttcaaaacttttttcctctttattgacttcaaatctttctaactcttgtaaaaactgtagttttcccacatcgcaaatagcaaagtgaagcttatcatgtttcgtaagaaaatggcataactttgaaagattgctaaagtctctaggcaaatcgagacaaccatcccatgcttctagatctagaatcctcaaatgataaaatctagaaagggcacttgttaaatgagttttacttcgacgtggtgcccctagccttatgtagcgtagatggactagtgtcgagaatttattaaaaatgaaccccacaggaaatgacattttgggcaaatgtagaacacggagagcacttgcttccttgaacaaatcatgaaaactttcagcaaaactttcatctagttccccaaatatcatcacagtttgcaagttttcaacctttactcttgtctttagtttttgtaatatgttcctaaagctttcattgttcattccatcactatcatccacaccatctgtattgatagacaagtgacgaatggaaggccaaatttccactgatctcacattagaataatgtaaactaacacactcacgagatgcaaccttcgctgctaaattatgtagcaggtcatgaataatatagcatggatgcccatcggtttcatcttttttgaaaaatccatggctgaccaaatcatttaaattgttcaaagctatatcatcatttgttttattctgatattcagaatgtaaaatatctagtcctatccaaaagcaagtaagttcttttgtgtcaaacttgtaatcttcaggaaacaaagcacaatagaaaaaacattgttgcagatgaaaaggtagataatcataactaagctgcaatgcaggcataatgtcatgattgctggtttccatttcccattctctactttctaggactctgttccaatgatattgatcaaagtggttcctcaatagtcgacctactgtttttgctgcaagaggggaaccttttagttttcctgcaatcttatctccgatcacaagtaagtctttatggacgtctcttggtagcttatcaccaaatacatatgctaggaataaatccctaaacgctccagggtccaaaccttccaaatctactgagttatccattgttttaaccatttctgctacaaccggaaaccgagttgtgactagaattatgttaccctttgtctgtccttttgttagtggaagtaaaagctttttccaatcatcactttgacacttccaaatatcatccaatatcaataaaaatcttttagacttcaatctttgttcaattagctcttctggtctaccatctttttcaccatccactttagggacatattgtttgatctcttctatgagcttatcaacactgaaattttgagaaacacatatccagaccttgacctggaaatggttttgcacttcaaggcttttatatatgtattgtatgagagttgtcttccctatgcctcctgggccaacaatcggcaagacagtcaagtccttgccgcagtctgtaccttgggttatataatctattatgctcttcgctgtatcatccctcccatacagtttaggctctatacttgtaggtgtggtgatgggacgattgctcgcagtactggaatcagtgctacggatagaatggtgtatctctagattaagaatagtggtgacctttgcacacacgagctgcagttggtcgacaacatccttcattcttatagacagacccactctgtcaatcttcaactttggcgtttctttgatcacatcctttctctgttgtggtggcttgtgcatgcaagcaccacaacagattgaaacgctagaatcatcatcaacaacagctggaaaagatgagcaatggaggcgtttaccgacagcatggatggtgttgcgagcaccggaagcaagcttgcggatgccgccgccggtggcctcctcctcctcctcactgtcatggtcgttgtatgaccaaccacagcagaggccacgtccttgcgcaccttgttctgatcttggataggtgtgactaccattatcagcagcagcagcacaggagcatttagagaatcccagccgtttgctggcagctttggcagtgtgggtgacattgaggaagaggttgcgggcgcaaccgccggcgtgctcatcggcggcgtggtaggtgccgtcgagctcgtcctggatgcggaagtagtcgagctcgtccagcacgtcgtcagcgtcgaacgccaggtctcgcagcttctggaggagctccttgagcgcagggctgcgtatgtctttgccctgcgcgttgtcgagcaccccctgcgcgtagagcagctccatcttgagggcgtccacgttgggtccgagctcccggctggccgcccacgcctccaccaagccgtccgagacggggccgagggccttgcccaccacccaccgcgccgcgctcacggcggaatccatcgatccgatgcgcgcggttgcgcttcagtccaagatgctgcatgcaaaatcgagaagacgaaccattaattctcactcaaatgcaatcgaatgaacagtaatatgacagtggtattcagctattgttgattcgtggctgctgttagaggagagtggatacgtacgttacgacttacccaaggccgtacgtgcttctgcggcgtcggcagtcgggggcacgaaggtggagcgctcaggtattgggggtgaatgcttgagagaaccgtgcaaagagggtcgagttgtggcgcttgctttggagacgggagtccggagggaagatgctggatggaggctgctaaattactccactaaccttgtctgtttttctttttttctaaaaaaatatatttcctcggttttcacaatgctagatgttttgcttttaaataaatttatacatagacatatgtatatgctctatatatgtgtttagatttatatatgagtttttagtaaatttagaaaagagataaagaagctaaaatgtcattttgtggaacggaaggagtagctatttagatgacaagcggaacaaaggtacatcacattaacaggatgaaaaacaacattgagctcgcttccttcgtcggcgggtttgcccagcttgtttgaaactttcgcacggaacaccaccgtttagtagtttgaaaaatgtgctaacgaaaaccgaggtaaaaatctgaatcttaataaaaaaaatctaggtcctttttttttctaattaagatgcagatttcacctcgatttctgttaccacatttttataaagtgctaaatttctggtaagaagttgctttaaaatatcaaataaaaaataaacctccgtgttcacctgcagataacatgtgagataacatgtcaagttaaaaaaaaaggacagataacatgtgagattgagaccgtcttcacgtggataccacacgtcaatttactctctccgtcctagtttatgaaaaaaataaacctagcatggatccggaaaggagtcatattcatatttataggttgcagcgatcaaaccgaaaaagtgttcacctgcgtggacgcattagtccaaacaaagtgtccttgtacgtagattttataaacgttaccaggttggaaacagattcgacccacataaatgagctcttgacccacagaaatgagctctccgcgcgctcctcgctggcagatctcaagaagaggtcccgtgcagagatactaacaacaatgcagtatagaacttttttaaggtacacttggaaaaaaaaaactccacacttcaacaatgcaatatataattactagaagagcgtgactattggcacgcttacaattttataacctgcacaatatgcttaatgagtatgtaggtttaatagactaacatcataccatttaatatattgatggtattaaaatggaaggggttggatattggctaccggaaattatttttctagcagaaaaaaagctgcgatatctaatccatttttttggccggtgaagcagctagaaaccctgcttcacgatgcccaacaatttttatcaatggaaaagtcgacaatagttatccaagagttctgtgtaaaaggattatcatgcaacggatcaaaggtacatcatggatagcacactatgacaccacggagatagccacttctgtcaacgacagcccctgaattcacccttccttgagttggttcgatttggagaaggagattatttttttttttaaaagaaactacatttattttgagatggagaagttaactctagtatgcatatgcactaaaattaacattgcattcacgagtgctcgtcggttttaagtaagaataggtaatttttgacactttatttttttttaaaaaaaacaactttaaagcaagcacttccaatttcaattctagtgattcttaaaaaaaagaatacaaacccaagaaataagtttgatatgaaaattgttgaaaatggagtttttttaaaaaagtttgttgaaaatagaattattatttttgtttgaaaataaaatctagagtaaatttgttcccttttgaaatagcccgggctctatgggcgcagagtagctcatgctttgtgcaaggaaaaagtacaccgaaggtccctcaacttgtcatcgagttaaaaatcgtcctcaaaccgcaaaaccagatatccgacgtcccttaactaatcaaaatcggttacaataggtccctcggtagttttgatcccggttttatcctatgtggcgctttgaccacatgtcagcgcgtccacattagcctcatctctctctctctctctctttcccctcttctctcccttcctcctctctctctctctctcactcttctctcttgggctctgggcaggccgaccaccaggtagggaggagaccgatggggcgaggcgggagaggaggtccggtggccggcgacgacacgggagcaggggagcaaggcatcggcggcggcggcggtagtggcgctctggcgagctcctcgccagcgcggccgatctcgttgtgtatccaaaagagaaaaggtatcctattcaaatgcaaacccgacggtacccttctgcgagttgcatggtcggccttgaagaggatggcgaagaggttggcagccttgaagaggaggagggcgaaccagtcgttggcgaggcggtggaggagatggcgttgggcgtgggtgcagggggcggcggagtcgaaggcggagtcgtcggagtcgatgtgggagaagagggcgtgggagatggcgatgtggacgaggaagaggaggaagagcgggaggacgaaggcggcggcgatgcgggcggtgggtgcggaggatggacgccgcctccccgtagatccctaccacgcccaggaattgcaactcctcccctgctagttgcgccaagctcctcccccatcggccgcgcccgcctctcgagccttttcgacggtgcaaccctgaggtcgcacgcgcgatgatgctctcccttctcctgccaccgccatgtcgtcggcagccgccgcgagccgcctcccttctccagtgtcgcaaccaccgccgcgagcctctcccacctcaccctaatgacctcctccccacccgccgttgccctgcagagaggagaggagagagagaggagaaaggtagagaattggggaaagagaaagggtgctaaggcggacaccctgacatgtggggcccacatgcgtcccacgctgactcagccgccacgtcagacaaaaccggggtcaaaacaaccgaaagacctaaagtgaacggttttgtaagttgaaggatgttctatatctgtttttgcagctgggggacgattttgtaactcaatgacaagttgagggaccttcggtgtactttttccctttgtgcaaggccctggcccagctaacggcccgcaggtgatacagggagattgcccacgtgggcgcctcccattggacggcactggatgcgcttctgcctctgcccagaatcatcggtctccagcaattcggctcctctctctctctcccgcacctgcagacatcgaaagccaaaaaccactcaagaagctgcaaccgcgtaatctcgagaaaacggtttactcggcctaagacagtgggagacgacggcgacggcggcggcgggaggaagccatggttctcgctctgctgttgggctcctcctcttcttctcttgcggcgccacaccctgcttgctcttccaggtaacaagcgccagtggcagcaacacgcagttgatttttcttggatcaaagttgtataaggctagatcaggtgctgttctattgtattcactgttcgaagcaggcatgtattttgggtaacattcttgatgtcaaagtcatattccacattcagtgatggcacgtaggaggagtcaggttagtacagtacctggatgaaaatgctgataagtaatcttcttattggtaggagaaaatgcagacccgctggacgaaataatttcagatgctctctgcatgacaaggtgccactgaatgctcatggagtattatccacaaaattgctctcatgccttgctgcttcgcttgttttcatctctccaccttgtcaggtacctataaatgttaacttattgtcagatgtatatacactaaggctgtgtttagttcacaccaaaattggaagtttggttgaaattggaacgatgtgacggaaaagttggaagtttgtgtgtgtaggaaagttttgatgtgatggaaaagttggtagtttgaagaaaaactttggaactaaacacggcgtaattcaaagagataacctcgggatcactaagcaagaacagttttttttaagaaaagatatttttactgttgaggattgagagaattttactgctgcaattttgattggatacataaaacttgttaatttcaattaagagaagagggaaaatggagtgagattaccagttcaggcttgtaacatggtatcgatgtactcttaatctctcatagttgaccaggctatccctgcagagacctttgtacagccaaaattgtgccaggttgctgtggtagcagccatcgacaaggctgcggttcctctgaaattcgatagcccttctgatgatggcggcacaggtttgatgatgaagggtatgactgccaagaactttgacccaattcgctactctggtagatggttcgaagtagcatcgctgaaacgtggctttgctggtcagggacaagaggactgtcactgtactcaggtattgtagtgccagaatcctcacacacaaatactagtagatcttaatctgtatgatgccccagcaatatgtacctctgaatcctgattcctgaaaacaccgatatctgacatctttgtatcaaactgatttggaataggttatcacaggcatgctattttttctatgccatttgcaccatataatgtgtaagaagattgttacagaaatttgttggtactgcagggggtgtattcatttgatgagaaatcacgctcaatccaagtggacacattctgtgttcatggtggacctgatggttacatcaccggtattcggggaagggtgcaatgcctgt

SEQ ID NO: 50422 - DNA, 1361 bp, Oryza sativa
  unsure (1)..(1361): unsure at all n locations
aatagggttaagcaaggacttgaacactgagaaatcagagccaatattccttaccttcatatgcctattctgaccccttttggaaaccggaatatcataacattgtgtcgtctctcggcaatgcatcagatatactcaagaacacctaatcctggaccagaattcatcgagaagtacaagtcctacgctgccaacttcggttatgatccgagcaagatcaaggacaccccacaggattgcgaggtgatgtccacggaccagcttggtctgatgatgtcaatgcctgggatgactgaggctttgacgaatcagttcccagacctgaagctgagtgcacctgttgcattcaacccattcacaagtgtgtttgacaccctgaagaaacttgtagaactgtacttcaagtaaactccatattgtaaaacttgtgatcaatgttccctccacatgaagatgcagttgaataaaattctcacacacagatgtctctagtgatttatgttttttcatgcgccttatcagaggaagagtttagcaaaaatcataaaatataaaatgaactgtttagcatctggaaaccttagttcatatcagtatgtactaactaaatagagattagcttatgaagagtcagctcttaaacagtgaccaagaacactgtggctggtaagcagaacgcacaatgagacagattcagggcattatgggacatgttgtgctgttattcgactccattctcgtgtgctcaagcagagagagggaggtgatggcaacacttttttctgtgcgagtctcgcggcatccaagcttggaaatccatgttccaacaggacaaaaacatcatacgctaagactcatgagttcatcaatgtctcaatgcctgcatcaaatcccagcaagaacgctaaagagaaaaccgagaagagaactcaaaaccaagaacacatcaacgaaagaacaagccaaccaacctcgcccgcgtgtctacccacacggcggcgccgagtggaaccctagaaagccgctgatataggcgttttagctgcaggccaagcccacatggtgatgggccttgggccccacctatctcgagggccgggcccatgtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50423 - DNA, 778 bp, Oryza sativa
catgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatg

SEQ ID NO: 50424 - DNA, 1306 bp, Oryza sativa
tgcaagaatcaaattatcgttacatggatccgctagttgttggtgtttgtcaccctgctcccagaagtagcatttgtcaccagccttcctcctctaataagtggttgttgaactgtcgataatgcaggtggaccttcattctggtgacgatttacttcggggtaggtcccttaatccctcctttttcacaacaaaatagtttgtctctgcactgaattcatgaatctaatgattcatgtcgatttatctttacatcgaacacatctgaagaaaagtttgttttgtggaattgttcagctcggcacggcgttgtccatctatggatgcagcaagcttgctgatgagaatgttgtcactgaaagaacagacatggagctcggctcgtacgtcgcccatggagctggtactaaacccaatttgaatggggaagatgacacaggagagattgctggattctggggttacctgctccagatcatctaccaggtaaagagggattccatgcagccaaagaacttagaataaccatccacttgagcgcctttttttttcttatttgttattgaagagagttatcttatctgcactgacatttgcgtccatggagagggggtctgatctcattaggcttttcatacgcaattattgcactaacaactaaagtacgtttgtggtgtgctctgatgaattggattccgtttctaaagatcagatgtgcccacatactagcatctttgtccggtcacatttcaagggctctcacgtagccgccctacatgagccatcttgacatcttgttggtcctatctaaatattcagataatctctgcaaatctcacatttccttgtacctcaagggctgaatcagctttaaaccgctttgcgaaatgtagggctgactctttttagtagtggcatcaagaataaagacaacatgtttcctttgtgttgatttgcaaggcctaactgtacccaaacggtgactgaatacctttctaggctgaaataggacagaatggaactattgttctgctttgtgaataagaattactagatagttctatggatggtagtttactagcgccatgtttagttccaaagttattcttcaaactttcaactttttcatcgcatcaaaactttcctacacacacaaacttccaacttttccgtcacatcatttcaatttcaaccaaacttccaattttggtgtgaactaaacacaacctagatctgtgttgggttactgtgtacactttgccaacaaaattttgtaatatatctcaccttttttagagaaaagaat

SEQ ID NO: 50425 - DNA, 2966 bp, Oryza sativa
  unsure (1)..(2966): unsure at all n locations
aagtttataatatcattcttcattttgctactaaattgaatcttgaatttgctgatctttgcttgctgaagatgttaattcgtatccaccatacagaaatatctgcagttaggaacactgattatattgcattacacatgatgttatcgacaatggtggccaacactcccattgacattcttcatcactgcatgtttcccacatctaaggttaaagctaaagctatacagttgcttttgggagcaaatcctatgcacatgcgcctttttggaaaattgctcacggatattctgaaaaaagacacttctgttatgcaagtcgtgggttccgattctaatgcttcatggactcatgaggatagttttatacttttgttgcctgctgccttatcatacatagagcatcatagtgggggcaatagacagtgtgttgacttccttgagccagttccagtcttctatcgtgaaattcttttgagtgataatggctttccatgttggaaaagttttgttactagaagtatttttgaggaagattttagtgactttagacacacatcagttgaagatataatgaattatttcggtgacactctcttggggaagtcaataactatgctatgctattatttctattcgaaagagatacctcggaagcaacgattaaagataattgcttcaatttgcccacaatcatctgagctcttagattctgacatcagttttgttactcctgtttcatgcaacggtattatgaagcttactaatgagttatttgcaaagatatcactgattaggatgttgttatctcctcctagaggatcgttgaacaatgaaatagccccagagaaggagtccaagcgagtcaacaatgcaaagctgagttttataagcatattggtcagaacgttggataaaatattcaggaatttccctcatagtgatggcatcttactttcctctcctgaggaacaaaatgtcgtcagttgtttggagtatgcaatcctcaagaacattgttgagttgtcttcggaggttcagtcacatctgaaccagttgaagccaatacctttcctcaaccaattgatcagatcatccctcttacatagattcagtgatcctgttgtaataaaagcaatccgatgcataattgttgtattatctgaagggaagtttcctgctgatgaaattcttgaactcatactgggtcactcccattttgtgtcgacaataacctgcagtggagtttccgagtgcccatctgcttgtaatcccactgggggcctgcttcagccagcaccaagtattttaaaatcaggtgattctgcttttgcaaaagaaaacaagttccaagactgcattccagaaaagaagaaagtagaaatcatcaggttactcagggtactgtatgatattaagagtaggcaacataacagtagcctattggatgaatcaagggagcttggtttcttgcttttatctgtttatggtgcaactcttagtgaaacagatctagagatactttaccttatgaatgagatagagtcatctgaatgcaaagccattactgatgtggatcatctttggggaaaggcagctgtgaaatttagaaaaactgaagctaaattttcagcatttttttgggaaaattaacccggccctanctaaaaaaatagtggaaaaaagaatagncngngnaananaatattaaaaggtgataggcgaaggtcgctattccgcgagaacatacccattgattctaagctctgtgtcatgactgtcttacaattttgctataggagatcttcaagagcttctattttttcactggaacagcttcagcaagataattttggcgatattttcaaggtaatttgtgtcaattgaagttttgactccatttttgttctagattttttttttctttcagaataacactcctttatcttcctggtatatttgtctcccttgtgctcttaaaccacacttgtattggttgacaggcaacatctcaaagcatggatgcggttcggatttatgatcctgtgtttatcttgcacttctcaatccatactcttctgatgggctatattgaacctgttgaattttcccgactagggctacttgcaataacattagttagcatatcatctcccgatgaagacttaaggaagctgggttatgaatctctaggaacattcaaaaaatcattggaggtactgaacagctgctatttattgaatattgatatgatattttgtcatactggtttattgaattcaaatgccactggttattgcctactctggcagtggcagccctactttgatttcttgttgttgtgttatattgctacactgccagctaaacatgtctttgtaatgctaacacattgaatgttctcttaactttctaggcacatatgtaatgtcatgggctcatggttttgatatttatttgtctcaaaccactgtgaaaagataatttgtattgacattctgggagcagtttgatttctggtagatgtgggactaaaattctgtagaaatagactgataatgatggtttgaaggaaaaactggagggtggtgagtagagtcgagaggaaccagactagagagaggaacttgaggggctaattcatttcttccttaactcaaaagagatgaggagttgaggaccctccttaactgatccaactaatacatatgataagcctgacaaataacttaacaagcctgaaaagggataacaaggaaatctgggttaactctttagtcatatcccatgcagaatgaataaagaatggtttcattacagtagatctgagtacagagtggttatcttctatagtagtcactaggtgtaagtgtgtaaagcttgtatgaataaagaatgttttcattacaataatctgtaattttcttgaagaatcactgcttctatataatacaggcttctcagaaa

SEQ ID NO: 50426 - DNA, 10535 bp, Oryza sativa
  unsure (1)..(10535): unsure at all n locations
ttgcagatgaaaaggtagataatcataactaagctgcaatgcaggcataatgtcatgattgctggtttccatttcccattctctactttctaggactctgttccaatgatattgatcaaagtggttcctcaatagtcgacctactgtttttgctgcaagaggggaaccttttagttttcctgcaatcttatctccgatcacaagtaagtctttatggacgtctcttggtagcttatcaccaaatacatatgctaggaataaatccctaaacgctccagggtccaaaccttccaaatctactgagttatccattgttttaaccatttctgctacaaccggaaaccgagttgtgactagaattatgttaccctttgactgtccttttgttagtggaagtaaaagctttttccaatcatcactttgacacttgcaaatatcatccaatatcaataaaaatcttttagacttcaatctttgttcaattagctcttctggtctaccatctttttcaccatccactttagggacatattgtttgatctcttctatgagcttatcaacactgaaattttgagaaacacatatccagaccttgacctggaaatggttttgcacttcaaggcttttatatatgtattgtatgagagttgtcttccctatgcctcctgggccaacaatcggcaagacagtcaagtccttgccgcagtctgtaccttgggttatataatctattatgctcttcgctgtatcatccctcccatacagtttaggctctatacttgtaggtgtggtgatgggacgattgctcgcagtactggaatcagtgctacggatagaatggtgtatctctagattaagaatagtggtgacctttgcacacacgagctgcagttggtcgacaacatccttcattcttatagacagacccactctgtcaatcttcaactttggcgtttctttgatcacatcctttctctgttgtggtggcttgtgcatgcaagcaccacaacagattgaaacgctagaatcatcatcaacaacagctggaaaagatgagcaatggaggcgtttaccgacagcatggatggtgttgcgagcaccggaagcaagcttgcggatgccgccgccggtggcctcctcctcctcctcactgtcatggtcgttgtatgaccaaccacagcagaggccacgtccttgcgcaccttgttctgatcttggataggtgtgactaccattatcagcagcagcagcacaggagcatttagagaatcccagccgtttgctggcagctttggcagtgtgggtgacattgaggaagaggttgcgggcgcaaccgccggcgtgctcatcggcggcgtggtaggtgccgtcgagctcgtcctggatgcggaagtagtcgagctcgtccagcacgtcgtcagcgtcgaacgccaggtctcgcagcttctggaggagctccttgagcgcagggctgcgtatgtctttgccctgcgcgttgtcgagcaccccctgcgcgtagagcagctccatcttgagggcgtccacgttgggtccgagctcccggctggccgcccacgcctccaccaagccgtccgagacggggccgagggccttgcccaccacccaccgagccgggctcacgggggaatccatcgatccgatgcgcgcggttgcgcttcagtccaagatgctgcatgcaaaatcgagaagacgaaccattaattctcactcaaatgcaatcgaatgaacagtaatatgacagtggtattcagctattgttgattcgtggctgctgttagaggagagtggatacgtacgttacgacttacccaagcccgtacgtgcttctgcggcgtcggcagtcgggggcacgaaggtggagcgctcaggtattgggggtgaatgcttgagagaaccgtgcaaagagggtcgagttgtggcgcttgctttggagacgggagtccggagggaagatgctggatggaggctgctaaattactccactaaccttgtctgtttttctttttttctaaaaaaatatatttcctcggttttcacaatgctagatgttttgcttttaaataaatttatacatagacatatgtatatgctctatatatgtgtttagatttatatatgagtttttagtaaatttagaaaagagataaagaagctaaaatgtcattttgtggaacggaaggagtagctatttagatgacaagcggaacaaaggtacatcacattaacaggatgaaaaacaacattgagctcgcttccttcgtcggcgggtttgcccagcttgtttgaaactttcgcacggaacaccaccgtttagtagtttgaaaaatgtgctaacgaaaaccgaggtaaaaatctgaatcttaataaaaaaaatctaggtcctttttttttctaattaagatgcagatttcacctcgatttctgttaccacatttttataaagtgctaaatttctggtaagaagttgctttaaaatatcaaataaaaaataaacctccgtgttcacctgcagataacatgtgagataacatgtcaagttaaaaaaaaaggacagataacatgtgagattgagaccgtcttcacgtggataccacacgtcaatttactctctccgtcctagtttatgaaaaaaataaacctagcatggatccggaaaggagtcatattcatatttataggttgcagcgatcaaaccgaaaaagtgttcacctgcgtggacgcattagtccaaacaaagtgtccttgtacgtagattttataaacgttaccaggttggaaacagattcgacccacataaatgagctcttgacccacagaaatgagctctccgcgcgctcctcgctggcagatctcaagaagaggtcccgtgcagagatactaacaacaatgcagtatagaacttttttaaggtacacttggaaaaaaaaaactccacacttcaacaatgcaatatataattactagaagagcgtgactattggcacgcttacaattttataacctgcacaatatgcttaatgagtatgtaggtttaatagactaacatcataccatttaatatattgatggtattaaaatggaaggggttggatattggctaccggaaattatttttctagcagaaaaaaagctgcgatatctaatccatttttttggccggtgaagcagctagaaaccctgcttcacgatgcccaacaatttttatcaatggaaaagtcgacaatagttatccaagagttctgtgtaaaaggattatcatgcaacggatcaaaggtacatcatggatagcacactatgacaccacggagatagccacttctgtcaacgacagcccctgaattcacccttccttgagttggttcgatttggagaaggagattatttttttttttaaaagaaactacatttattttgagatggagaagttaactctagtatgcatatgcactaaaattaacattgcattcacgagtgctcgtcggttttaagtaagaataggtaatttttgacactttatttttttttaaaaaaaacaactttaaagcaagcacttccaatttcaattctagtgattcttaaaaaaaagaatacaaacccaagaaataagtttgatatgaaaattgttgaaaatggagtttttttaaaaaagtttgttgaaaatagaattattatttttgtttgaaaataaaatctagagtaaatttgttcccttttgaaatagcccgggctctatgggcgcagagtagctcatgctttgtgcaaggaaaaagtacaccgaaggtccctcaacttgtcatcgagttaaaaatcgtcctcaaaccgcaaaaccagatatccgacgtcccttaactaatcaaaatcggttacaataggtccctcggtagttttgatcccggttttatcctatgtggcgctttgaccacatgtcagcgcgtccacattagcctcatctctctctctctctctctttcccctcttctctcccttcctcctctctctctctctctcactcttctctcttgggctctgggcaggccgaccaccaggtagggaggagaccgatggggcgaggcgggagaggaggtccggtggccggcgacgacacgggagcaggggagcaaggcatcggcggcggcggcggtagtggcgctctggcgagctcctcgccagcgcggccgatctcgttgtgtatccaaaagagaaaaggtatcctattcaaatgcaaacccgacggtacccttctgcgagttgcatggtcggccttgaagaggatggcgaagaggttggcagccttgaagaggaggagggcgaaccagtcgttggcgaggcggtggaggagatggcgttgggcgtgggtgcagggggcggcggagtcgaaggcggagtcgtcggagtcgatgtgggagaagagggcgtgggagatggcgatgtggacgaggaagaggaggaagagcgggaggacgaaggcggcggcgatgcgggcggtgggtgcggaggatggacgccgcctccccgtagatccctaccacgcccaggaattgcaactcctcccctgctagttgcgccaagctcctcccccatcggccgcgcccgcctctcgagccttttcgacggtgcaaccctgaggtcgcacgcgcgatgatgctctcccttctcctgccaccgccatgtcgtcggcagccgccgcgagccgcctcccttctccagtgtcgcaaccaccgccgcgagcctctcccacctcaccctaatgacctcctccccacccgccgttgccctgcagagaggagaggagagagagaggagaaaggtagagaattggggaaagagaaagggtgctaaggcggacaccctgacatgtggggcccacatgcgtcccacgctgactcagccgccacgtcagacaaaaccggggtcaaaacaaccgaaagacctaaagtgaacggttttgtaagttgaaggatgttctatatctgtttttgcagctgggggacgattttgtaactcaatgacaagttgagggaccttcggtgtactttttccctttgtgcaaggccctggcccagctaacggcccgcaggtgatacagggagattgcccacgtgggcgcctcccattggacggcactggatgcgcttctgcctctgcccagaatcatcggtctccagcaattcggctcctctctctctctcccgcacctgcagacatcgaaagccaaaaaccactcaagaagctgcaaccgcgtaatctcgagaaaacggtttactcggcctaagacagtgggagacgacggcgacggcggcggcgggaggaagccatggttctcgctctgctgttgggctcctcctcttcttctcttgcggcgccacaccctgcttgctcttccaggtaacaagcgccagtggcagcaacacgcagttgatttttcttggatcaaagttgtataaggctagatcaggtgctgttctattgtattcactgttcgaagcaggcatgtattttgggtaacattcttgatgtcaaagtcatattccacattcagtgatggcacgtaggaggagtcaggttagtacagtacctggatgaaaatgctgataagtaatcttcttattggtaggagaaaatgcagacccgctggacgaaataatttcagatgctctctgcatgacaaggtgccactgaatgctcatggagtattatccacaaaattgctctcatgccttgctgcttcgcttgttttcatctctccaccttgtcaggtacctataaatgttaacttattgtcagatgtatatacactaaggctgtgtttagttcacaccaaaattggaagtttggttgaaattggaacgatgtgacggaaaagttggaagtttgtgtgtgtaggaaagttttgatgtgatggaaaagttggtagtttgaagaaaaactttggaactaaacacggcgtaattcaaagagataacctcgggatcactaagcaagaacagttttttttaagaaaagatatttttactgttgaggattgagagaattttactgctgcaattttgattggatacataaaacttgttaatttcaattaagagaagagggaaaatggagtgagattaccagttcaggcttgtaacatggtatcgatgtactcttaatctctcatagttgaccaggctatccctgcagagacctttgtacagccaaaattgtgccaggttgctgtggtagcagccatcgacaaggctgcggttcctctgaaattcgatagcccttctgatgatggcggcacaggtttgatgatgaagggtatgactgccaagaactttgacccaattcgctactctggtagatggttcgaagtagcatcgctgaaacgtggctttgcttgtcagggacaagaggactgtcactgtactcaggtattgtagtgccagaatcctcaccccaatactagtaggtttttaaaaaaaaatttccttcttagctggttaaattggaattggcccccccccaagggcaaactaaataatgttacctctgaatcctgattcctgaaaacaccgatatctgacatctttgtatcaaactgatttggaataggttatcacaggcatgctattttttctatgccatttgcaccatataatgtgtaagaagattgttacagaaatttgttggtactgcagggggtgtatgcattggatgagaaatcacgctcaatccaggtggacacattctgtgttcatggtggacctgatggttacatcaccggtattcggggaagggtgcaatgcctgtccgaagaggacatggcgagtgctgagacagatcttgaaaggcaggagatgatcaaggggaaatgctttctccgtttccccacactaccattcattacncncaaaaggaaccttatgatgtgcttgcaaccgattatgacaattacgccgttgtgtctggtgctaaagacacaagctttatccaggtcagaaactgatctctgaactgcaaatgaccactatttcttagccctctgcatgcttattctgcatattgaaagatcaatctagttacgtaagctgttccatgaaccaaatatagtgtcaaatagagacaacatagggttaagcaaggacttgaacactgagaaatcaagccaatattccttaccttcatatgcctattctgacgcattttgtaaactgaaatatcataacattgtgtcgtctctcggcaatgcatcagatatactcaagaacacctaatcctggaccagaattcatcgagaagtacaagtcctacgctgccaacttcggttatgatccgagcaagatcaaggacaccccacaggattgcgaggtgatgtccacggaccagcttggtctgatgatgtcaatgcctgggatgactgaggctttgacgaatcagttcccagacctgaagctgagtgcacctgttgcattcaacccattcacaagtgtgtttgacaccctgaagaaacttgtagaactgtacttcaagtaaactccatattgtaaaacttgtgatcaatgttccctccacatgaagatgcagttgaataaaattctcacacacagatgtctctagtgatttatgttttttcatgcgccttatcagaggaagagtttagcaaaaatcataaaatataaaatgaactgtttagcatctggaaaccttagttcatatcagtatgtactaactaaatagagattagcttatgaagagtcagctcttaaacagtgaccaagaacactgtggctggtaagcagaacgcacaatgagacagattcagggcattatgggacatgttgtgctgttattcgactccattctcgtgtgctcaagcagagagagggaggtgatggcaacacttttttctgtgcgagtctcgcggcatccaagcttggaaatccatgttccaacaggacaaaaacatcatacgctaagactcatgagttcatcaatgtctcaatgcctgcatcaaatcccagcaagaacgctaaagagaaaaccgagaagagaactcaaaaccaagaacacatcaacgaaagaacaagccaaccaacctcgcccgcgtgtctacccacacggcggcgccgagtggaaccctagaaagccgctgatataggcgttttagctgcaggccaagcccacatggtgatgggccttgggccccacctatctcgagggccgggcccatgtacaaagcttgagttagtatacggccgagaaatcccgaccgtcgaaagtaaatcaacggccgtgatctgagtggaaccctagaaagccgctgatataggcgtttagcgaattttttttatttataatttttcttattaaaagttttacaaaaataattttccattttgaaaattgacggaaatagtcgcctaccgccctctgggagggcgatttttaaaaatcgctctcccagagggcggcgaaaatgacgtggcagacggccgttcgctctcgggcgacggccggtaacgaaattggcaggcggccccctttccgccctccgcgagggcgattttgcactgtgcggggggccgcctgcaaatgggcggcgagggggcatggaattttgcaggcggcccccttgccgccctgggggagggcgatttttgcctcccccctataaagcccagcccctcccctatgaaatttcattatattcactaaaaatccaaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaatgaggaaaatcaacccatggaggagcangccatgggcatggcggatgagggggagagagtcggtataattgttgatgaaatggagagggaagattcngataatgagcaagcggaggacgacgcatcattcgatgaggaaaggtgatgtaatggccactgattgggcaaatgaggacttctctggtcttgttatatcagagggtgatcatgtaccctgggagtataaggagtacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttgttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgagta

SEQ ID NO: 50427 - DNA, 729 bp, Oryza sativa
tatacatgatcgtcatgcgggtatgttgcgggctattgactacttgtagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggtgtgg

SEQ ID NO: 50428 - DNA, 704 bp, Oryza sativa
ccttcaaactggttaaatttagagataagcttacggatatgctcttggtatttgtacagattgttcccaactactgaaatggcatcacaaaggaaagggatcacaatgtgtgacagtctattagatgcttcaactcctaagccctctctttcaaaacctttggccttgtaacacggcaagaaagccaaccatgcatcaatctctgcaatgttctgatcaaaagcgccagaactcgccacagcagctttaactaaaatatatgctttatcacggatgctcttaacttgcgaatgcaacataatgtcaatcagaggttgcaaatacttgtacatagattctggaactttttctgggcaccaatatccatcagattgacctgaatactcaactaaaagagataaaagggactgctgttcatccatggacagatccaaaggattaggcggcataaccttgaagaagtcaaatgatccatcaaaagagctaggcattaccctctgaaaagaaattgaagttaaaagttagaataccaaaagagtagattgtgaacgaaacttaatatatgcatttgaatatcaaaacattaaaatcataaattgtgaaggaacattatcgatttccttttgctagtcccagaaaacaaaaggagacagagcaggaatggaggaattaattaattcgagcaatgaaataagcaaatatag

SEQ ID NO: 50429 - DNA, 16641 bp, Oryza sativa
gagaagaacctgcggatcaggtatagctccacgaactacatcttgaatatattctctcagagttatccacctatcgacgtgcattttgtctccatgtagaacctcatgtacaatggatgcatctgctgaagtagaacagcttaatcctggaaaaccgtctattttgactgtcacttttgttgaattatcgtgttctgactttaccctagcatttgatactatgtcattgattacttcaattacatcgcacagaaggttgactgattcaaaaacaagtctcagagcaccgtgctttacaagatcatcagaatgcagaagccccctgtttatcactgctcgagtgcacatattgggcacaatgcacttcaacagtacttgcacttgctcatcatcaacagataccagatcatgtgaagtggacaaaagattttgaaagatgccatcacagtttactgaagatatcatgtccgctgctagggatatggcagaaaacctgagaaacagtaattagataggaaagagtatactgcacgccaataaaaattacagagatgctcagctcaaagaactaaccatgaggaggatgggcgtggttcaatgctgtaagggaattcattcatgtatgctgaacaaagagacaaactcttactcacaatagccagcaacaaattcttgtggtgaacgacctcagtagctttcaacttcttcatgagatccagcagacgtttctggttacctctcaggtttgagcttggcatcagtccattttttggatcagtacacaccatgattaacacctcatgagcaatgtcagctgcctcccccgcatccaaattcccagatatcaagctcagttgttccagtgtggcactaccaaaaaggacactccggagccctggtgggacaagtgactcatctaccaagacattattccgcaacgttgagaggatatagacaatggtatcagtatcatcgtctccgatcccacgaagaacccctgaatagagctccctttgttgaaggatccatcttagcatcctcgggttcccaacctccaagaatgacatggcaaacccaacaaacgatcgccttgtggatccgaaatcagttcccttcttccgattccccccatctctgccacctctcttcttccgcacccccgagagctgcggcaaaacagccatcttgaaatcaaagctcttagcaatctccgacgccaaccctccaccacgcctaacaattgcagccagcaaatcaagcgcagcattctgcctccggaactcaccactgttcagctccagatacacgtcgcccatcttctccttatcctccagtatcatcctagcaactccatccaggctcttcttaaccaaaccatgccgccgcaacttaccgccagggtgtcctaagacagtagcaaagagcgaaagtatgtaagccatccctggcttctccctatgcaatcgccatgcctcagccagctccacgagccgtggcgactgctgcacatactcccgcagcacctcaccctcagggtcaccatccaatagctcaatgaactccctcgacgcgtcggagtagattttgatctcggcggtgtggaggtttttaaggatatggattagcctgaccttacaggttgctccgaatgactggttccaggcctccatccccaccttaaccaaattttgctcccgtttgggttccgcttcctccatctcattgtcttcattgagatcaacatcgaactgctcgtcgtcgtcatctaggattcattaaaaaaaacagtgagcatgttagtgttccatcgagaaatccgcaccaaatcgaaccgaatttacaccaaatttcaccaaaaaccgggaagtattttggtagctagaggtgctcaccgagatataaatcctcttggacgatttcatgctcgtcttcacctccaacgtcggcggtggagtccatcggagtttgtctcccggcgagcgattgcgagcacaatgcggaatcgagctggtagggtttaagcgaatcgaagggtagggtttaagggagggtatagagctgcaacgggatgagaccccccgcggcggaggaggagaggacccggcgagccgccgctgtcgtcggaggaggcgaggacggccggtgaagtgggtgctcgtggaagaaggggagtcgcgtccggtcgccggagcagcgggcagcggcgcgagtcgcgcgcgttcgccgccgtggagaagaagtcggcggccgggatgggaggggggaaagcagatgaaagacagaccagggtttcacttccgtttacatgggcttgggctctatccacgtgggcttctatttacatgggctcaatctacgtgggcttctattttaatgggctgaaaggctgagatatgtgaacaccagaccaggtttggcccaccatcatgcgtttcgtggcttagaataagttcacttatactctcttaacaagtggtatgcctaaaaaactaccggatattttgaacactcaactattaaagccgctgcaatttgactcacttgacgatttagaggtgtgacacctacatagtgttgacctagggttcatccaacgtcagatatgaatcagattagaaagctagctaaaggatttatagaggagttatttcctcttggctttgcgtcacgcgtagcggcatgcgcggtagttggatgacttggatcgatgcacggagctttcatttttgtttcgcatactactagcttggaatatgggcgggttaaacgacgtaaagaattctcgaattaatacgtagtgcgagaatgcgaatagtccataaatacccgcaccggaagcgttcgatatgatatgacccgcccgcctgttcctttcctttcgatgccacccatggctagcagttcgacatcgtcgagatgcctgacggcgagcgtcaccgggacgcacaacttggaggtgacgagctactcgctgctcgaaggcatgggggtcggcaagttcgtgagctcgaccaccttctccgtcgccggctacgactggaacctccgcttctaccccgacggcatcacggacaacgacagaaaggaaggctacggggctgtttggatgcttgcttcagtttaccaaatttctatagctaaggtgtggcatgccacaatttatgtggctaagaaattcttggccacaagttaggcaaatgttggcaaatgtatgtgcctatgataagtggggtcacaaaatcaaaaagtgtggcatgacaaagatgtggcaatcaagcaaacactaggctaaattggtcaaagtagcttgccaaagttgtggcaagtatgatcaccatccaaacaacccctatgtatccgcctctctgcatctcgttggcaccacgacgggtgccatgccaattagggtgagattccgcttatccctactgaacggatacgggtttgacgcataacttcgagcgagccggcagcgactgcaggatcgccaggttcgtcaagaaatctgacctgcaggaacatgcaattcgccggattcggttcactggcaacgacagcttcaagatcgagtgttcgctgaccgtcataagcgagtctcgcgctgaagacgtgagcacgatcccagtcccgccgtcgaacctgcaccagcacctcgccggcatgttgcacggcgtcgagatcgcggatgtggagttcagcgtcggcggcgagccgttccgcgcccacgcgtgcgtgctggcggcgcggtcgccggtgttcagggcggagctcctcggaccagctgctgcacggagcatcaagatcgacgacgacgacgacatggagcccgcgacattcaaggcgcttcttcacttcatctacacggatcacctgccgaacgactccggattcggcaaagacgcggcaatgcagcggcgtctgctggtggctgccgatcgctacggggtggacaggctgagggcgatgtgcggggtcaagctgtacaagagcgttagcgttgggacggtcgtggattccctggaattcgcagagaagcaccactgcgcgcagctcaaggatgcttgccttggattcatggcttcacctaacgttcttggtgtcgtcaggaaaaccgatggattcaagcgtctcgtggagggctgcccttgggtcttgaaggagattttagacaaggtgcctagattctgaaaaggtgtggatttttctttggagaggattgggagtcctgggatgagtacttggccttgctgacatgcttgatttcagtaagatcaacgacactgtgcactgaagtttatctatgttcggttacaatccatatcctgcttattgatccagctaataagcttattgacatgtaggcccgatgatatgagatccacatgtcagtgagcagttactgcatatcccatgtagtgccgcattattagtactatatggagcatattttttagataatgactacatggagtatagtttttagataatgactatatggagtatatgctagtattgtgatagtattattctgaactctgaacttgtccaatgcttcccatcaaaacttaacgagagtgatctaagcgcctaactaagtttctatatatttgtccgatgagtataaggactcattctaagagtatactcctttgttttatattataaatcatttaactttattcttagtcaaagtttttattgtttgatcaagtttatagaaaaaattagtactccctccgtttcataatataagtcatttgatttttttctagttaaactttgttaaatttgattaagtttatataaaattttatacacatctaaaatatcaaattagcttcattaaatctagcattgaatatattttgataatgtatttttttgttttatttttatgtgtactagaaaaaatgcccgtgcgttgcaatgggtgaagtttattttaatcttattattgttatatggtttagttaaaatgaaattcgttgtgggagttcgcttggatatatattttttttagaaaatcatgagctgcagttaggagttcgatcatctcaagttagcatgggagttttttttttaaatagatctcttatatgattccttatgtattaccaaaaatgaacgatcttaaaaccaactcaaatacggatatgtattttcaaaagcaaacgaacttaaaaatcgactcatatacggatgacatagagatatagattaaaccaaacataaaattaaagctgactcaaacatggatgacgaaccacggaaacatctttaatttttataactgactcaaacacggatgacggaccgcggaaatgtctttaacttttttaatagataatagactagagtaaaacttgttctaaaaaaactagagtactgaacagcttccattgatccttctcatgctcatttgacctgcattattcattagcatcatctagtaaatgtttgctacaccaagagctcctccaaacacttggcaacatcacttgaaccgttcctatgaagagcttgaagagaactcatgggaataccaaatgtgtctcgtagtttgaaatatcacatgttaaatgcctgatgacatcgagagttcccccaaacacttcacaataggcattgaaatagtgccacgtgaagtgttcgaagggaactcacggtgataccaaactaggctccacctctttgtagtttaaaatgtcacgtaataagtgcttggtgacatcgagagttcccccaaacaattcacatagtaggccttgaaatagtaccatgtgaagtgattgaagggaacccgcgataataccaaacgtggctctcatctcattcttgtggtttaagcactacattaaatgtttggtgatatcgagagttcccccaaacacttcacacaataggccttgaaacagtgccacgtgaagtggttgaagggaactctcgataataccaaaagtggctcccatctcaatctcgtggtttaaacactatatgttgaatgtttggtgatatcgagagttcccccaaacacttcacatagtaggcattgagatagtgccacgtgaagtgcttgaagggaactcacgacaataccaaacgtggctctcagtcttgtggtttaaacactatctactaattgtttgatgacaccgagagttcctccaaacacttcacaacaaccctataaataatggtgtcgtatgaagtgcttaaagagaactcttgataataccaaacgtttctctcatttcttgtagtttaaacactatctacttaaatgcttggcgacactaagagttcccccaaacacttcacgacaactctcaatacagtgtgtcgtaaagtgcttgaaaggaactcctagggactccaaacctaatcattctctgtcacttacaaattcataaagtacaagcacttacatacctaacttgaaaatgctgagtgtcaactggagttcccccaagcacttcactatacatagctagcttttggccccatgatcacagttatgtaacagtgcaatgcaatgaggcctagccatagctatctactgaagtggattgaggagaactccagtggacaaccaaccaaattttgactccctagacctgattacttcatttttgatgtggaccacttcacttgtttaatctgccttgctgatgagcacagagccggtggctatttataagtgtatgtatgactaaagagtaagctagctagctatctgtctcctgtggactgtggtgtgtgtgtgtgcatatggtcgtccttgcaatgcggttggcatatattggatgaacttggcaacggatgcacctagccgtgatgcagactaggttagaagatggagtgtagtgaggagaatccaatgtgatctttgggctgcactgatctccgaatcgtagaaagcatgcatatgtggagcaaaaaagtgcccagccctgcaaattccttatcaccagcagagcactgtgtcgtcgcccggtttctgtccacgcacatttctttcacctcaacaaagatggagagaaatcgtcctgaccattgacttgctgcaaatgcgtgcaaattgcaagccccgggaggaaacatgtgtatgtaagattggatcacgagtaatttgcttagtttgtactaggcttcgtagcacgtcattgcgttcgtcgttgcgttgcgttgttcctggtcttttctgatgtgatcggtttgcaatatgcccatttaccggtagtgcttactactgcagtagtgaagtgctcctactgaattctactaccatcccaaaatataacaatttagaattagatgaaacatatcctaatctaataaatctggagaacaaattattatattttgggaccgagggagtaccattctcttaaactacttaatgagttgagaatctagtgatgatgaaattaccctacgaacgtcagatcatcatgtatgagagcacatattaaagtatatattcagttgtcttttgcatgtcggcgaccagtgggtgtcacaggttccccagtgatagaggacagcaatcatacagataaacaatggaaaaacaagccacctaatctggcaccttttcttactgctactccccgtttcataataaaagacaactttctagcattgtttatataaatatttatatagatgttaatatagacatatatttgtgagcaagtattaaactacttgcatgtcggcgaccagtatatataaatatgagtaatgtaagaaagttttatattataaaacggatgaagtattaaactactccatcatatatactccctctgtcccataaaatacgaatctagaattgaatatgacatattttaatactatgaatctggacatatgtatatcatccggtactaggttgattttttatgagaccgagggactaagaatctagaattagattaaatattttttagtactacgaatctagacatggtatctcatccggttctaaattcttatattttgagacggagaaatataagatattttagacggatgtgacacttctcagtgttacggatctgaaaaagaagtactaataagtgtctcatctatccaaaatctcttatatttgaaaatgaagtgagtatgaaaaaaagttgggacacacacaaacagtgggatggcagcattttctcagccacctgataatcgatgagtcatattcccaaaccccaaaaccatatgctcaaaaaggggaaagaaaaaaaaggtgaagaaggcgtccaggttcaatgtatgcgatccttggcattgcaaggacaatctttcagacccaccagctgaccactttcaaagcatgtccaaatagcaggctaggttccagctttaggaggaggggagagatatttgcagtataagtagctttggagaaggaacattcctaaagccaagatgcatcaagaactgttcttcttcaagctgtagcctgtaggagcggttgcgtcagatggagttcccccattcttcacttctggttcttgtttgcttcttcaggtagagctggtttggttttggtgattttcgtgttcatgattcatggagagatggatttgtttctcagtatccttatgtatgttgtagctggatcatttcaaagcaaataaatcgacgatgagtaaagagattatctgtgtttctcgatctttctagttacttgtctatttgtgtgttcggatgtgatgacctcaagaaatgcaaatgagtcagtttcatgctgccgtttagagatcgaaaggtcacagatccaacaggcaagcaacccatcagtgtcaagatgtttaggccgtgtacctacacctctgtactactgggcatctcgattctgcaacgcaaaatctcacgaggtttctgatgaactttaatagccgatatcatgccgtggtaaccaggtttacaaactgtaccgttatcgtggttatcacgtgtaataaccttctcaatttttaaaatcacgatatgtcttacggtaaccgtacgatgacaataaccacatcagtttggtaaaccctagtagtaacgtacacgagtctttgcagccaggcagccagctcgagttatgaaccatgatgcgtaaatcgtgaaccatctagctgactgcataagttggaaatgagtgatatgtgggtcaggatggttcaccatttggaaataagttatcatccaaatgggcatatatagtacagtgccaagatgaaacatcgaacttatagcaaaggaaaaattgaaaccatgccattataattttgcaaaatttgagatatgccatcctgacccacgtatcactcatgtgggtcctatatgtcattgagataccgatgacatatctcaaactttacaaaattataatggcatggttcaaaaggtttcattcgacctctgattcaccccatcctagatatgccatcggttggtcacaggacatcaaaggcaggtgatgggaattgagttaattttcacccaaatatatagcaaaagaaaggtttcagctgacttcagattcacccctcctagctatgccatcgtccaaccggacgagaagtcatgtggctacatcactacatgcccatagcagaatctccaagggacaacgaggatatatatacatggtgagttcgagagtagatgtggagttctagcagacttctatatcaaatctaaggcagatcccaatgttgaatagctcctgatatagcagctttgcgccgtatgggcgtatggcacataacacattgatccttactatatcttttttctgaagagcggcagaacccacgtgattaatacaattatgatgtaattatagtgtactttcaaaaatctctaggtgacatgctaattatgtgaaaacgaaggtaatgatatcgaatcccttacatgtgcgtgagttatcagtttatgtgcatcgaggggaagcaacgataaagtgcaacccccgaatgagtgaagattctatcatgtaccatcacctataccctcaatatcaaaaatgtactagacaatctattactaccttcgtcccaaaatatagcaatctattacaagatgagatatatattagaccaacgatctggacaggccgagatctttggattaagatatgtcctatctattcccaaattactatattttagaacggtgggagtactatatatatatggctctcattttatttctttttctcgttgctttgtttggctgtatacctctgtacatatatctactccatttttttttcttttcgaaggatataagcaagataagcaagaagtgtcgcacgtccagtgatcgtcgccggcgaatcgccatgctattgggcctgtcgagacaactccagcacggcccaatcgctgcccaaattgggccatctattctgtcgctcgcacggataccgcttttgtttttctctggattctgaactcatatactttggcgccggtcacgtatacacaacaactatatataatcaaagagatgcacacagatacgtatgtgtttggaaacaccctgatttgttgcgaacttcagcttggagcatcttgatcgacaagacaaactctgtatttacatgttgttgttttttgttgttgttcaagcttcgttgttctccttcgatcttcgccatgggcaacagcttgttctccatggcgagcagcaccgcttctccttcagatggtcgatccccacggctgccggaaacactgtcgaggtgcgtgacggcgagcgtcgccgctgcgcacaatttcgaggtgacacggtactcgctgctcgccggggtgggcgccggcgagttcgtcacctcgggcaccttctccatcgacggccacaactggaacatccaggtctaccccgacaggtggaagcaggagatgaacgccggctacgtgtcggtcttcctgtgcctctgcggcggagcaaccggcgtcagggcgaagtacacgctgagcctttcggagaacggcggcgagtccgtacaacggagcttgacgcatcggttcgacacggtgggcgccttctggggattccccaggttcatggagaggcccaggctgcggcaatggctgcttcgccgcggccccggcggcggcgacgactgcgtcacgttcaggtgctccctgaccgtcatcagggagcctcgcaccgagggcgtggccgccgtcgccgtgccgccgtcggacatgcgccggcacatggcgaacatgctgaggggcggcgacggcgcggacgtggtggtgctggtgcgcgaccagccgttccgcgcccaccgctgcgtgctcgccgcgcggtcgccggtgttcagggcggagctcttcggcggcggccacatgagggagaggcggacgagctgcgtcgtcgtcgacgacatggagccctccatcttctcggcattcctccacttcatctacacggattccttgccagaaaacccggacacacctggcgatgatcaagattgcatggcgatgcagcatttgatggtggcagccgatcggtatggcctggacaggctcgtgctgatctgcgaggagaagctgtgccgcggcattgacgtgcagacggtggcgacgacgctggctttggcagagcagcatcagcgtgtagcgctcaaggatgcttgccttggtttcatagtctctcggggtgttcttggcgctgtcgctaggactgatgggtttaagcatctgctcacgacctgcccgtcgattatggtggacattttagacaaggttgccagcgtcatgagcaagtaataatagattcatagtctagtctttctgatcttatgagtaacttttattagtgactagcaaagtagtactgtagtagtaataaagttcgagactgagtttgcgacgcgacatgatttgcagtatcacagtagttctattttttgttggtttcatgcttgcctggaaacatatcgaaaaagaactgaagattagagtcacattgttgtttcggtactcaaattgcattcctctgaactctgaagcagtcactctgttcttctctggtctcccctgtgtgttgctgttctatttccaggtgtgattattgttctgtttggcgccattattatctaagtttttgtttctgttacacattttggtcgagtttaactcgagatgagcaaattctttaactttgttcccggttgtaacttgtgagcctgtggcggagcaggttcagattcgtcagaaaccaaaaaaaaaaaaagttcagattcgttagtggcacaggctctctcagccctgaccaaaaatgggctaatctagttggtcaggcctgtggcgggcatgttcagattctgcagttttgggccggaatcaccaatttctctctcagccctgaccaaaaatgggctaatctagttgggccgcctagtcagacgcatgaacggccacgtggcacgtgcttcgtccgtgcgcacccgtggatcacaggcctcgtggcgggggtttcggtcgtgcgcactgtggagtacaggtcggcagggagccagggtcaatcgaatcgagtcgaggagaggagagagagagagagagagagagagagagagagagagagagagactcagggagggtttcgtttccgtttcttgcgcctcctccaaccgcggcggccgtcagtggggagcctcgtcggcgtccgcctccgccattcgcgagaggaattcaggtgatccctctccctaccagagccgcgctcccctccgatcctccccgaatctggatgatctcccccgattccgctcggcttcgctgatcccccctccgccgccgccgccgccgccgcggcgggtgggctatcccgcttgtcggaatcgatcgatttctgaggccttggattgtgatgaagtcatggatatcgggccgcatagcatccagctgatcgcgccgccgtccctctatcacgccgcctccgctgccgccatgggtgatcaccgcgacccggctttccccgcggcggcgggcggctgccggctgcccaagacgtcgtcggtgagcgtcacggagtccgtcaccgcggtgcacgatttcaaggtgacgggttactcgctgatcgaggggctgggcatcggcaggtacgtcagctcatccaccttcaccgtcggcggcgtcgactgggccgtcaggttctaccccgacggctccaccgtcacctgcctcgggaacgcgtcggcgttcctctactactgcggcagggagaaggaggtcaggaccaggttcaccctgaatctgctcggcaaggacggcaaattgtcgcaggtgaccaattcctacatgaagcacaccttctccccggcgagtgacaattggggattcatcaaattcgccgagaaatcgaagctgcagagctcgccgttcctccacaacgactgcctgaccatcaggtgcttgctgaccgtcgtcagggaatcccacaccaaggatgttgaggtcaattctgttgttgtcccaccgtccaacctgcataccgattttgagaacatgctccaggatggtgaaggttcagatgtgacattcaccgtgggtggccaagagttccgtgctcataaatgtgttcttgccttccggtccccggtgttcaaggccgagcttttcggtccgatgaaagaaaatggcacgcaatgtatcaagatcgacgacatggagcctgaggtttttgaggctcttcttcacttcatttacacagataggctgccagatagctgcagagatggcaaggctgcagcaatgcagcacttgctagttgccgcggatcggtacggagtggacaggctgaggctgatttgtgagaggcggctcagcgaaaccattgatgtggaaacagtggcaaccactcttgttttagcagaacaacatcactgctcgcagctgagacaggcttgcattgggtttgtggcatctccaaacatgcttgggccagtcatagaaagcgatggatttaagcatctggtagaaagctgcccgttgattatgaaggagatcttgagtaaggtttcacatatttggattgacaagtcttgctgagaagtttattaagctatcacttttgtagtagtacatcttagtagttatgaaagtcatgatcagttatctacatctctatatgcgactttgatctttttaagttgtgtgatccttccaacgcctaatatgtatgaacagtagaaatcttatgtatatggatgactccttagcaccatggtgtaagtttgggcattcttccccttttcatcttttttgaaatgttggatttactctatactcacatgctttcctgaatgtataatgactagttttttgagtggaatatatacggactaataatcattaattcaactctgtcttggtgatataaatcatcatttcaactctgaacatctcacattctttggtccaacccatacctcagagcatgcccaacaatcacccaatatttgattcccaaaaaatctgaattaggaataccaaaataaaaattgggcccaacaatgaacccctcctccaagagatgcccaaaaatcaattccctatcatttgttagtttgccacgtaagcaaggtggggcccagttcggtacttgtgcacgtcttctccctcccgcaccagcgccgatcgacttcttcctccccggacctgcgccgccgtgacctagcgccgtcatcaccagccagtcaaccagtgtcctgactgctgcgatttgttaaaaaacggaacaccaaggagatgccgtagcaattcgtgtcatcaaggaggtaatcgttagcaaatcccattgatctcttgtgtcgtagtcaatctctatgtctatattttgatatgtggatatatattattggaaaatattaagtttgatctgataattaattttgcagattgattattgttctattcctgccatcagttccctccattgcacttcatccctgtggtaaacgctccaaccccgtggcaaacaaaaagaggagatgagtcgtcgaagcaccctccttcaaatgctattggatgagttttcatcggatggtgacgaagaatttatttcttcggcggttgatatagtgcacgaagagttcgacgatgatgaagttccaaagcatggtgaatctgttataggtcatgcagtaattaatcagtgacagtgaaccttgttagtatgtatgtcagtggcacatacatactgaaattgaatctttcagacactattttcaatctttggcataagcatgtggttgttcatctgctaatctaaaaagtgaggcatactaaatgcagatgatcacttcaattaagcagttgttgtacttagagctaagaactgtacaagttattataatcctactgaacctatgctgttgtacttagaattctgcagctgcagctttcatgaaactaaaagtctaattggcaaaagcaggtggttcttttatcttgaaaaatagactatggattgcatcttgttgcattatctgtcaaattatctaacaacattatcttaatgcaaaaattcagagcatatttcaaagatgctgtgatgagagaaaaatatttcagactttcagagcatatttcagactttgggagtacatttgacatagcaaaaatatttgacacagcatatttcagactttcagagcataccacacatttagagcatatccttcattactaaatgttctgaaacctgatttcctctaagtgttcagactttcaaatttagagcatatcctacatatttcagactttcattcaatacagtacaaatttcagactttctgatattttcctctaagtgttctgaatcctgaattcctgaatttctagcaggggaagtcagtcacagaatagacatcagatcaggctacaacactctgaaaattaatctaaacatcgaacgaatcagggacagccttaccgaaattgctcctatggaggaattcttcatcactcacagaataagctgtggagaaatcgacgccaggagcttcgtgtgagaggggattcagtgtctcccatggagcatgtccctccatggactctgtcgcctgcacaccggagtagggaggttgaggatgaggcagaccgagacgacggcgaggcggcggtgtggggcgcagagggccgtcagccccaaatcgaggaggcagtggtcgacgtgcgggcgccccctggaacagcgccgccgccgacgcctgcgaggaagaggacggcggctgcatcgccgcttggagcaacgccggcgcctgcgcctgagaggaagggcatggccgctgcatcgctgcctggagcaacaccgacgccgacccctgtgaccaagaggaaggggacgaccgctgcatctccgcgtggaactcagtcaacgacgcctgcgaggaaggggttggccgttgcttcgccgcctggaaagccgctgccgacgcctgggaggaagaggaattttgttgctggcgactggcgaggagggcgagaaaaggagcgcgggaacaattttccccctacgcgcgcgaggcagcgacgaccgcgattgggaagaaaaaatggttccctgcaaatgagtaacgacatatacggatatgggaacatggattattgggatgtt

SEQ ID NO: 50430 - DNA, 5581 bp, Oryza sativa
atacctgggtagggtggctttactttgcctacgtaaatcccaaccatctgtcttcatttaagagctaatctccaattaaatttcctatcaattcccaccacctctaccaatcaacgtaaatctcaaccatctctttttatttaagatataatctcccattaaacttcctatcaattcccaccacctctaccaatcaagagattgagagtaaaaaatcaaattcttatgttaatctcataatcaattctctcatctaaacctccaatcctttctcttaaattgccaaacagaattctctcatctaaccctccaatcttttctcttaaattgccaaacagaccgtcaactcctccgaacggagactaaatattgttttttttcttccgaacaagatgtacaccttttatgtccccttttttctcgatggtgcatccagatggcaataaatagcgtcccatgctgttcaaaacttcagaggatgcaacctgaaccacaccccattttttctctgaacattcagactgcctctgttcgtacccctgtactactgagcaggctaggctgtatgaaaggcatcgacatggactcatggtcaccaccatagcgttcgcggagcagcagtgtagcaccggagctcgtgtctctgggcagcctgcgacacaagagtggcgccatgatcagttggattaagctcagattgtcaccttgtcacacgtatcgtctcgttcgcatgatcaggacttcttttgactcccgagttgtgatttggaggttgaaacggatcaggactatagtatccaataccataaattatctcttcttggatcaactcgtcgagagagattaaacggcaacgcgtggtatccaataccataaaagcatcttgcagtctatcgacgaggctctctcttcggcagggtaccggtggctgcatcgtctggtatgcggtatttcaaactctcgttgctcttaattgaatttgttataaatattagtcgatatagcggaacgataactaatcttcccgatcgcttcagtcattgaccacacaagacatgctaggtgacgacataggaacacacaatatttgttaacaaactttagctaaagtctacatctctagggttctgattatgggcaatcctccacaaccaatatagcacctagccgctacgagttcatggcctcgccgccatcctctccctgtgtgtctacactacattgcagtcctcataattacattatggtacccctctctatttaagagagttgccggttacagagccagagtccgactttaactctacccctaccatctattataactctaagtccaactataaccatatacacctattctaacataatcgatttgatttaaacatgcgcttgtttcatccaataaaagaagtgtctttgttgctagattagatttgacaaacaaaatagcacaattgcatcctctttttgtcaattcttgcagtggcagacatgttgacttcatcggctgcccgtacgtcctcacggagcgtgtgggagggcatcaccgggacgcacgacttcgaggtggtcggctactcgttgatggacggcttcggcgccggaaggcacgtctgctccggcgacttcagcgtcgccggccatgactggtatgtcgcgttctaccccgatggcctcgaccaggattccgccggctacgcgtcggcctgcctcgcctaccgcggcaaggagaggctcgtgagagccaagtacagcctgagcttggtggccagggacggcagggcgtcgccgctcgccggcgacacgctgcggtcgcactacttcacgccgacgagccgcagcgccgacgtcctcaagttcgtcgagaaatccaacctgtcgtcgtcgccgtcgtcgtcgtcgtactcgtgcctcgacaacaacaccctgaccatacggtgcgtggtcaccgtggtcaccggcccgcgcgtggtgagcgtcgcgccggccaagaagaggggcccccgcgtcacggtgccgccgccgagcctccacgagcacctggcgcggatgctgcgcgacgggcggggctcggacgtggcgttccgcgtgggcggcagggtgctccgcgcgcaccggtgcgtgctcgccgcgcggtcgccggtgttcgacgcggagctcctgggcccgatgatggagaccaccgctccgtgcatcgagatccacggcgtcgagcccgccgccttcgaggcgctcctccgcttcgtctacacggacagctggccgctcgccggcgtcgacgtcgcggcgacggtgcgcctgctctccgcggcggacaggtacgggctggagaggctgcggctgatgtgcgaggagaagctgcacgagggcatcgacgtggacaacgccgccgacgtcctcgccatggcggagctccaccattgctcgcagctcagagacgcctgcgtcgcgttcattgcctcgccgagcacgctgggtcccgtcctggcgtcgagcggcttcgaggatctcatcatggcgaccggcgcttcggtgaccaaggagattttgcacaaggtgtccgaatcgtggagcggtcctggtaacagaaataattcaagcaaaagaaagtgagaaaaatggcaattatattgaatacgactgaactactctattcgttagtatttttagtttccccagcaaagattatcgagggtacacttttcaaactacttcttcttaaaaaaaaccaatctaagtgattcattatcctagttagtgtcaaagccttttcaaggacggaggaagtacacggtagtttcgtgcataagttttctataacaagtttattttttcaaaaaaaaatcaattataagcttataacaattaatacttaataacttatctcattttgcgtgttgcaataagctaaacccaaacatctattcgaaagtaacctaaactacttagattcctcttgtaaacacttgattacttgaaaatgcatagattcctaagtacagggatcaatgtccttaaattgcttatactgcatataaattttaaaaatataattacttatatttgaaaacaaataaaatatacgacacacttatacttacactcaattttctggtgaaaacaaaacaaaaaaagccaatcaagcagaaaacaataaaaaaaagccaatcaagcagcaaaggagcatttttccccaagctgacaaaaaaaaaaggaattttcgggcaacgagcaaatcacgggctcttcccacggcccacgggaagtggtctctctcggtctcggccatatctgaaccctgcatccccccacgtctcctccccctctctcagtctctctctctctctctctcccgttcgtgcgtgctagctagggcatctcgtcgcattgatgcagcagccgccgtcgcagccgcagcccggcatgggcggcccgcctccgccgccacaaggcgcggcggggcagccgccgcaatggggcgcgatcccgccgccgatgccgccgcaccagtacggggcgccgccgccccagcagccgccggcgatgtggggccagcccccgccgcaagcgcactacgggcaggtgcccccgccccagccgtactacgccgcgccaccgccgcaggcgatgcccgcccccgcggccgcggacgaagtgaaaacggtttggatcggcgacctgcaaccctggatggacgaaaagtacatttacaactgcttcgcggcccccggggaaggacgggtcctgatctgctgttaaaattggttgcccgtaatttttggttgtgtggcttggtgctgatggagttgtactgtggtgtattgcgactaatttagttcctgatgctgtatgttgtgacttgcgactgacttagttctgacttctcaaaagctctaggctatgagttgtgggtctacaataaaaacaaaatttcatgcttcggctgatttatcagtgattgttgaatgtatctttttggtttattgagattttatgaacatgctactttctttagtgaatcgatttcggaaggttttgtttggttttttacttacttgtttgacatggatgctaagtttgcaaactatataacatttgcgtcattctaatgctattatttatcgggtttgcttttaattttcattaaccattggttaaaataatatggaataaatggcaccttttattataccaaaatggggtccgccatttcataattaacctcccgattctaaggtttggcattaactggcaggttcattctgtgaacttaatccggaacaaacaaagtggacagctttaggggttatggctttgttgagtttacaagtcgtgcaactgctgatcaatttcttcagacttataatggacagatgatgccgaatgtggagatggtctcccattgatttggccagtgctggcgaaaacgtgatgatacccctgactacaccatttttgtcggggatttggctgcaaattgtacagacttcctactacaagagacaatcaaggtccattacccttcggttaagggtgcaaaagttgtacctgacaaaatgacaatgcgttcaaagggttatgggtttgtgaaatttggtgatcctacagagcaagctcgtgcaatgactgaaatgaatggaatgctttgctcttccagaccgatgcgtattggtccagcggcaaataagaaaacaacaggggttcaggagagaggtaaatgctgctgatcgtatttcccattgacaccttttacttattagctattattatgggcagttatctttatttctatctatatgtctggctggctactctgcttgatgataccttttccttttgatgttccggttttaccttttacggttatacttacttttacggaataaaccaaagcttgtgtgaccctttttcttcaagaagatattattccttagtacaacattccctgtgaatttggatcatttcatgcactataactagaaaaatagtagacttattaaactcgagttatctggaagcaggaggtcaacaggctctctcagtattggagttttggaactgatttgagctgtgatgcatttcttgtgtaatgcatggcctcatttaggtcagtgtaaaacatttatgttctaaatttgaagtctgtttctttcgatttctgccctccgaatacttcagtcatttattcttcttgctatttcagattctacttcatttgtgcacgcatacgtttactatacattttctttgtttaaaaagttttatgactcatgcttgatgtgatatgcacatagttaaattagcatgttggctcgagcttgcttttatttgctaggcttgactattgagggtcatatccgtgcttcatgtattgaggcttgatatttttaacattttctatttccttctttttgaaaaatagatttttgaatgacaaaatgttagtaccttctgtgaataaattcttgtctttttcatgccttctagtttttggtattgtgatattttacacttcgagttgccacactgtttatctgttcttttaaacatctgcgagaatattctgcttcttttctcaaca

SEQ ID NO: 50431 - DNA, 6659 bp, Oryza sativa
aactccattataagtctgttaagtgaaatcttgtctacatgtgtactattagcttggtggtttcgcctccataatcttatcaaactttagcatggttctgatgaacatgttcctgaattgctgagctatcctagttactctattctaaattgtcttcagtgatgcttgatattctgcttaatgcatatggcttgacatggctggatctatatgaatatcactgcttatgcttgtaataatctatttactactataagaacatcagtgaacgagacatttgcatgataagcattcatgtttaccagcatttgacaaatcttacattgtattttcttcacttttttgctttcatttacagtaccaaatgctcaaggagctcagtctgagaatgatcctaacaataccaccgtgcgttcttagttctatttttcctgtacaacagtaatttcttttcagttcatttagtgactatgtttgttgttgagctcagatattcgttggtggtcttgaccccaacgtcactgaagatgtcttgaaacaagttttcgctccttatggagaagttgtccatgttaagattcctgttgggaaaagatgtggttttgttcaatatgttaacaggttgactctttgttcgtttgttctatttccacagatgtcttactgccttgtattttttttttttgatgaggtacttgcaaattactcttgtcattgcatattcaggccttctgctgagcaagcactggcagtgctacaagggaccttgattggtgggcagaatgttagactttcgtggggtcgaagcctttcaaacaaacaggtccagatcaaactcaacatagtaattttcttatctataaagctgtataatggagctaaagttgataacattgtggtttttgaatgtcttcagcctcagcacgactcgaatcagtggggtgctggtgctggtgctggtggttactatggtggctatggacaaggttatgaggcttatggtgggtatgcacaacctcaggatcctaacatgtatggttatggagcctatgctggttatcccaattaccaacagcaacaagtagcacagcagcagccgccgcagcaggtgagactcccccttcttgtttccgatgtcatctaacattggaaatttacacactttacaaatattgtaactttcttgaaagttatcatgaattctgccatgtcaatcagcgtttgcatagctatatcctctagcgattaatttgaagcattattttttctttcttccagtgagccctgtttgatcgatcgcgtctttgggctgtgaggcacacaacccatttcaagctacagctttagctatgttattgctattctcaatagagagacggtttctgaagactccagatttcgattgaggttttaatgtatgaactgtattatgattatgaacaacggatgctgccatatcgtggttcctatattgagtcatgtattttgaaaacatatcctctgtttccatctcacccttatcatcgattattattattgctatgtaccgtttgtttcccgttggtttttgcgtgttggattctcctttttcgtgaaggacaagtgagttttctggttgcctgattggccacgtgggcggacattgcatcagggcatcagtgtatgctctgcacaatggaatctcgccaacttttgcttcgacactttaccccggttaaaatctttgctcgtgttttttttcaccgtgaaaatggctgttaaaatttctctacttgttttcaccgtgaatggctgttaaaatgtgtatatctatctgatcgtgtgccatggaagacgaaatgataatcgttttcactcgggctatttacgaggttagaaagtagaaactagaaagacttcaggaaagatctgttaaatgccatggtaaatttgacacagacaacgtaaaagctcccattaatctagtgctacactgacaccgacagcgtaaaagcacccgtaaatctagttgtattattcgcttattaacccagttaaagttaattaatctggttccaccatcttatcctagctaatgtgctttaagattagcgcgcgatcgaatcggccgcccttgaaatcgagagagctccgaacttaaccttcccgtttgcacggccgcatcggtggccttttccccttccgctttcgtctcgtctcgcctcgtcgcctcgcctcgcctcccctcccaccaccctctctctcttttccctcccttcctccctcccatggcccgccccaagaggacgaagccgccgccgccgtcgcgcaaggcggaggcggcggcggcggcggcgcaacggccgtcgtcttcgtcgtcgtcgccgtcgccgtccctccccgaggcgctgctgctcgcgacggtgtgcatggtcggcctccccgtggaggtgcaggtccgcgacggatccgcgtacgcgggcgtcctccacaccgcctccgtcgaaggcggatacggtgggtgctcctccctctctcctcctcctcctcctcctccccgtcgttgtttctgtggttgggtggctcgcttagggttcggagatcgcggggatgtggttgtgagcgtgatccagctgtgtgcgcgtgtgtgcgtagtgggtggcgatttttaatagggttggtgctccggctttttttttttttcgtttcgaagttaactggttcgtgatccgcttgttggttgggttgggtggcggtggacgctggacgcttgcgttgtttgttttttggatagtgccatggtgggatggatttgggggtggttgctggttagagatcgctggatgagtttcccccatttgtggcgtggctgtagatgtacttttgtgtttgcggttaagatcttggctgtttggtctttgatcgtcgtgattgcggtggggatttggatgagagtcccgtaaatcgttcctgggttcgtggtctagagaggatctcgcactgggttccaggatcataggcaatgatcctggtctctataatgtaatcgggtatcatggttatgctataaaccaactgcctggttgattgcaaatatatgttgtttttcttctctagaattgagatgccaatttgccatgaagaaatttatgattcatttactgcattctagcattctggcagcagtcacatttttgggtttgattcgtactccttttggatttgtaatatcctagggatgcattttttttcttgccagatcatgtttataatgttgttctttctggtttcaacaatcaatttagttttctttttctgtgtggagaaaaaatgatactgatgtatttatgttgaacaggtgttgtgctaaagaaagcgcgaaagatcgctaacgggaatgataatgccaatattcctctgggagcttttgtagatagtcttgttattcacccagatgatctcgttcaagtcattgcaaaggtagctttgatgtgcttaaacatgctaacaaattttcccgccaaaagaaaaggtatactaacagattgccttctcgtggacgcttctacttttcaggatttttcactccatacaaaagatgtgtgcagaactcctgtttgtgataccgtcgcagccagtgcatatgtgaagcctcaaacttcacatgtgaatgtgtttccactaaagtatattcttgattcaccaataataggataaaactctttcaattgtttctttaatgatgctggttaataatgtagatttctagcaatctattctgtatatatatttcaatgtctattcattcttgaggttaattcatgctatttctttaacagagaggttaagaagtgcagcacgccaggtgaggagactaacatctccattgggagaagttctcctggtattatgtctaacctctttactattttactccgataattctttttccacttttcttccttgtacttaaacccgtccaactgttatgctagcctctccaactggatatgtagggccacgcctctcctgtaacgagataatgagttctgcggttgttggatcaaaagatggaaatactaagagtgcagttttgactacacccacaatgtcttcagatgtgaaaatctctcctccagccacagttgctaaaactgccacgccgagcaaaaccattgctaaggtgagctctctcggacccttgatacgtaagcatagggaaaactgtgtctagagaattagagatctagaaaaatgttttgctaatatattttaccttttaaggagcccagtactatttggaaagcattatcagttatttcgtccatgtacataacaatctgtgcaaggcttgccaactatgttatcaatgttatcagtgtgttattttcttattttgtattatcaagcacagttctctttccttcctatgtcatggatttctatgcatcctgagggaatgaagccgtgccaattctgtttttatgtttactgctgtcatagatgttctacctttgtaaccttcctgtgcttcatcattgtcctcagtccattcactattgcaggaatccaaactcaccctttgtgctaggggctttctctctttcgttgcaagttccagaccagtacttgcagctgcaccctctgttaacccaatctacatctcaaactctgtagctggagttccaaccgggttacctgtatttgaactaactcaatgccaggcggttcatccctgtccagcagggctgttcattataataacctggctgttgcaaactatgctatttcacctcaatatactcagtcagtaagttctttgattaattcttttataatatcattgttgcttcaatagttcatcactttcttcagattgctgtcatatagtcatgaagtgataaacaaggaaaatattgcaatatggtgccaactcctattcagcaccgacattcctttaagctgataatttgctttatgtgaccactactactatctctacatattttaactattatctttactctggtgtaattttccatttatcttgagattaactattgaactactaatagctatcgtcaggggcggaatcaggcatggggcagctagggcttgagccccatgcctagctccataatccccattataatcttgaaaaatgctatgtaatttatgaaaatatttgagatcccattagctcagccttaggcgtggaaattttctggctccgccactggctatcgtttatcgttatgttatattctgtgcattgaattttcagattctacttcactttgatcttattgctgcataactctggcatgtacgttttgttcggatatgatcctgcctcctgaatccttatacatggttttttgaatgacagaccatggggcataatgtgagcaggctggatcctgctagaattggcacaccttatcatcccatgcaagttggacctgcttacattagccctagtcctcagcctgtaagttctaatcagttgtatatatataaatatatatatatatatatatatatatatatatatactgatattaatttcaaaatgctgttcatttgtacctattggttacatgatatactatcatttgctcctgtactgatctaatttatttttatgttatgacatcataggttactggtgggaaatttaatcatgttgtttatgtacacccattttctcaggtgagtaatgcaacagtgttatttctattaatagctcaagtggaactctgcgagagtaagatgatgaattaatgatgcaagtacaatttgtgttgtttcatacaatacttttaactgattaaatagtgctgattcattggagatatcatggttgtcttttgtatcgctcaaccagtagatagtgcaagtgaggcactgttatccaaattgaacttggatattcgtctgttttaaaaaataaaaactactcagctacatttcacacattagataatgtgaagcttcatttcgtggcatgcatctttgttggcaaccctatacattgcgtagtcatttaggcatatgaagctctcctgttaaccgtaatgattaatatttgacattatcatccctctaaaaaactcatcctagttatatttactgcaaatacaaattgccctaactgcttttagctgatctactatttgctttccgctgaaggatgtaatgcatggagcacctgttatgccccaaggatggtctcttcctgcaccattgaactcacatcaagctagcctccagaagttccaaggtaaaaatcgtactcattgtcgactgcttcctttattttaatggaaggtattaaaatgtttattttatttattcattacactaatcaaaacattttacttcgaaactctccaggcacagcccctgtatatgtagccccacctatcatggcaactgggaacctgccattggtggtaccaagccctgcaccgcttgtgcagccattccaggccgttcgtcccatcatggtacctgctgcaagcagcatggttccaggcaaatacatgtaaacttgtcatagcagtgtgatatcagtttttgttggaagaatcttggttttacccctttggccgttggggtttacatctaagaggactcgcagttttgcctaatctgtaattctcttgctagttgctggt

SEQ ID NO: 50432 - DNA, 744 bp, Oryza sativa
ggctggcgccgccgcctctattcctgtttctctgtatggagttgcaacggtgtcatttttattttattttttgatgttttttcacactcaggatcacgatacaaccaaccacaaaaaaatttacactcgaactaccacttaactaagtctgaaaatatctagcataccacttagtctactttgcaccttcactaaaattagaccataactcctttagtaaaactctttgatcaacatgttaaacataatgcactataccactatatgaaattacttaatctaattcaaaatataaccacatgaaatgacatatataagttaaacagtacatagagatgcaatttttttatttttattttatttttttgatatttttttcacacttaggagaacataggaaccaaccgtataaaaaataaactccaacggataaaatatgtgacatgcagaattttctaaaactctaccgaaacggacaaaatatgtcatctattaaaataggcgtaactttctcatacggactcggcgtcaggcaaataatatatgcacggacatctacagaaaaagttacatccgattctccccgctttgtcgggttcggcgatattaaaacctccaaattccgcttgcaagattgtgttttcgaggagagaagtttttcggtggagctttggaaaattccacgtgccacatattttgtccgtttgagttatttttacatggttggttcctgtgagttcctaa

SEQ ID NO: 50433 - DNA, 1129 bp, Oryza sativa
atatatgggttcgggatctcaggatcttacacaacgctgagtgcccaagttttttatattccagatccatctaagtttagggtgaaaaagggtcgacgccaaactagacgcatcagaaatgatatggatgagtcagaagcaggtgggaggactttacgctgcagcaagtgtgatctgcgcggccatacttacaagacatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgaccggatgcaggagaagatgcgtgcggtcatgcgcgtcttctcctgtcgcagcgccgtggacgtcgtacctccagttggtccggtacacccacggcctcgcggtcctaccgtcggagcaggacctcgtttgtcttcgagcgcccctagcttcggagcagtgcgacctacaacaccggtttcgcacggtacagttcagcccagatattagttcatttttatttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgccagctctttctctcacggagcgtcgatccctcgcccacacggtactttactttttattaatactgttaaatacctatacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactccccggggcacattagggcgcagggtaggagggacaggggtaagaggcctcgtcagtagtgttctacctct

SEQ ID NO: 50434 - DNA, 1741 bp, Oryza sativa
cggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgtatagttttcaatataaaaagatttgataactattgatatttatataaaaaaaatatagagcacagtacaaaatcgccctcccccagggcggcaagggggccgcctgcaaaattccatgccccctcgccgcccatttgcaggcgggcccccgcacagtgcaaaatcgccctcgcggagggtggcaagggggcctcctgcaaatttccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattcggcgtttagctgcaggccaagccaacatggagatgggccttatgggccccatctatctcgagggccggccccatgtacaaagccttgatctggcatacggccgagagatcctgaccgtcgaaagtaaatcaacgtccgtgatctgcgcacgtcaccggcttgagccttcacaatcgaaacggcaaacgatatccatcgcactactcgtctcgtctactcctcccccatctctctctacctcgccggtggcacacggcgagcccttctcctccgcgccgcctcgcctcgcctccgcgcgcgctctcgccgccggcgaaccggcccgggaggcacggtgcggactgcctcgtcctcttacctgaaccctgccctgctcttatcccccttggtgcggcgcaaggacggcgatcaatcgatcatctcggttcgaatcggattgcaggtattcaatctcatatcctccgcggatcgcttgatgaggcgtcgtggattaggttggtgagcttgttcgggctttggatggatttatttgcctccgattgatttttttttgtttcatccagttttgtcccgaatttaggggttaagtgaatcgatgtgatatggtggtaatcgatggtacagaaggggggaaatcatttcgtttggatgttgcttcaattctttttgaggtgttagtttggtaggttgggttgggggatggataagattgctaggggtgatgaacttcacttccaaaaggtcaaaacacgtttttacaagattgttttatcacagttacagtatctgagtatccccggggtttga

SEQ ID NO: 50435 - DNA, 8613 bp, Oryza sativa
ttcatttatttgacacatattttacaaagcatgagtactgctcagggcatgtgttacagacctacaagagctcagcgtgctaataagttgtttttctgcattagtaatccaagaatgtaactcagtttaatttattacttgttggtgctggtaatagttgctataaaacatttatagctagtaaggtgtttatgttccttttgcctcgtatgcatatgataaatttagttttcattgcttcaaggatatttactgctattatttattacataaacactatatatatgactatgggtgaaaacagtcgcggaaattcccacactgacgctcaattctggcaattaccatttccgatggattcgctcgctaggaatcggaaatggtcactggtgaatgcacaattgaaatttaggggggcgcgagagaaataaaaaacacaaggctaacgaagtgaaagtaatccattttatggatccagatttatacatgaattgcatataaacatatcaaatcatgcaaaagaacaactgaagaaagtaattcagcaatggaaagcatagtcctacaaactgataaatatgcttaaatatctatttaattactttgtaattgtataaaaataaattagaaaattggaagcaatgatagatgaaatatttaaactaagcacaagttgccttcatcctcacaaccacacaagaggcaccaacgcctgcgcaactgagcttaagtaagcggcatgcacaccagagccggcttgcacacacacgctgcaaccctgccacctacctgtatgaatggtggaccagtgggtttggtcgcagccatagttattaggaccggactagacatcgaaccagtcaaggcctcagttcatggtttgtttggtccagccggttgaaccactagtccaacctggttcaaatggaaaaaagatatgtatcaaatcactagtctatatatagcctagtggtagatgcgcacctcctcaacatggatgcgcacctccccatgcacaggccctgcctttttggcttaatttctcctccctcccacttccactcccacatacccatcttgtgccattcaagctgagtcagcgtcgtgcaccggcccatttagccggtttattgtcctgtattcaaccagtttcaatgtaaaaaccagcagttcaacctgtttattccggttcaattgcacactcgatcttttaggtggaccggctaaggccctggttccgattttttccggtcagaccaccgattcgatcctaataactatggtcgcagcagggaatgctcaggaacccatgctgtgtccacccctagaaatggtaagagccattcaaaaacggaggcagaaatggttttgctgttctaccgaccgttttctcggtttaccattttgttctggaaatcattgttttggggaaatcagtaattactatataccacgccaactagaggcccatcatgatcctctccaagtagagggccaccatagcaaccaggacatggcccagccacccagcccacttctttcacaaaaataggcgccggttagggagattcaaacagctaactgtaggttagaaaagacatgctccaaccaccatccttgttgctgatgttgatggatagccaattctgtaaagtatgtaaactttgatatgcaccatatatacaactattttattatttgacatatatttttagttcaatagtaaatgactatatgtaaaaacatgtttgagttatattacgtgtatatgtatgttggtcgagtgtgtgaaaacatacggtgtcacagtttccaaatgataccgcatgtttccaacatgaattgccgatttccttatgatgcaaagcatgtttctgtttccggctctaccatttaaaattctatttccaggaaaagtgtgattcagaaaatggttgaagctgttttcaaaccgttttcacccctagatatgaccgtgtgggtactttatttacattactgattgcaaactgtgtcatgtttattttgaaaatagtttcatgagagcttccttttcaataacatattgtgtcaacttgctctatcgtcttctaatttcttctgattacttgccacattttgtcatccttttaatgttgaggttactcattattttcactttgcatgttcagggggagaaaaattgtgaatacacttttgctggtattctcatcgttcctaggttcagctacaaaaggttgaagcaaagtaccaaagatgacatctgaagagaataaagctgttacacctaatgaacccatagaggcatcaagctctggttctaagcgtaagcgtggtcgtccacggaagtctgagtatggcatgcatgaaaaaccatatagtgtacagcccattcagagcgtcccacctcttcacagcacagaagatagctcaaatatccaacaggatgggatacagatcaatcataaatcaggtggtagtgttggtccgtctgccaatctggttaagacttctctcagccaagcctccacttatactagtgcttccttgcaaagtaattcagtcaaagatggtattgttggcaagtattttgttggtaagatgtccaacaaagttcctgggttttctctcattacggtgaaagtgaaggacaatctggtcctcaaaggttggattccagatgaaagtgacctccgcccaataacaccaaaggatgacctcgccccagatcttcccatgcttcggccaagtcaagttcgaaagaggccatctactatttacaagcaagctgctggtccaattccagtccccttggaggatgttacatttgcaaagcctctacagatgaggaagcctgttgagaaatctgtcgctaagtgagagaacctgaacttctgtagaaattctgaagtctggagaagttcaaagaaggcaaaggctagtttagattaagggaacagaacctgcggttgtgatttctctgtactgctccatatggcattggacggttggaattgattgatgtaatcactgttgctgtaatctcttttcttaaatactgaggtgtcagcatttatgtctgaggctttgacgaatcggttgccggatctgaagctggatgcactagttgcatttacaagtgtgtatggcaccttgtagaagctttgtagaactgtacttaaagtaaactccatattttgtgaactatgatgttcagtgttcgctccacatgatttgtgttcgctccacatgatgttgcggttgaaaaaaatttcacatgatgtttgtgttcgctccacatgatgttgcgattgaagaaaatttagtttagtgttcgctccacatgatatgttgcggttgaagaaaatttgtgttcgctcacataatgttgcggttgaagaaaatttagtttgatgtttgtgttcgctccacatagtttgatgtttgtgttcgctccacatgatgttgcggttgaagaaattttagtttagtgttagctccacatgatatgttgtgattgaagaaaatttgtgttcgctccacatgatgttgcggttgaagaaaatttagtttagtgttagctacacatgatatgttgtggttgaagaaaaatttgtgttgcggttgaagaaaatttagtttgtagtttctcttattataagatgctccacgctttgctgcgaatatatgatagatatgggagaaataatgaaatactctctccgtttcaaaatgtttgacaccgttgactttttaagcacgtgtttgaccattcaaatttaaataattatttattattttcatatcattttattcattgttaaatatactttcatgtacacatatagttttatatatttcatattttttttaataaaacaaccggccaaccccgttgctaaaaagtcaacggggtcaacatttgaaccggagggagtatttggaattaaatttttatgaaaatatttggaaatggagaattaacctggtgtatgcttacttttagaatgaaataaattatagatataattaatatatgtttgcatgttgaactttgtgtgttaaatgagttgatgtgacatgtttgcatgtagattttaggagtgttaataaatattatgtttgcatgttgagttttagatatttagtggacattagttttatagaaaaaatggatgaaccgtttagcatccagaaacccttactttagatgtactactcttgcgtgtgttatcagaggaaaactttacccaaattataagatttattataatgaaccgtttagcatctagaaaccttactttagatgtactacaaactgcttaggaagagaggataaagagaaaaaatctctcagtttttttattgagattgacttatgcacaacaaacaagagagaaaaatgaaaactcaaaacgtttggagaggataaagagaaaaagtccctcagttttttatgcgcacatttcctgaatggtgtgtattttggaaaaaatctataaaaattattttaaaaaatcatattaatttttaatttaaaataattaatacttaattaattatgtgaaaatggttcatctcgttttgagcatcttttcaacattctcctttcccctactcaaacacgccaatgatgggcctcgtggacccatatgtagcttatgggtcggcccacacgttaatgccaacgctggcccgatggctcggcccccttcgaaacctcgagttggtagccatccatcatcatcaaaacagacaacctctcagaaaaaaaaaagggaaaagaaaaccaataccaacaaatccaaaccgtccaaactaaatccatcggctgggatcgacggacggcacggcttcgccttcacgatcgaaacggcaaacgatttccatccacgcctcgcatcgcctccccccctccctctcgcgttttcctccccatctctcctcctcctcctcctccgtgtctccgccggtggtgccccggcgagctctcctccgccgcctcggcgcgccacctctcctctcctcgcgccgcgggggagaagccgaacgggcgccggagacacggcgcggattgcctcaccccccttagtggccgtatcaactatcacccttggtgcgcggcctcctcgcgcgcgcgggaacggcgatcgtatcggggtcggatcggattggaggtatccatttttttctctcttgggcatctgcgtcatttcatgagacggcgttgattggatttgtgacccattcgggattagatggatttttttttttttgccctctgattagctcatccagtttttttcccggaatttaggagctcagttaatcgatgttatgtgttgatgtaatatggtaatcaatggtacaggaggaggggaaatcatttcatttggttattgctttcaacaaagctgtgcctcggcctttaattttacttaaaaaatgcattgctgcattttttttaggttttagtgtggtaggttgggtaggaattggataagattgctagtggtaatgaacttcacctccaactcatctttatacgattctttttgttgcttgagcccaggcttgcaattttggtgcaacatttagggattattacaagttccaacgaacaagtttggtgatattagttggtccctctagttcatctgtttgacacatattttacaaagcttgagtgtttgtgctcagggcatgtgttacagatctacaagagctcaacgccgtaataagttggtttctgcatttgtaatccaagaatataacccagtttaatttattacatgttgatgctagtaatagttgctatagaacatttatagccaggaaggtatttatgttccttttgcctcgtatgcatctgacaaatttcattttcattgcttcatggatatttactgttatttattatataaacattagatatgactagggcttcgtggaaattcctcctccaatgctcgtttttggcaattactgtttccaatggatttggtcactaggaatggtaaccgacgcacacaggattaaaatgtaggggttgccagtgaaataaaaaacacattagtaacgactgaagtgaaaggaatcatttttttggatccaaatttatacatgaaccgcatgtaaacaaaccaatcgtgcaaaagaaaattgaagatagtaattcggcaatgcacagcgaagtcctgagaactgataaatgtgcttaaatatctatttgtgtactaatatcatcataattaatggtgattttgaagtgctacttcataattttataaatgtaaatttggaaactgaacacaaattgccttcatttatcacagccacagcccacagcagaggcaccaacacctgagcagctgaactcaactaagcggcatgcacaccagagtcggcttgcactcacacgctacaaccctgccacttgtacgaatggaagaatggttggaccgcagcaggggatgctcgggcccccctgttgtgtctgccccttgaaacggttacggaaacggtaagagccattcgaaacggtggcagaaatggttttgctgttcaatcgaccattttcttggtttatcatattgttccagaaattatcattttggggaaatcggtaattagcatatacagctccaactagaggctgactatagcaacgcgtagaggcccatgatccacgccaagtaaggaccacttcaggccacatcaccgtgtagagagccactacgtcaatcaggacttgaccaagctaccctgcccacttctttcacaaaaatggttccagctaggggattcaaacagctgacctataagttagaaaagacatgcaccaaccaccatattaaatatttaaacttcattatgcacctcgtatacaactattttattagttcataaatgtttttagtacaattgtcaatggctatatgtaaacatgccatcatattaaataaattgagttatattacgtgtatatgtgtgttggtcaagtgtgtgaaaacatatgttgttactatttgatgtttccgacatgaattgttggtttcctaatgattccaacacatttccgcccggattattccctttttgatttttcaatatcatttccatttccatttccggctctactgctttcaattatattttcgagaaaagtacggttacagaaatggttgaagctgttttccgaccattttctcccctagatatgaccctgtgggtactttatttattgcaaactgtgctatgtctcttttgaaaataattccatgagagcttcctttttagttacgttcttagcagacttaattaatttcattcttagcggatatggaaagtaggcttctatcttcctgattgtcgacttgctctatcatcttctaatcttcttgtgattacttgccatattttgccatcctttcgctattgaggttgctcattgcgctcactttgcatgttcaaggggagaaaaactcatcaagtaattgaaggtggtgaatacacttttacggggcattatcatcgttcctaggttcagctgcaaaaagttaaagcaaattgccaaagatgacatctgaagagaataaagctgttgcacataatgaaccactacccatggagcagacattaagctctggtgctaagcgtaagcgtggtcgtccacggaagtatgagtacggcatgcatgaattaccatatagtgtgcagcacattcagagcgtcccacctcttcacagcacacaagatagctcaaacatccgacaggatgggatacagatcaaccatacatcaggtggtagctttggccctaatataggcacaattcaggctttgcctacaaagcaaggcccagctaatagatccagtggacctagagattctgtcaatctggttaagacttctctcagccaagcctccatttatactagtgctcctttgcaaggtaattcagtcaaagatgatattgttggcaagtattttgttggtaagatgtcgaagaaatttcctgggttttctctgattacggtgaaagtgaaggacaatcaggttctcaaaggttggattccagatgaaaataacctccgcccaataacaccaaaagatgatcttgccccagatctccctatgcttcgaccaagtcaagttcgaaagaggccatctactgtttacagacaagcttctggtcctattccagtccccttggaggatgttacatttgcaaagcctctacagatgaggaggcctgtagagaaatccttcactaagcacacggtcccttccgttccaagacctcacatgggttctggggttgttgcagcagtacctatctcagtttcacccagtaatgctgaatcaaggattttctccgagcagggtactgaacatgtgaatccacaaccgttatctgctgtggtacctattaaatcaggtcaacctgtattggcatcatgcaaggaagtcgctggagggaaaactgtcaatgagattcaaacagtctctgaatcttcaaagcacactgaagagtcatcaggtatgttcgttggaggaatgcaatttgatctactttgaataatatattacctctggatagaaataaagctt

SEQ ID NO: 50436 - DNA, 932 bp, Oryza sativa
taaaaatgtgataccctctacttttaatgtttttattggcacctagagtaacgttaaaagctttgattctatgggcatatgttctgagcaaatatgtttgtttattggctcaaagataatcctttgcctgcacaagcttttttttccttgtgtgtaaccattgatttgctgttagtactttgttgtgtgccatacataagctagattgtgttgctaacataaatccttttcctcgtgtgtaaccattgatttgctgctagtactatgttgtgttccccatacataagctagattgtgttgctaacataaatccttctccttagtcgtgtgtaaccattgattttctgctagttctttgttgtgtgccttacataagcagtgatgctaacaataaccattttccttggattgtgttctaaacataaacccctcttttatttcaggaactgcacctccggtagaggcttcaaccgcagtacataatccccaaggtaaccttctacacctcttgggaacattttattattatctattatttactgcaagaactaacaaacttgctgttacattgaaaatcaaaattccagatgacagtcatgaaatgaaggttgacaacaaatgaaagcagcgcttgagaaagacaaaatgattcttaatgttaggtgaaagcttcaaatccagattgtttctgccaagtcttactataaatggctggatgccaaaggcgtagactcgtactctaggatatatacttgtctttcgcttttatttgtcttccttataaggatacttgagctatctttcattttcattcgtcttccatttaaggatacttgaaccttttaataatgatgtaaagccatacaaaaaagttacttcatacttggaacaaaaagaaatgagaaaaaacttggaaggactaggccccatat

SEQ ID NO: 50437 - DNA, 4229 bp, Oryza sativa
  unsure (1)..(4229): unsure at all n locations
cgtgttggcgcttttctggccagctggacgatcatgccatcaacacagacactgaaagaacgattactaccttgctagtgacatgcatggcacgccaccttaattatatttctttccatggagctcggaccaactgcttgatgaaaccaaacacgagagctaatatgagtttcttatcattgctagaagtcgaaatcaaatcacgaggtccccaaacagtaggccattaatcttagctagtactagtagctactccctccgtcccataatattacaacctcgaattggatgtgatgttttatagtacaatgaatctggacatttatctgtctagattcgttgtacgatgaaatgtcccatccagttcaaggttttaatattatgggacggagagagtagttggcactttagatgattaataataataataagttcagctctgaatgatttatcacgtaaatgggaggataagaatcgaggctagctatacacgatgcttaatttcgtcgttgtaagttgtaagcgagaaagtgacagcttcctcagaagcaggaggccctccatggctggagcgaactgccagtgccacctgctcatttcgacgaatctcggcttttctcgctgcacatggaggaagaaactcatcaacccatctgttagccggtcggcactctggccggatcactccgtcggcgggatccctcacctattgtcacctcacccgtcgattggcaatttgtccgtggcatcaaggctacggagtagttcattagcgtataattaattaggtattagctatttttttaaaaaatagatcaatataattttctaagtaaatttcgtatataaatttttttaaaaaaacaccgtttagcaattaaaaaaacgcgtgcgtgaaaatacaagatcgacgacatagtacggccgccaatgcagcgagcaccagcgcctcctacgtgctgtaccagtttccaccaacctctgcctttctctgttgcgcgcagccgcgcgcgcggggtctcgcgccgtccttggcgacgagacgacggagggagcgcgcggcagcggcacgcgagagagtcgttgtgttgcgcgctcacgcgcgaggggatcgagtgatcgaccgacggatgcttcaccctgcgacgcccgagcgcgcgcgtgagcgagaccacgccaaacacgcgcgcagcccggccggtgggctgcaggaaaacgagtggatcacgcggacgcgcgcgcgcgaggcgcagttggtgtgtgtcccgaggagtacgtaggaactctactggtgtggcgctcggagtcggagaagctactactcggctggagtgcagttccagccaacacggacgtgtaccgagtaccgacggtgtaattttcacgggccccgtgatttctcccgttccaaaattaaagatattactacgaatttgaaacaaggaatttttacacttaggtaccacatatcacccattatttgcatttgacttaaataattatatatatttttaaaaaatgtaaacataaagaaaattatttttgtatcaaagggaaggcaccctccatttacattaagattgaaaacatcaattgggatgacataagcctatagacagacacgcaagactaaatttaattcataactagagaaaaaaaataataaaatcaagtagagaatagtatatgtacaaatcagataaaatttgtttttttatgcatatatcaaatttagatttgcatgattgcgtggagtcttataatatcataatatttcttgtccaattttataaaaattttatataactatttagaccgcatgcatatacctagatgtcatggtatctagtggttgaaaatatttttcctacgaatcaggactagtattaggattattaacattntaaactaggcttatntattttgagatatatattataaatcgtttgactttnttatagtcaaacttatttaaattcgatcaaattatagtaaaatatagtagtgtttccaacacaaaacaaacatgttatcaaactacattcaattttaagtttaataaaactaatttcatattttagatgttaattttttttctataaatttgatcaacctttgttaagttcgataaagagtaaataagctagcgtgcaatcggaaggagtgcgggtcatggcgggccaggaagaaaaaatcgaagcctcgtggccgatgctggcgccatacatgcaggacgcggtcagcgcaagatggatgtggagccgcccgtttcccatgtgttgaagctgcaaccaactgggagcaaaacatgcatgtgctatagctgatcctgcaggtccatttctcatgctgcaagagggcgtacgggtaccaggtttccctcccatcatcccatgtaccttgatggcttgatccgttgatcgtgtgcaaacctaacggacacttagcgtgagaagcatatttgacatatgagccggtaaagcattgttgtcacacgcacatgggaccgatcgacccctcgccacaactaactttgtccggtgccactatgctaatatggccggtttaagctattgactctaaagatcagggcaaagcgcttctacctcaaagaaacgagggacacatggctaaagcacgaaggttgcttttaatttggttgggagaaaaagaaggggtctagaagcatctgtctactggcacatcatctaaccaacacgctaaaagagcatgactagtgtaaagatgcatgcacaaggggaacacaaggaagagaaccagccagctgaccttggaaagctagttgattatacgcaaagcgatatcgtcaaagtaaaccagtttaaagtgcagtaggtgctacaatgtgcaagcaattctataaccagtttaaagtgcagtaggtgctacaatatgcaagcgattctataaccaatttaaactgcaataggtgctacaatatacatgcaattctaggtaaacgtgagatagctcaactgttgaagtggcatctgaggccatggcctcaaaaccaaacagataatcttaattgatcatgcaaatggaacccaccaatatccacctactagagtactaggtcgctgctcaccagataacgaatgaagacgattagcgagattgggttcaaaacaaatagccatgtaaatgtttttcttttttttaaaaaaaaacgtcgatagatacatggaaataatcaagaaattaacatgtttgcaatttatcgggtttggagcagagaagcacatgatagaaaacagaaattgaaacagaggaacacactcagaaaagttcaatgaacaatatcttcaaatatattttaccagcaattaaatccacaaaaagaactattaatactccagtcaaactggagagagcagggtaattgggaataggtagcttaagatctgaaaaaagaattacctccgagacatctaaatttcttctctctctggttcagactgctgttcgaaactggtccatagaaaaagcaagcagacagaatcacagaacacatggaacgggagctggcaacaagaaaaaggccaagcattacagtccctagtatatttcaactgagcagtattcaacaagtatcgtagggaagcaaaaaatgacaaacatatggtcacaaaggggatgaataatatgcgattgaaacaagtaatttctgcagcgctctctaatcaagtggaacaaaaataagtcatggtgcacagggctacaacaagattgtaaaacactgacgcttgtaacattcagaacatgcaattccaacatggcatcagcaccataccagaaacaagagctcagacgagaaagttggttgcatccaaagtcatacaagataccaaaattagcaaacagagttgacagtgacaaaataaacactaaagcgcttcttcattctactacaaatcaatcatactactaaattagagaaaccaatgactaatgcaggaaatgcagccgctgtatcctattgaactgaagttagattgaataacaggtcccaactaacttccaccaggatgtattgatctcacaagttcaaataatttaaatggcatatgctacccaagaataaaaagcactaataatacttttcaatagctgacagctcatagataaagcaagacaaatcaaagaaatatcattccacactgaatccagcaccgaagcatatcaaatagatgtgatggtcatccaat

SEQ ID NO: 50438 - DNA, 4977 bp, Oryza sativa
atgaatagaccaaatagcacagatagggaacctaattgagaaatgaaaacagtaaggcagaacaaaataaaatgagatgtgtccctaactgggccccaacatatgtacagctccaagctactgctcctaactaggacaatatatcagcatttcacttttctgttaatcctcattatgacatacactcaaagcagtacatacgggaacttccagaaaagaataatatgttcgcttttcgacaaacaatacaatgtcatataaaaacctcaagaacggtcagcaaattccaagaactacggatttgctaatagcagaaacatggaaactgagttgtactactaaaccatacacaacatcctaacagaagcactctttttgcatggttaaaagatgaagtgtgggtttcatcttactcaatatgctcctggcaagcagatagtgagtcgtaattaaatgaagaatctagcttaaaaggatgaagatagtgagaatgacacactccaaaatgctgcgagaagtgtgtcctttttttcgcatgctcaaatcaaattgaccccaaaatatacagtatcttcacatgcaaaagacttagagtgagagtacttaccctctgctttcaccatcttttttgccaagagaagggtgtcaaaaaacagccaatctgcaggaagtggtgctgaacaacgatcaaactcctgagcaaggaaacgagcatcaaattgttttgcggtatgagcaacccacagaactggcttgccaggagcttggcgacttcgacggaatgccaatagtagtgggattacatcactaaacctgtggtagtcatattaagataacattcagaataagtgaaatagtaaattaactgttggtgaagtgagatatgcataaccagttttccattgcaaaaactaacttattcctacaagcaaataatttacaataaaacctgccttaatggcatgcatgcttgtgaaaaagagggaatacagagctattgcatacattttccataactaattcaatactatggtctgttcacagcatcatgttgagtgacaaatacatcagggcatgttgacgacgactgttatcaagacatgtgatgaagagattaggaataatatggattcgttggatgcaaaacacaccttgggataccaggcctgcacacgagatcagtgccaattttaatgagatgttcaacgtagtcaggaacagtcctttcaggattaacaagagtttcaaaagtgctattctttcctccagaaagatcacagagtgcaaactcaactattctatgatccttatggaaatagccagtagtctcaagatcaaaaactagaatagttgctgcgccgcaacttccttcccatgttcctgtacttgtgttgtgaaatgtcgtttcccacagcttctaggatcaagcaattctacagttgataatccggcttgttgcttaagaaatctgacagggaagctactccatatactgttcctcagctgaatggatcgaagaatcgatgacattgtgcacaggaaatccacttaaaaccaatacgcagagccaaacctgtatacattgtcccacacaactaccatgtcagagtagatggcaagtaatcaacctcacagtgtttcgatatgaaatttaacctcccccccaaaagaagacttatcttccaaagtcaatacgttctaaacgtagcaaacgaaaggaactcacaagacaggataaattgcattaaaaaaagggtaaatttaaaaaacgatgttttcacgcgcagctgaacttccggaaggcatgaggcctgcgtgcgactcctgtcgacacacatcatccaatccagcaccccctatagttgagacaggcttgagcatttcacctcttaaaataaaatggactaatttttcagtttcacggaccaaccaggaagataggctcgcagctatgaactcccgcaacctcccccagcgagaaacaaataagaaatctgcaggttcagtacagccagtatccctcccagaaccctactcccaacagtcccaactccccccaaatctcctccccccgcaccctacccagatcatccaggcataacatcaccacgagagagagagagagagagagagagagagagagagagagagagagaggaaggaatggagtttaccagcgccgacatgagcgtacgacccccgccgagatgcccacgcacgccgccacctcccccgccgccgagggatttagctaggggtggctgcggtggtgaactgattgtgtcgcgcggcgcgtgatgcggcgagcgagacggggtggggtcagttaacagaggtggtgggggataacggcgcggaaaaaagtccatttgacaaccttaaaatatgccgcaactaattcctatccctaagcgagtaaactggatagtttctcgaagtattgaaaccagtgtaatttaactccccagcgattttggaggatggttttaacttctctagcagttttggagaacggtttttactgacgtggtggtgttgacctgattttcgtcccatgtgggggcttatgtggtattagaattaaaaaaaattatgtgggatccatttaccatcactctcaaaacatattgcaagacccccatcctctctctccaacccttcttcccttggcttctccccttatcctcatctagcatcggtgcagaggctgcgcgcggcggccaggcgaggcaacaacagcggcgacggtgatggtgtggagttggctcgccgatcccctccttccaacaaccatggacgacgaggaggagcatggcgcagcacggcgcggcgttgctgtctcccttgtcgatggccccatctctcttatcgggagccttccctcctctccgtccttcaccacccctcccccctcccagcggcggcggtggagaaggccgagtgaggcggcagtggcggtggaggaggctcgctacctctctctctctctctctctcccgaggacccttcctcctcctctccatccaccctccaccctctcttcactgtaagtgcggtggccgatgagttagcggtggcgcaagtttgggctcgcctgacagagcggataggatcaaggaaaagggtggggagctagagtaggaggctggtcgaggatggagtggagcagcgcaggggagcttggggtcatgctcccaagcagcaagggtctcccgcgacggagatggacaggagcatcgcgagcggcgtcactaagctcccaagcaacatggacgtgggacgtcgacaacgctaccgggtgatagagacagagtcggtggtgggagtcggatgtggggaagggtgacgaaaggggcacagagaggtgaggaaaactttggtggaagggccacagccgtcggtgaggaggcggcaacagagagtgacacgaattgcgttgcttggtatgtgaggaacctcacccacaatgacatcgtgaactcctcccacacgcgtgcttagttgggaagattctcctctgcgcgtgcccaactgacgactcctctcagagcacgacctcccagcgagatcctccccagcgcacgactggccagcgagctccttccccatgcgcagtctcctggtgaggtcccccctcacatgttgggataagggagagagagaggggggaggaagaggggttggagagagaggatggttgtgggtcccacaatatatttgagtgtgaatgacagatgggtcctacagatatttttgttaattctaatgccacataagtgtcacgtgggatgaagactagattaacaccgccacgtcagcaaaatcgccctccaaaacctctgagggagtcaaattgcactggtttcaatagttaaggagtcatctgatccagttttctagttaaggggtacgaattagagtggcctccttctgaagggagtcggagtagactttttcctaacggcgttgtgtgactgtgcggtggggcctttcgacctggtgagagatgggccgaatctaacggcccgttcctccgtggttttagtcaccgaaccccattacaaccggagtgtactgagtaagcacggcctgagtaagatatttgggccaacatttatgtgctaaatcttctttgggccaaggcctgattaaatttagttcctactactgtagcgagcaagcttgctttcttcagttttcgttgcagtataaactataagctgttaagttcgatcaaaatcaatcttacatttaagatccaaaccgatgtgatgttttgttaatcatccaaatcgaaatcgagacttatcgtcagctagattagaagctaagcgtggggctatacgctggcgttttcatcagttggttctgaaggttctttcagtatcaagtgtactgtctgcatcctgcagtgcagcagggaatagagttaacctctctctaattattcgtcctcctttttgcaaggatttttttctgtcttacagatgaactcgggtgaatccaaaagaaaccaaattgatcgatcgatcaagatcaagtacagtaattcagtccaactccaaccactgtgtattgccactccatttctacaattctacagatgcacaaatctctatttttctttcatttcgtcagacgtgacgcaaccttcacgagcaagcgtgtgttcgtcgtgcttgcataatgctctacttgtccacatcacactgccccgtcgttgctgccgtccttatcccccgtaggatgactgatccttgtcttctgacgaacagcaacaacaacgcatgcactgcactgagctgagctggatggattgtatatcctagtatgtagacccgtatctgatagtatattgagatgtgaaaggaatacttcatagaatctttgccccatggttaactattgcagcatcatggaatcacgatcctgtagagattagttgtcttttttacagagttcggtgaacaatctctg

SEQ ID NO: 50439 - DNA, 4892 bp, Oryza sativa
atgaccacaccttaggtaacttttggctaaaagatgggtgtatgacatgtgggcctttgaattgaaaaactttggcatgccacaactttggaagtgaaataaacgagtatcctagaaagtgtaccaaagttggccaaagggagggagtgaaccaaatagcccttaagtagtttcacaaaacagtggctgaaatacaaacatgtttatgaatcttggccctttttctctctgacttattcatccaattattaaatcatatttatttatcgcattattgaaacgggctatttgcgtcttcatgacgagagttttcgaagaaaatccgtaacatttttaccatggtaagcaaacaaagactatatcaaaactgctttggagcaaaactatgggctcttcctaagaacatttttttaatttctgttaccagttacaattgatgtttaattaatttgtgtaaaagaagcatatgctggcgcgagtatgtcgcatgattttttattttccttggcctatctggaagcaacatgtatgtgttattacaaaaggtaagatcagccaattacttctcagtagtgggtaagattaaccaattacttctcggtagtttctcactcttgtactccaactgggtgtgttagcctttctcttgtgacatggaaaattgtattcaaaagcttggaaacaattttctatatcaatttgatctgtagataagattccatgcacgcgcattgatggtgcagaaaagaatttttagttcgtgccaattcacagaaatgacaatgcaataaggcattcgggagcttggtactgtttgtttgttctttaggtgccagaaacaaagggcagaaatcaaaaacttgagatggtcactactatgtcctgtccttagcaaggaacatccatgtgcaagcgtgctgttcttgcagctgtccaaacaaaaattccaattcagagaggccactagcggcatatgcaacgaaccagcaatttaattattgtacttgtatagcataatttaccatgaaatctgaatgagaaaatttacccccctgtataagagcaaataatattttccgcattacttgtacaattttttttctcctgttatattcaataaaattagcacaatttagtgtcggttcattaaaaaaaagaatgagaaatttggggtcattaagacttaaaagaggtactaaaattttgtgtatggagatttttttttggtgtgctgggagtgtatgagacccgtccatcacttctaatctaataattaatttgacacctcctgttatctaggtactgaaaggtagcaatttttttcgccggcctagctagctagccgatgtattaaggaggagagggtttagaaactgtacagggatgtacaaacagagccaaaagccaaaagtctcacaccaaaagccaaaagtctcctactactttgggactgttcctcagttacaaaagagatagtaatagatagagaagcataaatacctccattatttgtagatgtcacttcacatcaaagaagaattcggcttaatctcatcttttagatgctagaagatccttgctgtgaatggctatcatcgcatatttgacacaaactgcaccaatgctttcttcattccattattagtccttagatatatcagacgtttgatacaacacgcacacatgcagatatgctgcctgcctgcctcgtcagaaattaggaacaaactctcctggtccttaaaatttactagcttcaaatttatcctaaaataaagttattttttttacctacacccatatcatctttcatttaattttttctatctactttatattcttaactaattacttccatcaaaaattctaactgttttattaataatttatataacaatataacgaaaagcttacattttaggacggagggaatatccgtttgatgcacaacacaggacagcagcacagcaaccatctgagcctttaaataccccacaccacgagacctcccctgctccgctccaagacactcgcacgcagacatcacatccattccaggctcgatcgcttcgatccctttgcctgagaccgagtaagccatttctccctctgatcctcctgtgaaaatttctcctaacctttgtgattgtttgcctggtttctcttttattcttgcatgtgttgtttcagtttcttgtagcgtgattcttggagataatttacaaggatgagggttttctgttatttcttcccgaatctttgggatcagtcagatctgttctttttcactgtacagttcatcagtaatactgttggagcttcgattggaatcaaagtttagattctgcaaaccattcttcttgattgcatggcttcatttaatcatgcttcttctttttcttcagtttttttaaactgtactgtactagaggcagttagagtataactgttaatggatgaacttggtggctgaacttctaatggtgatgacttgagcagagaaatggagctaatcacaaacgtctccgagtatgagcagcttgcaaagcagaagctgccgaagatgatctacgactactacgcctctggtgcagaagatcaatggactctcaaggagaacagggaggccttctcaagaattctgtaagctaccttccaaaatagtaggctttatctctagaaaatatattagacttttagctagctgtttctatctggtagcacactgctggatgaactgtgtttgttttatttacatcagcagataataattgagcttaaagtagtgcaattgaaaagttcttggaaatatttttttcaaaaggatcccagttccatattttttttgatgtctcatgaaaagatagatgatagatatggccagaggcgtctccaatcctagtggaaagcttacaagtccgtgattataattaactttcggattttttcaagtttctgacaaggtttgagtgtaagtggatcagtttgcctttgattaatgtaatgacatggcggccaaagtggacaaacaacattgagtagaggacaaagatcagacgtgtcttgtgacatgtggtttgtatggtcaaagtagatgacagtttcattaagaattctcatacaaagatagtactacatgacaacattacttcttctcggtttcaaaaaaacaacattacttctgcatgtgaagatatagatcatctgcaaggctccagctcattgtagaaaactaggcttgcattcgtttcttttagacttgaaatatttctcttcaactttgctgctcccagtttctatagctatcctggatatatactgtcatactgatgctcatgctagatgagaaatactctagctcagaaaaaaaaacacgaatattaaggaaggatctaatataaaataaatagaaggagtgaggtttcgaacccaggccggctagtccaccaccttgtggctctagctcagaaaacgtctgttgacaaaatagtcatactgcattatcttcaatcggatacaaggaagtctcgcacacgtgatatatttgaatatgaaaggtattgatcacaagattcttgaactttactttacccttccctgaaaaatggttccaggtttcgaccgcgaatactgattgatgtatcccgtatcaacatggctacaaatgtcttgggcttcaacatttccatgcccataatgattgctccctcagccatgcagaaaatggcccaccccgaaggtttatccaagttgcattcacctaattctttcctctttattttttttttcaaagcaatgtttctcatggagatgtttatctgacatgcaggagagcttgctactgcaagagcagcttctgctgcaggaacaataatggtttgagagatatccaaaagcttgttatgttttttttggtctcaaaatgattaattcagtgttctgatgctatggctcaacattatgttttttttttcagacattgtcttcatggtccacttctagtgttgaagaggttaattcagcagcgccggggatacgtttcttccaactctatgtatatatttttcttcaaaaatacttaagatgtaatgaggagcagtgttttcagtttctaaaccttagctgagttacctctgtctttactaggtttacaaggataggaatatagtacggcaacttgtcagaagggctgaattggctggttttaaggcgattgcactcactgtcgacactccaaggcttggtcgcagggaagctgacatcaagaacaggtcctaatctagcaactctgtacacaattactgtatgctttaccacgttccatactgtcatttcatcaggggctttacagtcttaagtatgtattctgaatttccgatgtcttgcagattcaacttacctccacatctggtattgaagaattttgaagcgctggatctcggcaagatggacaaggtttatctaaaactgaacccttatgcatctatatatgaacaaaattttcttatattcttaaatgtgttttatgtttttattcagacaaatgattctggccttgcttcctatgttgctagccaagttgaccgctctctgtcttggacggtatatgcttcgataccatccttagttttgtgcaccaaacaatgaatcagaaactgggatactgtcctggttcttctggcacttctctgtggcaatgagatgctgatgctactgatgcacaatgcaggacgtgaagtggctacagacaatcacctcgttgccgatcttaatgaaaggagtcatgactgcagaagatagtaagtgcagtttcagagtcctggttgctcattgttcattggtatggcatgccatggtttgatggctgatgatcacatggatttggtgcaaaa

SEQ ID NO: 50440 - DNA, 11389 bp, Oryza sativa
cccagttactgtcataaaatgcacttgtaaacatcttcagaggaatcttcagtgcaactgacatattcagaaattctagcaagaaacttccctgaacttccatgatctatactgaaagtgtcgagcaaactcaggtcgtcagggaggcaaaggggcggctgccggtgttcctcgacggcggcgtccgccgtggcacggacgtgttcaaggccctggcgctgggagcttcaggagtatttgtttgtccccagagcctgcattttcaatcaagttagtacagtaccatctgaatttacagcccgcttaacgccatgagcatttgggtgttcgtcagattggcaggccggtgctgttctcgctggccgtggacggcgaggccggcgtgaggaaggtgctgcagatgctccgcgacgagctggagctcaccatggcgctcagcggatgcacgtcgctggccgagatcacccgcaaccacgtcatcaccgacagcgacaggatccgccgctccaggctgtagaggctaagctctgcagcggttgcagtgatcgaattgtccatgtatggtatgctagtccatttgagatgctactgctagtagttattgtgatccctcccacatttgatgatgccgggtaataaggagagggaggaggctgggatgtgtgcctccaggtgtatgtgttcggtgttcctccgtgatggaggagtatgtagcagggaatttgtcactgttgctgtcgttggcagggaatttggtgattcagagtagtttgtgttggaaaaaggaaaatctgtccaattctgtctcgacactgactgtgatgctttgcatcgtcatttgtcgtggacgaaacgaagcttttgcctctgttcatgatttttttaaccttttttattttaaaatttaaagataaacccttccaaaacttatttccaaaatataaaccttctcatcacatcagccagagtaacgtggccaaataacgctgccatgtcagcgagattggcgtgacaatattgttttgccacatcagttcagctagcatggtcaaaatgttcggattttgaaaataagtttgtgtagggtctatttttaaaattgaaaattaaaggttaaaaagattaaaaaaaattctctgttcatagctcaggaaatcgtttgctctctgataaatgggccccaggcccactgtcagtttcacatacactcctccccagtcacctacgaattccgccagcggcagtggcggcggcggcgctcctcgccgccggccgctcgccgcctcaccgatgccgttcccgcgcctccccgcggtgtaggtccagttcctagcagccagcgcttgctgcctgctggcctttcaactgcctccaaggctccaaccctagcgcggcgccatcatcatcccaatcgtccgctacagcctacaaatcgcggtgatggtcgcgtcagcgtcgcaagctaccgaactagcgccgcttcgtcgtcctgccgctgcggcttgcagggagagacagcgagagctgtgctgatgaagtgatgaaacttgtgggcttgcggcttccaggaccaaactgcaggtaccagcaccaatttttattccaagaacacgcgtgatactctcctctagtaaaatacttcagatatcagtcaatctttggtgtcttgctgatggggaaaatctgattcttgaatacaaaattagtacacaagtaaagatccttcctacctccaagatattctcccctgtcactgtcggtagatcaccactctcttcctcatccacacagatgaacacaaagaggaaagagcataaaaaagccccccaattcctccttccagttcaagagtacaagaaagacacaagcacagacaaaattcctgagccctgccccccgttgcttagtaaacagtgagtcctcttgctgatctatcgtgcagaaattccaaaactacacctttggttttagtatacttctttttcatgcatgtcttttaatttgatggatttgtgtgggggaaaatgtttcgcttgagcttctcgcatgctctattcctgttttatttcatcaaattttgtgaatctgtaagattaattcgattcatgggtaattggtaagcacgacatctgtgccattttatatcgtataagcacctttgtactgatgcatattacataagggccatcattttttttcatgttgcttttgccttccatactaagctggtcctgtagcattttggagtttttatggctgtgctgaagataataatttgagcagggagatggctctggtcacaaatgtgtgcgaatatgaagaacttgcaaagcacaaactgccaaagatggtttatgatttctatgctgttgacgcagaagaccaatggactctcagggagaacagtgaggcattctccagaattttgtaagttgtgctctaaattggtagggaatatctgaaaatggagatagggaggtcctgattttgtgttatattcatagaagttattgttaggatgtagcttttagttattttcatttgacattgtgttttgattttgaaataaaatatattacccattacttcgtctttcaaagtatattatggtgtcctttgtggataaatgatgttaggtttcagccggttgtattggttgatgtgtcctgtatcgacatgtctatgagtgtcttaggctacaatatttccatgcccattatgattgctcctacggctttgcacaaattggcacatcctgaaggttctggtttgctacctttatatctttcttttggcaatcgcatatttcaatgagaagttcctttagggatatttatctggaatgcaggagagcttgctactgccagagctgcagctgctgcagaaactataatggtttgaaagatcgtaacaaattttatgcattttgatatctacgtctgacacattgattcaccaactagtcatattttcagacattgtcttcatggtcatcttgtagtattgaagaggttaatttggcagggcctggagttcgtttcttccaactttcagtattacactattttctttcttagattcttcacctttcttctttaggatttatgctcccttacttcttatcaatgtcttgttcagatatacaaggacaggaacttagtgcaacagcttatccaaagggctgaaaaggctggctataaggcaattgtactgactgttgatgctccatggcttggtcgcagggaagctgatgtcaagaacaggtcctcatcgtgcaaccgtagtgtttgacttgtgcattatgcattatttaatgaaaatctgtaccctgcatcaatatccttttcttaaaggcacctttattgaaagaagaaactccaccgcaaactcattatctgcattatactttacattacattctaggttcaccttgcctcaaaatgtcatgttgaagatctttgaggggctggatcaagggaagatagatgaggttgtctaaaaactagtgccattgtgtgaagtagtcatgattctgtttaacaatgccctgaatcattctatttatctgatgtttcagacgaatggttctggtcttgctgcctatgtcgctagccagattgaccgctctttttcttggaaggtattgcagtgacactatgacttgtaatttccagataacaaccagttaatatgaaagattttaaccatcagaacaatgtcatatctcagacaattcttaatgtgaatgaaaccgtgtgatgttgatgactcatcctacaatacaggatatcaagtggttacagacagttacatcattgccggtcttagtgaaaggaattataacagcacaagacagtatgtcctttgctttcaattaccttgtgtaactacatgcctcattatccaagctgcagatctcacaagacatttacaaaaatgcagctagaattgctatagaatacggtgcagctggtatcatcatgtccaaccatggcggccgccagctagactatcttcctgcaaccatcagctgtctagaagagctatgccatatgtaactctcttttcaatcttaatgaaatttggtcggctccttcaccgactcagcaatcagctgtgtagaagaggtatgccattgataacccaatctgcacttcagcttattgtgcttttaaacacattttaactgaaaacagcacgaatctcaggttgtcagggaagcaaatgggcgtgtgccggtgttcatcgacagcggttttcgccgcggcaccgacgtgttcaaggccctggcattgggagcttcaggggtatttgtaagtcccctagctagctactgcttgaatgaaagatgatgctgaattgctcatgacacggcatctgcatacgcttcttgttctgtcagattggtaggccggtgctgttctccctcgccatcgacggcgaggccggcgtgaggaacgcgctgcggatgctgagagacgagctggagatcaccatggcgctcagcggctgcacgtcggtgaaggagatcacgcgcggccacgtcgtcaccgagagcgacaggatccgccgttgttctcggctgtagtgtacccaggtttcctttgcgtttgcgttcttgggagtgttttggctgactgtggaaaattctaatttgttttattgtgatgttttctgatctattatatcgaccctctcatggggtatatataggagtacataggggatagagacttggagtataatacaagtaagagtagatttatctctaggattctatctttaggactctatcttatctctaggagtcaatctctaggatatatcttatctctatatttgtatttgactcttatctctaactaacacattatatttctaacaaaagacatctttgcagattgcaattgatgtgattctgtaactttgcgttcattgtcagatggagatggttgtgtttttttagaaacttagtacaatcaggcatgtggagaatggtaagtatttagaaacacaattcaaacataggcgttcataaccgcgtacgtataacatactcacctatatgaacacatacacatggagaatgacaagttttttaaaaacaaaattcaaacgtgggcattcataacgtatgcacacacataccctattatactgaaaaaaataattagtcgtagaggcgagcatctgtacatcaagacaataattagtcgtaaatgcaaacacatgtgttgactctagaacttaattcggatggattaatttgaccataagaaaccaaactagttgaattacgccgtaatacagataaatcctaatagatctattttagaagatgataagttcataaataatatccaaattcggcatggttcacattaaaattagaaattatagacgaggaaggaaaccaatctgctgccgtgttacacggtaaccgcagtttgcaaccgtcaataggagaccctatccactacgaaatccgttggatccctcgtgctccgcaatctcagccgtccgtttccccctatagtcccccttacctccccttctacagttctacgaagtacgatccaaacaccagcggcgaaggcgacgaagacgagggcaaaaacaccagaaggggaaaacttttgctctcccggcgatctcgagatctctcaagatggtaatcccccatccaatttctctctacttttcctcggatttgcgccgcactcccgatcgatgtcttcgacgcggttaactgcgatggatttgcgcgagatcggatcctatggtctagaatttcgagtcgattaggcttttttttgggtggtgttttgcgttgggtgatttcagattggaagtagaacggggggacgaggattctgagaagaatctactggtctttgtcgtactgaatgctctcgatttcctcctgttttgatcgcgtctgtgtggtttggtctggtcaggtggtgctgcaaccagatccgtttctgagcgagttgacgagcatgtacgagcggagcacggagaagggatctgtctgggtcaccatgaagcgatgtgagtgcgcgctttcatctggcaatctggtttgtgatttgggtggctgaagaactgatgcttgagttgatgggggttgtttgatatgtgcagcatcgatgaagtgccaggcaaggttgaagaagatggcggcgaagggagaggcagtggagtaccggtgcctcgtccgtgccaccgatggcaagaagaacatctgcaccgcggtacagtgactgtcctattgtcctttgctgtgctgattttgaattattattttgcttatggttgttagttttgtgcataatggttaccgattatctggtattcgatgctaattatgccaccaggcggtaagtgaggaatgtgaatatgacattaggcgcttttggtattgcactaaaacctctcggatatgaaatttcggtactgagccagtttatttggtattcaagtcagcaaggtatattgttttaagagatagataaaagtatggaactgtagaagtgctgcaataagtatgatccaaactgtgaactgtatatatagtgaacatatattgtagattggtctatgtagaagatatacagtacgttggtttcttgcttaagcttctcacaagcatcctttcgcggtaacatgtgtaggcactcgtgaagcatgatcataaacagcgaggtaccgtagaatcagatgcttactcataggacatcttaactcgcatcctattgaagtagaatgtgtaacataatcataagttggaacagactatactatcacatgcttagttgtagcatggtaaattgataataaacatgaatgaactttgttcaatagacaaactagccaagaaaacgtttagtgccattcatggtgttaatattgcatgtttgcctgccctacactaccgcagtctcattttcatcctatgctaagataactctcaagttggtgtagatattgagtatgaaactcatttgtgtgctcttgccaagttttgattgcattaagtagtgaggtttctcattaattgcaccatcttgcattttctgaaagcgtcatcaagttgtttgagcttaaatttatatggtgaaagtattgtttctaatgataagactgtagtatcgatgggcatccactggccactttttcccatgtgattaatctttaccaccaaacagttgggtcgataatctttttccacaagagtaagaacgccatgataagttcagagtcccaagatctatgttctgaacagtttattttctcctctaccctatatgtggtgaaaattcacatggtgatgtgaggtattccatatgaaggctaaaaagttggtgattatatctcccatgctgttcatgtagatacagaataatagctggtttggaaccatgtgtgtccatatctatttgtccctgctaaattacatttgtcaaagctcgcccaatggagcatttatttgcccctgctattgcaataatgcctcctaggggtcgatagtgcaattacgagctgaggtaaactactatatttacttagatgttagtgatactatgtttttttccttcaatactatttataggacagtcatttgcaatacttttttttttgtaattttgatgaaaactggatatctgagttgactaattacatgttcgtagttttgatgaaataatggatatttgaactgattaatgatggatttattcatctttctgaagccataaacattagccatacttatttgagatgcgtaaattattctcctgtcacttccttagctttttgggctacccaataagtctaacttaaaaagctcgccatgtctttcagctctctgcaaaggagtacctgaagttccaagcttcatatgccacagttcttaaagcccatatgcacgctttgaagaagagggagaggaaagacaagaagaaggctgcagaggttgagaagataccagagaaggcaccgaagaagcagaagaaagcaccgtcttcaaagaaatctgcagggtccaagtcgtaagttactgaaagaatttgctaagcccttttttggccacaggcctgagtaagatgggtgtagtcaagacattatcctccattttactcttattcatgtctgcgagatgaagcatgtgaatacctttatagagctgtgccgtcgacattagcaatttttgaagcagctttggttgtctagatgtaagccgccctggaattttctatttctatcatagaaaggcatctcttaaactgtgcctgatctgatcgtcaagttagtgcaactttcaattgacagaattacgtctggaacatgaagttatgcaactaagactgcagaaggaaattgcagaactgttatctggatgtctgtgttccttcaattttgtttttctggttggggagaaaaagtgtgaaggtatgtctgtgtcacgattcccacatgcaagtggtgatcagaatataagcagattccatgtttaggttggtgcataagcaaacggcgtactactatgggcctatttggtagagcttcaactctggattttagctctaggagttgggtctggagtggagttgtagagctgcctgaacctagctctatctctgagattttcacccttctattttaagtggagctgaggtgccaaacaggccctatctctcagcaattgctgcatcaacatggagcattggagggccgtatgcccgtatcctgtgtatgggcacagcattgtcggttcctagctatttgttctgccatcccccggtcccaactgattctcgtatcggtccagacaagtccaaaagctccaagctccagtttttacaccatttcgtttttctttaacacggttagaatttataaaccatatcatgtggtggtatttttgtccagagattcacctcagaagtggcgaattttttatcgtaccaaattgcagagacgaatctttgctgagtaggaggcagcaaccactatgagcagccgtcaccatccaaccggacaaaatcccatcaaaaaataaacccaaagaaatcaaaacaaaagcgagcacccaccgatgatcactcactgatctctcatcaccaaacgcctccgacctcgctcgcgtcgcgcgccgcgcaaccatccccccggccttgccaccacccactcccgatcgcccccgtcgccacccaccccctcagaaatctcatcttttccgcctcctctcgccaaccaaacccgcgaaacccccacaaacgacggtggtgaaagaagatgagagggctactcgcgtgcgccacgctcgcccgccgcgccgccggcgcgacgtcgacggcgcggcggcacctggcgggcgcggccgaggcggcggaggcggagctgaagaagacggcgctgtacgacttccacgtcgcgcacggcgggaagatggtgccgttcgccgggtggagcatgcccatccagtacaaggacaccatcatggactccaccctcaactgccgcgccaacggcagcctcttcgacgtctcccacatgtgcggcctcagcctccacggccgccaggccatccccttcctcgagtccctcgtcgtcgccgacgtcgcggcgctcaaggacggcaccgggacgctcaccgtcttcaccaacgaccgcggcggcgccatcgacgactccgtcgttaccaaggtcaccgaccagcacatctacctcgtcgtcaacgccgggtgcagggacaaggatctcgcccacattggggagcacatggaggccttcaacaagaagggcggcgacgtcaagtggcacgtccacgatgagcgctcgcttcttgcattgcaggtgagcggtttctgtttcttgccctctttcatctggggaatctgttggtgattttagtttgcttaattgattgcctcaattgattatacatttcggaaagggatttagcaattgattatttctgggatttgggaatgtcatgctttgagatgagtagtcaatacatggataaaaggtccattcctgtcagatataaggtgggatgtgtagtcactagttagtggatgatggtaagcgaagaaagattcgcttcatatgaagtagtaattttcttgcctacttgaagaaaaactacatatcgtttttattagctggaggattagagaatataagctgttaggcttgtttctttctgcagttttatttgttatattgtcaacgcagggtagaagataaggcttttttcccaggatgcacaatgccttgatgtgcatatgagcaataggtagtaaggcagatgtttgaattttgatggcgtgttggtggaaacatgcggtgacttattatttgttgtttaatgtttagtggcattttcatgatcagtaaatttgatttctggttgtcaaacaatagttctttgctaaatcattattttatttgttatagtgcttttttggaactgactatatattgatttgttgaggtagtggttgagcaagtttgtgtgtccttttcttggttggtggaagtaaagcttcttctagtcctgtgggtttatttttagtgtaatacagaagtgtctaggccatattgtcacaaaacaaactttaagtttcctatgcaatcacgatacaatacacataacctggtttcccttctatagcaactaatttcatcaagaaagaggcagatggatgtctgtgcaaatgtatattcatggatagaaacattgcgcgacatattttgtactttcaaattttcatgcaagattgctgcagaacttgtccctcaattcctactccctcagcctttgtggggttttatcatagtgatcagctttcactattacagcacgtagaaatttaatttttcctgacggcattacttgtttttcacacgaacagggacctcttgctgcaccaactctccagttgctgacaaaagaagatttaagcaaaatgtatttcagtgacttcaagatgattgacatcaatggatatgcttgctttctcaccagaactgggtatgcttcatttgatcctttagccaagttgttaacaaccatgctactacctttgttttgtggaattattttgaacactatgtcaatattctgagaatttcttacagttataccggtgaagatgggtttgaaatctctgttccatcagaaaatgcagttgatcttgcaaaggccctcctgaagaaatctgagggcaaggtgagactgactggtttaagtgcccgtgacagtctccgcttggaggctggcctctgcctgtacggcaacgacatggagcaacacatcacaccagttgaggctggtctctcatgggcaattggcaagaggaggaaagcagaaggcggt

SEQ ID NO: 50441 - DNA, 4785 bp, Oryza sativa
gcttgttctgcagcaccgcaactgtaacttcggtaaggtctcatcttacagcttgacattttacctctgcccatctaataatatgaaatgtgatatgcagtatggatcctttcccacaggtaacccatattttgtcttcagaactggttgtctgcgttggcagttgcaaggccaataggccatgttccccgtctgcaacagatgtcgcagaaagcaaattcagcatctatttgcctcctgtgtttgtctataaactcagatgttcttcaagaaaagaacacttgatagccaaacattaaggaaatcgagacctgtagttccttgatgcaaaagagaataagaaatgtagagagaaaacaaccatgaacttgcagaaaaacagtggacacggttccaattcatagatctgggtgattctgcgtcagcatgataattccacttcagcgagaggctgaagaagctctagggaagaagctgctgaactgttgcgaccgggcctactggtgatggcaccacaggtcagtgaagcaagccatcggtttaaaggggctgtttagttcatgaaaagaaaatttttgggtgtcacatcagatctttgaccagatgtcggaagggctttttggacacgaatgaaaaaaataatttcataacccgtctagaaactgcgagacgaatcttttgagcctaattaatccatcattagcacatgtgggttactgtagcacttatagctaatcatgaactaattaggcttaaaagatttgtctcgcgatttcccccctaactatgtaattagtttttttatttatctatatttaatgcttcatgcatgtgttcaaagatgtgatgtgatgtttttaggaaaaaaatttggggtactaaacagggcctaaggtttaccttcctcttcgtctactgtccgattaaacttaggcggctgagattgagggagaaccagaggtaaaggtgtctttgcattgggaccctcatacaataccgtattgctttacactactaggtccccaaaaagttggatgtccaaatgtcgttctcgccatataccgtccgatctcacataggcggtggatattatgttgggggactcggagtaacgtggcggtgacttttcatagcaactctcgtactgcactgtatgcgtagagcataaaagttggatagctaccaacggtagcgatccagattgccttcaacatgaacaccccacctcacgcagtcacgctcacgagctcacagcaatttgggttgttaagttgtttgggggattgggatcctctgtcgtagcatgtaatacaacagatagttatagtatattgtatatagtatatagtagtccctcctttcctaaatgtttaacgtcgttgattttttaaacatgtttgaccgttcgtcttattcaaaaaatttaagcaattattaattcttttcctaccatttgattcattgctaaatatacttttatgtatacatatagctttacatatttcacaaaagtttttgaataaaacgaacggtcaaacatatttaaaaaagtcaacggcgtcaaacatttagggaatgagggagtattagaggtattgtgtatttttgaatgtgattatagatggccatatggcatgaggcccatggcccggtccaaggcacgccaatttggcccggcccaagtacggcacggcccgacagccagaccatgcttgggccgctcccttggcacggtgggctggcccggcacgtcactgatcgaaaaaaatagtagaggaacgtaaaatagacttaattaaccatataaggcgaggcccaaagacatgaggaatacaaatagacttatttccaactatatgtgcataacccacagagtttagggagcaaaaatatacttattctgtggagtaaagtgctactattcttttcttttcagaaaaaaactgtgtttattaatcaaggacaattacatgagttacattttctagtgggtaaagttgagagaatagctagttttacataaaagcccctaagtgatgggtaaatacacttcaagaataacatatacgaaaaaaagacctacaaagataaaataaaaagcaatcaaatccttgcaacaaccacataggcgatggcaagatccttgcagacgacgacggcaggagcaaaagaaacatgtttagttgcaatgggtagagccaaggagcatacccgaacgaggcctcttgatagaggttgaagccaccttggcccataggagaaatcatcagccacattttgcaaaacaaccgtcagagacgaattagacaaccactataagtatgtgagacttgctgaatatggagtaaacaaccgatgcaaccttttgttagacatgctagaggacaagctttcaacccaaagcaaaactcccaattgaaagcattggaggtgaacccaacattcactaggcagaaagatgacgctagcaagaacgtcaatgaggttcgccatgtccatcaagctgagacataaaaatcgaacgtcggtgaccctcttgaggtacacaaagaatgggatgaacccgagaacgaaaaagatctgactaaacctaaacctatctctagtagtgggaggaaggaaccagaaccctctctcctccacccacacacacaccacacgatgaccagaaggccaccggagaaggaaggaaatgggcaagtagtcgagttttttctgcttaagacacctagagcttttaaggcgaagggatcaaagtgctactactttactgcatttattcactgttctcctcgcatcaacaatccccctctaggttactatagaggaaccggatcattgtttaggcgagacgattcttcccctcccgggaagaaccgaagaagcgcgctctttcaacgccgcactgtcactatcagagctagggatggcaatcgggcgctgcgggcacgggtatgggtaggtgtgcccatgagattatttgtgcctgtgggtatacccattattacatgacgggtaaggatggttgcccatgcccatcgcccgcgggcgccttgtgcccgcggtcatgcccgtttacccaccacaacaaaagcagtggaacaaaaagtctacaagcttctaagttcgaatcgaacttaaaacatcaaatattctccgcctcggtgtggtatctctcctctggcggcgatagagtaagggggagagaaataataagggaaataaaagggaaaccgtagaaaacaaagaacgtggcttatgtattctagtggattttgctcttagcctacatataagttagattttgcgggtaaacgggcaaagcgggcatgggtagtgattaccaatacccatgcccatttactcatcgggcatagcttttgacccaataagatacccatgggtataaaatagagaataaacctaaccctaatagagtttttacccacgagtaaacggacaaacgggcacaattgccatccctaatcagggcgggcaccccacgactcaggcccggggcatattcagatattctcgtgccaccggtacggtgtgccaccaagtctgccagctacacggaattgggcaaatagcgcgctgcagcccaggccaggcgcacagaccacgacgactcgaaggcaacagcggcggccgcgcctgacctcctgcgctagcctcaccaggccgcgcacgcgtgtggcgtcctcgtcaattccgcgagctcattggcacgcgtgtacgatctgtcgcgccaagctaggctgcaccacgccccgttgccgcggaagcctcacaactcacagcgcaggtaggtcgatcggttgggctccgtctctgcacaattagtcgtgcgcccacatgcacgcgacactactacctgcgatcgagccagtggtgtggccgctgccgcttgtgggcgatgcgtgcaactgcacccgcgggccgcggcgccgatgacccaagtctcgcttcgcgggcgcatgcacgatgatgcgactggttgcattgcgaggtgcgggtgtcagtggtgtgtgggcgatgcgtgcaagtgcaacctgccgcagacagccacagaggagggggggtctacaagctgcgcggccggcgcaggggagaggcagaagcaggatcgcggtccatcactccactcgtgagcacgagtacatgccatgcttgcttaattaccctgcctgacatcggtcactcgccgggggtccaaacgtacgcacgccggctaccccggcccctggcaacttatgcttcgtgtcgggcaccaaactctacgattccggagtaaattttctgactaaagttactcggatatatatcaaccttaattttgcatcctctgttctgtttgttcaactgagtcatggtcaatgcaactcgagcacatatctcgtctgatgccatgttgcttccaacatgggaatattttcgattcctatcaaaattggaactatcttgttacagcatccctccttaaatataagagattttgattgaatgtgacacattctaatacaacgaatctagacataaagcctgtctaaattcgttgtacttggataaatcatattcaaccaaaatcatgtgtatttaggaacagaggaagtaatttcaagccgaattcaagaaaaccttaaccgcgaaacactagtaccgcttccaccacctctctcctggatttttcacattttggtccttttaaaaaacttatttcgcaaatagacccctgaaaaaacttatcccagaaatggtcctttttggggcgccagagtggct

SEQ ID NO: 50442 - DNA, 11672 bp, Oryza sativa
aaataagttttttaaaaggaccaaaatgtgaaaaatccagcacctctctccatgcaattatgtaagagtagttagctgcacctttctgacagatccataccaagcggccagctaaccatcggttgggccccaagtgaaattatcacatagaatctgcaaggctagtgacttttacttgatgtaaaagaaaaaaaagtcttcctcggatgcgaggtgagcttcttgcttgcttctgcggacatatttatgtcgctcagggcagttttcttcagagagaatggcctgcattttattgcccatggttagttatgtcagtcacctgtccagtgccatgccactgcctgactggcataccagtagacagtagtaggagtagtagcctttgatcataccaccagtactagtagacagcagtactgtactcctactccctatgtgcctccctccgtcccagatattttgattttttctcgcactaccattcgtcttatttaaaaaaaataaagttattatttattttatttgtgacttactttatcatccagagtactttaagcacaatttttcgttttttatatttgcataaattttttaaataagacgagtggtcaaacgatacaaacagaaagtcgaattcccttatattatagtacggagggagtactggatgtggcacatcctattactacgaatatggacatacatctgtccagattcattgtactataatatataacatctatttctagatttactttttttttacggagggagtatgtgcttaagttaatgatctcttttgactactagctccaacctctcctattacaacttcccttgagagcaaggctaataatatagctgacttgttggctataaggttatttgcaacattctctcaacccactcatataatagttaactcgttataattaatacagggaccacttgtctctctcacatagtttcttggttcttgtgtccaagccggctgtaagtttacagcccgcttctcctctctctcctccacctcagtatttagtcggtttaaagcctcctattatatttgctctaagaaatagaatggcacattgcatgataatacatgcatgacgctgttgctgctagcactctaagggcaagtactataaacctctacgcacttgcccctaggtgccatgcttaagctcacacgataatgtggatgagagatatgaaagaagagagagaacgagccacctcttatgcaaagagcaacttctacacaaactccaagagagatgagaacaagagaccaatgaattgataggaaacaaataaagtaaaattaatattgtgtattggggcaagtgtactagaggtaatttgttgtatatattgcctcttaattaatgagttgatgatgtggactaaattaagggtgacctccactgtaaaacctgactgctggttatcgtttgctactgccaactccctctgtccatttttttaaaactagtaacatcccaaaaagaacttaagcagaaagacaaaagataaaaatacccctaattaatagaaaaattatattggtggatgcgtatatgagagatatggaggaatgaaatttctcaatttacggaagaaggtaggagtttgttatttgggaaaaaagtttaaactaagttggaacggagtagtactcttcagttcaggaaaaatacatttgctagtgttgacgtataattgtgccgccacaccttaagcacgctatgtgcaacacggagacacacacgcgcagacacgccgccgtagggagtaggtagatgccgccgaccgaacagccgggaaggacctcgttaaggtgaacgtgcattggtttgttctaaactcggcaggctagctaggacgccctctaacgtcgtagagatgagagacaacgagcaattaggggatttgaggagaatagactttgggataggtagcaagaaagagggagatgtagaatataaagggtttggataaataaattgattttgacgattgattgattgttatttcaatcgaccttaacccccttatatttatataggaggggtggacttacttcccagggtctttttcacatccaattaggtgtagaaatcaatcaaaactctaaaatctcaggcattagcagaaacccgagaaccaacaaatcggactcgagtcggactctgccggtctgactagctacatgccgccgatcagatcgtccccctgtcatcggtctgaccagcccgatgactgcgatcagaccggccttcgcgtggcaagtctgggttgtttttgaatttggctgtagtttctttttcatactctaggagtcaaatttggatattaacaatacaatttatgttcagagtaaaaacatttgccactattactggccaatgattgtcatgctgtgaaagtgttgatttctatcattctatggcaaagctttactactaataataatcagtctgaatctgcattctctctacgtccacgaccatgagcgaatagtacatgtgcctgtacttacctgacagagtagtcttgagttcttggccaccacatcagcttctttggtccccagcaggcagggatacagtagtacggcaatgtgtggaaagtggtggtaaacagcataggattttactgcaagcaccggcaaagataaacaagaagcatctgatctatataatgggatttgcattgtcattattacactagaaaattacagtacttctttacaaatgaaggtcagaaaaagatggcgacatgaaaagctcgcttgctccaattgtacgtccttttgagatgctctttctgcaagctctcttccaagcttactaagatctttatcgtaggcaaagacttgcgatcgatgtggatctgtctgtctgtctccctttgggcacttgtgatcagcttttcaagttcagacactgcaaatactatgtagcacacagaacaatggtcatgcactcttttgtctctactactatcttttgatccttctaatcgatcttacgtgcactctcaacattgccttttatgccgttccgcatgagacgattgctacactgagagcttagctaagtttaaagtgtgttcactgcgcttttgtgccaaaaaagcagctggaaaagcagcaacaactttgtcgtatgaattggatggaagtgggaaatataataaactacagggccacaaggttattcctcaatttcatcgtataatcagataggggtatatatactgcatcgacattgctattccctccgttttacaatgtaaaactttctagcattgtccacatacatatagatattaatgaatcaaacacatacatatgtctagattcattaacatctaaatgaatatggggaatgctagaaaatcaaatcttacattgtgaaacagaggaagtacctaaatatcacatcagatatacctgaagaatgtaatcagatattactgaactacacttcttttcagccacaccatgcatgtaaacactagaaaaattatgcgactgtaaaatctgaataactaatgacggatcgacaagctttaaaatgaatcatgtcaacagaacttagtctgagaggctgcagtttgctagtagcatgaaatcaagaactaacttatctgacaagagggagtatcaaattaacaaatcagagaaggatgagcacatgcgtaacagcaacagtttcttaatttactcctacgtactaacagtacatggatagaaaacagttcataaacatctagcatcagttcctctgaaaaccagaaaaagaaggtctctatcacattgttgaactcataataaacgagtacaaaaccataaacctgacagggaaagatctaaacggattaaaagaaataatgaaaaaaacatccttacataaacaaacgagcagctgcaaaggcgacgtgatattggcacggctcaatcaaagagtggagcccctcgccttcggagcacaagctttctgattgaaccgcaccaatatcccgttcccacatagagagcagaacaatcccccaacgatcagcattcagatcagcaaaacaaggcaaatcatcagagataaaaacagcaatccaatcaatacactccctctcaagtactctcacctcactaggatcaaacaagagttcatgaggacatgggatcagagaaacacaacagctagctaactatgcaaagcaagtaagcaactagtttttttttcttggtttcatgcagaagcagaagtgaaggagatgagaagaggaggagcaggagggagaggaaggagtcgtaggatcctttaatatggcttcttggaggcaatgcaaaagtgagggagaggtagttgtagatgagaagaagaagaagaagaagaagaagacgaggagagcttagctaggagcaaaagcacaacatggctagccgctacaacgtgagtgatgacatataggaggaggagccgaggaagggggggcgagttggaacagcaacggcattgttgggaaaacgaattgaatgggccaacaaccaaacaaagaggaggttggagcatttatgagacgcaatgaatttgaacaaggtgagagaagcagcacagtacaagtagtactacgctagaggaggtcgtcacgctaggagatgcctcgagcgagagacgatcgatcgatgtggacgtcgacattaacgacgattcgatcgattccaataggcggcagtggcagcagcagcagcagcagcagcggtgtgggggcgtggctggcttgaatgcactgcagtgatttcccatcccgtctacagcctatgcaggcatggcatgggatgtttgcctccccccctctccctgcagctgcaacctgcatctgcatgccatattgccattgccacccccaagccttctctctctctctctttctctacgcataccatgcatccatctctcgatcgcttcttatgttgcgtcaggttcgcgtgacgccaatggctagctaggagtagtgccgtgtgatgcgtcgtttgccggcaatggctggcttccaaggaaccggctagtctttgtactacgtcgtcgttgacgacgacgacgacgaccaatgtcttctgaattctgatcatctctgatgagctgtgctgctgcagcagctagaagaagaagaactgatcgatcagatctcagtgattctgcgtagtacgtactagtagtagaatgcttgaaaagggaaattaattgccgttaaattcttgaagcgatcgatgaaggcgggcgtgtagtcaggatcggagtatacgacgaccaccatatgtgcatccatcatccgtgaattgatgaagtgtttggccggtgcgtgttgcgtgacgccatgggctgctgctgctgccaacaacaacacgcagtacaattaattatgtaaacggcaggcaggcaggcatgcacgacatatatatgagtttgatgtctctgcatatatggccatgtcgacaacgataatcgagtcaaaatggcaatgatacggggagattgatcgatccagtggccaaaccaatggcgatttggtctgaaacaatttttcgtcgtcagcgatatctgtgcatagataattctcataatgttctttaggcatgtggatcgacaaagggaatcagttcatcatgcatatgaacctttatcgctggcaatctcacgggcgaaatatgattaattatctctttttttttctgaaagaatacatgtctacagtgaagtagctgtagttttttcgtgatggcgctttcagtgattgcgagctttagctagcaatgcagcgctacgttcataaatgcagtatacagtatactgtatacgtactggccatgcatcgtgtacgtttagaactggagtagcggcaatgaatgatctgcagtccatatatatacgtacgaacgcatgtgtagcacgcagacatcatgcttagcatgaatgaatgatcttgcaagccccagccagctttaatttaagttttctgattctggcttgcttactcttaattactactaaagtgacaactaatagtctggggttggtaaggaaaaggattcggctctcacattattcttagcttatcggtaggacctagggtcctaggcttccattgatgggtgagtttcttgtgaaaatggaacacacctcattgatgtttgataagctacaacggacattgttttcaaaaaaaaaaaaaaaaaaaaaaaaaagctacaacggacatgacttgcccaattcacgagcttggaagccaaaaaaaaaaagaaaagaaaaagagaaaaaaggttaacaatgaaacaagcacaattttgcactccacccaacttgaccaaaacacagttggttgtaaattgaatcgcttcctgcattgttctcttctgcttctacttggccaacaaatcaagcacacagcagctagctaatatacattccaatattaatccatcatcccaggccacaggcaagagcaaccaaaaataagatcgatgcagcagattgatccctacaaaaccccaggaaaaaacaatcaggattccctgctcgcggcgcagcttcatcctgacactgcacacattgaatgccagtgccaggatgaagaaccaccatccaggctctgcgaccagcaacagaacccaaacgcagtaaatttaaggacctcgtgccggcgaccttttccatcagcagctgctgctgctgtcggtagagccaggcaggcaggcaataaagcggcaacagcaaccagattaatgacacactgagatctagattgacctcgtcacagcaacggtaaaagttaagagaccacaagagaacacattcaccagagccacaattacttgggagtattatcaagcagcgtatatatgttcagaacaactgagaggatcttggcattactactattagagtttaaagatttgccacgaggtaagcaaagaatatacacttgtttggcaagtcttatttacaggagttgagagcgatattgctgccgcgcctagagcagcccaaaggtgttctcgccactgtaggtcatgtagaggaacccatcctcatccttgttctcctcgtaaattgcggacatcagagcagctgcaaatccaacaaagtgatgaaatgagataacatgaaccatgcaggttctttgagatactgggatcataaaccatgcagtagtatactattcgaccaaagtccttgtgttttcaaaggaaaatgattcaagggattttcagacctgttggtggaagagtattcttcacaaagatgaagattgctttctcaggactgagcttgatccgcttccgaacaacatagacaaactgcccaacggtaagatcagcagggaccaggtacctatattagaaaatcataagctactaaggatgatacggtaatattgattgatacttgatgtaacatgtattaaagtttcagagcaacaaaagtttcgagcttgaatgccatagccataccggcatccttgcaataataaattgaaacacagtcagctgcttttggaacatagagttaggactttacagtgataaatagtaaatactactacatgtttaactaaaaagagcataaaggatttaatgtgatgcaagtactgtaatgatgctgtactgctagtaccaaaaaagtttataggacaccgttaatcatgactttaagtccttgaaacaattataataaaatgaaatatgcccccaaaggacccacaagcaataccattgcatcaatgcagtcctagataaggataaatgaatggcaagagctactagttgctatcatctgaacacctgaagtcctccactagcatttacttgatagcaattaaagacaatattccttcctttagcggttcaatagactaactaaataaaaatctaaatgctatggtttcgtaaatgcttggaaactgactttttcttgtcgatgtcaggaatatcacttctttcagctttctcaacaatcacctacattacattagatatgtaacaaattagagcaaaaaaaccacaatgaaggaaacaacataactgagcaatatgaagagcaagcttacaggaattctgtcactgtacttttctctgatacggttagcctcagcctgcctcctctctgaaatacatgcacaagaagaacaagattttggttattatgaactgactaaaaggctgaaacatctctaaaatgtatacataaatcaaggttgtagaagatggagaacgagaaatcagagatttcaaatcactgtagagaaaactataataacagagtgattacaagaaagggcaaccaaaaaagtgcaatacttatgctgtctatttctcaaaaaaggaatctatgctatcatgttggcacacacattaatcaacttaaatattgttcaagcacaaaaggtaaaagataaaaaattagacaggaagaaataactcagtgaaaaaaagcatgatactaaacatcagggccctttcacagaagattgggcaggatttacagcaacccctaaacatgcaatagactaccaaaaccatgttctcaagcataaagtgttgggtgattgaattggaaagtctattccttatacgatccatcagaaaaggaacaagaccacataagtcttaaaaacaaatcaaagaatcagctaatgatgctggattgtcaggtcaactgttatttatagtctacaatactagagatattgggttttacagccttacataatagttaaaactggtgtatcagaaattcagatagacacattgaggctctttataatttgattcatcagtaatgatgacatattttccccattaaccatccctctatccatccgcacagaacctactattcccattatgaaaaggcatgtactactattattactaccaaattcaaatcagtcacacaactttgtagcaatcgcaacctactcctactcccagattcgcacagaacatgcacaattcaataaacagttgctaccacacacattcagatgttttggtaagccatccccttaaaccgggggaaaaaacatattcctgtgtctctttctctcgtcttcgcacacattcaatcaattatcgaacaaataaacccaacacgcaatcatcgcagccacactactaaagcacatataggaaaaaataaaaagaggaacacgataagaaaacaaaccgaccgagcgtgtggtccagcttgaacgagctcttggccatggcgctccttcctgcacacaatcaccaaatcagcgccccccaaaaaattaaccaccagaaacacaccgatcgaagccaatcgcgcaacgaaacacaacaactcgatcaaacccttacgagagactgagctggtcctggagaacacgagcaaaaacacgaatcaaccaccaaatcggacaaggaagcccccctgatcggcgaacccgatgccgaatcgacggaagaggggagcggaaactcacgcgactcgccggattggattggattggattggggagagggagggggagggtttcttcttccttggcgcaatggagatgtgtgggttgcggagacgggtggtgggtaggagaaaaggtgtggggttgcgttggtttttaagtaacgaaaaggttatacgacttggacgcgctgcgcacgaaacgtaacgaaaaggaaaccttgattaaaaactcctctacgtttcctccaagaaaacttaggcttctgtaatccttaagagaataatattgtgacttacgttaattcatgaacaatgtttcgaggtagtaatgtataaggtcgttatgaaatttacatcgagtacaagcagtaatatacgagttgtttttcctttatattagctactccctctgtgtcaggttataaaatattttgactttagtcaatattaaactgtttcaagtttgactaaggttgtgtttgagatgggaactaatcctttccgcacgaaaaacgaaccgatctattagcatgtgattaattaagtattagctatttttttttaaaaaaaaagattaatttgaatttttaagcacctttggtatataactttttgcaaaaaaaacgtaccgtttagtagtttgaaaagcgtgcgtgcggaaaacgaaaaagaggggttgggaaaaaagggtaccgatcacaccctctttataatactaaattagtttcatcaaatcaataattgaatatattttcttaataaatttgtcttgagttaaaaaatgttactattttttctacaaacttagttaaacttaaaacagtttgatttgtaaaaacgtctcgtaatctgaaacgaacatagtactaagtaatgtataaggtttttatgaaatttatatcgagtacaagcagtaatacgaattcttttttcctttatattagcaacaacatgagatcaatacgccgagaaaatgttcagctgtccttttccaataagcactcaagatgcataatgtttataactttatttagatcgttttttttattttaaagtctttgtcgataaagacacgacaactccatcctagcaataacaatcccaaaacattttaaattgacgtattcgatgacggcccggatcggcccagcacaatccactgatcagcaatactcggcccactgtgttcagtgggcaaagctctcatcccaaagcgcagacaggcctcgttttggtgggcctcaatacatgtgtataggccaaaattttagttcaatctcccggcctatacatgtggaagggccaaattgaggcccaaactagccatcagggcagcgcaaattctacaacgctgcagaagagcacacctaccaggctaccaccgaccaccgtaccacgtttgtatctgatcaacgctgatgcaaagacgacggtcactcgttcttcgctgtcgccgttttgtcagccatcaatattttccgctgggggacagcggaacgacgccaaccgctagtcattcatccagtcgcagtcatgtgacctactccaaccgtttcatattaaaaatcgtttgattttttatcaaacaatttttttagaaacacagtacaaacgcaggcgctcacaacgtgcacacactcacccctatgaacatttttatatttgatcaaagtttacagaaaaatactctctccattctaaaatgtgtagtcttacactatttatattcaatgatcaacaacgtttgactgttcgtcttatttaatttttttattagtattttttgttgttattagatgataaaacacgaatagtactaacattttttttgtttttttataaacttttcaaataaaacggacggtcaaacgttagacacggatacccacaactgcacttattttgggatggaggtagtataaacaaacattgcatcaaaatttattcaatattaaattcaatgggactaattccgtgttgtagatgttgttagttttttttttctataaatgtggtctaaccaaagaatttgacaaacaacaataacgataacaatatgtacagttacgacgatggaataatcatacatctgaagtcctttctttaaaggatcaatcctaaggaagccaacagagagagagcatacatttgaaactagttctttgttcctgaagc

SEQ ID NO: 50443 - DNA, 38773 bp, Oryza sativa
gtgtacgtaagatcaaattgtttaatacgaacaaaataattatgatgtgtatcagatgatttcgggagcaaggaagacggagctgttcatggggcagccgtaccgtaccatgccggcgaccagccggaaccgaggctgggcaccgttgagcactcgagcatgtgccgcacggccccgtccaccaatggaccggcgatcagaggcagccgaacgacgaggacatgggcgcgcaccttactcggcggcacgcgacccggttttcttcgcgcaccacggcaacatcgaacgcctgtggtattaatagagcaggagaaaattatattgagatatatacatggttagatttttttagataatggaatataatatcccggcctttgctcaaaagagctacagggttagatgaaaaaaacgaaacaaataacctgcaaaaggagaggcaaaaggcagagattaagtgatatctcccaaaatttcaaactcctgcaggatagaagcccctgctttgacccatgctctctcttcctccttgatctttgctaggattgaggatagcgaatatgcattgttgcggaagattcttgcgttcctttcgcaccagatttcccacgagattaaaatcaccagggtcctgagaggtttgcgtggagtgtttggagatttcgttacaagtgtccaccattactcgactgagtgatagctatgccagttgttcatctgaaggtcagtcccggtccatctctgcatttctgcccatatcctctctgtgagtcacatttggccaggaggtacagggccgattcatcaacattgtagcaaagtaggcaaatcttttgggtttgccatcctcttttttctagcctgtctgccgtccatactctattttacgtgactagctaagagaagaacttgcacttcagcggcgcccatgtctttcagattgactgatagaagatagatttggcagcccttgccttcctttaaaaaaatcgagcgcctgtggtacatccgccgtggccttctcttccccggcaacaccaacttcaccgtgctcgacgcgagcttccacttttacaacgaggatgcccgcctcatctgcgtccgcgactccctcgacgcggcgcgctgcgcttcacgtactaggatgtgggtctcccgtggctgatcaacgccagctgtccacaccggcgcccacgacaggcgcctgccggggaatctggacaagaccgtgcgggtggcagtgatgaggcccaagacgtcgaggagccgcaaggagaaggacgccgaggaggaggtgcttgtcatcgaggggatcgaggtcagccgaccactccacgtacattaagttcgacgtgttcgtgttgaacgcgccagcgagagcgggaacatcgcggcggcgagtacgtgcaccgggagcgtcgtgctaacgcagacagtgtccaccacgacgagaggatgcgttctccgaggaagacggtggcgaggtcactactataaaactaattttcgcagtggccaaaactaatttttatagatgggagagaggtccgcctacaccacaacgactgcgaaaatcatcgatttttgcagttggggcaacagcccgcctgcgaaaatggaagggacgaaaaaaaaaaatcgccggcccacgccgggagccgccgccggcctcccccccctcctccggccagatctcggagggaggggggaagggagccgtctccgccgcccggccagcgccgtcgccgctccacgccatcgttgtccctgttggcctcccccctctctcctccggccagatctaggagggaggggggtaaccgccgccgccgcccggcccgcgccatcgctgcccttggaagcctcccccctccctcctccggccagatttgggagggagggggaggggaaccgccgtcgccgcccagcccgtgctgttgtcaccgccgcccttggcggccttttcccttccttcttcgggcagatctgggagggagggggcaggggagctactgtcgtggctgggagccgcgcctcctcgccgatgtcgccctccgccgccaccggccgccgcgctcccccctccccccctgcgcccctctagatctgggagggacgggccgggccatgccgccctcctccgtcgccctccttggccgcgccgcctcgcctcctcgccgctgccgcccttcgccgccaccgcctgccgccgtcggggagtgtagaagtgaggggaggggaaaggaggagatgtgtgaggacttagaaaaaaattacggcccgcaagtccatttatatctcgatctctactacataaaaaataagagatgcttccatcgtccgaaaaaacccagcgaaaaaaccggacgagagagaaaaaatccggacggaaaaacggtagctgtccggcgaaaaaataatccgattctgtgaaaaaaaaagggcgaaaaaccgttgaaaaaatcagtattgtctgataaaaaaaggcaaaaaaaaagtccgattccgtgaaaaaaagggcgacaaaaaaccgccccaagaaaaccggacgagcgagaaaaaaaacggaactgcccgatcccaaaaaaaaatctgattccgtgcaaaaaaaaagtgaaaaaaaatctctatctctatctctacttgtctatctctatctctacacttaaaaaataataaaagatgttttcttcgtccgtaaaaaaaagctaaaaaaaataaaataaaaagtccgacttctatccgattccctctcataaacggaaaaaaaactccgactatagatccgattctcaatctataccgtgatatctcacagatcttggtgaaacaaaatgatgtgtcggattgaagatctgtttaataaacggaacctacaggtcgatagcattccatttttatatgatttcaatttttgggtttgtacttttgcttttgagtccctgtaatttttatatttacatttgagtccctataatcctgcaataaggtacttgaggccgtgtttgttaaaaataataataaaagagagagaacaaaaacagaaacgtgcatctctactacttaaaaaataagaggtgcttccatcgtccgtaaaaaaagtggacgaaaaaaagaaaaaaaccaaacatatccgattaaaaaaaccagaaaaagaaaaaccaaacgtaaaatagggggcaataaaaaaaaccagatcggtccgataaaaaaaccagaaaaagaaaaagaaaaagaaaaaccaaacgtaaaaaaaagggcgataaaaaagaaaaagaccagatcggtccaataaaaaaaaccggaaaaagaaaaagaaaaccaaatgtaaaaaaagggcgataaaaagaaaaaaaaaagatcggtccgataaaaaaatcccgggcgaaaaaaccgggaggaaaaaaatgggcgaaaaaaataatccaattccgtgaaaaacaaggcgaaaaaaataaaaaaaaaagaatcggtccgattctaaaaaaacgaaatcgggcgaaaaaaaacccgtgaaaaaaaatcaggcgaaaaaaagaatccgattttgtgtaaaaaagggcgaaaaaataaaaaaagaatcggtcgaattaaaaaaaaaagaaatcgggcgaaaaaaatcgggtgaaaaaaccgggcaaaaaaaatccgactatgtggacgcggtaaaaaaaggcgaaaaaaataaaaatgaatatgtctaatttgatcaaagaacgtgggtctgattttttaaattaaaacccgttggataaactcctgagtagactcgaaaaataaattctaaatcatatactaattcatcaaattagtctcggttctacctatttgttaatatatcaaattaaacttgatttttaccgatttgaggtttttaaggtgtcacattatcaaacggtgtttctcccgttgcaacgcacgggcactattgctagtaaaaagaaaaaggaaagctgcacaaaaaaaaaagaaaaataacaacaacaaaagttccgttttcccttagtggcgaaaaaaaaattgtagatccgaaccaaaaaaatccgagtcctataaaaggcaaaaaaaaagtggtgaaaaaaaaatactagattcaattcctttaaaaaccggaaaaaaagtctgattcctataaaagcaaaaaaaaaactgaaaatacatctaaaaaagtttgtccgattccctaaaaaagtggcgaaaaaaatagttcgtaaaaaataaaaagcttgttcgtataaaataaaaaatgcacacgagaaaaaaattgaaagggcgaaacaaagtctgatttctaatcgatatatatctcttctctatctctaatataatctaactatttaaaaagataaaatacacgagaaaataaaaacggttcaaataaacgcgtgagaaaaaagtcagaaaaagtgcaaaaaaacaaacactccaaaaaggttttccatcttccataaaaaaaataaaaaaacgggcgagaaaaattatttccatcgtcggtaatttttttaaagaaaacatgcgaggaaaaaacagtcagaaaaaacgcgccaatttaacaaatggttttaaaaaaccgtgcaagaaaaaaacaccgtctattaaaaaaatcgctctgagtcggatatgatccatcgatgtttttgccacctactacacggcttttatttcgtcatatattctccttactgaaaaaaaaagaaaaaagaacatttgaaaaaaaaacaagcaaaaaaacgcgcgagaaaataattggcaaaaaaaaggcaaaaaaacacacgagaaaagaaaagcaaaaaatggagaaaaatatggttttcgttgtaaataaaaaagcaaaaaatacatgctagaaaaaaacttttaagaaagaaatacgccattcaacttttaagaaagaaatgcgccatttctgaatggtttgagaaaattgggcaagaaaaaaacaccgtttataaaaatacaagccgctcattaaaatacaaacattgtcattgacatgattattcatgaaaaatatatattatcattagaattttttcacccgttgcaacgcacgggcatttttgctagttcaagtctattttcgcaggtgccgtcgcaggcggacattaaatttcatcccgatttctatttttataggcggtaatttggttctaagggtcatgtccgcttgcgaaaataatacaccgtgtctgaaaaaatgatttttctattagtggttcggcatcggcaacttgctcgatgacatcggcgccgacggcgaccggacgatcgtcgtctcgatcgtgacgaggtccggctgcgattcggtcaccatagtgtttgatgtgtaactaatgaataatacggtataaataatgacataattactgactagtcgttctttgattaaatggcgtcattagtcgttctttgattgaatagcgtcaatagactcccatgacgtaacgttgttccttagtacccgtactacttgttgtaattaataaggaaataaatattgactcgtcgttctttgaatttaaatggtgtcaatggtcaataaaaaccttaggggatgattaaaatggaatggaaggagtaattagtaatgtcaagacctaaaaaccttaggggatgattaaaatggaatggagggagtaattagtaataccattgcaaatatagaagcatagtaagaaagaaaaaagtgggcgctacactacagtatacacactagagtggattctaaattcttaggatcaggcattctttcgttatttgcatatcatccaaattattatgaaaaaaattaaaaaaatttaactaaatagattaatatgtgatagatcattccataagcatgcaagttaaaattcaaccattacatgttaaaaaaaattaagctataaatagttaacgtatattcatagttaaattttgttttttttccattacaatctgtagaagttaattttggtattgcatgtttatggagtgattgatcatatattaatttattttattgattttttttaaaaaaaatttataaccatttagatgagatgtaaataacgagtgatctattctcaatagtttagattaatagtttctcgtatacacacgcattgccctataaaatacacacaccactgcaagaactagtttacagctgaatgccgccatggagagcatcaatgtagcacgaggtgcatccgtgacgcctcgcatggcgctgccgtgcatcagcaacctccagacccttcactacaacctgctcttgcaccgcaaccgcaagacgaacgggaggaaactgcggagcgtgtcatgcagggcgagcgccggccgaggcggcggccgcggcctcgaccgccgcgacgtgctccttggcataggcgcagcggccgccatggtggccacgcagggcggcggcggcgcgctcgcggcgccaatccaggccccggacctcggccactgccacgagcccgtggacctccccgaccccgacacagcgccggagatcagctgctgcccgacgtacagcgccggcaccgtcgccgtcgacttcacgccgccgccggcgtcctcgccgctccgcgtgcggccggcggcgcacctggtggacattgcgtacttgaccaagtacgagagggccgtgtcgctcatgaagaagctccccgccgatgatccccgcagcttcaagcagcagtggcgcgtgcactgcgcctactgcgacggcgcgtacgaccaggtcggcttcccgggtctggagattcagatacacagctgctggttcttttttccatggcataggtacggtacgtgacaacaacattatactccgtcccaaaaaaacaaatttctagctacgaaactagacacatacacatgtgtccagattcgtaggttggattgatattttattagacggaggaggtatatacggagacgtccgtcgatgattcttacataccacttaccacttactagtaaatagctataaattttctaaaataattaataagaaaatatgagatatatcatttcacaaattaacacataagctcaaatttgaaatctacaaattgtaaaaaaaagagagagataaattattaaaactagtcaacttacatccgcacctttatttttttttctgttgtaaaatatagaagttgtgtttgaacttatataaaaaagtaatactccagctaatgttaatttatcttatttttaaaattttctgttgtaaaatgtagaagttgaggggtatattagccttttgagtatatctcacgttaatttatcttattttttaaattttctgttaactatatattaaattaaatgacatgaaaaagaagggatacccctcaaaaggctaataaagacactttccccaaatatacatcccgtctcgtctggttcgtgtacgggcatccagctatatgtgctgatgtggctgtgattctctgcatgcactggacccatgcgtatgaacgtgcaggatgtacctgtacttccacgagagaatactgggcaagctcatcggcgacgagacgtttgcgctgccgttctggaactgggacgcgccggccggcatgtcgttcccggcgatctacgccaactgcaggctgtcgtcgctgtacgacccaaggcgaaatcaggcgcaccagccaccgttcccgctcgacctcaactacaacggaaccgacctgtcgaaactagatttcggcaataataaaagggggtggctatcaagctaggaaagtgtatgggtttggagacaaaggatttatacaggttcaggccttcttacaaaagaagtaataccctactcctgtccggggatgaatccgccgagtgtgttattgattgtatgatttggagaaaatccaacctccgcccctagaggcacccggaccccccttatatatgggaaagagtccgtgttacaaaagataatctatattcctaacggaatatgtaaatacagataaaatacagtcgtgaccgactaagtctcaaggtgtttccttgatgtacaagttaagaaacaaacccaggatacacataagatattctatctatattcggtatcctatatccagtccaaatatcatcgccgtgtagatatgggatatccataatctccacagtagcccccgagacctttgcagtcaaccatcatagccttctcaaagataataatccgagtgcttcaaaacttatcatgccaagacctgccgagtagcgaagacgaagactgtaaagggcgaaaagataaaaatatggtgcatcgaatagatgcacctaattaggtgtagcccccaactatgtgattagttaacgaactaaacatatagttgagaaacaaaataataacacaattgtgcatcatatgacaaaagcatacacggcgcctagataggcatgctagccgactgctttttagccataatgaaaagagtccgagtggtttacactctaaaaggttcacgaatgaacacactggacaggcatccgaatataaaactctaaagattacccaccaagtattataaaaattatggtaatgaataagtctaatagcctgggccatgactatttaccataatgaaaataggtatataacataccaaggaagtgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaaggattttatcagcattgggcaacactattgtgcgcataatattgccaaagcaaaatatgcctaagtccctaaggaacacaatgggccacgctgttaaaagtattgggctgaagtactgttcaggcctaggcccatttgctcctccgatacccttaacaagaaatcccgagatccaagcaacgcttcgtctcccccgccggaactctcgccattttccccactccttgctacagtgcagaactgcgccggcgaactagggttcaccactccactcaaatccaccttcgaaaaaatgcatcaaaatccttcccgtgatccaccgcctcaattcctcacctctcccaagccatccctcgaatcaaatcagcgcattcggggaaaatcgatggcggaggaaaaagaaagctttgaaggccagtgggcgccatccgacgtaacggaagagaacctgaaggagatggtggcgcacggcgttctccctgccaaggagatcatcgggtggcggccagcgtgcggtgagacttttccgacccccgatacacatgagattgtggtcttctctcatttcttctatggcggcttcgcccttccgacctcgaaatttttccgcgggatattaagcttctatggaatcagcttgcatcacctaaacccgaattccatagtccatatcgccaatttcatccatgtttgtgaagcctttttgggaattaggccccacttcgctctgttttgccggatcttctttctcaagccccaaccgaacaagaataagccatgtgtagtcggaggggcaggatttcagttgaggggaactctgagtcagaagtacttctttatgcccttcaagacctcaaacaaagggtggcatgcgaactggttttatgttcagaatcctgagcctgctcttcccgagtattcttgtcttcctccggtgtaccaagatacttggaactctcttccaatcggagatgaagctgcccaagctttggaattgttggatcgcatgttaaaactcaaagaacaaggcttgcaaggagagcagatcactcggcatttcatcaaatgccgactggcgccaattaaagaaagatcccgtacagcttttgagtttgacggcaagcatgatcctaatcgcgaagaaccagactctctggatttcaaaatcatgaaggagagaatgtataaaatcttctcaaatgccatcgtcgtcagctactcacatcagctgccagttgtgccatataatgcattcaatccgcctccgcaggtatgcatctgaaatcttcaatctatgaccaaaacattatcttgtcttcatgttgaattaattaaccgtggaagcatctcatttaggaatatgcattgatgaaatctgatcccccaatcactcagcgccggtcacctcgtcagcacaccgttcagggaagtggagggccgacaatcaggtcagacccacaacctcaaacctccaaaccggctgggcagacaggtcctcgcaagagaaagctggtgcttaatgacgatgagggcgatgacagcaacaaatctggggacaagggcactcccaacaaactcccaaagcataccatgcccgggaaaaaactggctggccgtcaaattccaaagattagaacatcttccaggtataaacctctcgataccattttatttcggcatgcttctcttatagaaattatgctaaatgtcaaaaggacactttgcaggaaaccatccgacatagatccaactggaaaagatcctgatccggctgtgacagagccaaatttatccaaagacgctgagccgactgccgaaaatcagccgaatgccgaaagccagccgactgccgaaagtcagccgactggcgcccaagcttcggacgacaaggccaatccgagtgatcagccgccgactggaaaccagtcggcagcaactgaaactgcaacaacccgagagcccccgactggaaaccagtcggatgtagatctaaatcaagagattcctgaagctgaagcgcagacaacttctcaaggaccaaaagttggtaatgactcagtgattgggtctccagataaagagcaaggatcccctcacgctcagccaggcacatcctcaggtaactcaacttctcaagtgatgccactctgaataactccagcttgttcgtctaatatcttgggaatacatcaggtccactaggcggcgacgaagaagaaattctccgcataaaggcagctaatgactctcgtcctcctatcttactcaaatggtgggacgagaactctcaagtttccggcattgttataaatcgccaaaaagaagacgaggaagtgtgccagctgaagaaagtacttggagaagccactcgcattgtgaatgtaagtcttctaggtgattgcctttgatgactttgtttttttgttagcaaaactaatccctgaaccaccgtgcagagaatccatcttcgtaatgaagccaagactgcaaccttagaaaagctggttccacatttgggaactcttgaagccgttagggaacagctacacgaggctaaggagcatgccaagaaaacggagaaggaattaagggagcgaattgcacagctccaggactccaacttcgagctgagtggttcatcaaaaggtaatctctagatctgtcccatttgtgctgtcataactggatcctcaaacatttggattttaaacagcgcaagccaccaggatgactcaaatggagaagcaaatagaagccttgaaaaaagacaaggtagaactggctgcggaaagggactcagccttgaaggaggttgaaggtactgccagctgacaatttgaactgccctctctgtaaggcagcagattcttattataaatgtgttttgtagaccgtaaaatcaaatctcaagctcagtttgatgtcctggttggtaagatcattaagcttaaaggagcaagagatgaagtcgccaatgtcgctacaccacttgtccaagctatgtttcttaataacagtggtccgagtgcacttgatgcaaccgagatctttgacaagctaagagttgcaccggatgtgtacttcaagaacatcaagaaagctggaagtatgggagctagcatggcattggcaatgaccaaatccttgtacccgagaatcgaaattgataccattgatggctttgcagacgggacaagtgaagaagctgctcttgatcttatcagtaatgctcaaagtgcggctgacaagattgcaagtgatgttgtagagcaattccgcaacaacgaccttcagccgagcaataataactctgatgatgaaaggactgattctgactgagtgtaaatgtagcaaatggaggctcaatttgtacaatactggtgtatttatgctgtgcttgatagttctagccaagtctttgatttcttaaaagcttttatcaagctttgttgagcctaaaacccaaagaagctattaaaaactttcagtcctcgcagactaagtagaaaaaatcaaacaaggcaatgatagaccaagtaagcaaattaaattgataaaaaatcacactccattattatgatgatagcccccgactgacaacggcaagaagaaaacttgatgttgacagtcaagatagggaaatacaatgataagcttaagcatagaaacgacgaagatgttcaatgttccaagagttgtcgacgagagtaccgtcttcgcgcttgagtcggtaggaacctggtcgggtgacttcagagatgataaatggcccctcccataaaggagataacttgtgccgatcccgtgtagtttgaattttcctcaaaaccaggtcgccgactagaaaggcacgggatcgaacattgcgattatgataacgccgcaacccttgtaaatatcgagccgaccgaatcaaagctgcttcgcggacttcttccaatcggtgcaagtcatccactcggtcctcttcgtagcgttcttcacggaaatttcgaaagcgcaaagattcgaattcgacttcactcggcaacattgcttctgccccatagacaaggaaaaaggtgactggcctgtggccccactgggtgtagttcgcaaagaccaaagtactgatggcagctgttgcacccatttgccggcatagggttttagccggtcaaaaacacgtgctttaatcccttgaagtatcatgccattggctcgctccacctgtccattgctcatggggtgtgccactgaggcataacaaattttaattccaaagtcctcacaaaagtctttaaaaactccaccagtgaattgtgtgccattatcagtgatgatccgattgggcactccaaatctatgcacaatgttgatgaagaagtctcgagcattatctgctgtgattgtgacaaccggtttagcttcaatccacttggagaatttgtcaatggccacaaagagatgtgtgtaaccgccgactgcctttttaaacgggccaaccatgtcgagcccccaaaccgcaaacggccaagacagcgggatagtttgcaactcttgagctggcaagtgaatttgtctagcgaaaaattggcaaccttcgcacgtgcgcacaatcttgtcggcgtcggacactgcagtaggccagaaaaaaccctgccggtaagctttgccgacaatggtgcgtgcagcggcatggtttccgcatatcccagaatgtatgtcctgcagcaattgtctcccttcctctaaagatacgcagcgttgcagaattcctgaagggcttttcttgtataactcagcttcatgcataacataaagtttgctccgccttgaaatccgctcggcttcatctttgtcttgagggagttcttgagaagtcaaaaatcgtatgaggggttctcgccagtcggtttcaaccatagcgacgtcatgagtgcccgcaacttgagtggtatctttgtgaggtactgtcggcgtataaaggtgttcgacgaaaacatcagagggcgccacctcgcgcttggatccaaagttggcaagtctatcggcggcttcattattatgtcgaagaacatgactgagctcgagtccatcgaacttatcttccaatttgcgtacctcttgtcgatatgccatcatgttgtcgtcaaggcaggaccactccttcataacttggttgacaaccagctgtgaatcgcctcgaactattagacgctttatccctagggaaattgcaatccgcagtccatgaaggagggcctcatattcggcgacgttgtgggacgccgaaaaatgtatccaaagcacgtagctcaatctttctccagttggggaaatcaaaaccactcctgctccagtgcccgaaagtcgtttggatccgtcaaaatgcatggtccagtgctccatgttctccgcgggggtatcctcctggcactcggtccattcggcgacaaaatcagctaacgcttgggacttgattgaaattcggggcttgaatgatatgtccaaagacatcaactccaaagcccacttagcaatacgtccgtttgcttcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaataaatcggtcgttggactttctggacatggccttcttcctcgcgttcaacaaccaagactgtgctcacaacctgggaggtggctgatacatacagcaacaacggctcctgcgggtgtggtgaggctaagactggtggctcagtgaggagtttcttgaaatcttcgaaggccttctgtgcttcgggtccccactggaagttatctgttttcttcagcagcttaaagaagggcatcccccgctcgccaagtcgtgaaacaaatcggctgagcgccgccatgcatccagtcagcttctgaacatctttctgggtacttggcggtttcatgttgaggatagcagtaactttctccgggttggcttggatgcccctatgagacaccataaagccaaccagcttccctgacggtactccgaaggtgcacttttcagggttcaatttcatcctgaaagcacggatgctcgcaaaggtttcttctagatccgagatcaaatcatccttttgcttggtcttgacgactacgtcatccacataggcttcaacgttgcggccgatctgcgttgagaagcatctctgaatcatgcgttgataagttgctcctgcgttttttagtccgaacggcatggtgacgtagcagtatgcccccaaaggcgtgatgaatgaagtcttcaagcaggcggattccttcagtcggatctgatgataccccgagtagcaatccaaaaaactgagaagttacggccggcggtcgagtcaactacctggtcaatgcgaggcaacccaaaaggatctttagggcaggatttgttgaggtcggtataatcaacacacatgcgccattgccctgttttcttccgaactagaaccgggtttgccagccagtcgggatgaaggacttctttgatgaagcctgctgctaacagcttggttaattcctccttgatcgcgtctttcctgtcttgtgcaaatcggcggagtcgttgtttgataggcttggcgtcttctttgacatgtaaggaatgctcaatcacctctctaggaataccgggcatatcagatggtttccacgcaaagatatctttattgttctgaagaaaggtgatgagcgcgctttcctatttacaatctaactcggcgcctattacagcagttttagcaggatcagagggatctaggggaatcttcttagtcttggcttcgctttctccactctttgaaatcttggtagcgggctcttctccttcgctcgccgtggctgcagccagtcggatatcctctcgggcagacgccatctcgcgagtttgggccatgtcgcaactctccttgtcgcatgtgacggcttgcttgatgtcactccgtagggataggactcctcggggaccaggcatcttcatcatcatgtaagtgtagtgcgggacggccatgaacttggctaacgccgggcgtccgagtatggcatggtatgctgtctcgaaatcagcgacttcaaagctgatgttctctgtgcgaaagtttttccgagtgcccaaagtgactgggaaggtgatctggccgagtggagttgcggataatcctggaatcactccgtgaaaaggcccattgcttggttttaactcggagtgaggatctgcatatcatccagggtcttggcggggaggatattgagtgcactgccaccgtcgatgagggttctgcgaagcttgacattacggaccactgggtctagtaccagggggtaccgccccgggtggaccactcggtcaggatgatccgagcggtcaaacttgattgcgatctctgaccatcgaagatattggggcgtgtccggctgaacagcattgatctcccgttcagtcaacttctgcttccgtttagactcataagccagggggccgccgaagatatgattgagctccttgcggtgatcttgaaaacctgccggggtgtcgccgtcgtccttcttcctcgacgtgctttgttcttcgtcagaattcttccgtgcagtcttggtgtattgatccgcgaattgcttgtagacgaaacaatctttggccacgtggttggagttaggatggtgcgagcattgggagttcatgatcttgtcgaacgtgttgacgcgcgaacgctgtcgagaagagtgactggcggttgcaacaagttccgcaggcttacgcttgcggtccttatgattgttacttccacctcctcccgtagccggcgtacccttgttttgcttccaactgggacccgactgctttgatgcggtgacggcgtcttcagccttggcgtactcgttggctttttcaaacataagcttgactgtcatggggggcttacgcccgaacttgccgaccaattcttcgtggcgaatccctttggtgaatgcggcaatgatgacgtcatcggtgatgtcggagatcttgttacgttgctcagaaaatcgccggatgtaatctcgaagagattctccggacttctgaataacgttgtagaggtcgtattgtgtgccgggtcgctcaaaggtgccttggaagttggcgatgaagtggtcgcgtaattcagcccaagatccaattgtaccacggggtaatccatggagccaagatcgggccgaatccgctaaagccactggtaaatagttcgccatggccttgttgtctcctcctgctgcgcggattgcgagaccgtagacggtaagccacgattctgggttagtggtaccgtcgtacttctctattccagtcggcttgaagccggctggccaatccactcgacgcaggtcgtcggtgaaggctgctactccgtcaaggtcgtcgtcgtggcggttcggcgaatgatgatggcctccagctgctcggcgctgtatgattgtgtcgcgaaaatcgacggggcggcaacaaggtggtgagcgaggccgttccactcggcgctccctatattggtcgggaggtgagtgaatggaccgctcgtcgtgacccctgctcctgcgattggatcccccgcccgtgatgctgaggcttggatgacggtagtcatgagatcggaagtgggggactcggctgccagtcggcgtgtggacgctttcggagttaactgggaccgaagccgcaatcatggtcttcgtctggttcaagatgttgacgacgtgatcggattgattgagctcgttttggttgaggagggtgtcgagaagggtgatcgcggcaaccgcattctgttgaggggtgcggaaaaccggtgtcccttcgacatcttgctggtcgatgagatcacgcgctcggcgcctctgtcttttccaaagctcgctgacgtcgatcctcagcctccttcgcggtccgctcacggtcctgctgctcacgccgtagccgttcttgttcttgtgcttgatgctcctcctccagtcggcgacgttcttcggtctcccaggcttggcgttgctcctccgtctcattattggccatgaaaacgccaaagtagagaggggtgtagttgtcatcaaggcttccgtcgaagtcgtcgaagtcgttgtagcgagaactaaattcgtcgtactccacgatgtcagtaggacgtgagtcgacggtgggagagctgttgtagtcatccagctgatccgtcgaaaccgtgccgagtggttggaggatgacgccgacttccctgaagctaggcgaaatcggtgttgaagccgacttccgcctaggcctacgggatgaaaacgttgtcgtggtggaaacggccgctaaatcgtcggggagcttcatcaggactggtgggtaagccccatcatcttgatctggtgtcgttggagaagatgcgatctcggccgagtggtttgaagccgactcggttgagatggtcttgaagtagctttcagccgcgttcgggaatccaaacgggaccgaaatccggttctctcccgactggtctgattccgagtcgaggagagaaatcttgccgaagttgttggtgacgaagtcgaggctgccgaaccgaaacgtctgcccgggcgggaagacgaggtcgtcgatgccggagacgaaacccattgcactgatcggcgaaaagcttgacgctacccctacctggcgcgccaactgtcgaaactagatttcggcaataataaaagggggtggctatcaagctaggaaagtgtatgggtttggagacaaaggatttatacaggttcaggccttcttacaaaagaagtaataccctactcctgtccggggatgaatccgccgagtgtgttattgattgtatgatttggagaaaatccaacctccgcccctagaggcacccggaccccccttatatatgggaaagagtccgtgttacaaaagataatctatatccctaacggaatatgtaaatacagataaaatacagtcgtgaccgactaagtctcaaggtgtttccttgatgtacaagttaagaaacaaacccaggatacacataagatattctatctatattcggtatcctatattcagtccaaatatcatcgccgtgtagatatgggatatccataatctccacacgacccaaccatcccggaagatcagctgatcgatcagaacctcaagatcatgtaccgccaggccagtaatcacatacacagtttgacacaaactaggaattaattgaagtagctactgaaaaccgtagatagcaaactccaaattaattagtcgactttaaattggatcgcgtgtctaatatgaacagtataatttatgatgtatcagatgatttcgggggctaggaagaaagagctgttcatgggacatccgtacagcgccggcgaccagccgaaaccgggggcgggcaccgttgagttcgtgctgcacaacaccgtccaccactggaccggcgacccgaggcagccgaacggtgaggacatgggcatgttttactaggcggcgcgcgacccggtgttcttcgcgcaccacggcaacgtcgaccgcatgtggtacattcgccacggcctcttcccccggagacacagacttcacggaccccgactggctcgacgcgaccttcctgttctacgacgaggaggcccgcctagtccgcgttcgcgtccgcgactccctcgacgaggccgcgctgcggtacacgtaccaggacgttggccccctgccgtggctgaacgccaagccgtccacgggacccgccggcgccctgccggggaccctggacaagaccgtgcgggtggccttgacgaggcccaagacgtcgaggagccgcaaggagaaggacgccgaggaggaggcgcctgtcatcgaggggatcgaggtccccgaccactccgcgtacgttaagttcgacgtgttcgtgaacgcgcccgagaacgccgacgtcgcgtcgcgctgacgccacacggggtccaccgcgaggagaggaagcgttctccgagaaagacggtggcgaggttcggcatctccgacttgctcgaagatatcggcgccgacggccacaagacgatcgtcgtctcgatcgtgccgaggtccggctgcgattcggtcagagtctcgggcgtcagcatcggctacgtacgctaagtgaagtacaacgtgaacgtaagaatacgtttatgtacaatgtgtgacgtgtgattaatgattgtatgagtgtgatgttgcgtgtgtaatggtgtaggcgcgtgtgggtctgtcattaaaaaatgataccccgcgcgttgctgcgggatatacaaatcattttagagatgtgaacttgttggaccgccgctaacatcgtgttgaactaccgctaacatcttgtttaactgccttacaggattaaattaatatcattacaaaagaaaagccaaataacaaagtaggtatgaatccaattgagtgtaaggcataaaactcaatgaaaaacttgatggtccacatcgttgatgattgatcaatgataaaaactatacatgatgtaatttggtctcgatcagtactggcttttgttataatcgattgtcaaataaaaaactcagttcaaacagttcaaattaatggattgagaatatataatttgcaaggaaaccaacttaaaaattgtaaaataataattaacaaaagggccgcggtgtaaaatagcacctctcatgtcttatctgaccagaccgaatggacgatttagccgatagtgatcagaaatgatgttgtcggccttacttagctgcatatatatagtggtgaagacaaacaacaatctagctaatatatgtataacaaccttttgtttttttcttttaaaaataaactaatgcaacagaaagggatattgttaccatgtatttgtacatcggtaaagttgatatatccggtagaaataaatagaatatgattacagagattatctccttcaattttgtacccccaactgcccaagtcagaaggaaattgcaatttgaccggtgattgatcggcgatgtgatgttgatctacatgaggcaacttgagcgaagctcccagactttgcaagcatggcaacctcaatgcccaccggtggtagttaggattttagggataacgatgatcaaggtgatgagaggaacatccaatcgattgaacttgtaacccctttccctgaatgaatatgcttctgttttataggatagacatgacttttgagctcctcttggggaaaacggtagtgcaatcacttatatcgtattggactacttggatccttggcagtttcggccacattagttacccgtatgtcattaatcatcgagctgcggcagaaaacgtatcattccctgatagaattgaagacggcagcggcaagcgtgcggaatgcatgtagcgttgggtgcaacgttcctagcatgtgacgctagacgcttaattaacatcgaatggctgaaagaaaagagggtggtgacgtggaagcataagaacaaagagaattgctaataactacactaagtaaggatcacttatatagtattataggatatgattgtataaaaataatgcgtgcatcagcgtgcatgaactgatgatttggtaaccgctgccaatttgaaatcattttttcagataacaacccgaggaattaaggcttcagagatcagatggcatgccattaggcatgcacgctcttaagatgggtagaagataagctaaagagagcatccgtccaaacagggccggctctacaatttgaagggccttagggcgagcttgatggtgtaggctcttaatatgtgttttctatttatatatttttaaaccatatattttctgatgaaataaacattgaacatcttctgtatataactaaagaacatcaaaatggagctaatatgaataccttgaataaaggtcaaactctaactgtctaacgactctatcaataatacctcacaaataaagagattacaaatatccatggcttctcacgaaaaaaatacactcctttaaacatttttgatgcaaaatctttaaaaaatgtaatgagattaatattatccatcacattcttctcaacttagcacacagccaagccttgtcatagggcctaaacatagtatgttctcgtggtaatttggcctttcaccgagcagatgagatagttaagagacatactccttagttacttcttacttgaatacaaactcactcaagaatagtacctgaaaactgaaggttgtgaggtcatgtttccacggaggcagcaatgacgtgatcagttggacacggttgctccgtcaccacaaacaatcgccacgcatttgctcgcagtatatacgtatgtagtttctaaaggtaaacgcacgtatacggcataccagttcgtacttacttacctgatcttgggcccctacttacgttgggccctaggccgtcgcactcctcgccgtagctctaagccgggcctgcgtccaaagaatctaatctttgagttacagaggtggtgtttgaatcccctgaatatgaagataaagataaagatgaaaatgaagtgtttcacacaaaacgagttggtaataacgtgtgattaattgagttttaattattgcgaacttgaaaaatggattattctgatagaaaattttagaacaattttcatatagaaaattttcacagaaaacgtgccgtttaatagtttgaaaagcgtgacatgaatatccaagacttaatccacttttttttaaggggtaacatgtagtagatctgagactgcagaatcgcagaactttgggcagaatcagcatgtccatccgtacggggcgtcgcatggtcgcgaatttgcaatagcaggacaaaagccattggatggctaatgaaggaatgtttaacgttgtacttgcctgtcaagggcgtacttcgatggagtagccgtaatgccattgttgtcagctccttcgaaactgaacccattcggctccagtgagatccggcgacttgggccttgtttagttctaaacttttttttcaaacttttaatttttccattacatcgaaacttttttacacacataaatttctaattttttcatcacatcgttccaatttcaaccaaactttcaatttttgcgtgatctaaacggtgtgcagcttctgcttcaaggtggtggtggtggtggtggtggtgggggttgtgacttggttagcgaccgcccataataacggaactgactccgagcacccgcgaccaagcagcagcacagctcgtaggggagcgttgaccactcccctgctcatccctatgcctaaaacgccgttgttactacttatgggtgtttacggtgcgccgatttgtcattcagcccgagcatgaaacgttgaaaaatacggtgccatgtttgcctctgatgctactcacctaaagcccgcacattaaaagagagacacttgttcccggtcagctagcattgccaaaaaaaagcaagaagatatatgtcgcgccttcggaaaggggtaggaagcttcagctcctctcctccaatatttccgccaccattgagcagtagagaacgatgatgccactgtcgaggaagctgccgtcggccgagctcccgatctgtgtcacctgaggaggggactgacggcggcattgactggagactcaggaaggccgtcgccaccgcgtgggctcgggatagccgagggagaagtccggagaggaaggggagaggcgctcgctgtcatcaccctcgctgccaacagatccgctagggagaggaaggggagagggcctggtgccgccgcgttttttcccaagcggcgccggtgggaggagagggggggcgggggagtcgtcgccatgggagaggacggaagaggagggggcgggaggcccgtcgtgggaagcccagtgagggagaggtcaagagagagaaccggggaaccagcggcggaggttggggaggatggtgtgggagatgttgctccaggaaggagatgacgatgatagtaattttcgtggtggggccaacctaaaacaatggtggtgggcccacctaaagctacacgaactatggatatcggagcatcattttttttcctacgatgatacttgggtttcttgatgaggctgggacacactgctatagtgcccaaggtgtggagtcctgaacccatctctatcatgatatcatcctggccctaatgcccacctctaccgtcagacagatctcctcggttccatggcaatgatatcctcttatcccctaggtccctcaatgccaccccctaggaggtgttgagaaaattaaggggagagagactggagggagggagaggaaaaaaggttctactatttttctttatttttgttcgagagacttatacgagggtttcatctaactttttttattgaaaactaaaaaactggatcaatataatattgtcgagtgattttatttgcaccgttttaaaaatttagaggataacatatatatggttttacagttgagagatgtgaattaaattcgaccatagttgaaggatttgaaatacactttttccttaagttcacgaggagtgtcaacgatgacctggctcggcccagctcgatccattcagcagcaattctaggcccactctcttattctctatgctgactgcagtgctctatccttttcgctagtcaggcctcgttcggatgggccacactcccagaccatttatgtatgagagaattccttatatgccactctaaattaaccggttttcttatatgccactttaaattgacttctcccttttatgccatcggttcaagtttctcctcccttttatgctattgccgtcagtccaccgtcagttgaccgttaacttcattgtaaaaagacgcaattgcccttaagaattagtatacaaccaataataggtattttagtactaatataactactggatacaacatatgaaaattgatttttttctgcatcacatgcaattttagccattaccatcacaaataaattttcaatgtaagcatgaatcatgcagttttccaacaatatttttaatataaagagcatttttcactagttctgacaaaattttgttcactcaaaaaagatttaaaataaattagttatgattttttgaagtttacacattttttagttgagagggcatattggtcatttacgaaaaaaaactatcctttactaacagtcaactaacactatagtggtgggagttgcataaaaggttggaaaaacttgaactagagagaagccaattttaagtgtcatataagggaactggtcaaattctagtggtatataagtaattctctctttatgtatatgggccaaaatttaagttcaatctcctggcctatacatgtggaaggaccagtctgaggcccaaacaagccatcagggcaacgaggcagagcacactgcacaccaaccccgtttatgtcaacctttaagaacttaaaggtatgtttggattaaaaccaattcttgccctaccaattatttggtagtagtgttgtagtacttgttagctatttagattgaggttaaatcttactaattcaatagagttagaaacaacatagccctaccaaaatttttggtagtgccaaaactagcccaagatttggcaataccaaaattttggtacggcttcaaaccaaaatagctctataagtgttgctgccacgtgtttgacacatcgcatacatctgatctgattgggtgaggatcctctaacataatatcactatcattacaatgactgttatgtacttccttcgttccataatataagagattttaaagaaatactccctccgttttaaaatatttgacatcgttgactttttagcacatgtttgaccgttcgtcttattcaaaaaatttgtgaaatatgtaaaattatatgtgtacatgaaagtatatttaacaataaatcaaatgatatgaaaagaataaataattacttaaaattttttgaataagacgaatggttaaacatgtactaaaaagtcaacggtgtcaaacattttgaaacggaaggagtatgacacattctaatacatgaatctgtatagagagcccgtctagattcatagtgctaggatatgtcacatctcttatattatagaacggagggaataagtcttactctcctattgtttcacatatcagtgtctctaatgatattgttattatggtaaaggacccgatatgatcaacgacgttcgctcgttcttcaccgtcgcagtttttgtcagccatccatttttttcgccggggacggcggaacgacgccgacaagtcatcagtcatctagttgcagcgtccaaacgacgtacgccgcccggcctgaactgaaactccggccgttttaggcaagggttagttgacctgggatgaactgcctccatcatccatgcatatccgtgattccgtagcggagttggccggatgaattgcgtgtatattcagacgattcacgcacaggatgatggagtgtttcgcccaacgctctcgtaggtcaggtcgtttgggagctttccgatttgcgtaacgacagtgaaactgttgttgacgggtgcatagttattaactggttcacttgacaatttcgagccgctgggtgaaaggttaatctctgaactacttcgagctgacatgatatctctcaacgggattgcttaagtgacggatatatgtttgacttggtatatgtggtgctaatgtgcactaggtagagatgtagcaaagtgacagtgtgacacgacaccagtagaaggtgatcggtgtgtgttcctattttaattaatatatttcgatgtgatcttttaatttcacttcgttttttcaaatttcctctttctgttccactgaatcgagtagaaagaattattttctctctgctccaataaatgttcgatgataagatgaactgtattccgtgactatgataagaatgtgttttccaggtaataagaatcatatctcaattttctatttagtgagaaacttaattactacaacaatagctaagcattagattgatactagttttcctaatgtatagttggagggccactagttgtcatgaagattaatcaaagagcagtggtagtgtagagacccattccaatatattaaaaaattatacagtcttggtacattactcccttcgtcttagaatataagcatttttagtatagtgatagatcaaacattttcaactctaactattaatagaaaaaaatatcactcatataaaattgatgttactagatgtatcattaaacaaattattataatatataacctttttatttaaaacatcctacttttatagatattgttagttaaagtaacatctcggaaatcttgttagagtctaaaaatacttatattttgggatggagggaatatgtgtgattagtattttttatgaataagatcctattttataatagtcagtctcccaaattgttagtgcgcggccctgcaaacggtcacaccaaagtaccaaacaaccagtgggctactacagtatagtagtatacacattgccctataaatacacacgctattgcaactttgcaagtgcaagttcacagcgcagtgccgccatggagagcatcaacgtagcaccaggaacaaccgctacgcctcgcatggcgccgccgccgccgccgccgtgcatcaccaacctccagagtacccttcgctacaacaacctgctcttgcaccgcaagacgaaggggtggaagccgcggaacgtgtcctgcagggtcgaccgccgcgacgtgctcctcggcatcagcggcgcggccgccatggtggccacgcagggcggcggcggcgcgctcgcggcgcccatccaggccccggacctcggcgactgccaccagcccgtggacgtccccgccacggcgccggcgatcaactgctgcccgacgtacagcgccggcaccgtcgccgtcgacttcgcgccgccgccggcgtcctcgccgctccgcgtgcggccggcggctcacctggcggacagggcgtacctggccaagtacgagagggccgtgtcgctcatgaagaagctccccgccgacgacccccgcagcttcgagcagcagtggcgcgtccactgcgcctactgcgacggcgcgtacgaccaggtcggcttccccggcttggagatccagatacacagctgctggctcttcttcccatggcacaggtacgtgacattgtgacaacatggctgcatcacgttcacgtctcgcgttgttcgtgtacagttgcatgcatgatatatatggggagtggattttttacgacttcctcttattttgtacatgtcattcaaaaagttatcaaaaaatttaaaaaatttgtcaagatagatcaatatacggtatatctttttcgcaaacatacgagttaaaattcgacttatacaattcgaaacaaaaacaacaaatttgaccgtgatttacgcagttaaatttgttatttttgtttctacttgtataagttgaatttgaatttgtatgtttgtgaaataacatattatatattgatgtaatattgatctatactgctatatttttttaatttttttgatgactttttacttgacatgtaaaaatgagaggattatttgagtggctcatgagattctgtgaacgctggacgcatgcgtgtgaacgtacgtgcaggatgtacctgtacttccatgagaggatactgggcaagctgatcggcgacgagacgttcgcgctgccgttctggaactgggacgcgccggacggcatgtcgttccccgcgatgtacgccaacaggtggtcgccgctgtacgacccgcggcgcaaccaggctcacctgccaccgttcccgctcgacctcgactacagtggaaccgacacgaacatcccgaaagaccagctgatcgatcagaacctcaacatcatgtaccgccaggccagtaatcacatacaaattttgatataaataataatagatgacaaaaactccaaattaatcgacttatgagttaagattggacgaacaaaattttatgatgtttcagatgatttcgggagctaggaaggcggagctgttcatggggcagccgtaccgcgccggcgaccagccggagccgggggcgggcaccgtcgagagcgtgccgcacaaccccgtccacagatggaccggcgacccgaggcagccgaacggcgaggacatgggcatcttctactcggcggcgcgcgacccggtgttcttcgcgcaccacggcaacgtcgaccgcatgtggcacatccgccgcggcctcctcttccccggcgacaccgacttcaccgaccccgactggctcgacgccagcttcttcttctacgacgaggaggcccgcctcgtccgcgtccgcgtccgcgacaccctcgacccgtcggcgctgcgcttcacgtaccaggacgtgggtctcccgtggctgaacgccaagccgtccacgggagcagccagcacgccggcgcccgcggccggcgcgttcccggcgaccctggacaagaccgtgcgggtggccgtgacgaggcccagggcgtcgaggagccgcgaggagaaggaggaggaggaggaggtcgagatccccgaccactccacgtacgtcaagttcgacgtgttcgtgaacgcgcccgagagcggggacggcgcggcgacgtgcgcggcgacgtgcgccggcagcgtcgcgctggcgccgcacgggatccaccgcgaggggcagctgtcgccgaggaagacggaggcgaggttcggcatatgcgacttgctggacgacatcggcgccgacggcgacaagacgatcgtcgtgtcgatcgtgccgaggtgtggctgcgattcggtcaccgtcgccggcgtcagcatcggctacgctaagtgaagcacaacgtgaaccgtggacgtatatttatcatctatacatgtgaacccagatggagagacggatttgtgtttgatatgtgtgtgactaatgattgtatacaaaataatgccagtaatataatgagcatggatgatattggcttaaaaactttgaaacttttagagtattcaattgatggtttggttcacgctgccaatttgaaatcaattttgagatgtcagcacgagaaattaaaaagctacacaggccgtcacatgccattctgctcgcacttcattccttctccgagtgagcagaaaataaaccagagagaacatccgccctacaaatctaatctgccttacatatgtacatccgaaacactgcagaatcgtaaaatggaacatatttgcatggtacatgtttgcaaaactggctttaagcacgatgagcttcctgcatgtcacatacgcacgggcgccgtacgatggcgaactcacaaccgcaggataacggaaagattaattgatctcttactgacgctggagatcaatgtagaagccgggattggattctcctcattttctttctgtctaaagaatggtacccagagaaagggtatgtactgggatgccggcatgtcccagaaacctggggaaacctacttcccaaaatccatgtgttcttggggctagaaaggtctcagttcttgcgagcggaatggtacaattccatatagtccagagcaggtcggttccatgtccaatcttgctccatcaccctcttgcagagggagtggaaccaatcgcgagcatcataccatgtggtgatcgctctgaaattggatagcaaaagaatgaattattaacgtcgtagcattaaaatttgtgttaactcctatgggttatacttacctgtcaagggcgtaatccacaccgttgctgtcagctccttcgaaactgaacccgtttggctcaagaccttgttctcgagctcgatccttatcatcgtcgacgtcaaaaacggtgtcataaaggcctgcataatgctcggcgtatcttttatcgatgctagaaataccaaaaggcaatgcaatgtcagggagatatcaagatgacaacgcacctccagttttccgaactattgggatagatccataacgcatagcagtaagctgggttaaaccacaaggttcaaacatggaaggaacaaggatgaagtcggcaccagcataaatctacaatacagtagaaccatagatttagtacacaactataaatcagttttccagttctaacataagttgctattggtagagtgtgaaacttaccaaatgagatagtggctcatcataggttaaacaaagctttacacgaccatggtattcgccatgcagtttactagctaagttggtaaagtcaccttgtatgcgatgatctggagctgagcctagtaaaaccacctatttaagaaagccaatgtgtttcagtattgaaaaatagaataacagatagatggcaagaaacatatgcatcaaacagtgtggcatctatgagcaagatatagacctgcccattgcgttcaagagttcgataaattgcatgtttgataaggtgaattcccttctggactgtcagacgactgataattccaacaacaggggtatcagtttgctgtagtccaagcctctgttgcaatgcctttttggcagcactcttgccctcaacaacattctcagaggtatagtggaccttaaagaaacaccccaaaaaaatgttaagtgagcaaatacccgtacaactactaaatcaaagaattggatatttgatcaacagcgaatataagcatatgtatgctactaatcaaattagctgcagataatcaacttcttaactagacatgcactctttatacactttacagatccaagaagatagtaaatgcacagttatggaatatgaatgaatatactgaatggtgattaatataccgggataaaattgtcactgtatggatcccaaatatctggatcaattccgttacgaataccgtggaatttggaaaagtgaggggcaatagcaccatgtcctgacacttcccttgaatacgtatatgaaacctgcaagttatggccaaaacagttaaaaacagacaatgagaagcacacattagtgatacgttcacatagaaaatggtatcttgaagaatttgaaaaagaaacacgatagtaaaaacagaacacggccaggtcactcacagttgtagccttatcacaacgtgccattgctttgccgatgtgatgtgcaccaaattcaaggttgtggatggtaaatacaacccgcccatttgacagtccattttgagcatattgttccttgaatagccaagcaactggagcacttgaccaatcatgacaatgtataatatcctgtcagaatgacagcacttgtgtatgagaagggtggaagcaaaaaaaaaaaaaaaaggtaacagtacaaaatctgtgaacagtgatggttcaaacgttcagcgatatagcaaaaactagctgctgcttggaatcaatttgtgatgaacagaactggaaaattgactcattagttcttttaagatgagttcacatataaattgtgattagttcatggccaagtacgagaacggagaaaatggcatggtacaaaaaacttaaatcttttcctacactataatcaaaggggcagatctcttgcacccattttcgaaataaaagcttaaatcttatggaacaaatcttgcacttacaggagaagatccattttggcggagaaactctagagcagaatggcagaagaagccaaatctactctcgtcatttcttccatagacacatccaacccaaaacatcctgcaaataaaaatgtcagaacaaaccttattttatgctaaaagacaaggtaatagattacttatcataaataagggtgcattgacagaaggaaaaagaattatgtacaccctccgttttttaatatatgatgccgttgacttttagacatatgtttaaccattcattttatttgaaaaaatatatgcgactatcatttattttgttgtgacttgttttgtcattaaaggtactttaaccatgacttctatttgcaaaaaagaaaaatcaaataaaacaaatggtcaaacatatgaccaaaagtcaacaatatcatatattaaaaaacgatggagtgatcaagaatggtctacacgtgtgtaataaggtaaggtgctgtatacccattctgtggttccaagaagtaaacagggacgtcttcaacttttccaaaccatacttttatctctgtattaccccaagtaaaactttgacggtaatgtaaatctttcacctgaaccaaaagacaagtaaattaatgagaaaaaagcccccacaaacagcgatgttcacactctcaccagcgaaggaagcaaatgatcgtaaaaataaaagcatggactatagttgatttcacgagaaatgcttcagtgctctttcaaaagtgaaaagtgaaaaccacagaatttaaagtgtttagagggactagttgcaaccattgaaccacctattgctccagcacttacagttgatttgatatttgcactttgtttttgccagtatctttaagattccacaaaaccccagagctacatatattagataaaacaagaaagaaaccatctgcactgtgcatatacatagcatttccatagaattccattgaaacactgaaaagaatgcaaccgaaaaggaagacgccaggatgccttacattgcttaggtttaaacagtcatacttgggaagaataacctcaacattgtggcctaaatcttgaacggctcgtgaaagacttgtaacaacatcaccaagacccccaacctgtgacagatcattttttagtacctcagcactttctgtggtccaaaagaattggtaaaaggtgtctttacctttgcaataggagccatttctactgcaatgtgcacaatatgcataggaggttcttttgcaacggaatcagtcacaggactatgatagtccatgccattcctgttgtcatatattccaccttcttccgactcagagaaaacaaagtccatcatatatgcatccaaaggaaccctaactagaaaaaagaacagatcacgtcaagcaaaggaaataaagtcaaacaacatcatcatacaaaaatgtgtgtgtgcatctgagagagagagagagaaagagagacagagagacagagagagaaccatgacaaagaagccaaatttcttttcctacagctcctaccacctcttattagtagtacaatattactttttatatattatcattattatcttcattttcttgtgtggctccacttgggtttcatgtcgatcctacattcctacccaaggttgctttgggactaaaagtcattgggaatatcattaatattgacatattattcaaaaaatttcaaaagcatgcggtgaaaacaagtgggattagatttttacacaaatttagtatgtttgaaaaaaggtaactcctgctttatcaggtttgcatgcttattagattctttctggtaaccatagtaagagaggaagagtagtttgaactagtctcgaagaagtctaatgaccttttaattgaggtattagtatgaaaaatgcaatcagaaaaaagacccccaacaaggacacacacctgttgctcttaagtgtgaaccattctccgcattcaccatcttctgtggcggcaaaggaccacttggatgagtccaacgattaaaggaacatctgaaccaaacctctggctttccgttcagcaccgtgttagacggattgtatagaacatccacggtggttcctgcacgtacttcgagaggctcagtgtacacaatgtgtttctgcgagagaagaaagtctctcatagtcttttccttcatctcagctttcatttttgcagttatctcagactgaaacaaacaaaaggcaaaagtcaaatgatgccctcctggatgtgttattgaacttgaaccagggccataaattaccatttatcaacaaagagtagcaagtaaccaagtatatacagtaatataggtttaatgctcctaattaatatgcaaacattctcttgaactgacctttcttcgatcagcatcctccctttctttcctttctttctgaagccttttaaatatcatgtgctcttcttccacccaaaacaggtcctcagatatgttatttggaacaacagcatggaaatcctggcgtccattgttatcataattccttgcattcccaggtggcccatcagcaaaaacccagtctaacaccaatgccccttcaggtagagtaactatacatggagtaaagtaaggagtaagctacctgagtaatagactaaaaaagcaagaaaacaccaaagatccaaggcatgtaattcactcatgagagatacacatttattctaggaaacaaacatcagtaggtgtcttcaagtcatatacgatttccaagtcaacgaacttcttaatattgaattcgataacattttaactctttgcatttctaaattaagaaagctataccatgattaaatgtacatactatcatgttacgaatcatctctcaagagatgaaaagtgtgaaatagcataccatctgcataccaccaatcaccatccttttcatatgatttgattaatttttcagcaatagagagcccatcactccaattattgtaaccgccatgcatccaaatctcagtgttatgcattagcggtcttgagcttctgttgtagaacaatttgaccctatcccctgctttgtatgtgtgaggctctatataccatagattatcagcatatctgctggctgaatttaataaattttgcaacttattcttgttcatctcgacttcagcctttgcttgtgccctgtcagcctccattgcagccctttcttcctccttacgacgctcctcctcagcctgtcttttcctttcagcttcttctgcagcaagcctttcaagctctctttgtttttcttcaaccaagaagtcctcaaatgagtgttcattgatttcgctttctatttgtaggacgaaatcattatgattgttattttcgtagatggtgtcaccattaaagaatacaaaatctaatctgtaagcctgcttgggtatatggagtttgcagcaccaccaatcccctgttaactcacttttatgcattttttgggtaaattttttccatctccaaccattgaatgcccctttgataagaatatcaggctcactggctaaggctgacatgctatggttcaagtaaagatcaatgaccgaatccgcctgtactacttcaggaaaaacaaaacacttattcccagccaaataatttttctcagcaagctcttcaagccgcctcctgagcacttgtggatccacatcatcctgtactggtgctatatcaggttcatactgttcatccttgattatcctagggtcatcatcagcaaacagaactttctcagtttctctacttaatggttccctctcaatactcttgccagttatctcttctggtgcttcttcggtgacatcttgtccactaataatggttttctcttctgttggattttgtccactgacaccactacttggctggctttgttcgggaacagagacaattgatctatcttgctcatggaaactaactacagatttttcttgttcatgaaaaccaacaattgatctgtcctgtacatgagtgctagaaactgatgtaggttcaggtttcgaacttattagtgcacttattttaccacggtattcatcaagttttctgtcaattgcatcatcatccatagattcagaagacagttctggagactgattttgctcgacctcttcttcagtctcagcttcaaaagcatcatccattccctccaagaatacactgctcgatacatttccagagaagtccacctccgatgattcttctacattactagtttgctctgttgcttcactactgagcttcccattgcttgtgccaagatcaccttcatctgtgccgctttgtccaatcttcttcatgctggattcaacagtaggtctcggagcatatgttctagaggcagcacctttaggtttcggagtggaggctctccttgggtttctcttagaataatctgaacaatgcaatgtcaggaaaaaaaaaacatgatcaaagaagtaccacataaagacagttgtgctttgaacaaaaccattccaccaacctgcacttgccaccaagcatcggagaagccttgtccttgtaaatctcctgcaccttatgatcggctggggaaaaaaaaacagaaaatggtacatgtgtgtgagtgcagatcatttacctttcctgaactaatcgtacttaatacatgcatttcagtgaaaatatccctgaagcagaaccgcacaatccaaattcccacccaagctacaaaaatttccgacaatgttcaatgcgtggagcaaatcagcaaaattgtcataaagttcacttcagtcttcagatacacacaaagcctgaaatgaaccaaccgaccggaacaaattctactcctagaaagtagaaaccaatcaaaggaacggaacaaaacgcctcgaccacgcatggcctcatcttctaaagcggcatggcctctcagtggtagcaccaattaaatcagaacccggagaacacgaacaaggaggaggccaaaaccgacacagccgcacccaaacagctccagagacgcacctgcgcgaagccagtggcggccgtcgccgggcggacgacgagcaccggccggctccgggagcagagcgggctatgcgccatctccattgccagcgccaaaacctccctcctctccccctgatcccctcctcctccctccctctccctctccctcctcagagctgactcccttcccttctttttcttttctggtttccaaaaactcgcatcgaaatgcgcagctgtgtgctgtccgcagacacacacacgcgcgcacgctcgatcgaaggagaaagaaaggctcccgtcctttcccgtgaaattttcgcgatctttttcttttttattttctgcggcgagagggaggatttgtgcggatttgtgtggacagtgtaaggtgccgaggtggtggggccctgagcgcagggagacaggagcaaaaggctacaaatcccaaaggagggggccgcggggttgcaaacggccaaacctggcgcgtcagtgagtgggccagggggcgttgcaacggacggctgctcttggttgggggagatatggatggggacatcggatggatggcgagagccgtgtatgccttcgccgttccggtggatcggcatctctccctgctgggttctggaacattccatgttagatctcgccgactgcccagtttcaagcagtcacctgttaacgtctatactgactttaagatagctataacttttttttcagaatcaaaagtttgcccaagcaatttaacatttcgtctagaatataaaaatatgtagttgtagatttcagaagataaactagaaaccagattcatagaaactagctatcaactaactacttcttagaatattaaactcctaaacagacccttagtcagtgaaatctattaataatattgctgctacactgatctaggcttctagttgtagtgtattagtactacagtgctttaacaaaatcaagaatcagacacgtgatttccaccataagagcaagaagtgtcttaaagtatcactagtgttgtctcacaatccaagagcatgaatacattatgacatgaataacacaatcgagaaattaaacattcatcttttctacatatatgacaaatgcattagtacgttgtggtactacattgt

SEQ ID NO: 50444 - DNA, 3158 bp, Oryza sativa
acttcaacagaaaaacttttagcaattatgccaagatgtaaatgattcaacagcaacacaccatggagatcaatgtcgaccagaccaattcataaatggatcagtaatatcagttgataatatgtaaaaccccactgcttactaaagcgatcaactataaacttaacaagatgcaaaagaaggaaacacaataaagaagcgaagtagaacgtaccatccgttcttaattgtcttaattagcagtaccctacgattcacctcactatacaaactaaatgaagaaagtagaaatggctggtccgaaaacgaatcatgttccaacaaaacagtggaacaccattatgtatacaagtcatagatggtatataacagcaatgcatgacataagcccaactcacatttctcagaagttggaacttgaaagcatcaaattgattgctatggatgacgacatcacgacactaatggctgcagttgaagatgctccatgttagtagtcaccgagaacaaatgaacctaatacatcagtcacagaaaaggcaatatcatcaaaaccaagcgagaatttggaaaacatcctgaatatgctcccaaccattcaatgtgaatttagcataagccactattgctgcaagtgaactgataacaagagtattttcacaatctgggcagaatgaagttctattaagagcatacgaaatgtaagagaaaaacatgaccaaagttaattcgaaggcagctctgactaatgattttggctactagcagttacaaccaagaaagcatactaagatttatgtcagataagagggtagttgccaaacaaatttacttactgtagacaaatagctttcaatttctgaagaataccagctcctctttactttcacacggcaatgaaaaattcaacatgctatacccataggaaaatcaagaacaagatagcttcaattcacagagcattcaatagatcacagtaagagcatccagtcatattgcaactcttttgtgtcactttcgtatttttttagcaaatcaaagcataagtattcttttttgtctttgttttcacatatcagtacaaccaaacaaggaaaaaaaaaatcataaaccacaaaactatcgaaacaagggagagctagatccccaaatctacaggtctatcgcagcaaatacatcacgatccgccctcctagtgagcggcgaccaccatgtccggcgagccgaggaactccatggccacctcgacgggcaggtccgggctcggcggcggcggcgcgaagagcatcaccctcttcgccgccgcgagcttcttccgctgggggcaccgcgggccgaggagcctcgatacgggcacgaagtacggcatcaccgcgccgccctcgccgtccccggccgcagcaggagggggagacgacgagggcgcggcgggggaaggcgaaggcgacgagggaggggcggggcgggagacggcggggttccggcgccggagcctggcgtcgcggaggcgggcgagggcgccggggcggaggaagcggtggtggtcgacgacgcccgcggcggcggcggccgacgaggaggagcggggcttgcgtgtggctgccatgtgggcccgaggtgtcagtgagagccggatgcgggaggcgcggattggtgggaggcggagggagcgggtgggggtatttgaaggggttagggttgggcggggacgcgcgagccttaggagggaaaaaggtttgtgccaaaaatgggatcgcgccttcgttgctggtgacgcgtttacactatgacgagtgggtcccgtatgtatgtgggtcccacatggcggtgggatagatggcgcgtgacgtggagggagtaaattggggggaccggttgctcacgtttgaaacgagcgggcggcggatggcgcgcgtgccgcgtgatcgatcgcgcgcctatcacggtaacccgaccgatcgtatgggccgggttcgttgaaagcgttggatcgcgagaagaaaaaagtccactttacatcccttacaaatggatcgagttttaataatataacttgaacgtaaaatcaggtatactgtgcaactcgagtaaaagtgcatcataggaattggatgcaagccttgtccacaattcaacagttcgactagaaatccatccacaattcaacagttcaaggaattggatgcaagccttgtccacaagtcaacagttcgactagaaatccatccacaattcaacagttcaagtagaagtgcatgatgttccataggccatatttgcataggaattgccgaattggatacaaagtgtgtctgcagcaatagtctaggataagaaaaacatttgagcgggcaacaaacagacggcatacttgatttgttctaaggatacaactgccggcacagtttgtttcacatataagaaagtagtgcataaaaaagggacctagaatacaaatgtggaccaaaactgcacaaaaacagtaacgaaaaggtgatcattacaatcttaaaatctggaaacaattgtgaacgatatctgaaagatggcaagttccacattataagctgaatcaaaaacatcaccggcatcccacatccatatttacattctttgaatcgaacacatcatcagatgaatccctcggcattctctggcttctttggagttttggtactgttcacatcagtagtggccgtgcagacaggaatcgttgcagggcttcctgggatatgggttttcgacaattcgctgtacgggttcctgtgcttttcacttttcgcggccatcgtgaaacttccaggtatatcggccttaggtaaatcagcctcctgatgcttatgctccttcccggttatttgggcattttcttgcgcatgggctgttgggattgcggcctcctgattttccagctcccgtttacccatttcaggtttttctggcatgttcttctttggtcgttcaccttcctgatgcttgccctcttgtacaaactctttagagcttataggagaatagtcctttgccggtttatcatcttgatgcttgtcatcctgctcagccaccaccatttcctttgattttgctccagcatcagttgcagtggttgcaaccttgctataggcatcggttacccatgctgcccctgtaaggatgta

SEQ ID NO: 50445 - DNA, 1221 bp, Oryza sativa
tatagagagcacaaccaataagacaaattttgaatccatagcttcttattacattaagtcaattaggcaatgtataggtgctaaagcacaaaagcacatcattatcaattactggaagaaaagaccgttacatattaccgtgagaagcatagccctctctgctccttcgtcatcttcgaaggtgatgtaggcaaactgagaccgctcgtcaccactgaaaagcattgcaaaaaggttagagccatatatcctccttcgtgagctgtctttgaaggttagttgctctgtataaataataagagatgtcatgaaggacatagcactaacctttgcatttcaacatgtacgatgacaccggaaaaggaaaagaactccctgatatcttgttctgatgcttcaagtgagacattgtggacctttattgtgctaaccatgcttgctttcaaaaaagagcataaacagaaaggcactaatcagcacactggttagggttttccatttttagatgcctctctagttagaaaaccaggacggtgtagaatgaacttcctcttttagtaaacaaatgaattttatggatcaatcaatttgggaactttctcacagacacacaaccgagaaattaattttatgcaaaactatgttacttgtcagcaagcgttatcaatggatcatgtcttcatcaaataaggttgaaactcacccaatttcatgaaagtaatacatttgaatggtgcttaacaagtaaaagagggagtgccagtattacatgcattattgggtctcagtttctaacagcttttgaaaatggaacagtcaacatgtgctcatttctgtgaacaaaatatagtatggaagagacagacatatatgttaagactaaaagaagaatgaaacattaaaagatcttctaaattttataaactggcaaaatatatcatgatggagtggtaaaaaaaatgtgacatgccaaagatttatagtgcaggtaaggatactaccgatctatgcagcagacaaccttttttagatgcattagatgttagaaacttagaatcatggtattacattgtgcaaattgccaaaacaacatgcatcgggtagcacatcaggaataaataaatcaacatatactagaaaaaagaactttagacatccagaatttcagagtaccaatgctgtctcttttcctcacatgcgagaagctgcagccataatatt

SEQ ID NO: 50446 - DNA, 1861 bp, Oryza sativa
tagtatatgcccgattttagctttttctgctatgtatgtgtaccacgcataacatatctattccaaaccgaaaaacggttagcattatgaatttatttccactggagtcaatttgatgttgttcttagatttgagatgtaaagttctcgatggtacgaactgataaaaagaaaatttgaaacattcaagcactagcatagatagataatgtttccagattccttgcacaactcctaacaatttcatgcagccatagccttgctagacataggactacaagaaataggcggggacgttcgatttctgacagaccaatgaagctgcaacttcatatttacacctttgtgatccgaggtaacagcaattctctcagcaacattgttgatcgatattactaatactgtaccaagctatgaaaattatttactcttcatttctgtgaaataaataactgtcaccctgttaacgttgttacaacttgcaaaatggaatcttaaatgtaatgaggcttctaaataaaaagcagttctctgttcaatgtaacggaactgttctaaattacagattgagtggatttatggttccttacagaaggtatactcagtgaattcaagatgcatgcatgaggctacaggccaatcttgcacgtaaagcccagctttaagtgatttcaaagctttggttcacagttggttttgctgaaattattttggatgtagattttttttagccaagattatgttgatcttagtgatatatatttggtcaggacttaaacattcttagatatctcaaaatagaaatatcacaaatacctctacaattaccatcaactgattcatttttattccatctcatatatacacttataccatctcatagagactcatttttattccatctctaggctgcgttctttaccgctggttcccaacccatctctctcgtttttcgcgcgcacgattttcaaactgctaaacggtatgtttttttgcaaaaaaaagtttatatatgaaagttgcttaaaaaaatcaaattaatccattttttaaaaaaatagctaatactcaattaatcacgcgctaatggatcgctccgttttccgtacggagatgataggttcccaaccccaactaacataataatctgataaaattatacatttatacaacattttctagtgccaacctaaatttggccctgtacacaaattctcctatccagttgtccatcttgagcagatgattgcaacgcatccagtttttcctctttcttctgctcgcgtgcatctccattgtcacccctacttcttgttgcacatggttccttttctggagacgaatcaatagccgtaacgacttacgaaggccaagaatcaagatatgttgcagatcgtttcttgattatagcaccatgcagtaatatgcaggaacatcttttaacacaaacaaaaacatgcagacaaacaatggccattgagtactgcagcagcattgcagcatggggagaaggaagataaccatgaatggctaaaacagtaatttgactgaacactgctgcttctttatgtctatattatacatcataatggatctcacagtagcctatcaaatggaatcaatatcaccaggactacagtgagatacagaagcagcaatgctccagctggcccacaaaggccaacctgatctttttcttcagtactgtagtgcatacattacaagttaccctaaaacaagagaaatgaagcatggaaatactcttggaattattccttggattaaattctaggcttacaatgttttccctattcggtggtcgtggcaactctagatcttctgcttgagcacttgccggagct

SEQ ID NO: 50447 - DNA, 3093 bp, Oryza sativa
tcggcgagctgaggcctatttcttgaatgccactgtcaatggtagaatgggtcccaacggatagccgaacattagatgatcttccattgatcgtctccacagaatctttcttgcagacgtcattgttctttggacgggacgacttccagagctttgataaggctgattctttcttcttgggttggctcatgtttgtcaggtatatatcagtcgaatcatccttcagtttctcagcttccttgtactcaaaatcgtttcggctcgtccaagagatgcttccatcacagatcttgttaactgacggttcacttccatccggtgaaccacttgaagcctgcatatcttcatggcttattgtctcccagctgctgccatcttcagtgtcactctcattctgagggcttttacttgagtacaccttggttggcttttccaggaatatatcagtcattgggctagcctcttggatttctgattcgcacatagcagagttgttcttgtagcatggctcaatctcctttatgacaggctcttcacttggacgcagctcttcaaaaatggaaaatatgtcttctgattgtgccggtggctcatatctgaattcaatatcttgtgctctaacagatttgatcgcctgtattatgttctctgcttcttccacaaccataatgtctcctctagcacaactgcatgcagcaataaaagcctcaacatcctgttgcagtttgctcaattgtgtgtatttggcatcaagagtaagttttgcatcaacaagcttcatctgcacccgttcttcacgccaaacctcagccatctgtagcatcttgcgctcctcatcaacctcctctcgcagcttgagggaatcatgtttcaaggcttcaatctcggctttgtcttcctccacctcccttgccagttcattgcacacctcctcagtgagctcgcgtgctttcctctcattatcatattcttgcagtagctgctttgctgacatcttggcttccttcaactcattgacaagcttcaagttaatcatctccaggcgtctcctgtttttcttctcatggtcaagatctgccttcatatcttcaagaattgcgcgcactttctcatgctctctactccgccaagctgccttttcctctgcaagtttcttgaacaagtgatccagcttcttcttagccgcacgtcgctcggtttccagttcacttacccgatcacgtgcttgctggagctccatctggaggttagcaacataagttgcatcttgctgctcgttgagaagatttagttgactagctatcagataggcatcatgtgcttccattccctccaagctctctggctcccattttgttgccttctccatagcggtgactggtagcacagctgtagcagcatgaagcggtacctgcagaattaaatagatcagtgatcttacatgctggtgcagcaaaaagtatacagaggttttaacctcagtgcctcaccttatggagctctccactctttcgttccaaaacagaaattgggcttgaaatctcattcttaagggtttggtgatgaaccaaattattctgtttaataagctggacttgtagatgtcttgggatatgctgtcacaaaggcacatgcacaaataagttacaagaaaaatagatccaccagattttacagcaaatccatccagaattccagaaagcaggcccctcccccctagatatgtataaattcatgttactgtttaccactggggctattccatatataacaaaacagtgaattgtcatgggacgtcatccgaaacacagagaatccagaggggcccaaactatcatgacagatagacccctctaaaacagaaacatatgcactgaacctaaagtccaacctacatgaccacacttgtagcgttggtaacatcgatctcatttgttggctaggattccccatcagacctaaggttcaaagttcaaaaaccatttgatgtagctaggatagactccaattggatgagacaagaagctgtatggtcagctagtggctcacaagggaccacatagctgaacccagcttgcatatgtttgttgctgcacgggataagagttcaatcatttggctcatcggatccctcttaaaccaatcaacccaaccaagatccaaattccaaatcacacacttccaatgcaccattcatttccgtaaaacggagataagctactaccgttttcaccaacgaaatggcctaagccatacggacaattcatttgtagccatacgggcaattcgattgtactagttgcacgagcatggagaatccaatgactggggcccgaccaggttcacatgaggggatccgggagcaggaaatgcaactgccctttttggatcagtaaatttatgcgacaaggatcacggccatcgcccaatgggctcagcacggcagctctccataaatgtccatgcttctgagcgacgcatcctgcgcttacgacgaccactgaatgcgtcgatgctgagcgactgacactagtactgctaagcacttcaatgaggagaatggattaatggatttgactacggcagtcggcaggcgagtttaaggcagaaataagcagatgaagctagcaggcagatggtacatgctcctgcatggtgtaatgaagaaatcgcccagaaggcgaactccgaaatgttttgcgtgagatctgaacatctctgcaacaaatgagtgcgttttgacctggaatcttagcattttggtagtaatggattagtcaaaaaaaggataaacatgaccctagccaaagtttttgtttgttttttctttgattcaagctgaaatagcatgaaaccggaacaaatccatcaaaaagcattgaaaatgcccgcttttttagctggacttgactaggagatggacgaacgatacagcaaatcagctcaccgaaaaagcaaacgaagcacgagcttttagtgagctaaccaccactgcaacgcatattggtggggggaaaaattcaaaaccgaaaaaggggaaagggtttaagcttccgtgcacgtacctcgaggccgacgtgaaccttcttcttt

SEQ ID NO: 50448 - DNA, 12173 bp, Oryza sativa
taatttgggttgaaattggtataatgtgacttaaaagttgcgtgtgtgcgacaagtttatgtgatgcaaaaagttgtaagtttggatctacacagcatatgtgttggtacggtacatcttccgtggtggaaattcagacaacttttatgtgttggtacggtatggttacaaacttaaaaacacgttacgtcctctagtatttattgtgtgagaaaaaatatacgaagttaacaaaacaaaagcaaattaatcacataaaagaacatcaattaacttaggggacaaggtccaatctcagatgacgcctcctatatctctagaaagcgcaacagcacgtcacatgacatatcgccgtcaccggctcaccgccgcaggtccccctccaaaacggagggcaataacggaacagccctcacaccccgcacgtcgccgttgaagattgaagaacccatcatcaaatgatcaacaaaatcccaaatccaactgcttcgctaacctctccagatgaccacagatccgaacacacaccacacgttcgacaccacgacacacctccacgtggcggcatcccgcacgagcgccgcgctgtccggtgtccggactccggacgcgagcaccggccgagagccgcgcgggaaaaaggcatccgaggtcaggagcacgagggtacggggagaccccccgccacgtcggaccggacgggcccagggccccacccgtcagagaggacgacgtggctgcacgcggtggtgggccccacctgccgcccgcgtcagcatttcgtccttctccatccatcgcggccgcggggagcagtaaaaaaaaaaatgggtctcgccgggaggaagacgacgacgaggccgtgcgcccgtgtcgacgcaacgcacgcagcgctatgactttttctctttttttttttgacagcagcgcctgtgattcttctgcgagcgtaacagtggagggtgaattcaaaatttaaaccttgccgcaaaggtaaaaaacgcaaaccggcaaaaccccattgtgatctgtgaattcttcaactttttttctctgtgttcggagctctcctcttcagattctttccctggttcatgtggatggatccgattcatcacccatcaagcgtggagacagctcgttcgtaaacaataacgccgtgtctgtgataaggatctagcaggagagaatactatgccgcagcagtagtagcagcatccgagctttctcatcaagggggaagaaagaatacgatgtagcactagcagcagcgtgcagcatgcttgacccgacacacacatgaagatgagcatttttaactgcagatcctctcgtgctcgtgctgcgtggagtatgcatgtggcgtagtcgaatgctctacgggggtctaggctagtagtagaataattctctttgtatcaaaataaaccaatatcgtatcggatatgatacatcgttcaaattcatcgtataaaaatatgttacatctaatattatattggtttattttgaaacggagagattagtatagagcctgttcactttgatgtaaaaaaaaaccttttttggtaaagttgtcaaaatttcagtaggatttcttatatagttaccaaaatttaatagcaaactaaatgtagctattttttttataacttaactaaaatttggttagattgaaaatgtgaacatgcccatagatttgcctcgctggtcggctcggtgccgacttctgagctccgacgaagatcaggtaggtgtagttcaggtcaggtcgcatgattagtcttggagcggcgttttgctccgtaattatggctgcagatcgatcggtcaaggcgtaccgcgtacagtatgtactactcgtatagtctactgtagaagtaacatgctggtggttggcgatgccttgttaatcttgggggcacggtggttagatcatgattcggaaatggtagttgggcttgcagaggagacaaagcaattacatgtgtaaaggggagcgattttttcttgcaggtacaggaatgccttttcaactggtgtagtacgcattagtagctcggttgttgcgtattctttggattccccctatttatgttctgtattgtgttgctctcgacgctgcttgttctttgggcttaggattccccttaagtattttatgtttatcctgtattattattgcggagaagcaaagcttgaaacttcctggaaggagtacaaaaatctagaattcggcctgccttgatgtggctgagaacgttggcccaacttagcccaaacaaatttaactggctttggcccatacaggattcaaggtttttgggtcccacggaaaacgaactgaatgtatctctatctctgtcaaagttaaaaatatttctaccacaattttagtacgtcatccgtatttgagttagttataaatccatacttaatttgaatgtctaaaataactagtatatacttttagggaccacctattatgcagttaattgaaaaaaacgaaatcatcagttgattttggtatagcgttcaaatccaacggttgttgagtaaaacaacccaactcaactagctcaacctttctctctcccaccctaactcgaccgacccataccatcccatgcgtctccaatcgacgccacgtgcaccttctccgaccggcggtctttttctctcgctaatcctgaccctctccctctacttccaatctcatctcttttctttttttttctcttcgaaattcctcttctcataaatattttccttttgaatttatcattgtttaaaatgtgaaatgtagtaagtttgttacattgcaaatacctttccatctagagtaaaagaatgtttactaatgaataaacaaaatttcaacatttgattgacgaggtatagtaaaatgcgtcaacttatgtaatagacacttgattgatttgtgagattatagaaaagtgtacataagggattgttcgttccatgatgcatgaagcacgtgtaacccgcaatgctatacatggtttctaactttatttgctgttgttttatttgtctattttcgatttttatcaatcgtataagttatctcactggttaaaacgcatacatttttgctggttcgataaaaactgcgaaaaaaagagcagtggcgatcgagactcttcgaattcgttcgattccctccacgaaatttgcccaaaaaacagttctcccgccaaagcgtgaatcccccggccaaattttccccaccggatcttcatcctgcgaccgcggctcaatcccaatcccatgccgatcccctcctgcttcctctctcaaatctccctgccgcaaccctagcctcgccgccgccgccgccgcctccggctcgccggctcccccctcccccgcggatccaagctatccaccaaatccctccctcgccgtcgccggcggatggacttcactgccccttccttctccctcggctccgagttcgacgagccagaggaggcggtagggtatacggcgcccgatgccccgtccttctctctcggaatcgatttcgagggcgacggcgacgagtcccacctcaccgatgccggcaatggaggggaggagcagaagcgttatgaggctcccgatgcgccatccttctctgtcggcatcgattccggcagcgacggcggtgaggagcgccgccgggaggagcaacggcgaagttacgaggctcccgacgcgccctccttctccctcggtatcgactccgatggcgacggcggcgacgagccccacctcaccaacggaggccaccgggaggagcagcagcggcgttacgaggcgcccgacgcgccctctttctccctcggcatcgacttcggcgacggcgacgacgaaccccgcctccccaacgcaagccgccaagctccgcgctacgaggcgcccgatgcaccctccttctccctcgggttcgatgacgacgaagacgatgttctcatcggcggcagccgtcacgagctcgggactgtcgaggaggaggacgacgacttcgtcctcgccgacggccaacagcaacagcaacggcggcacgaaactgttgtccccgacccggcgccgccgccgccagagatgaatcgattcaagcggctgcggagaggccccgcgccgccatctcaagcgccaacaccacctcctcataggacaccagcgccggctacgatggaggcttctccggtggtgagctcgaaggccgtcttgggggatattgggagctttgaggatgagatcgaggatttcaccgacgaggagagattcatgcgaggtgagggaaccactgaccctactttcttgaatttttgtgcttacttatctttctaggcatttccgtttcttattctgaatctagtaatacacacgtacacactcctggtcaatgaatttgtaatttggcttcttcaaaaagctgaaggttagccaaattactggaaccagcacagcacacactagacatccaccaaaacttgcagtctgaaaaatagagagagtgatttctagcgatttggagtcacatgcctgttcatgtaacataagagtaatccagtagtcaaccataaaaccacacactcagtagatctccaaaataacactggtcagattacactgaagactgaacaacccgtagtacttcctcaatcttcagaactaacttcagacaagaaattagctgggatatcctcaaccaggcttgctgccatttcacaccaattatgccttcagatttgttgtatttgttgcttgattgcttgaaatcctattaatatatttttctggtatcgccccttgactagacattccaacatgtgctgtgtacatctgctggatgaggaacttatgccccttccaataccatcctgtttgttgtcagccaaagagcccaacaaagagctagcagcccgtataacataatagtttttttggctaactttttagcttcccatgtctcatctgttctttggaaaattcagaaatagagttaggaacactgcaaatttgccatagagcgctgaaacaaagaaatgtggccagcagcacccaattatccacacaatttctattgtgattattcattcatcatgtatgtggtatatttgtctgcagctggctaatctctatattttacggaactttcttcatttccttgtgtggattgtggaacatgtaacaacttctctgcttgcagacgtaccgccgtctgttggtagctgcatcacttctagcagctcaaggttctctcatgccagcaattcaaagttctcgctgatgaaccatggtgtcctgatgagccaatcaacaagtaaatcaaagaaatttgcacaaacacctaattattctgcttcaaaatctatggaagaaagcagcaccaagaaactgctccctaagacagcattgagcccaatgaggaaaattcatttgcttgattcagatagtgactcggatgataacaaggaaatgcctggtttgcagcaaaactgcaaatccaaagtgagcactgttcaacataagggcaaggctgagatgaatgacagttgggcgacacctgctcttgatgagttctgcaatgagtatttcaaatccgtggaagactcgagaccatctcagcagaaagaaggcaacagtttttgtggccccaaagtcatacgttctaactactctgttagtgaaactggaggacattttccacatcaatccactccaagtggggctgtactagaggacaatcagacagatagtcatcctcctgcaatgcattattttttccaccatgaccagttggttcgtgacctggtccgtcaaagactcaagcattttgttcctgttggagtagacagcagaggaaatgagcaagatggaacacaaaatctccagtacaggtaattgcggttcacacatcaacaaattcacaatcatatcctgcagtcctctgtgcaatgtcttcgctgatcttggttactctgtttcatcatccttctacaggagtcagaccggccggtgtgctgctgaaaatgatcggtgggtgactccgaacaagaggatgcctgttgcaactcaagttggcagaagaagagtaaatcctgctggaatgtctggctctggccattggttgactggagacgatgggaagaaggtaaacctgcatgtttgttttcaacactctagttgatttcttgatggaaaaaaggctctgtcgcatatgcactgtttttcattatggaggccgacctgtttccccctgtattttggttacgtattcatcgttgtgctccattggatttgggctgcaggtctatatctccaaagatggccaggagttaactggaagggttgcttaccgacaataccaaagggtgatatgctcattcctttatgattaatttcaaagcattatccttgtttgcaccacactagtttcatacacaatattagcatattttgatttattttcaatttaagcatatagtggttacatatgcctagagttgcacaaatatatttagtttggaattcatagtgaacctggcatgaggatgttatttttactgcatggtggcatgccatctaatttaacaaatctgtgcggaacaggaaagtggcaagggatttcgccagtcgaagaagaaaagttcggctggaactagagcaaagaaagccactactaaggtgaaacaagagaaaactagagcaaaaagaaagcgctgaattcaagacgtgctggcctcgtattcacagacgaggtggtgccaatgtaattagtcaatgagaaatcatagtcattatttgttcaatccatttcataaggagttgttaaaaacatagagcagagtagaatgacatggtttatgtcggagaatataatcacataacaaagcttcaactgttcttctttgataaggtaatttgggtgactagttatttgttaacttgatcaggctttgctactattttacacgtcgtgctcgtggttctctcatagcactaatgcaggaacacaaggccttggggctttgaagctgttcactgctgggtgaaccttgattggcaaacgaggtctccatggagtcatggagagaagaaaacggtcagacaatagcggctgcgcagcctgggcattcgtgaccgtggctgatagctgcggcgcactggtgttggcctccctgtttcgcgcttaaggtgttgtttcttcactagatgagctgaattcgctaggatacgtagcagccaaactagtaggcctaaatgggccttaacatttatttcacaagaaaagcttcaactgcagctctccttggataaggtgatttgggtgacgattgacttgtactccctcttccctctgtccaaaaaaaaaaaaaataaacccaactataaaaaatttttatataagacggacagttaaagttggacatagaaacttagagtttatcttttttttttttggacggagaaagtacgtcgtacgcgtggttctctcctgttgccacactcaattgtttacttacccttgattagttgtttgtcgtgtcgtgtcgtgcccgtggttctctcctgttgctgcactccatgtctattgtttttaccctcggtcaattgtttgggaacccacggtatcgagctgttcgccagccgaatcgtaagttagtacagagctaatgcagacagcaaacatggttgcggaacatggccatcagcagttcagcactccccaacgttctcacgcgttctccaacccttctgccagagcaattctcacgcgtgcacgcgtcaggccttcgatttgtttatgttgtgcacttgtgcttgtgcgtgcggtgtgccggagtttcgccggccactctttccactccataaccataatctctccgttttgacagtccacccgcggaagggaaatgcctggaggcgcggctcgtgtgctggcctgcccagtggccgagtgcttccacgccgtgcgcttgcttccagtggccgagtggcctttgcctttgctatgatcaagatgagcgcaatgacgggacgtgcagctgcatcgttcccgcgccgcgcgtccaacggctaacgcctccaaccgccaacgaaatccagagtcctaactaatctcgcgcagggttcggttaccttacctgcactgagctgccgaccgattattggtagaccggccggaacaattcaagtccatatttaaattttaaattgcatgatctacagattccgtgcaacatatatgttgaggtggatctatagaaaaaaatgttatgcattacatcatctctactctctagtagtatcctctactttagagtccctaagagcacccgcaatggtaaagtaaggtgctctctataaaacatgtacatctcagcaatagactagataatagtaaactacttcaatagtatgtctacatgggtatctatagctctctaatgcattgcctcgtttttctctatagactatctccaggttagtagatagctgtgctctctctcttcatttaatctcttccaagtaggaaaatatgctgacatggatctcttgtagagagcctatatataaccattgtgggtgccttaacaatcaaatgggggttgcctccaattctttaaaaccttaaatatgccatcaactttagtagtagccctcatattttagctcctatttcttttcctcttttattttagcatataatttatgtttatatatagtttaacaccaaaagtttgaattttaagttttgaagtcaggaaggcggattattttttaacctgggtttatcggcagtgatcggctcgttatccgtggaaaccagtttttcaattcaaaatgttattatattcaaacttttgtccacaacaactggccaattaccggtattttttttcacggaacttcaccgtagcatggcaccacgggtccacgaccgtacatggcccgagtcgcgactcgcgagccccggcccccgcacatggcacaccaccctgcgcgcgcgtcatctttcgacggtgtcggtaaccagtgaccacgcgcgagccaacatccgccgcccacccgctcgtctgatcggccggtgtcccgtatgacgcgccgatgcttgcgtgcaccgtgcactgtgcgggcgggtgcatgtccatatcgatatcgagcatcaccaacaatctacttatcttattccaaaactaatttttcgagattttagttaaaaaaacagttccaatatatacctactctcctacccgaattttgagttcccttctctcgattcctcactctatttatatgcgggtgtgaaactcactcccaatcttgcactccgcctctctctctccagttaccgcgtgggagatagcgatccttacatgtgtgaaagaaaaaaatggaatattctattagtagtttgacagaagggcccatttttaagttttagacggttgaatttaggcggttggagggatgagtctttcactttttattttcagtttagaaaaccaaaaatacttttttttttggaatgtgatgctcaccaaagctggattgaaacggctctccatcaatggcctgagcgctaaattttgcgaggaagttttggcggatgggaaccggtcgataaaacagagacgatcatgctacccgatacaacgctgccacatgttagagcaggagtttgtcagtttttggctaaacgggcaggattaccggtttcaaccgatgtatttggtgtaaagagaacttttacggtacaatctcttagtatatactagtagtatatagaagacatgttatctatgatcgggatcagacatgctgtgaaagttaagctatcggaaatagaaaaagtctatacgtactaaatttttcttacaaaatgtttacaaactctgatatgtcaaactgtgagtaaatctagatttcttacaactttcatctagttaaatcaaacggttgagaaatttgttagtaaaagttttgtaagaaaattttagtacgtgtagcagtactctcggaaataagcaagtaactaatcaggatttgatcccaaggatcgtatctacagattacagaatctgtacgaattacgtataactgttaatacgaaacccttaacagcatcatcttccaaatgctacagtagtagtactacattatatgttcactcgccattattgcgttggaccttgcttgatcgcgcgttcgggaccttgattaatttgttctggtgtacccgagttcagtcggtactcggcagtgacgtggttgcagcaacgtgagaaatccaaactgcctcctctccagcggccgctcgcccgtccatctgctttgcccatcccaccccgagggaccgagagcgtgacaagcagggcaacctgctctcccagccgccaccaccatcaaagtggccggggcccgagccgcgcacggcgcagcgcacggttcgcccctcgtccgcgggacgctgaccgcgcgcgcgacatctaccgatccgcgcgggcgtcacggtgcgtgctgcccaaccgatcgtgcattcgcgctcctccccgctgtgcgctagcttcctctggccacaggccgcgcgcccgtcccccggccgtttctgccacaccccatcccaattcccaccccgcttcccctcgtgcagtcgcgtggccagtgcccggtgaaaacgttgcatacgcgacgcgacgctgctacttccaccgtgcctcccgcgggaggcccctcgctcgctcgtctgatccgccagcttcgtctcccggcgttgtgcggtgccaccctctcatgcgtgcgattccatcgatcgatcggtgcgccactgcgtgccggccagtggccgaacgagaaagtgagcaaccagccgaccgggcgcgctcgtttttttgcacaaggccgccgcccgtacgtacgtctacaccgctctaaccaagttggatcggaatggctccttcagtggccctctgcccctctcgctctaaatttcgcgagggggtttcgatggaaagggacccgggtcggccgagcaaaccgagacacgacgtgttacctgacgcgacggtgccacaagtttaaagttagctagaccaggtgtttgtagctaaacgggcactgcttagatacacgtgatccggatcgaggcagcccatcagggggctccaaatggcgtccatagaaggggcagatggaccatcgacaggtttccatcgttttcgaatccaaatgctactgaagaacttgttccccttcaccacaattgcggtggacctgacctgttattagcttgcggagttgtggtatcagtctctcttcgaactttccagattttcttcctctcggcaggtgatgtacgtgtgtcagtgtgtggtcctgacgggctgaattaatcccctaacaacggcatgcatgcatggattgatggatacgccattaaacactgaacatccgatactttgttttcgcatatttattatctgacagtgtcggcgctccgggttatacaagtttaccatgtcggagaatttaaggggagagcggttccattcttctctctcattctctcttcctcaatactaaggtgtgcttggtttgttactatgccaaaatattggtaaccaaaatctaggcaagtttttgtagtgtcaatattttggtaactttttgtgtgctattggtagcaaaccaaacactattaaaatactaatcaaagtgctaaacaatttggtagggcacattttggcttcaaaccaaaatgaccctaaaaatatggacagagtgaagtccggtgtcggttgttagggttgagttttggacaatctcactgtagtttttttgttggccaagcgacgattggtcacgtttagcaatgatcggtccagtgttagctttctcacgagtttaagtgttaacgatgttggcgcgtggggtggttattattttttttttctggttacgatctttcaggactgtagtcttgtaaatttttttattccctattaacttcgtatttcgtattgtcttgtgcgagtgggtgaaaaaaaggttgtttcattctagacaggccttaaacaccttagttggaattctacgatattactgcgtcagcttcagaaaaaactgtagtatactgtagtcctacacagatgcacaac

SEQ ID NO: 50449 - DNA, 1786 bp, Oryza sativa
aagtttctggcaaggtctaatcttaaaataaattttcttaatgggtcaatttatcaaaattgttgccagagcgttctctattagctctccacaaccacacaaagcttcgcgccacgacgctctctcgcctctctgctgctttagcgttcgcgcgcgcgcgctgcggctggctggctggaccaagctaatagctatggacaccgtcgtggcggccgcgacgacgggatcgagacggtggctgccgtgggcgcggcggcaggcggcggcgtacctggcggcggccgggggaggcgacgacgggtggcggcgtgcgcggcgtcggcggtgcggatcgtggtgtgcttcgtgtccatgatggcgacgacggcggcgtgggcggtggtgatgctgctgctgctgccgtggccctgcgcgcgcatccggcagggcaacctctacggccacgtcaccggccgcatgctggtaaccaacgctgcgagaagccaaccgatgtttcttggactatacgaattcagcgaagctgaataaactttttttttttgcttgcagatgtggattctggggaatccgatcaagctggaagggatggagaacctgaacacgaggggaatcttcatctgcaaccacgcttcgccgctcgacatcttcctcgtcatgtggctggctccgaccggcactgtcggaatcgccaaaaaggaggtagatagaactgtatatacacagttgtgctagcatgcaagagagtgagaaaatcatctgcctagattgtactaataacgtggctgaaattgcaatttatgcagatcatctggtacccactgttcgggcagctctacgtgctggccaatcacctccgcatccaccgctctaaccctgccgctgcaatcgagtcaatgaaagaggtataattaagttcagtgatgtttacacactcctgttcatgtcgatgcatcattgtgcttgtgcatttgtgctgtttcgtagcatgctcatatttcttctgccctgctgttcccaggttgctcgtgcagttaccaagaacaacctatcactgatcctgttcccagaggacacacggtccaaaaccggaaggctactccccttcaagaaggtactacaataccaatacagattcagcaactcctcatcatcatcgtaatatcagctgaaaaactcaccgatgaatctcgatgcgtggcacgcaggggttcgtgcacacggccctgcagacgaggctgccgatcgtgccgatggtggtgaccggcacgcacctggcgtggaggaagaacagcctgcgggtcaggccggcgccgctcaccgtgaaggtgctgccgccgatcgagacggacgggtgggtggaggagaggatcgacgagtatgtggagatggtgcactcgctgtacgccgacagcctcccggactcgcagaagccgctcgagcctgtgaacaccgggaagaagaagatgagctaagttcacggttagttaacgcacacacggtgacaatgggtgtagttttgtgcatacgcgctgtgctgattgttgtatagattggtgtgtgcgtgatatacatgcttgatttggggatttgtagatgcaacagaaggttaaaaaaaggttattgattttgtgagcacatgaagcattgagcttgtatttgggtgccaatgctgtcttcagcccttctgcggatcatattttcgttcttttctttgctcgctctccaagcgaaaccctatctaaagaaaacagagctaaagaccgatacaatgttgaactcattttct

SEQ ID NO: 50450 - DNA, 1088 bp, Oryza sativa
agctcggtacaggtatactcagccgtttatagaaggaagaaaaaaaaaggcacaatcaacctttacgatccaattgaggaccaggcgttcttttgattatatatgtatacacaggtcagttatgcagcaaataccaatgttaggttcgtattggcagatgcttgcttcaaaactgagagttggaaatctttccaggcatttatcgacctggattccctgaacctagcagcaaaagaagaaatgtcgcattaattcataactgcaaaataaatatcaacgcataatagaaatgatggataatagtgatatattaccacatcatcatatagagtcctgtagtgatgactgatgaaataaatcattatcccaatttctgttttgagttacgcaaacacaccaagtcctcctagcgtaaccgttcagtcagttggtcagttgattgccattgggctctgggaaattaaagaaccgtttcaacttcagcaaactgaagtttacgtctatttaagtatggaatgtctttcccactgaaataggccagacttctcaacatcaccaagtgacaacacaggaaaacctgaaagcccagcactgaagctgttagaaaacataaccaggaggctttggcaggcctgctcttcttctaggtgctctgcctcattgcgatgcatagcaggatccttccaaggttgataataatgcctgggagaataaacatggttagatcctgcagtacaaaaatatctaatcataagagaagcatagacaaatgtaaatgatgtggttttacacactagaggccataccatctccatgcaggattagcttcagccggacattgtatctgtgagcacagcatttcgatttgtccataatcgccaatgaagtttatgataactgctttaagaaggttaaaaaaaatacgagtgcaaagcattagcaagacgggcgcatgttagacctagaattgatagattaaaaattcaaatcacggtaaacataccttgtttattggatctgtcaagaagcttcaagcaaaaaaaagccaccacagatggcaaaaaatctcggttcattttcagatgttt

SEQ ID NO: 50451 - DNA, 1711 bp, Oryza sativa
gtcacaaaaaatataatttataaatcccattacacaaaatgcatatgaagacaaaaaagaaacatgttactgcaaattatattaattatgaggtccacattgttcatggcactgcacattctcagttattaacagtaccacatggttaggcacaaaaatatatacagtaaaatcttataaattccacatgaatcaagagtatgcaagaatagggacagatagagacaaggcaaggcacaaatgaagtaccatttcagacaaaactggcagaggaccattcataagaatgacatcaatgccaagttgcattgcaagcttaacttctatgcttcttgagatgccaccaatagttcggcacaatttatgtatgccatggagggataaagagaaatgtggttggtaaatcttccttttcatagacaacctcatcgttgatgcaatcacatttagcactgaagttagcaatggaacatttcctttcaacaatttcatatcttcaacaaggacataaaggtatttagatattcttgagagttgctcaagggcggtttcttggagccattctgcaattaatcttgatgatgtcaaatcattcactacctggagagaggacataaaatcatatgtatagattaaaaagcagattcacaatactatcgtaaagaaaatgatgtgcaaaacattgctaaaaaaactctccaaatcataaaataataatagaccattgaccaatgtggttttcatagaaaaccaaatgttataatctgtgatggttaatggtatgcaggtgacaaccggctaaaatagtgtgtttgtatcaatcctatgggttcattgactgttttctaaagatatgatttagtgactcatgtttcagtagtagttgcttgacagaaacaactgactggcattatcaggagtgtgagttgcaacctacttaacttgtctaaagaaacagcattactaatgagtgagaaacatatatttagaactgcatgcaccaattaatgttataaactaaactaggacagctgcaataattatatatacttttaaagtattgacacaaggaaacagctaatatcactgcagagtgaatttgacttaaggtacaaaatcggcattaataaatcagtcagttctagtaatatcaagcaacggcaagaatcagtcccacaaagtagttagttgaaatgatcctcatggtcaccagcagagatcccatgaaagaaatgatgggctacaacctacaatcaagattcatgaaaaaatatggcaaatcctagagaaatggttctccaagtgtatatatgtgggtacatgcactgtcctgcccagttatagtgcttcaatatctgtgcaaaggtaacgcgatagaatgaatggatagggaacatgggtggtttggtttgaattttgaagattttacaccaatctcaaggcatatgtttgactgcagtgatacatgcagaaaatacaatagccaactcgtacagtcaagaatctcatctataaaagtgttatagaaagtaatgtaaaacagtgtttacctccaacgctgacccaattactgtagaagaataggagttttttacactgtccagcccttcgacatgagatgagattacagaggataaccacaacagaaggccagagtcttttgttaaatgatgagccagaacgggaagttttacacacttctttagcacct

SEQ ID NO: 50452 - DNA, 1108 bp, Oryza sativa
gcaggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtaagaccttaaatggaatttagatagcaacaaatgcttcaaagcaaccgaaccgccgccagccattcaccatccatccagccagccatccagccagccatccagccagccaaccaactatccatccacaatttgtggacacaattcaggcattcaaccaaaattccagttgaatgggtgaatggtgaatggctgaatggacgaatgccaggggatcatcatgaatggcaatgcaactatcaggtagagatcccactccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcgga

SEQ ID NO: 50453 - DNA, 748 bp, Oryza sativa
  unsure (1)..(748): unsure at all n locations
ccgcgcctgattgagatntcgatttgaaagaaagcaccccatcagnatagtggaatcctttaacgccgtcagctccctgattctgggtcaatctgaaaactttattgcctataaagatatcctcggcaaaatctcccgtaatcgtatgtacaccatggctgccacggcaatgtgcaccgagtcgatgtccatcgttggtgcatacatgaccatgctggaaccgaaatacgtcgttgctgcgctggtactgaacatgttcagcacctttatcgtgctgtcgctgatcaatccttaccgtgttgatgccagtgaagaaaacattcagatgtccaacctgcacgaaggtcagagcttcttccaaatgctgggtgaatacattctggcaggtttcaaagttgccattatcgttgccgcgatgctgattggctttatcgccctgatcgccgcgctgaacgcactgttttgcaccgttactggcttatttggctacagcatctnctttcaggggcttctgggctacatcttctattcgattgcatgggtgatgggtgttctttcagtgaacactgcaagtgggcagattatggcgccaaactggtttcaacaagttgtgggaagatgatttgagaaattggtgccgcttcttcgcggctgaagcatcatttgggttctgggttctcggtactctctcattcggatattgagtgcaattaaggcttatgagagcaggtactggtttttccttagg

SEQ ID NO: 50454 - DNA, 798 bp, Oryza sativa
  unsure (1)..(798): unsure at all n locations
catgtgtgccattcgacctacncgatggtacccatgaattcagaaccccagagtccgcacatcctcaaatacaaagcacttccctagttagatgtaagttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcgggtcggttgctttgaagcatttgttgctatctaaattccatttaaggtcgtaccttatcgcccaacatcatcttattctctatttgtattccctccatctttcagatacggatgtagccctggatgtgcccgtgcccaatgaagaggaagagcgcaacatgaaacgtaagtacaaaagtaccggacacccacccagatcccaatagaatccggctaatcctgcgggaaattgtaatcccattcaccagctcctacatttaattaacaagagaactattgtatttatctaacacctggattatctncacctttcattngatccctatttatagnatacgctgcgttgctaacgggccgcaccttctatttccctcaaggtgaggn

SEQ ID NO: 50455 - DNA, 742 bp, Oryza sativa
caatgcaaacaaactcattgtttataatcatgaatgtatttatttattacatgattgctgcaaactcccgattacacaatgataagtagcgaactgaaaaccacaaacatggctactcattctgattctgaagaggtatagctggcattgttctagtgactgcatccttgattggttctgtgatgatgtgataggactgcatattgctatcattcacaggagaagcttccttctgattgctattcgaagcagagaacggtcttctgcttggtatcgccctcctgagattgattgccctttgctcggcctggagtaggtcggggagagacacaacttcttccatcgatgacaattctttgctgaggctgtcggtgcagagaatggttggtgctgaaggtattattgctatgatttattgcagagtcaggtgcagcaggaggagcattggtgctgtggatgatatcgtcgatgttgctgttggagctaactagctgatgagacaatcgtagggttgttcgttggatttctgcggtcttggtcaacaacacactgagttggcaatccttgggcacatggtttgtaccttcgcacagaaaacatgtgaccttgcgggtgggacattcacctggtggatggtcttccccacaatgagggcagagtgtgagacacatgctagcaatgtgtccaatttctccacaacggttgcatgcttttgattccatctctgatgaactatgtacca

SEQ ID NO: 50456 - DNA, 15111 bp, Oryza sativa
  unsure (1)..(15111): unsure at all n locations
acacaaccgagcaatgtcgaaacattcgacagcaagataacactcaagctccaaggcagtagcaagtcaaggccgaagaggcgcctcaggaagcggctcttgaccaaccacgtaagccgaacagcgccaggatgcgcagcgaagagtgatccaagtcatcacaagatttgatcccccttcgcaatcgtcgaaacgcaagaaaaaaaatgcaacttcgagcagtgcacaacatcgtttcggcaagcgaaggggccttgaggcatttggcgcagcagatatatttcagacaagaggatgccgaatgagttttgttcccacaccaagacccactggtggtatcggtagaaatagtcggttttgaagttcgacatattctgatcgatggaggaagctcggctgatgtcattttcaccggaacatatgccaagatgggactaccaaccctggcattgtctcaagcactgactttgctccgaggtttcgaaggcaaggccgtgcaagttttgggtcaggctctcctgaaggtctcctttggcactcaagaatacaagcgagaagaagagatacttttcgacgttgttgacatcccatacaactacaatgccatcttcggccgaggcactttgaacaaattcgaagcagtctcccaccacaactacctcaagctcaagatgccgactacaagcgaaggagataggcggtttaaataaaaaaagacccaaaatttcaaacatgtatctagaatcacaggaaaactacaaacaaaaatagtgaaaattagctcgttaggaacccatccaagattgttatagacccaacgaattagtagttcccaaccgcgggtggagtaaaacccaacaaaaaaatcagtaactaaaagaataaaaaagcttttactgagtcatttaagttatagaagaattcctgaacccaagaattcaaaataacaagttccactttacccagaaaaaaagaaccacttagaatagccaaacatattatatttgtcgagaaatgcaaaatgatatggagatgacctcattatctattttggccaattgtattatttcctggtccggccattgggattgttgtcaaggggctctagccttcggctggttcagtggccccattcgacaaggaagtgcacactgtcgacgtcgaagggcaagaaagagccagactagtgccgaagcccgctccacatggcaaggttacccaggtgcagatagacgatattgaccccaccaaagtcgtatccccgtggggagatctgggcgagcaagaggtgaacaccatcttggctatgctaaaaaagaacattgatatcttcgcttggaagtgggaggcgtttcgcctgacctcatcatgcactacctgtcagtcaagcctgacgcaaagccgaagcagcagaaattgagaaagatgtcagcggattgccaagaggcggcaaaagcggaagtgcaaaagttgctcaaagcaaggtaatctaagaaatcaactacccagactggttggcaaattcggtactggtgaagaagtcgaacggcaagtggcgaatgtgtgtcgatttcacggaccttaataaggtgtgccgaaatgatgacttcccttgcctcggatcgaccaactggtcgattcgactgccggatgtgagctcatgagtttcctggatgcatactccggatatcaccaaattcacatgaacctagcggacatccccaagacagcctttatcacgcctttcaacaaattttgccatctcaggatgcccttcggcctgaggaatgttggggctacattcgccaggccggtatacaaggtcttagtaccacaattggggcgaaacatcgaagcctacattgacgacattgttgtaaaaagtcgcaaggctttcgaccatgcgtcagacctgcaggagacattcgacaacatccatgcggctggcatgaaattgaacccagagaagtgtgtgtttggtgtttgcgcgggtaagttattggattttctggtgtccgaaagggggtcgaagcgaaccctgaaaagatcgatgccattcagtaaatgaagccaccattgatgtggacatcactccttcggatacacacaacaatcctccaacggtcattcaaggactgattgttggcaactttttgtgacaagttgacaaccacgatcgcagcacctaaagctttgcggtgatagtagagtcgccaaccacctcaatctagcaaaagctaaatcaagaagggtttcgataactaaactggctagcggagccgattctagataactacccgtctcgtgggcaaaacggaaggttttcaggacaaacctacaaagagggtctcgcactctcgcagcggcggtggaaaatttacggcgcaaattgacaaagatggacaaactaagagaaaactaaaagcaatatgaaaaacgattcgattgattgattatagattggttgttacaatgaaccagccttatcccttatataggggttggtcttgccctctacaggcccttatccacatctaactcgggatagaatccaaaggaaacccgaaacatgccttcccgagtaaggaaacttcgagacccggcgaaacagtcctggactcggactctgtcggtcaaaccggccacacaccgccggtctgaccggtcttctagcggcggtctgaccagccaacatatggcggtcagaccggccctctctggagaaaaccggcacaacctcaaagtttggcaacttttcctatttcgatcctaggtgccaaatttgggtgtaaacacatgcctccctgcctttttgatgaacaacatgaatctaaaagcatagaacatgttttggtcataggacgataatccaatttccggccatagaaactcctaagcgtcttgcaaaacacttaggaagtatttcttcaagtatttcccgttgattgcccgctgaaaacgctctccttgaagtgtctccaaaaaatatgcgttccctcgaacaatgccgcatactcgataaggaccttcccaactaggagaccactttccgaactctctggatcgagtacccaaaggcaaaattgtcttccaaaccaagtctccaacttgaaacaactttgctctcacccttcgccttcaagcgcttgtcgatgacttcatcaaggttgtctcccatcaatgtcttgtaatcttcacttgataaatcatcttgtttgatataacgaagagagccaagattcgcctcaactggcaaaatggcttcttgaccataaactgactcaaaaggagtgactttagtggtaccatgtttagatatcctatgtgcccacaatgcttcagaaacaacctcatgccacttctttgggtgttcctcaatctgctttcttaccagcttcaacaacgttttattactcgactcggcttgtccattagcctgagcgtagtaaggagaagaactcaacaatttgataccataggattcggcaaaactcttcagttccttagacatgaaagaagctccttgatccatagtcaatgtttgtggaataccgaatctatggataatatgcttcaaaataaagccaattacctccgtatgagtcatgttcttgagcggcacggcttcggcccacatgctgaagtaatctgttgcaactagcacgaacctatgcccctttgatgacgaaggataaatttgaccaataaaatccaaagctcaacctcggaacggccatggtttgataatagggttcaacacggcggcgggcgccaattgaacattgccgaaccgttgacaagcttcgcatcccctataatatttgaagcaatcctcaatcatcctcggccaatagaaccccgctctcccaattaaccaattcatcttatgggccgattgatgagttccacaaatttcttcatgtacctctcctatagccactttagattgatcatcatccaagcacttcaatagaactccatctatatttctgcgatatagatctccatcaagcaatgtatatttgaacgcttgcaaccaaatttttcgatcaaccttaagtgtaagatctttcaaatatttaatcaaaggaaccctccaatcttcttgtatttcctgggtacaaacgtctgaatttacaattaattcggtctttgaatcaattgtggcatgcccccaacttcctgtccagaaacggtcagaccgactatgcaaggccagtcagactgcccggggtggccggtcagaccggcggcatatggccagtcagaccgcccctggtcacaagtcagaccggccatgtaatgccagtcagaccgcacctggtctctgattttgccaatttcgcacaaaggtttaaaatcaagcaccggctcttccaatatcaaaaatactcctcttttcacattatagccagatgcttgttgtgctaagtcatttgctctagaattatcacgcctagcaatatgtctaattgaaaaattatcaaaattggcaataatatccaagcattgatcgagatacctatttattgatccgtccaagcatttataagctccggcaacttgttgcgccaccaattccgaatcaccaaatgcttccacgtgtttagctccaaccattaccatcacttgtaagccaaataataaagcattgtattcggtttgatcatttgtacaataatattccaaacgaactgatgcctcataacacatgccattaggtgaaaataaaactactcctatgccttgaccctctttgcaagaagaaccatcaaaataaatcttccaaggtatgacttcagtaagcaaacctcttcttcataagcaatatccacatgatggtctactataaaatcaactacaatttggcctttcatagatttcaatggttcataagccaaatcatattcaatcaaagcacccatttgccaattctccctcttagaattggcctttacaacatgtgtttaataacatcggcttaacaagcaactatgcatgtactagataacaaataatgccgcaatttggtacaagcctagtatagacataaacaaagtctctataaagacatacctcgtttcagtatccaaaagatggcggctcaaatatgtaatgatatattccttgccatcttcctcttgtgtcaaaacggcatctatgacttagtcttcggaggcaatatataaccgaaatggcattccggctttaggtgctcgtaccacgggtggagtagataaatacttcttcaactcctcaaatgcctcttattgttttgccccccaagtaaaatcgacttcttttttcaaacgaagtataaggacaaaagcatcgatattacccgctaggttagaaataaatcttctcaaataattcaccttacctagcaatttttgaacttccttcttgcatgtcagcgctttgaaatcacgaatcttttctatcttcttaggatcaatctcaactcctctctcatgcaccatgaatcctaagaacttccccaccgatacaccaaaaacacatttaagtggattaatcttcaaactataccggcgcatcctctcaaaagctaatctcaaatcggctatatgtccatcaaacccatcgatttgaccaccaatatcatcaatatagatttttaagataatacctagcaaatcatggaagatcaaattcattgccctttgatatgttgcaccggcgttcttcaatccaaaagtcatgacaacccactcaaatagaccaacaaatcccgggcacctaaaagccgtcttgtacatgttgacggtccttaaatcataatatttgaccgtcaatacctgcatataatgaaataaaatatggtatccaacttagtgtagggtttattactaatcctttccactactgttggtgaaatatgtgtatgcaggtaatttgaggagaaaacacatccgtcatgtgacaaaatgtacctccgcattcaggacgcgtttacacggattagaggaccaataagtcaataaaaactatttagaattgggccaaaacatagcctaggttattcggggcccattaagcaacctcccggctgaaggagaggctgggaggacacattttgggttcggncnaaccccngntcngccgaaccagttctgcggccgttcatcgcaagattacacgtgtacactcctgatcacctgccaatggcggttccgtggcattttggacatttcacataggctgtaaccgtcatacctgcctataaaaggaggagctcactcacattccaacatacacaactttaaactgaattacaagaggctctattgtatcttttgtacattagagtaaggtaaagagtgaggggaagctctggaggagtgcccagaaagtttggcgctctctctgacttctttctcgacgagtgtagcttcctaggaggaattctagaggagtaccggagctgtcggtacactctgctccgggttcggagaaacttcttctataaagtaagcattcgttttcctttcttatgttatttaattacttactctgagtaagttatatttccatctttgcaggttcattgtttagtattcatactaagtgctttagtactcggactctggataaagaaggaagttcttgtataagtattagagtagtaattaataacttagacgtgatgtctaggttagagattacctttgtttgttgtgtatcccacggatttctcaaaggtaggcgataggtggtggcagccctgaattccgtcccagtaatcctccacgttcggatacatcatagagctatagccggaaccacgctggcagaccagcaggggtcggtgcccgaagcaacagatatggaattacattgcttagcgtagataattaaaatacatagaaagtcctctctagcctagcctacctagcatcagttgttgtccttggatagtcttagccttgggtagattacacatgttccctgagttcgatatccttttggggtcacccgaaggtgaagtgctacagcagtattccgtgagcttgcggatttatctgtggtcgtaagaaataccaatagtacatatcctcttccaccataaaaatttgattgtagccggcattaccatccaaaaaactaatcaccttatgacccgaagcatcattaatcatcatgtcggctataggcattggatattcatctttcggagtagctttatttaaatctctaaagtctatgcaaactctaatcttaccgctccaattcttttccaccgggactatactagatacccactccacataatgatatggcctaataaaccccgctttcaatcaaccgatcaatctcctctttgactcggtcatatagcaaaggattgaaacgacgaggtggttgtttataaggcctaaaaccctacttaatcggaagccgatgctcaccaagatcacggctaagacccggcatctcatgatactcccatgcgaagcaatccacatagtccttaagttgcttgattattttaaccttataatcggctctcatatttttgtttacaaaagtcggccttgggtagattttaacctatttctacttcttccaacggattggccgatgtaaacccttgaccaagcttctctacttcatcaaaatcttcaatagtttcaccaatatcgttctttgtagaccgatattcttgcacccttttttgaaaccactctaaattagcttcttcactcattacataaagtaatatggcctagccgtgcttagccggctttatagagataggtacaaatttgtcatcggagatactaatgaaatcataactagaaagattcctccccgataagcattgaatattcccatgacaccactcaaatgttgcatcggccatattgcaacctcgaccaatgtatctgcttgaacaatttcaatatcaccgccgtccctttgaattaagcattgatgcaaggtagaaggcacacaacaattggcatggatccaacaacgacccaaaataacattgtagttaccttgcacatcgacgatgaagaaggcagtgggcaacgtcttgtttcccacggtaagttccaccgaaaagataccctttgcttccgttggttcaccattgaagccattgagaatcatgttggtcttcttcaactcatcatctccacgtcccaacttcttgaacaacgagtatggcatcaaattcacggcagcacctccatccactagcatcctagagactggctacccatcaatatgacctttgagataaagaggcttcatatgatggtttgactcatcgggcttctcagtctttaggatctagtgaaaattgagcaacctcggcttcatccatagcacaaaactccataggcaacatacacaccatgttgatatccatgtcttcctttggagatgaattttctttagcaaccgattgttcttccttttccttttgcacaacaaccggtttttctccatatatggatttatgcctccatacctttgtacgcggtggtcgcaacttgttgaactttctatctctttcctcttcggcctctctctctcttaattcttgggcctgaagatgttgcaaccttctcttttgagtagccgttaaatccttaggcattcaccttggtttcggctctattccaggaggtaaatagtgccctctgttgattttattcgaagatgattgtggggtacatggtacccgggtacccaacgacaagccttgggctgcaccacatggggtgggccaagtgccctatgcccatgcggcacacttgtatacatagtaagagataaaagataaggaagtctatcctatcgcttgtaaatagatggcaggtacctagactataagagataccctgccatgtatggcgccggcagccctagctctatataaagagcgctggcggcaatcctaggggggctgcttagttcatttttccaccccgatacagagaacaacacactggacgtagggtattacctcttcccgtggtcatgaactaggataaacacctgcgtcaccatctctcattgatctagcacaccccaaaaaatatattgccgatagtagaaatcgacaattggtgcgccaggtagggggcgcttgatcgtttcttcaaggaggagatggcctcaacaccgtcgggtttgtcgtttttcctagtggctaatgtagattgatatatgattatgcatgggcattgtcgtggttgcctccacgagcggggccagggtgctcgatggtcaccagcatgactaccggccgatccgttgctgcacgtgcactggtcgtcactgcggccaaaacaccctggagtgctgacgcatgctcgtcatcgatagcgtgaagtctttcaccgacaacacacatgcatgggtggatcctgcatctgtacatgcaggagattgatcttggatcatggagacacatcatcaccattcatgttgcatgaagacacgtcatcaccatgcatgctacagaaccatgcgtccaacaccaagaagagcaaatcgaaccaaataggagcatgcaatacatggcaacatggccagccaatcagagaagaaacaacatcatcgcccgcatctgtctcctccgccggtgcacgcagccaccgtcaacaacagcgatgtccctgacctcaccgccgccgccgccgacaagcgcggcgccatcgtcttccactcctgcatcgtcgtccacaccttgaagattgacgaccactaccagactaaggccgtagtctctgcgccactacaaggaagacggccggctgagtcgtcgccacagccacgcccgccgcaagtccgacggcctcagcctcctcgtcgtcaccgcagtacagcaccgtcttcctcttcgtgtcaattccaagcagcagcaccgtcaaggccaccgtccgcactaccaagtccaacggcctccagctccacatcgtcaccgcccgtcgacaagatcattagcagacgaattcaagtagcaagcatgcaccatggccaagcgatcagacggggacacatcatcaccaagcaacaagcatgcaacatggtcaatgagaggaggtcacatcaccaccatactacaagaccatgaaagcaactctgccctcacccagccacgacaatcaagacacaagaaaccgcgcaacatgccaaaggtcttgccttcaacctccacgctaatcaaccaagccccgagtcaggtctacctgcctgatccagcgccctctccttccgccagctacgcaagcggccagcaaccacccggaagttccgagaggctcacagtacagccgtgcctggaagtgataatctcacgatgatcaaaagttcctggaaacgcccaacccggccaagccagagggactttctttcgtccgccccgtaggtggctggcaaccacctaggagccagcgaaaaagtcagagtacactcgtcacaaccggaagttaatacccagccggccatcccagaggaactctcttttgtccgtcctacaagcggccgtcgaccacttagaagccggcgaaaacgtcaaagttcgctcgtcacgcctggaagacgacaacttctcagtcatcaaccattcctggactcgcccaactcggcaaagctagaaggactctctttcgtccgcttcgtaggtggctggcaaccgcttagaagccggcgaaaaagtcagagtacactcgccacgcccggaagctaataaactcccggccatccaccattcctggacgcccccaaaccggccaagccagaagcattccctttcgtctgcttcgcaggtggctggcaacttcttagaagctggcgaaaaagtcagagtacattatatcgacgaccattatcaaagcacacatgaaaccaccaggtcattcataaatcatcccgcagaaggtccaacaaggaagaaaacacctccgttgcatcagcccgtctacgccgacactcctctacaacatcgttagccgcaccgacgacgatggcgctggtcgcatcttctacagctacatctaccaccgtgtttactctgaccacggcaactacatgatcggctacatcaacgattcggcttccccaacatagacaggaggctccatcatctactacaccgcccgccggagatcctcgtcattcacccggctggtgcacttcaccaacttctccatgggcttagggggcttcaccacccgtaccgcctgggtgccatgccgcacgccgggggcttcgtcctacacccggctggcacgcttcgccgacttcgccatgggctcgggggcttcaccaccctcactgcctgggcgctacgccgcacgctgagagcttcgtccttcacctggctagcacgcttcgccgacttcgccacgggctcgggggcttcaactccctcgccgcctgggcgctactccgcccgccgggaatcttacgcctccacccggctggcacgcttcgccgacctcgctacgggctcaggggcttcacctgcctcaccgcccaggcactacaccgcccgccggggctcttcaccttcacccgactagcacgcttcaccaacctcgccacgggcttaggggcttcacctccctcttcacccatcaggcacgcttcgccgaccttgccacaggattactgcgcccaggggctacgccgcatgttaggggctccgcctacacccggccgaaacgactccgctccgggcgtgactactacgccagggggctacaccgcatgctgtgggctccaatcgcacacggccggcacgactccgccctaggcaagactactatgcccaggggcttcgccgcacctggaatattgccacgggcacaagggcttaaccccaatcgccgcctgggcgctacgccgcccgccggggatcttcgtccttcactcgcttggcacccttcgccgacctacccacgaggtcagggtctacaccgcacgctaggggctccgccttcacctggccggcacgactccgccctgggtgttaatgctacgcccagggggtacgctgcacgccgggggctccgccttcacccggccgacacgactcagccctaggcacgacggctatgcccgggggctacgccgcacactgagggctccgccttcacctggccggcacgagtccgccctaggtgttattgctacgcccggggctacgccgcacgccgagggctccgccttcacccagccgacacgtctcggccttggccatgactgctacgcccgggggctacgccgcatgctaggggctccgccttcacctggccggcacgactccgccctgggcattactgctatgcccggaggctacacctcacgccgggggctctgccttcagccagccgacacgactcggccatgggcacgactactacgcccgggagctgcaccacacgctgggggctccgccttcacccggtcggcacgactccgccccaagcaggactactgcgccggagggctacgccgtatgctgggggctccacctgcacccggccggcacgactccgcccttggtgcgactactacgcccgggggctacgccgcatgctgggggctccgccttcacctagggggtgagcgaagacctcggggtcttgcgcatcgagttcgtcaagtcaactccaccccgcgaagaccctagtcatcccggcatggagtcaggaggctaccctaaatctagactaaagtgaggagaattatgtatccatacaaggatgggttgtgaacttcatcaaaacactagagaattagcccaaaatttcgaagaatggatagaggagaactaggggaagacatgggtgaaaggccaggctaggtgggcccagcccagctacgcccgaaccccctagttcggctgaaccaccagctccaccgttggatgtggggtttgccgtggacagtcctaatcatctcctgatggcggttgcagggcatttccgacaattcgcatagtacaaccgtcatacctacccctatataaagacatcactccctcacttcacacacacactttcaagcttgagctgaattataagaggctctattgtactatattgtatactataataggaagagagtagagtagaagaagatggaagaattccggagttgtctgtaatcttctctcatttcttttattctgtttattactcttaattcaatataatattcttcctgagtaatttagatttatctcatgagaattatctcttggttagttcctaaatagcatgcgggatcattgttcactatagtccatctgtttatagtgattgctttagtgtttgatcaacactagaatagttattaattgcgtagacggtgtctaggtaattaatctcaagtagttgttgcgtatcccacaattcgtttgagataggtgtagaggtggtgacagccctcaagagcacttaagtcctccctgtccggatacgcagtagagtgacatctgggagctgcgggttgccagtgcccgaagtattgcattagattaaagttaagctttccttagacactgtttctcattagtaaatcctctctatcctggcctatcttctgctcgatgtccttggataaaccggaggaagatctgaccacacacgctcccttggatttgataccttttggaatacttcataggggaagtgctacatcggtatatccgtatgcttgcagattttatctgtgaccgtaagaaataccaacaagcatttttggcgccgttgccagggaacggttgctgatcatttccgaatccagttcatcctcgtatctcttttttgatttttattctacctttacccctgctacccagagaagtattcctgctaatttcttctcgaccatggagcaccaacttttcgagccatctgttcctaggggcgaattctatgagccacctccttcgtcggagcccatatatacaactggctatgaaattcgccccaaactaatcagcatggttagggaaagtccttcttctggcttcgatctagaaaatcactaccatcatctgcgagactttgagcaagtctgctcatgccttaagattcgtggcatgtgaccagaaactgtgcggtggaaattgtttccgttctcccttcaagagagagcaaagcaatggtacacatctaccgttggatgtgtaaacggtagctaggaaaaggtgcaagacagattttgtcttgccttcttcccaattactcgtattactgcccttcgagtagaaatatcctcagtttccagcagatcaaaaacaaatcaatcgatgcagcttggtccagattcactaatttagtgcagtccggaccaaccctgtccttacccgagtatgtgctattgcaacatttccagacgggtctggataaggagtctacattctatctcgacataactgccgaaggatcattcatgcacaaaacgccgtcggaaggaagaatatttttggattgcattctagaaaatacttccttcatgatacaatatgatgaactccagccggaggcatccgtgtccaagatagaggaacctctaacaatcgagccacactctgaaccatccttttctgctagctcgattgacgagaaggttcctgagtagccatttgttgagaatgaagaaattcagactccggatcgtgccgcaattctgttcagggactatttcgacgaagactatggcaacaccctgaactatttcagcaagaagaaaccactcgttcctttggcacctcccgatcctatggaacttgggttcctaagggaaactgttcgggagttgacatccataatgagcgacgaatggctaagggaggcagagctttcatccgaagtaattcggataaataccgctcctcgaatcattccttgccatctggaagggaatgacgttggtattctctacagtccaaccgttggggccaatctcgtttctgagtcttgtgcgttcgcttatttaagcgataaggcagtgaccccgacgaacaaattattcaagcatccaaacggaagtatcgttgaaggatttgggattgtgtaagatgtacatgtctactttgaagacagggaggcgatattg

SEQ ID NO: 50457 - DNA, 16486 bp, Oryza sativa
ctagaagatgaagtccccgacttcatcaaggatgaagcggaacccggtgagactcccgatctgccaatcatggaaccgccaccttgacctccgcttgagcttgaacctctacctcagggcctacgctatgctttcctacacaatgatagagaagcccctgtcataatcagtgacaagctctccgaagacgagattcaacgtcttctaactgtgttggaaaagcctcgttctgttcttggctattcctttcaagatctcagagggatcaatcccgcactttgcactcatcgtatccatattgacccttagagtactctctctagggaacctcaacgacggctcaataatgcgatgcgagaaatcgtaaagaaagaggtcttgaaactcctgcatgccaggattatttatcccgtaccatacagtgaatgggttagcccagttcaagttgtgccaaagaagggaggaatgatggtcgttgcaaatgctcaaaatgaacttattctgcaacgaaccgtaaccggatggagaatgtgcattgactacatgaagcttaacaaggctatgaaaaaggatcatttcccactgcccttcattgacgaaatgttggaacggctggcaaatcattcattcttctgtttcctcgatgggtattccgggtatcatcaaattcctatccatccggaggaccagagtaatactacgttcacatgtctgtacaacacctatgcatatcgtaggatgtccttcggactgtgcaacgctcctgcatctttccaaaggtgtatgatgtctattttcttggacatgatcgaggacaatatggaagtcttcatggatgacttctctgtctatggaaagtccttcggtcattgtctacaaaatttagacaaagtcttacaatgatgcaaagagaaggacttggtacttaattaggaaaagtgccatttcatggtccgtgaagggatagttcttggccatcgagtgtctgaacgaggaaacgaagttgattgtgctaaaatcgatgttatagatcagcttccacctcctgtgaacatcaaggggattcgtagtttcttgggacacgccagcttttatagaagcttcattaaggacttttctacaatcgcccggcctctgaccaatttgctggccaaggatgcgccctttgagttcgacgatgtgttgctaaagtcttttgaaatcctcaaaaaggcactcgtctctgctccaatcattcaacctcctgattggactctgcccttcgagatcatgtgtgatgcaagcgatttcgctgttggtgtgttcttgggccaaaccaaggataaaaagcatcatgcaatctgctatgctagcaaaactctaaccggagcttagttgaattatgcaacaactgaaaaagagctgctcgcggttgtttttgctatcgataagtttagatcttacttggtgggagctaaggtaataatttttactgatcatgctgctctgaagtgcctgctcactaagaaagatgctaaaccacgtctcttaagatggattttgctgctccatgaatttgacttagaaattcaggataaaaagggagtagaaaattccgtagcagatcatttgtctacgttgcagatcactgacacgcaggaacaaccaataaatgacttcttgagagatgacatgctgatgacggttcgcgactccaacctgtggtatgccaacatagtaaactacatggtatccaagtatataccactaggggaaaatcaacgaaagctgaagtatgaaagtcgctgtcatatatgggatgagctatacctatacagggtccactccaatggcttactaagaagatgtgtgccgactgaagaaggacttaagatcatagagcaatgccatacctcaccctatggtggccattacggtgcattccgcacccagggcaagatttggcaaagtggcttcttctggctgacaatgcacgaagattcaaaagaatttgtcagaagaagcacaagctgccagaggcaaggaggaatcactgctcgtgatgcaatgcccctcacatacaatttgcaagtcgagatattcgatgtttggggtatagacttcatgggacctttccctaagtcttgcaactgcgagtacattctggtggcagtcgactatgtctccaagtgggttgaggctatgccatgcagcgccacggatgtgaagcatgccaagaagatgttcacagaaatcgttttcccaagatttggtaaccctaggatggtcataagtgacagaggttctcacttcttcgacaagaccttccgagacctcctacgagacatgggagccaagcacaatgtggccactccttaccatcctcagaccaacggtcaagcagaaatattaaacaaacagatcaagaatattctgcaaaagacggtcaacaaaatgggaacaggatggaaggatagattgccggacgctgtcggtgatatgggcccgggggtacccacattagaggtaaagaatccttccatctggccacgtggccgtgtggcctgctccccccccaccccccgcccccacgggggaggtcgagcggtcgtgaagtggccaagggccctcggggtgccccgtcacacccctcaggcccttggcgcgcgccgccccgaggccctcacccggtagccacgtggcgccaagtgagcgaagccagaggcgcctccaagcgccataaatgagcagcgccccaaccgtccctcgccgcacttaatgcggcgagggcaggcgtgcaacgctgcccgattgacgtgcgtcatcggttttgaccagcccgtgactggtcgcaggcggatgggacgagtggcagtgcacccacgccccgccctatgtcaggcggaatgggggcaggtatgccctatcccatcgacacgcagctaaacgtgcgcccccgtccatgaatccacaaaagtctctatggagttaagagggaatgacggggatgtcccccatgtcaggcggagggcggcgccgggacccacctaggggggaacggccaccttgcttccgattgaaggcttgaacagtggcttgacccaggaagtatgggccccccaccaatgatgaaatgtgtaaaggcggtgcatgtggtatccccttggactataaaaggaggatctttcccaccaagaaaaaggacgactcttgatagcttgagctctaggggaaaatgcagttaggttttcccaagagcccaagatcccacgtaagaactcgatcataatcccacacacaagagtagggtattatgctccttagcggcccgaacctgtataatcctcggtttccgacacttgtttgtgaacgatctagttagccagatcccaggaggtggaacgctcttgatcatcgcgccttattccccggccaaactcacaaagggggtctcacgacctcccgctagaaaggattactcctcgacagacgcactgtgggcataccggacagcatacaagacacccattggaatgtccccttatcaaatagtctacgggaagtcatgccaaatccctgtagaactcgagcacagagcatactaggccatcaggaactggaatatggactttgaaggagcaggagaatggagaaaaatgtaaattgatgaacttgaagaatggagggagaaggcttatcacaacgcgaagatatacaaagaaaggacaaagcgctagcatgataaaaggataaaaatcaagaaattcaagccaggagacaaagtattgatgttcaactccagagttatgctttttggccacggaaaattgcgtagtaaatgggaatgaccgttcaacgtcatcgacacctctacacacggggcaatcacactccacgacgactcaggtaatatattcaaggtaaacggtcaacgcttaaagattttccttgagccaaatgaaactttagatgaagaagtggacgttattgaattaatcgattatgaaccataatgttctcatctattgcatgctaaaaaccctgtaaagttgtcatttttgttcttagcttaggatttagtgggtctaggaaaaagttggcagccagtcggacccaccagggttcggccgaaccaaccagggtggcacccgatcagccccaattttgaacatccgtctaccccgctcgtctatagtctgttgtgatgcgcattcggaggtagattagtcatatcaaacccagagcaccttttcttcctcctctctcccacttttgcaaaactcctctccatctcatctcaattcacttattccatcacctccaattcaccaatggttggcaagtccttgatcccatacattggctcctcctccaattccacttacaatcttgatggagagccaacaccggcgaaccaattgatcccggtggagaattacacaatggaaggggtgaatgcactgtgggcgtagccccctgcgaatctggagcccgtcggcgagctcgctggttcggccgaaccctcctcggccccgttcggcagagagatccctctcccctcaccatgttacgaagaccaaaatctgggggtattcacctgcgcgacggccgacaatgggcaaactcggtcttttgaaggagcgacgcctttttcaagacgatgagaatgccgctccgccttccgccgagcgatatgtgggcaccctattcaccaaggcatgggatgaagtgctccacaaatatatcacacccaccgctactccatccactccgaaggaggaccggttttgcattcagggagtgcgaactcccggcggtgggtatggtaagggtttgctccagcctttgatgacatcttagaaggagggggcagcggaatcccatagccctccacctatgaaggtgaagcgtcatttgacgccccctccaattgtaagggcggccggccaattccaagaagacgaagtgaaatcaccggagccctcggtccataagcacgccgcgcaagtgaagaaactccacaaggagaacatagagcttagggtttgcaacgcggaactaggcgtagaacttgctgaacttaggaataatgttgatacccttagtcgcggtttgtgtgctaaaatcaagcgtgcatttgtagaaatggggaaggagaataagtattatgcaaattagatgtctcctctctcataaataaaatagtagaaggtgcttagtttctatttttccaatcatgtaagcgcttgctataaataatatggctcattggtgctaaccccaatgcatgtcgagtttgtttttgttttcgtttaataaagttcaggtttcgaataagtgttggggagatatcccagcttctgacatgcatatactctgaaaattgttgagtctctgaacacctggaaggcactgaactctgcagaaaattgcagagggattgggcaccagagtggttcggccgaaccaccaggttcggtcaaaccagtgttggccccaatccccctcaatttttacaggtaagcaggtgagcacgtctattatctgtatatctccaccacgatatagtactagagctgaaaattcagaaaacaattggttcaagcgtaagtaaaagataaaatttccaactaatgaaattcttcatattgttgatcttgtatattcattattctcagctgaacttgtgcttgtgaacaaccatccatgtttagggaacattatgcatctaagtaattgtttattgttttatgtgagatgattcaagatgaaagaaattcttgcgactcttgttatgactcttgggaatttgttttcgaagtaaaattgttttaaaagctcattcctccaattgacttcattttatacctaccaaggccatatgcaagtgtatctttgataaaccttattatgcatatgactgcttgacattatattgagccttgtcaaatttatgtgactcgtgttagatatctttcatactctcatgatcaaggggtcatttccactttcatttccacatatacatgactaagctaagctcctacactggaagttggcttcccataaaaattccattcaaataaactcctacattagactgtacttacttctcctttaaaaaaaagagtccttgataaaaagaaacatgaaagaagggaggaaaggcatggctataaaaaaaagaaagagaaggaaataaagcttgctctcaaaacattgagcaagattaaaagaaaatatagccatgccccttccatattcatgccgagaaagcaaaatggagaggaagtataggaaaaagggagaatcatttcgttattccaccattccacaaatattctgcttttccattttctaccacaaataaagacccttgatctaggagtacgactgatgatcttcttgagtccatatttttggctttgcaatatatataatgcaggtatgtaacaatttatccctaccaagctccacatatcagccttagaataggggtaagttctagcaaattttgcctttgtgaggatccaaaaagaaaatacacatccttgagagataagagagaaggtcaatatgaggaaaagagctagtttgcgaaaattcataaaaatcccatgagtctgacagagaagcaagaaggactggaatcgggatcgttccatttatcaattgctcaagatggtaagatagccactaatagagttcacaggtgcaggtatggttgtgaatgatttatatgcctcattcataccttgaagaaattcattctacactaacctttactcagggatgagcaaagagctaagtgtggggggttttgttggcggctgttaaatgccaattctatattgccaacatctgcataaagttcaaataataaaacatccaacatagtgataggtgcttaatctcacaaattccacaaatgtttgtgtatatttgtacgcagatgatagacctcgaggttgggaggaaatctagactaaagtgaggagaattatgtatccatacaaggatgggttgtgaatttcatcaaaacaccagaaaattagcccaaaataacaaagaatggatagaggaggaccagaggaagacatgggccaaaggccaggccaggtgggcctagcccatgctcggccgaaccaggggttcggccgaatcaccagctccaccgttggatgtagggtttggcgtggacggtcctgatcatctcctgatggcggttgcagggcatttccgacaattcgcatagtacaaccgtcatacgtacccctatataaagacatcactccctcacttgacacacacactttcaagcttgagctgaattataagaggctctattgtactatattgtatactagaataggaagagagtagagtagaagaagtcagaagaattccggagttgtcggtaatcttctctcatttcttttattctgtttattactctgaattcaatataatattcttcctgagtaatttagaattatctcgtgagatttatctcttcgttagttcctaaatagcatacgggattattgttcactatagtccatttgtttatagtgattgctatgtttgatcgacactagagtagttattaattgcgtagacgcggtgtctgggtaattaatctccagtggctgctgcgtattccacagttcgtttaaggtaggtgtagaggtggtgacaacctccaagagcacttaagtcctccctgtccgggtacgtagtagaccaacatctgggagcagcgggttggcagtgcccgaagtattgcattaggattaaagttaagcttttcttagacactgtttctcactagtaaatcctctctatcctggcctatcttctgcttggtgtccttggatgaatcggaggaagatctgaccacacacgtcccttggattcaataccctttggaatactccgtagaggaagtgcgacatcggtatatccgtgcacttgcggattttatctgtgactgtaagaaatacaaacagtgtgcagtggcgccatgggctgcgatcggaggccgtcgcggacgtggcatgctgggttcccaaccctcaccaatgaacactgccgtaaacatcttgatgaacggctccggtttatctctaaagtacaagtactgcaaaaactctttttaagtcgacgatgcaattgtcaagcagttgtatacaacttgtgcttatgtttcccatattttggttaaaaaaataaaatgttgcgaacctaaatacattgtactaataaatgtctcattcgatttaagttcttatattttgggaccgaggtagtaattaaggtttgatgcacaaataattgtacttgtcctcaatcccacatgcaaccttcatatatcgtacgtcctgtaacacttgtacgtgtacacatgcttcttaatttgttacaggaatttatctttcatggcaaaaggtactgaatcgtctaaccgtaaccatgtgaatcaatcagctgtgtgtatcagaaaaatggtcaaaatacccaacagagtgagctaagaccacatggtatttgattcctagccatcaacatgtgaacctagactaaagcaccactcaatctctgtgattgattcccagcgaaaaaaaaaatctctgtgattgattgatactgccactcagatgacctggatggggatgcgcacagggaacaacatctagcaaaagattcagttgttttcaaatccccgtttaggcctttaacattattcaacagctttacatgaccgttggccaatacaaaccaatgaatgctctcctttgtatttagagaaaatccaaaaaatatcatttacaagcgcacaattacaagaaatatcattgataagtgtgaatttcatgaaataccatcgtacaagcgactttgtcccaaaaatatcgtcgccattaaggctccgttagcaaccctccgttaagtgctacagggaacggtgtatttaacggcatgagatagatggaaccctaacaacgatgacattttaaataaaatcgcttgtacgatggcattttatagacactgttggggaattgatctttaagactggttcgcaaccctttttagtccccattgtgcaactgggacgcacaatccgggacgaaagatgggtatttttagtccgcttgaaataatcgggacttaaaatcgatctttagtactaaagatttttttctttttttctccaaaaagcttgttattgctttatgatttcttatacacaggcgcatatgcatacatatatatatatgcacacatatatatatatatatatatatatatatatatatatatacatatatatatatatatacatatatacatatatatatacatatatatatatatatatatatatatatatatgagagatatgaaatggtcagttattgttgtgcagtaaaaagggtataaacagggtgatttaatggtgggatacaatagtaaaaaaattactcttcataggcggtgaggtggtaagaagatgatagtaaaaaaattactagctgcaacaggtagagaactggggatgagctagatagggggattagacggggtgcctgtgaggtgtgctatgaagatacgtggcaccttagggtgtggtatacatgcaaatatatatatatatatatatatatatatatatatatatatatatatatatatatatgcgctcttcccgatctctccatcccctctccccggcgcatctctctcccttttttttctcgctttttctcctcctcctccccatccccgatctttctcttctttttttttcttttcttcatttttttctctcccatctctcattttttcttctattttctagaaaaaaatataaattaattggtgaattcaagactagaacccataatctcatggtttataacaaactctcctaaccaaatcaccctataacactatgttgtttgagatcattgtttgctttctcaatatatctgttcaaattttgtgaacacaaacccgttatgttactgtagaaaatatacctttgttactatggttcggtagtaacattatcattactatggttcggtagtaacattatcgcagaagtgcagtaacacgatacgttactgcaaatgttataggtcgttattgtgaaatttgtaggtcatcactgcactttttacagtaacatcatgatgaatttgcagtaacagagaacatatggtagtaacggtactactacatgttaacgaccaaatttggtaattcaagtatcagagatgaagataaaaccgaagcgaaatccgagagatagatcgttccggaaacaaagcaagaatcggctgcgaccagggtcgacagagttcgtgtcggacaaggtagccaattgagccgattccgacaatgtgactcggtacacgttgtcgggttgagttatcgtacttcatatggattgccacgcatggattgagtcctgaaaaggcaattgtatctattaattaggatattttatgtaatttccttagagataagtttgggcaaaagtctactgcaaagacttatgatatcttagagtttgttagagataagaaacgtgtccgacaaggacatattttgtatctctggtataaatagaacccaaacccatgtaatcgaacaacaacacgttcaatacaatctcggcgcatcgccatctttttaatttactttcgttttgttttgacgagttcttgttttcgggttgagctgcatcgatttcgatcttcaactacaggtaaaactgttatgacggcttgcgttctcgggattagtgcttccatatttatgacactctaatcttgtttatgtaagttgtcgagttatcatatattctatataatctctgaaaacattgttatttaaccttcagtcggctaacatctgtcactaggaagcagccgattaggttaaataccaacgttgacctagattatatagggtatccaccaccctatgaaacatccaatggcttgattgtctagatattgttattctttccatacttataggtgcatcaattaagtttgaccttataagtcgtgattagaatctcaatctctagcctgctttttggttgaaaattagggtagtatcggggtttcagccgatcttacctgatttaactcctttatgtcttacattcttgattgacatgttaaatccgccctttatgttaagatcttgttgcatttaggtatattaagcttcctatttgatgtattttgcttgctttaatatcttaatatagagtggtatcagagtattagccgatacatgctagatctatctgatcggctatgctatgaatgcttataatctccctattaatgtatatttcgatctaagtgatttatactgtctcggcatggtgaccgatctatcccaatcacttgatttaagtatatatcgacagaggcattatataccattaatatctacagccgatcgaatagatttagttctaccttgtttatttataactgccgatcgattgaaatatgacatcggcttgaagataaatgatatgtcatcggctgctggccgatcggctatcgtttatggatttaaccgtggtttcttttgtctttatttattgttgattgcaggatcaaatcaactggcacactcacgaacctaaaggcaagatttttggacctgcactgaagttaagcagatcttcctggccactgtgtgttttttgcatcaacactacagtaccattgcttgtgcatagctaaatttttaaatcaaaatcttgtgcaaaatacaagtgctaaaaaagtgtatgtgtatggtcacaagttaacgcaagtgctaaaagtacttctatttgtccatacaaaaatacatagtagcaaagcttagtactagtaaacttttagaattctaatctttaaacaataatatctctcacattgcatattattttttagaaccggtttcaccataatgctttaaaaagacattacagcaagacaatagtcctgttactatacgatgatcgagacaaaaatgcttttataacgttgttactgcggaaagtagtcgtgttactgcacattgatcgtcgcgtttcttcgccgttctaaagagatgagaactaaaaaaaagtaaatctcaatctttagaaagcaatatctctcacgttatatagtatttttctaatccgtctgcaccatggtattcgtaaaaaagtgattaacaaaactagatccatcatgactacatttcaattttgttactgcgagaaagttgtcatgttaccgcacgatgactgttaagttactgcagaatttttgcgagacgtgaacaacaaagtgttgggcggggaagggagtcaatgggcgggtttgaccggcgggagggggctttgaccagcctttgactgaggtgggaggggggatttgggccctaagaagggtgggggaggtgggattggcccatgggagagggggtgtagaatagttattctaagggaggggtgtagaatagatttgctatatatatatatatatatatatatatatatatatatatatatataggtaaattaactagtgctacatggagtatgggctccaacaatatccaccgtatatgtgctttgagatttgtgctgctcaaaccagggtattagatatattaacgggttaaacccaattagatctttccatttttagtgtacccgcatgatttgcatacatgcatgtattgcctttccatataaacgtactcacatcgtttccatataagcaaacatgtacgtaataatttccttccgattgcatgattatttatttccatatatgatacatactttcctttttttggcacatgctcacatcgtttccctatgattgtgtgataatttatttccatatttgagatgacactgaatcagatccacaaattttcagtaattccactaattaagttgtaattgatttatttccatcaatactgattaatattttccactttttgtgtacatataaaatggtatgacatttcattttttacacactccactgtccagtccacgctactaccctgccggccggatgtcggcgagcttttcgtctctgccggttgtctgcaaggtttcgttgccgttgtcagtcatctgttagcttcgtcaccgcgccgttacgcaccgtcggtcgttcgcaaggttcgttgtcgccgccgtaggtcgcccgtgaggaggttcgtcgctactgtcatcgacggtcactgcgcgtgtggttcgtgtgtaatttatttcaatttattcttatattttgacaagtccctgttctaccgttttcgcagactgagtactgtaacaatttcatttcgttgtcaagaccttaagatggaaatgtatcctgctaataagtttttggttcatcttcctattgagccaaagactgtacgtacgtatgttgccctgggatcatgtggagaagatggtcgtgggcagaagaaacaccagttggatgcacgcgctaagagctagtgtatcaacacaagtttttttaaactgatgttcttgacagtgtattaacatgaaatttgcacgttgtaatcatgcaaattaatacagaatattttggtactatgtatatacctaccatcctactattccataaatgtcaccacctacttaatctacatcggtagaatatacatagcacacgagacttatatacctaaatctataaatagtttataggtatatacccaactagacttatacttacatctacatgtatctaattgcatctggccaagctacctagttagagtataaaaaaacttaactaaaaggcctagctagcttcaaattcagttcaagaaaaaaaaacctacttgaaaattaaacttttttcatgcgcatttagataggtatataccaaactacaatatgcaatttttaatgggtatatacctagtatgtgtgtttagaccggtatatacccaaatagaatctggtatgtcacacatacccaacatacgtgtttaaatacctaaaaatgtgtatcctaaatggtattatacccaattaaatgtacatatgaaatgcatgcatgtaaatacctagcttgtagtacgtttgaaacgcatgcacgtcacatacccaaaaaattaaaaagcacaacacacgagacttatatacatacatcacatctacatgtacctaattacatctggtcagctacctagcgagagtataaaaaaaacttaactaaaaggcctggctagtttcaaattcagttcaagaaaaaaaatgtaagctacttgaaagtcaaaattttttcacgcccatttagataggtatatacctaactaaaaatgggtatccgaaatatgcaatttttaatgggtatatacctaaatcaattctgtttactggttatattgtacttattttttctccggtatatactgatattttagatagtatatactagatttttcaagtatccaacatatattaaatcgaacggctaggcggcgtgatgcacaactgtaccaaagtttttttcacatattcgtacatcatataattacaaaaaaatgtacttctaatacccagttttttttgccataaaattaacatagactaaaattgaaattttttcattgcatgggattttttttccgtttcataccaaatttttgagtatacgacccattcgtacctaaaaatggaaagtgacccatagtgcatattttgtcactcaaattgctaaattaatggagtcatgaatgtaataatttggtacggatacattaccatataaatttgttgcgatattatccatgtttccaaatacatttgaatataataaattttctgcgatatatataataaatttccaactaatttgtttccatgtttccaaaaaccaacaatcagtatttagtgttacatacttagtttccattttcacatatacttactttccatttttccaaaaaattaatttgtttttccatatacttagtttccatttttcacaataatgttaccatttattcagaccccaacgtgaagcaagtaagtttccatatttacaagatattatttccaatttcacgggtatttaatgtttccatttttgaaatgtacacgcaattatggaaattctctcatccgcattgcatgcatataaatgcatttattccttttttttactgtctattcaaatatgtggattccattcattattaaatactatactctaaacgggtgtatacccattaagctatgtacccaaatgatcaaaaccgatcagtaagcatcctacggctcctaacgttggagcccatactccatggagccccatccgtgcgtcctatatctatatatatagagagagacacacacactgaaaagttgggtaacataaaataaaaaatttactcggactaggagtgggggaggtggcacatggtgggatcgagattggtcgtcggcgagttaacttttaactatatatagaactcctaagaagttggataacatcaagtaaaaaaattacatgggagtggaggagggggcacatgggtgggatcgagattggttgtcggtgagttaaattttaactacatatagaactaataagaagttggataacattaagtaaaaatttactcggactatgggagtgggggaagggggcgcaggggtgggattgagattggtcgtcagtgagttaaattttaattgcatactatggacctggtggggagcatatatatatatatatatatatatatatatatcgggatggctatatatctgttgacagatttttttttatagctgaatcattcgctttttaggccgttgatctttctttgagattggtgcaatcctagattagtatcatctagtttgttccgtccgtgggttactggctctttgggctttatgtggtctcacatttactgttcaattttgtgatactactagccaccgacagggagagtgtttgggattttttttgtgcagaattgctatatctttgtcgataattttttcccaaaaatctgtcacttttctattcattcgatttgatgctaagattcggttttgtatgtcctgtgcctgcatggaattggaatccaatgtctggtcattaacgtgttcacaccataagacccttttgttactctttttacccttatttaacgtgaagttcgctgacagaatatcggatgatcccacacgtacaaattacatcatacttacactataattacatatatatatatatatatatatatatatatatatatatataattttagtgtatttacgatgtaagtctgaaatccacttgagcccatttgagcccacgtgagcatcatattgtccatgtggcccgtttgtttgttttttttattttgtttgtgtatattaatgtcatccgttagatgttgattcaaaggataagaaatctgcatgatatgaggc
